United States Patent 9,487,797 (GENOMIC PLANT SEQUENCES AND USES THEREOF) - sequence listing, part 8

SEQ ID NO: 15409 - DNA, 1501 bp, Oryza sativa
acggtctacggcgcatgaaggctggccggcggggggtgccggtgtagtggtcccacatgtcggcagaggttggacagtgtggagcatcggggcgccagccatggactcgcaggtggtgagcggcgggtgaaaacccagcccagcctcggccgggccggcaacagtgacgctcaaagcgtcattccccttctgggggcgttatcatgccgtctcatccctcgtgtgtggacgttgggtaaaagtcgagtctcggttctctttgagaccttgacggacgacgacggcagtgttttcgtcgcttctctccttggagacgtcgtttaggtatcccttagccgaaaccccccatccaattggtgcaaactctctctagatttcttcctcctgtggcggcgccctagtctctacaaattggccacgtcggagggcctagaaggacaggagttccattcttctctctcaccctctctccctgactcctgaagacttggatagagcggggctttgtgttgattgtaagggttgggttttgggggatctcagctgtgtttctttgtttgcctagaggcggtcggtcacgcttagcggctgctggcccggtgctagccttttcttggttctgtgttggcactgttgatgtgtggatggtggtatatttttttcctttttcctggttacgaccttccagggttgtaatcttgtaatttttctcctgctctatcaatagaacctcgcacagtcttgtgtgagtcgttcaaaaaaaaaaaagagctcctagtcctgattaggaagacaagaggtgtatgcttcatgcatggctgtatactgaatcctagacatggatacaaagccatccatcaataaatgtagcctcaccattttttttcatatacatatatattattaaatatcaaatgtgggggaaaataataattaatccacacattttttgtaggccaagtaacatggtttgcgtggttctttctgacagtgtaggcctccaagtcgccttctcaccagcactttatctcctgttgttctgagcttctcccacttgcaaggggcaatacacgagtagcagaacatacactacacatcactcctcagtatggcctgtccctctcttccatctctaagagttcctcttcccaattcatgtttctggcatgtgactgccattggggccatattgtagtgtggcccctgttggtcagagccttgagctaggtgacacacttgttgtaaacgggaaggtcactctccctcttgcctgatctcatcaggttcctctatttgcagctagtagtagtctatttaacacgccagtagccacccatttctttctcccgtgcggctgtcttgtgtttctcaaactttgtcttacgccagccaaccgtaaacagacactgtctgcgcgtctctcttgcaagaacagctagctctcccatacatctctcctacgttggctgagatcgattgctgccacctacattggccgata

SEQ ID NO: 15410 - DNA, 1501 bp, Oryza sativa
ctctgtgaagtgtcaaattatcaaatccctcctcctattcgttgtgttgtaagaccagtttaaaacaattgatgaagtggagaattaccaaattccccctaatctctgtctccccctccctcacggcctcacctcttctccctccaaattctccatccccggatccccctctcctcctcctcctccgccgctcgtcggagccggaggcgcggcggccttctcccgcgcccttcgtctcctcacacccgcggcggccggcgagaaggcccagaggcaaaggcgtgaagcggcctcctcccccggcgcggcaccctcggacgcacggcggccggtgagcaggagcaggttcggagggggcgacgcggccgggctccttccaccggccagcatcctggctcgagtcgaattttgaaggtattgattactctcgtagcctccctccctccacctctccgcgatttcatgagccagtgtagattggggttgcagatcccctggagtttgacctccaaatccaccggggtggatttcagctgatgatttctatggatggcggattaagcaagtcactttgttccccatctactcggggtggccacatcatttcaatcctatactgctttgcgacatgtcaatctgtatcttattagctttcctgggctatcagtagttgacaaccagaacttgattggagaagaaacatcttgtgtgaaatacatatgacactgggaacatcatcatatgatagttatgtattacttacttttcagaaacttggggcaccagtatttaccgcaattgattgaatactagtactcccgacggcaaatataaggaaagggtgggagtatattattagcagatcaacagcgaaaattataaaatacggcacaagcattatgccataacttaaattattcattgtcttgtcagttatgaatgtatagctcattatgtgtgggattagggaagaagagggtgacatgggcaaatggctacatctaacgcctaaaaaagaagtaatggtccagatttgcgtaggtggatttggaaccaactctaggggatctgcacctgtagattggagatccatccggactttgctggagaaaattttagagttgagcaccctttaggtctgcacctgtttctagatgttcaattcattggaaattgatgacccaactgatgggcaaacacatttgtgaattgaaaaaaagattgcatgagtactgattaggagctatgttaaaactcagcaatacagtctgaattaaggttgtttgtgtgatcattcggacacaaatgatgtgcatgatgccatgacaacctgttccttctgcaatctaatttccttctaggactagataactaaagccatagtttccatgtgaaactgttatttattgtataatgctaaatggtaagattttcgtattgataggaagcatgaaggttgatgatggtcctggcgtcaatggcagtaggtgggccaaaatga

SEQ ID NO: 15411 - DNA, 323 bp, Oryza sativa
gcatgctgccgtgcgcgtgagagagagaggggaagagtgagacaggtagtgagagagataatagagaggaatagtggaagacgatatgataggtgggtcctacatttttttataaatagaatactaactagagtgccacgcgtacgccacatagaccaaaactaccgcggattgggtcgaggggggtaattcgtccggtttgcatagttagggttgaagaatatccggttttgtggtttagggggtaattcagacgaccgtgatatttcagtggtggtaccttctatctagacattgacaaaaaattgtgttcacgcacaaca

SEQ ID NO: 15412 - DNA, 1501 bp, Oryza sativa
tttctttttttctgaaatcaaagtttagtaatataaacttcatgcatatgaattttcgaaccaaataaagatgtatcttgtatttctaacaggaattttggaacaaaaaaaagtgttttaaaatcagaccacctagggacttgtggtagaaattaactttaaggtatagccaattagtaccaataactaaaattcagcattataatttaattaaaatataggatcacagtcgcatatagagacgcaagaggcattttaaacatattcatctcatgcatgatacgaagaaaatataagtttttgggtcctaattacatcatgacaaaattgcagtttttttaggtttttttttatcgtacacacgtacgttctttgtttgtttttttaatttacagtacctaaatattcatatacgtatgtaagtactttcatacgtacacatatgtaagtatttccatagtacgtaattattttgatgtatatagtatttccggtaaattgctcggatatagaaagcataaactttttaaatagatctaatccgacggtgtaaaataatgggtccaccaatttaaatgaaaatagatggtgggattgtagaatgccacatggcggtctaggaacgcttgtagaagcgccacgtggcggcttcggaacgtttataggatgcttaatggacttttagtatataatagatagatagatattacctaatacctaacacataacttttcgaaacctttgcaaacaagactatgcgtcaccggaggaaccaccttactttgatgcatgaccatggacaatgcttttttttttggacaaattagataacccctatagaagatgtgggatttaccccatgagcccatgacacaaacttatttcaatcatctagcctgtgtttgcaagatatatgacaataaagagatgttcgtgacaaggtcttccaaagccaatacagggttacccatgacacctgaaaagtcctcgaaccaagccattggatgggcatttgccaagccatgcaattatcagcatctcaataagcccaatcccatcacccaaagatccatgatttcctgctctcgaggcttcactgagagccaagggtgtcccataatacctatggtcacaaattagctatgcatggcactctatttgtaggtgcatacaaataggtttttctttgcaccacgtgttgagttctaaatgactttacaagcccacttttcccatagaaaaattacaaaggtgtttcatgttttgctgatacttatactcgaaaggcacagatatcaaggctttcctattatgttacaccaatcacatttagtcatttgttcctctcttttaatatatgcagaatgaagtgttgatgcttttattcaaagttgatccccaaagtgcaatgtccgtttatattcttcataagatggccaaggacaaattaaataaattatcaatgaaagatgctaagtcactgactcagacatatacgagc

SEQ ID NO: 15413 - DNA, 1501 bp, Oryza sativa
aaagtttatgctttctatatccgagcaatttaccggaaatactatatacatcaaaataattacgtactatggaaatacttacatatgtgtacgtatgaaagtacttacatacgtatatgaatatttaggtactgtaaattaaaaaaacaaacaaagaacgtacgtgtgtacgataaaaaaaaacctaaaaaaactgcaattttgtcatgatgtaattaggacccaaaaacttatattttcttcgtatcatgcatgagatgaatatgtttaaaatgcctcttgcgtctctatatgcgactgtgatcctatattttaattaaattataatgctgaattttagttattggtactaattggctataccttaaagttaatttctaccacaagtccctaggtggtctgattttaaaacacttttttttgttccaaaattcctgttagaaatacaagatacatctttatttggttcgaaaattcatatgcatgaagtttatattactaaactttgatttcagaaaaaaagaaagtgagttcaaatagatcatcttgttttatgtgtttctgtttgtgatgtgtagataataacactcctattattgagttgttagtggcactatagttacattcggtggttactgaaaatctgttctaaatatcattgtccagcatctctattatgttttctcgatgattctgacattttgagctaataaaataagaaatatcgctaagtacagttctttgaatagttcagattaaactggttcttttgtttaggaacttttgagatcaatccaaatatcagactgggagcacttgctaattctaatcacattgtctgttcagttctcacctgacactacgcttttcttcttggttaaactaatctgtcctctacttttgttcccttattagttattacacatgcaagcaactgcagcagcaagagtaagagccgattatccgggcaaaagctatagaagacaagggagcttgcaggaagacaagaaaaaatgctacatgagaggacaaggtttgagagagcaacattattggtcccatcgtttcgattatttgtggaataagccaaatggtatatttgcaaacgaaaaataatttgcgaataaaatttttatatatgtgttactagcgatctaaaaataaaggataaaaactaaacttcgataataaaaccctaaaatcagctccaactttaaggttgaaaatttaaattttggttgataagctaagtataagtgaaaattcaattttttttccagaattctcatagcttgaagaattgcaatgagggaatgaatgagcaagtggaaaatgaggtctgttgttttatgatgttgttagccttttcaaaatgtgatcaaacgtatcacttagttacaatatctgtcacatgtgattcagttcctttggcttaatttcagctgttgtatatatgttcattttctccaacaatctcccaaatattatctttgcagtgaat

SEQ ID NO: 15414 - DNA, 1501 bp, Oryza sativa
ttaccccacccatagtgccccagacgatggcattgggtggacgcagtgcaaagggcccagtggggtccggcagcagcggagatgcaaaggagataatggatgaggaagttggtgtggcgaaggctgaggtcgatcagtggtgggaatgctacctccagtaatggcttatagcacatgttgatttgaatgtctacgacagggtacgacaaggtagcctcgagacaacaacatgcttctcatcaacatggagggaagagggagggagaaagtgtcgcctggtcacctccattgtcacactagccactggccagctctcccacaccaccaatgccaggggcgagctttagcacagccaccgcttcacctccaccaccgcactaccctagcttcgcccaacagccaccgtcaacgcctcctctccgtcaacataagagagagagagaagaggagagtagccatgtggggaggaggaatagtacatggggcctaccgtttggcaagttattttgggttgccaagttaggccaataaggggagggatttggccatccggttggaaaggttattggggtagtatctttttactagaattgtcaaaaaaaaatagtttgagagccatttggagaggatgttgcctgttagagatgctcttaggacatcaaattccataaaaacatcagaaaaattctctcgatgaagatttataaccactaaaactgccctcaattcgaagggagttcaaaacaattaaaatcatgttcgaattgagtttcaatttcactttaacccctttgaaatctcaatggtaaaacatcaacccgtcaggtagcatggttctttttattcctttcaaaaagagttaattacaaacagaatcaaaactaacagttaggcccaaggcccatccgagcaaacaatagatcatgggccaggcctgccaccaccctccccctcctggctcccgctcttgaatttcaaaatccaaaaatatcggcacgactggccgccgacggagcgggcggaaaatgacggaacaacccctcgaattctaccccaactacgcccaccaacccacacgccactgacaatccggtcccacccttgtgggcccacctacaagcgagacgtcagtcgctcgcagcaaccagtgggcccacctcccagtgagcggcgggtagatctggactcttacccacccacactaaacaaaacggcatgaatattttgcactaaaaccctcagaaaaattccgatattccaaaccagtacagttcctgaccgttggaggagccaaagtggagcggagtgtaaaattgggaaacttaatcgagggggttaaacgcaaaaacgccgaggcgcctcccgctctatagaaaggggaggagtgggaggtggaaaccctaccacaccgcagagaaaggcgtcttcgtactcgcctctctccgcgccctcctccgccgccgctcgccgccgttcgtctccgccgccaccgccgccgcca

SEQ ID NO: 15415 - DNA, 1501 bp, Oryza sativa
tagcggctactgtggtgctgctccgcgcgccgccatggcgcctactgacggcttcgcgcagccgctccgcctgcagcctgccggcttccgcgcctgcggccgcctttgtttgctcttactcgccaccagacagctagctacggcgctgcagctcgaggcctcgagctcttgcgacttgcgtcggcgtcggctgctccagccgccaccagttgccagcgacagctcccaccctaaacacccccaaccctatccccacctgacctgtgtgagtgtgaagtgtgggaagtgggccactggactgggccattactatcgaattgggacaacctgttagaataattgggctaggcccaatttataataattaaatctcaaagacccataataaatgttgaggataataataccacctcagaatttaagcgagaaatatctcaacctaaatagggagttattagaggctccctgttgaccagttgaggtgggggtcggaatgccacgcgcgcgcgcgccgggccgtgggcgaggcgtggcgtggctggcggcgtgcgtcacgtcacaatccttttgcagccactaacccacgttcccacgattccctccacaaccgcgcttccacgttctttctcctgatagtcacgacgcaatccttttgcagccactaacccacgttctcacgattccctccgcaacagcgcgtccacgttctttctcctgatagataaggaggccgcgagtccgatccgacttcttagcttttttcccggtgttagtttctccttctccgcgcctgagttgctctcgcttccccgcttctgatctcttgcgcgcacgagagattggaagaagcagtggctccgaaaccacacctttgcctgagatctgcaccgggtaggcgggagatcaggtttttggggagtgcctcctgcacgactgctcatcgccatgtctggagttgctgctgccgccgctaccggcggaggtggtacgccgccgccgacaggagctggtgcgccgccgccgacaggagctggtgcgccaggaggaggtgccgtgaacgactacaacaacggaggcaattctgcctcaccatccagcggagggccattctcggggtataatcttctcctcctgctactgctgttagcgctattcctgttcccattgttagcgctatactgtgtgcgctatgttcttgttcctattctacgtgatgcctctagcatgttatcgcgttactggtatgttcctgtttctgacattcatgatgcgcatagtatgctactggttatgttaagattaccctacactgcttatgccatgatcattgtttcaatttcttggattaaaatatgccgaataatgactatatttccaacaatccaaaaacctgataggtcattttcggtagttggctttgctgctgcactgaaaccacatgcttttgatggttcaaactataagagatggaaagcacgtgcactattgtggttgacagcga

SEQ ID NO: 15416 - DNA, 1501 bp, Oryza sativa
gaaggcgacggcgaaggcccacggcgaccggcggtgggatggaaagatcggggattcggaggaaagaggctgatccgaatcgaactcgaatccacgaatttccaaacgattttagccgatgattccaaaagagaaaaggaagaggagatctcaaggatcatttcccctctaaagattcggccggagaagtaaaggatcggccgaatttggaaggagacggcggcggctcgcgctagggtttcaggcggcggcggcggcgcgaggaggacgacgaccctgacaagtgggacccacctgtcagcggctgagagagagaggagagcggcggctcggcggactgggccgacttgggctgactttcggcccaaagccaaaagagacttttaaaaacctttttcaatttaaattattcatgaaatacaattccatttattaaaaatacttccttagctcaaataaatcccagaaaaatctaggaattatagaattaagcaaagtatttaacaaaattttatctagcccaattttatattgagatttaacaaattaaaattagatcttctcttttaggcttttaaaatcatttctaacaattccttttaaacaacaatttataatttaaggatttttaaacaagaaaagctcttaacaaaaataattagatcattaatgatcaaataattactgaactgttctttgtatcatttaggaattgagctccgaaaaatccgagaaaatttcagagagttgacttaatcatggagaatttaataaaaattaaatccatccatgctttatatttaggaaattttatttcccacatttaacttttcttgtaaattaaagaacatttaatataaattctattaataatttattaaataatttataaatcctaaaacgaaaaaatcaggatgtgacagatctaccccccttacaaagaatctcgtcccgagattcggaacggctagaaagaaaaaggcataggtaaactgcagtctatcttattccataactccgataattattctaaggctttatagaaaactactgccgctttgaaactagtggctgagctgtaacacttgaagatgcaactcttgaagacacaactggtactgcattggctcctgtgacgacaatgttgttgacctgaccttgcggctgctgatgcttcggcttcggacactctcttgcaaagtggcctggcttgtaacagttgaaacatacctgctgctcccttctactactgttattctcccgagactgatcctgctgaactggcatcggctgatttatttgctcgatgttaacttcattgctttcattagtctctgatttgatctcaccagcgatattcaactgttgcgactgtccttgaccagcggaagaagattcaccaatttggagtggcttgatacgctgcctctggctactaccttgtgcctcctggaatacaatcattttccttttacggttatccatcctgttcttcttgtct

SEQ ID NO: 15417 - DNA, 1501 bp, Oryza sativa
agagagagaggagagcggcggctcggcggactgggccgacttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatattgagatttaacaaattaaaattagatcttctcttttaggcttttaaaatcatttctaacaattccttttaaacaacaatttataatttaagcatttttaaacaagaaaagctcttaacaaaaataattagatcattaatgatcaaataattactgaactgttctttgtatcatttaggaattgagctccgaaaaatccgagaaaatttcagagagttgacttaatcatggagaatttaataaaaattaaatccatccatgctttatatttaggaaattttatttcccacatttaacttttcttgtaaattaaagaacatttaatataaattctattaataatttattaaataatttataaatcctaaaacgaaaaaatcaggatgtgacatcggtctgatgatttaagactacgcctgcagacttatgttgtaataattcgcactagactctcgtgtatgtgcatttggtatctcggctatgaactcgtgtgtaccagactacttgatccagggaaatggtactgtttacacgattgattcctgttataaaaacgggggtctacagagcccgatgacattaaaaaataaatgcacagttgaaataaatagagaatttaaatataggatcagcatgctcaaaggaactgtgtttgggatctgtgtgacttgccttgcaataacgggtcttcaattaatcttcttgaatacttccggcgcactcgcgaaccttcgaaacgacggaaacgacaagctaaaacgcaaaacaaggaaaaagactaagaaactccaaataaacaatacatataaagtaaacaaatgtgtagatcatgattttagatgaattatgagacttgaacgggctcattctgacttcatatgaaataattacgaattttacaagatttaatctaattaaagcctatttaaaaaggattaaataaatttaattcaatttatggataattttaatatgtagatctttattttatacaactttagagacttgaaccaactaaaaccgagctaatatgaattagttatgaatttttaaagattaaaccggattaaaacatttatatggattttaattgaattatgacgcaataaagaattatttttgaaacggaaaagggaattattgcgtcagtgggctcggctcacggtggaccgagtgcacggcgatggtctacggaacgggcggccgagatctatcctatccaaaacggacggccgagatcaactcggtctaccgtggtctacggcggacggcgtcga

SEQ ID NO: 15418 - DNA, 1501 bp, Oryza sativa
ccggatgcaggccaagcacggcggtgccgcgcaccagggacgaccgctccgcgagcagctgtacgcgtcccccgggaaccgcttcaactacgacgacttcatcatgagagacgacgaggccacgaacgccgaggccgacaaggcgatggcgctcgtagcgagggagacgccgacgagcgagatgacgctggagcagctcctcgcgaaggcacaactcctcgtgtagtaggacaactttctttaaggatggccgcttttcactaaccacccgattaatccattacttagttaattactgtggttgcaatattaaaaattggagttaaaactaaatttagccgtgattgaatttggcttgcagctggcgccgcattgtcttttgctgccagtggcgatggtggtggtggttcttgctcttgagaagaagctgctggtggtggtgcttggaggagcacttgtagaagccggaggggtcggaggacatcaggcttctcgaggagaaggcatccgtgccgtcgtcgtcggagatggtgaagccataggggttggacgacagcttcggcttcttcccaccattgaaatgcccatgagaccgtgacggtgggagcaatgccggttatgctcttcttcttctctggaggaagcgggtggcggaggaggtcaagcgtcttagagaagggtcgacgcgggggaggaaggcggcggcggtgacggtggaggacgtcgttgtcgtcgaccccgccgcgtgtgcctcccgccgccgccgcccgccgtcctcctgcttgaacgcctggtcgccgtcggcgaggaggcggtggagctcagcccgggcgccgccgccactcccacgtctcccccgctcgccaccgtctccgcccgttgcgggagagagagagagagggagcggcgaggagggagaaggaactggagggaggggagagagaagggacacgtgggtcccataatttttttccgtgtcaatgacaaatgggtcccacacatatttttttaattctaaatgccacctaaacgccacgtgtaaagaagacccgatcaatactgccatgtagacgccacgtcagcaaaaccactctccaaaaccgtcaagggagtcaaattgcaccggttttaagagtttgggggtcgagatacccggttttgtggttttgggtcacggattaaatttcgatcacttttgagggtcactaagtgaacttattcctttccacgcggcacacggccgggtgcatgcggaagggccgagagcttgctactcctccatcctcctataaaaaacaatcaacaaaaatagtacggatcgtgatgtattctaatagtataaatttgaataaatatctatctaaatttatagtgctataatatatcacatctcatatttttttatagacgaagggagtagctggcaccattaataacccaacattttcatgctacacatacataaacgacatagtagcacacatatataaaaacgcggata

SEQ ID NO: 15419 - DNA, 1501 bp, Oryza sativa
ctgctgccgtcgctcgccgtgtgctcaccgcccgagctcagaagcgccactcgtcgccggcctccctcgatgcgattcctcctaatccggcgcaaggggtgggttcccgtagccgcgtagatgctctcgccgccgggaatcggcccctcgtgacctcatcgccgtttcccccttctcccgccgccggttgccgccgccgcaatccgccgccgtcgagcatcccccggcgaatccgagccattggctcgtctcccctcgtcctgtgcaacatcccggtgtgctcgccttcgcctgtatcgccatggttcgctccgccgctcgccgctgtcgtccgccgtccgttccggccggcgtcgtcgtctacctcccgccggctcgcgtggcagccacgtaggcgccacgtcggcgccacctcggccgcgaccgggtcaagcagaccccggtccgccgcttccctccgcccctcgcgcgcgcggtccaccgcgagccgtgaggctgcgcgtgggcccgtcgcaccacgtcctccgcgaaacgcgcgcatgcgccgcgcctccctccccaaaccctagcacgccccgcgtgcacctcgctcacggtgagccgagtcgctgacaagcgggtcccacccgggaccacgcgggatggacccggcccaccggctctctctctcccctccccgcccgcgcgcgcgccttgggccgccttcttgggccggccggcccattaagctcggccgagccgcccctttctctcgggccgcgccctagccgcccgagggaagtctaatttccctccctccttcttttctttttcaaaaaggatttaaataaatccttttcctttagaccaaaaatccaataatcttagaaattcaatatcttcccaaccgtaagtccgtttgactccgttcaacttccaaaattcctcaaatctcgagatctatcgaatggcacgcttagaggtcaataatagggctttatttttgccgtttgctgagctgtcccgtttcgcgtgtagtttcggagcccgaagacccgcagtgcgaggatttcgaggatcaagctcaagatctcgagcgaggcaagccacctttgaacatcttgagcctatatttgaacttaattatgttgcttgaaaaatattatgcattgataggatcgcacttaatctgcttgtcccgtctgcaaggcagattggcggacctacctaatttgttgcatttgaccattccattgtaattgttataccatgttcccttgtacccacctagttgcgcctcggtaatcgtgcactctgcacgggtatcgacggtcgccttcaaacttaaaatctgagaaacatcttgggtaaaacttgcgttttacaaaagacttggaaaatccgacacctgggtcggtgcttgcgaactaaatgaatttccaaaaccgcggaccggggaacgtaccgggtgtacggtttcccgctcttgcacctaaggactgtttccttggaatttcatccg

SEQ ID NO: 15420 - DNA, 1501 bp, Oryza sativa
ttttatgtttttccagcggtctacccaaacaatcatactatatatatatatatatatatatatatatatatatatatatatatatatgcaattatatgttttatcaactacatacgtttaaaaaaatctctaatagtggattggtaacatactaaaacttgttcgattaatcccacccgcaagagaaataaggaggatttgaagggctgttgtggaattatttcccccatatttatggtgtaaaattatttttcctcagtctcctttaaatccttcctcttaggaattaacgaaagtatcacgtcttttttagatgggataaaagcaggtgcatgcgtgcatttttagcgtgcgcgcttacatgctgcgtacatttgaaaagaaaaatgatatgagttttgagatataatgataaacagccagtataacatcatttaaaagttttttgggataacatttcaaagagttaaaaaaacacttaggccatatttggataatgggtttgggatatgattttcaacccctcaaaaggtaagtttcaatcttgggcttattcggtttgtaggattttcaaaccgtaggaatacagaaaacgtgtaatataggaatgcatgtgcaaacctatggattagaaaacataggaaatttttatatggttgggttgcaaacagtccaaaaggattaaaaacattgggttagagtggattatttttttcctttgttttccccctaaaagtggagggataggaatttttcctttcatgcattcctttaaaacgaatgatagtatagtgctcattccaaaggattgaatattcctgtaatttccctttacaaatcctctaaaacgaataagctagccatttattctactcactcatttcatcatattcctccactcatttctatttctcaatcccagctctcctaatccattattcaaacacatcattatagataaagcgttccggtatagtattagagaaaagaaaaagggtgatttttgagagatgtaataatgataaacatatgaagtaacattacaaagagttaatgcgttccgatccggttctttcttaggatggcaagcagttcagtggatcacattacacgtcgccctgatttctcaatcaacagccgttcattcacccaccgaacaatcaccagccgttcgatcgcgttcctgacgtccacggtcaaactcaaaaacagaaaaaatcaccgcgggcgtgcgggtttaatttatctccctcttacgccaacgacgatcgaacagagataagatcgatctaaccaccctaacaaaccgtagatgcaaccgtaataacagcctaaccccaaggaatgcgagatttatccgcccctgcaatgcgctataaatttacttcgaactcacggtgaaaaagtaattagcatcacctccctccttgcttatcaacacgtacgttgcgtttcttggcaatgcgtgctgcaccgacgacgatgtggcgttcgccggcgg

SEQ ID NO: 15421 - DNA, 1501 bp, Oryza sativa
gagctcgattagtttttcaaatgatctgtcaaaaaatatacaaaatccaagaaaatattagatgaactgattgaaacatagaacaaaaatggaattgaaacagtgtttgcatccagcgggtcataatgtctcatgtgttagtgatttttccaatcatatcttcgtcttttatattgcgtatctttttttttaagagctcggttagttttttaaatgatttgtcaaacaactgacaaaatccaaaaaaatattagatgaaacatgattggaattgaaacatattttgtagcaagcacacaaacacgacgcacaccaactaaatcggaacagcgtctgcaacggttgcaacaagcacacaaacactacccgcacacgcacaccaactaaatccaactagagtgaaaagcgtttgcaacaagcacacgaacacgatgcacaccaactaaatcggaacagcgtctgcaatggttgcaacaagcacacaaacacttcccgcacacgcaagggagatggattctaatagctcgattgaacatccatccgtttattgcatgtcaagtagatggttacgaaaaattttcaaaaaaattgacaagatagattaatatgtaatatatcactccacaaacaaacaagttcaaattcaacttctacaagttgtaacaaaaataacaaatttaattgtaaaaatacatatagtaatttgagttttgtttgttatttttgttacaagttgtagaagttgaattttaacttccatgtttgtggttgtaatatatctatcttagttcatattttttcaatttttttataactatttagatgacatgcaataaatgggtggacgtccactcgagcaagagaagcgatgagcagcagaacgttgaggagaaacacacgcacacatcatcatgagactacgatgagcagcacaaacacacgcaccgacgcacgtatgaacgcaaacaacgcacgcacgaacgcacacaacgcgcgaacacaagcacgctacgataagttgagaagaaacacacgcacgctacgataaggagaaacacacgcacacatcatcatgagactacgatgagcaacacaaacacacgcaccgacgcacgtatgaacgcaaacaacgcacgcacgaacgcacacaacacgcgcgaacgcaagcaagaagaagatgaacacaacgcagatgaatgaacacaatgcagatgaacaacacaacgcacaaaaagaacacaacacatataaacgcacactagcagatgagtaagggaagcgagaagcagagcgagcgcacacgacttaccctctcgattttgcgagaacattctccacaaccgacgccgtggcccgtgccgacacgaccactgtggcccgcgccgccgccattggaggagagggaaggaaagggagggggggtttatagttggaggaggaaatatttaagatgcgtagcgaataatgtagaaaaaaaatggtacgagaatcactcaccaat

SEQ ID NO: 15422 - DNA, 1501 bp, Oryza sativa
actgcgaccggtcacggaccggacgagcgcacgctgcgccgtattaaatgcggcgtggcgcgctcgtccaacccgcaataaatgcggttaggtgagcgccactgtgctcacctaacccacacacgtggcgccaataccacaggggtcggggcgccccagccctcgaggccgaaacgggagcggcccgacccctcggggagacagagggaggggtggccacgtcaccctcgggcccgacccccccgagggggtccggccacgtgggtgaccgcggctgcccaagcctctagtcacgatacccccggtcccatgtcaccgacaaacaattttttaaaatatattataagctatttattcagtttattataatatacaatactcttatatcacagaatgtaactggtcagatttgttcagatttgtagtaatatcaggatagatggatatttattcatccttaacattaagaacatcagtttggcccatcaattatatgaaaagaacactgcatgcattagcttcggtgggacatgactatctaaggtgcgtatcagagcaatcaagcagagaggtggcatatcagctaccgcacggtacttaatgaaagttgttggtgctatagctattaatacaacgacgatagtacggagtattagctacgatggtaactttagatggtgctagctacgatggtaactttttttcttaatcaagtttaatcaaatttataaaaaaatttatcaacatctaaaataacaaactaattttataaaatctaacattgaatatcaaaataataatatatttgttttatgttaaaactagtaatatatttctttataaacttagttaaacttaactaaaaaaatatcaaacgacttataataagaaaggatctaaagtttggattcaaacttcagttattttttatcacatcaacttgtcatatacacataacttttcagtcacatcatcttcaattttaaccaaaatctaaattttgcgctgaaatgaacgcaaccaaataaatggagtactccactggctaatgtactgtgtgcagtactagtggggaacaaatgatgctgcagagaagtgatgacaataatttaaccgggagcatgcttctcctcacatgatgcgatgcatcgcacgcacactcacactcgcagtaccacaccatgattaagctttggcgacaacgacggcggctgtctaaacagatacaagaccagatgaaacggccgccaaccacggactgagatgactccacagcccacggtgtgtatgtgcgtacgctctccatcgcttcgcgtgcacgcgacgcgacgctccatacgtgcaaaccccgtcgcggacgtgattgctatacacaccgttgctgcgagacccggcaggttcacgcgtggaaaacatcgttcaatcaacggctgccccgacgtgtacgctagctcgcctctcgtatcacatggcacgcagttaaaataaaaaaaaaggaaaa

SEQ ID NO: 15423 - DNA, 1501 bp, Oryza sativa
cgatgttttccacgcgtgaacctgccgggtctcgcagcaacggtgtgtatagcaatcacgtccgcgacggggtttgcacgtatggagcgtcgcgtcgcgtgcacgcgaagcgatggagagcgtacgcacatacacaccgtgggctgtggagtcatctcagtccgtggttggcggccgtttcatctggtcttgtatctgtttagacagccgccgtcgttgtcgccaaagcttaatcatggtgtggtactgcgagtgtgagtgtgcgtgcgatgcatcgcatcatgtgaggagaagcatgctcccggttaaattattgtcatcacttctctgcagcatcatttgttccccactagtactgcacacagtacattagccagtggagtactccatttatttggttgcgttcatttcagcgcaaaatttagattttggttaaaattgaagatgatgtgactgaaaagttatgtgtatatgacaagttgatgtgataaaaaataactgaagtttgaatccaaactttagatcctttcttattataagtcgtttgatatttttttagttaagtttaactaagtttataaagaaatatattactagttttaacataaaacaaatatattattattttgatattcaatgttagattttataaaattagtttgttattttagatgttgataaatttttttataaatttgattaaacttgattaagaaaaaaagttaccatcgtagctagcaccatctaaagttaccatcgtagctaatactccgtactatcgtcgttgtattaatagctatagcaccaacaactttcattaagtaccgtgcggtagctgatatgccacctctctgcttgattgctctgatacgcaccttagatagtcatgtcccaccgaagctaatgcatgcagtgttcttttcatataattgatgggccaaactgatgttcttaatgttaaggatgaataaatatccatctatcctgatattactacaaatctgaacaaatctgaccagttacattctgtgatataagagtattgtatattataataaactgaataaatagcttataatatattttaaaaaattgtttgtcggtgacatgggaccgggggtatcgtgactagaggcttgggcagccgcggtcacccacgtggccggaccccctcgggggggtcgggcccgagggtgacgtggccacccctccctctgtctccccgaggggtcgggccgctcccgtttcggcctcgagggctggggcgccccgacccctgtggtattggcgccacgtgtgtgggttaggtgagcacagtggcgctcacctaaccgcatttattgcgggttggacgagcgcgccacgccgcatttaatacggcgcagcgtgcgctcgtccggtccgtgaccggtcgcagtgtgtgaccggtcatagaccggtcagatcgcgggttaggtggcaacaggcggcctgtcacacgcctcgccccgtcccgtcggaa

SEQ ID NO: 15424 - DNA, 1501 bp, Oryza sativa
ctacccaaacaatcatactatatatatatatatatatatatatatatatatatatatatatatatatgttatatatatatatatatatatatatatatgtttatcaactacatacgtttaaaaaaatctctaatagtggattggtaacatactaaaacttgttcgattaatcccacccgcaagagaaataaggaggatttgaagggctgttgtggaattatttcccccatatttatggtgtaaaattatttttcctcagtctcctttaaatccttcctcttaggaattaacgaaagtatcacgtcttttttagatgggataaaagcaggtgcatgcgtgcatttttagcgtgcgcgcttacatgctgcgtacatttgaaaagaaaaatgatatgagttttgagatataatgataaacagccagtataacatcatttaaaagttttttgggataacatttcaaagagttaaaaaaacacttaggccatatttggataatgggtttgggatatgattttcaacccctcaaaaggtaagtttcaatcttgggcttattcggtttgtaggattttcaaaccgtaggaatacagaaaacgtgtaatataggaatgcatgtgcaaacctatggattagaaaacataggaaatttttatatggttgggttgcaaacagtccaaaaggattaaaaacattgggttagagtggattatttttttcctttgttttccccctaaaagtggagggataggaatttttcctttcatgcattcctttaaaacgaatgatagtatagtgctcattccaaaggattgaatattcctgtaatttccctttacaaatcctctaaaacgaataagctagccatttattctactcactcatttcatcatattcctccactcatttctatttctcaatcccagctctcctaatccattattcaaacacatcattatagataaagcgttccggtatagtattagagaaaagaaaaagggtgatttttgagagatgtaataatgataaacatatgaagtaacattacaaagagttaatgcgttccgatccggttctttcttaggatggcaagcagttcagtggatcacattacacgtcgccctgatttctcaatcaacagccgttcattcacccaccgaacaatcaccagccgttcgatcgcgttcctgacgtccacggtcaaactcaaaaacagaaaaaatcaccgcgggcgtgcgggtttaatttatctccctcttacgccaacgacgatcgaacagagataagatcgatctaaccaccctaacaaaccgtagatgcaaccgtaataacagcctaaccccaaggaatgcgagatttatccgcccctgcaatgcgctataaatttacttcgaactcacggtgaaaaagtaattagcatcacctcccttcttgcttatcaacacgtacgttgcgtttcttggcaatgcgtgctgcaccgacgacgatgtggcgttcgccggcgg

SEQ ID NO: 15425 - DNA, 769 bp, Oryza sativa
ttgtttgctgcttggctatggatgtgtgatgctgatttcacagcagcagcagttagaacttgttgttgtaccagaagacgcccttgttgtcctcaggctcgacgtagatgcactccttggcctcgcgccatgtcgccttggcgacgggcgtcgggtcgaactggtagtactcgccgaggatggggcggatcgccttagtggcctccatggcgtggtagtgcggcatggtggagaagaggtggtgcgcgacgtgcgtgtccgtgatgttgtggaacaccttgttgaggatgccgtagtcgcggtccacggtggccagcgcgccgcggagccagtcccactcgctcgagtcgtagtgcggcagcgccgggtgggtgtgctgcaggtaggtgatgagcaccagccacgcgttcacgatcagcagcggcacgccgtagacgcgcaccacccaccagaacccgaacgccgacacagcttgaacagggcgagccccgcggacacgacgccgacgtcggagatgaagatctggacgcgctcccggtcgttgtagatcgggccgtaggggtcgaagtggcacgcgaagcgcgggtacgggcggccggacacgttgaacgccaggtacagcggccacccgagggtgagctgcacgaagatgtgcaccagccggccgatcgggttgtggtacacgtacggggtgtaccacgccatcgccgacttctgcttcgggacgaacacctcgtcgcgctccagcgacccggtgttggagtggtgg

SEQ ID NO: 15426 - DNA, 1501 bp, Oryza sativa
tagttactacctccgtcccaaaataagtgcagccgtggatatccgtgcccaacatttgaccgtccgtcttatttgaaaattttgaaaatatttagtcacacataaagtactatttatgttttatcatctaatagcaataaaaatactaatcataaaaaaatttcaaataagacgaacggtcaaacgttgaacgtgaatagtgcaaaactgcatttattttgggacggagggagtaataactacgtcgtctgttcatctgtttttagccaaacacacgtagtatccacctagtaaatgtttacagattacaaagtcacagtatgacggaatgttttggaacaggagtcgctggcagagtgaacgagaaatgcgaaacggagagaacgtaatactagtaattcagacaacagaacgcatcgtccaaggagataaaacggatggtggcacacgccgtccgagcgcacgggatcgtcactcactgcacgcctacagcacacttacgacgtacggctattgctggcctgcacgccctgcagccaggagccattaacaaaagcgaaacactgtcgcctaccgcattccaccgcacggcagggaccgcaacacagcagcgccacgcggcggaagcgacgacgacgacacgccaagagcgcgactgcgattctgcgaaagccgagaggcgcctagccttgtgaggcggcgacagcctcgctttcaccgtctcacgcaccgggcggcggacgacggacgcgcggttgattgcctctcatccgcggcgcgtgagcggctgagcgcgtggaagcgaggcgcgcgcgacgtatttcttgctcgccttgaaggcgccacgaccagcggcgtgtggcgtcgcgcgtgcgcgggtggttgtggtttcactggctcggttttaatcccgtgcgtggcgcctgcggcggctgtcggtcacgggcgccaccagcgtccagcgagcgtgtcaagcgagacgtactactactactactactgaacctgaacggatggaatgttttgttggctctcgatcgtccttgttctctcgctcgctcccggagattccttcgagtttacacgcatgctgatgcacgcgctggttttttgggctgaggctgttcgtttcataacacgcctccgagcacgcgcacgcgcatgttggaatcatcaccgcgtaccatataaaatcctggagggatcagagctggagttgcatgctactggatgtacattgatctcactggcaatggagaggtgtgatgcctagtagagtagtaggccggcccacaagagctggggtcataagcccagcttgagttacggacaaaagttcacttttactcccttaagtagtggctggatccaattcatacccttcaaccgcaaaatcgggtataatcactttgccaagcccgactatttataaaccatgaaaaataaaacccttggttgttttgagagtggttttcgctaacatagtttctacatggcagcc

SEQ ID NO: 15427 - DNA, 1501 bp, Oryza sativa
ttctttgctgtcagattcaatggaggtaaccatatctttttttctattgttctttgttattcgtccactacaaattttggaagagagcaacaacagaacaactttttgaagcactcacaagtcatggagacaagcctttaaattttactgttatggttaattcatttttattctaattttttttgtctgaaaacagtaggggatgcacctgcgatatatataaaagaataagtaatacatacagagagagtaaaactaaaatacaatttcatattcacaattaggattaaggccatctgtaatgagaagaaacctaagctaaactagtattatcttctgtcatctgctcatgttcaaaaccattatctgccaacttcctttctattactagaggtagtattagatgtatcttctatgtattatttagcacatatttgttgtcactttagttggaaaacttaaaaaaaaagattttttaaataaaaaatagtcagtttttttcttctgacccctggtactgtccaaagctattacaattttgcatactgcaatgtgtgtaacatcagtttccttgatcttggcagtctaataaaattctagcgtggggaaaaccaagagaacaaccgttgagtgttgatgaggtattgaattctctgagcacttattttacatatctgtccccttatgttcaagtgctctatggtgctaaaattccatgtgctattattctgcttagcgttgcagttcaaataattactagatctgtaactcaatccacaagatacatcagttgtctaacctctaacatacaattggatgagttcaacatttgatttcggatgtatttactatcacagtaaagtattatgatcctcaagacagtcatacttctgttcaatcttgtgacctttgatatttaaacctcttgtttcttggagtcattatgtctttggctcagactctaggcatatgccttggggcttcaagcaagctaagaaatcctgcaggattttagtggaactcaggaactgttgcctcataatttgcaagccatgcttctcctggcaggagaattagcctttagcagatactgtatatttgatactaacaacttgttttctggaggtataaatagattgaaagggatagttacatggaaaattattccttttatccagtaaacatctagttatctgatcatgtcaagcagaggagcattgtgctggatacacacatgaaatattgtgctgcacacacttccattagtgaaaagatttgttttaccaaatggtagtttgacctttttcttcaactcaacggaaggctaagatttagtctggcattttacattaattaagaactgtatgagtttacgctgcacataatgtctttagtttcatggatcttctccaccaaccatctaataattatcatgtattgatcatgttgtaccactgttcctctcagaaacgtcttatgtttgtctgaaatttttattgca

SEQ ID NO: 15428 - DNA, 1501 bp, Oryza sativa
taagaacctctcaccatcattatttgatgggacatgtcgggctgcacgtcgcctgacatacgcgatggtgcgcctgacatactgggtcccatcggtcattcgaccggtcacagaccggttgagtgcactgcacaccgcattaaatgcggcgtggcgcgaccgctcgggtcgccataaatgcgggtaggtggacacctgtaggcggacacctaacccaccgtacgtggtgacctagagagggggtcgggggagcccgacccctagtcacgggagggggcggtcgccgctcgacctcgggcccgatcccccctcgggggagggccacgtggcgcctggggcagccttctccctctagtctcggccagggagtggccgccgccctatctcgggcccgacccctctcgggggagggccacgtggcattggggggcaacctcctccgtccaatctctgggagggagtggccgccgccctacctcgggcccgactcccctcggggagagccacgtggcattggggggcagcctcctccaactagtctttgggaaggagtggccgccaccccaccccgggcctgactccccctgggggagggccacgtggcattgggggacaacctcctccctctaaacatgatactcccgggcccatatcactgacaatattgctatcacatatgaaacattaagtttttattgtttgaaacatatgtttttctttcgtcagaatatagtcatgtgatattttgttataaagatttaattataacaaattcaacggcatgatcaaatcgctcatcggataaatagtttagaagaaaaagtatttttaagatcactaaatacatgcatacatgcatggtgtggggagaaagccaatcgaatggcgggagagagtagtgacgtaaacatcccatactttttatcggtcatttatgaaacattaggttatatatggtgaaacaagaaaatttagttatcgaaacatttaaatttttttatgaaacataacaaaaacatgtgttgaaacatattgctaccgcgtctgaaacattaaattttaacggattgaaatatatgtttttctttcatcggaatgtaatgatgtgatatcttgttgtaaagatttaattataacaaatataatggtatgatcatatcatcgattggataagtagtttaggagaaaaaatattttaaagatcattatatcatgtaatggatgtatgaagtggatagggagatagtagtttgcccatctgactttttatgatacgtcagacgtccgatattaagcgtttccgcatagcttatgccaaaattaatttccccaagttgcttttgtgacgaagtcttgaatggaatggctgcaccacgcgacactcaggatcgtcattagttagcgtgacaggggtttagagccgcctaaacccctcccaaaaccctaacaacccccctaatccctcccacgggatggctccacaagtagactaccacaaata

SEQ ID NO: 15429 - DNA, 1501 bp, Oryza sativa
taagccactattgccacatctttttatctcaatggcatgcgaagcctatatagtgaagaaagaatcttgtcttaagtatgactaatccacctaacttagttagatttgtctaacgcaagatatgtggcaaccttatgctccctccattccaaattaatctatatatttcatagctatatcaagaccaagacaaactaataactctctcatactatatttattctatcaacaaactcaatgcatgcatcatccccaatattttctagccaatagcaaatcaagatattgcatgtgggttataaatacttgtgtgcatgtgacggagcgtggggctcctcaccgggagaccgcgcaggcccccctttgccggttcggccgggggcgctaagtgaggttcttcgccctcgatctgaggaacgtcagcgagagaagaaatgcgcgagacacgggcgacgtagacaggttcgggccgctgagaagcgtaacaccctactcctgtgttctggtggatctgtgagtgaaggaatacagagagccggagagcgagagagagttcaggctctagccccgttcgccccctctcttctcctcttttttttctctctcctttctttctaggcctgggcctcctttttctctggtcaggggtcaccacaagggcctctcgccacctaagaaaggaaacatgcttttacaatgagggctagtctacagccggaagtgacctctgacaagcagagcgcacgtctcctgctctgctcgcccctttttcggtggacgcccatttcaacctttatttaatggccagcgacttccttgccatacttgcgctgaagccaggaatggatctgaccgggactgacataccaactccaggagttagcacgccggctccggctagggacgagagccacgaagctctcatcattccgacgggacggggcgaggcgtgtgacaggctgcctgttgccacctaacccgcgatctgaccggtctgtgaccggtcacacaccgcgactggtcacggaccggataagcgtgcgctgcgccgcattaaatgcggcgtggcgcactcgtccaacctgctataaatgcggttaggtgagcccgctgtgctcacctaacccacacacgtggcgccaaaaccacagggggtcggggcaccccagccctcggggccgaaacgggagcggcccgacccctcggggagacagagggaggggtggccacgtcaccgtcgggcccgaccccccccccgagggggtcaggccacgtgggtgaccgcggctacccaagcctctagtcacgatacccccggccccatgtcaccgacagtagcccccggcgttacgccagggcgaccgcccccctcgagggaggcgctcgggcgtgatgccactccttaggcccggtgacaggtggggccggtccccacaggcgggcggaaacccaacggtcgcaaatcgcgcgcatcggcaagggaaaaaccgatcgacaataa

SEQ ID NO: 15430 - DNA, 1501 bp, Oryza sativa
tggcccccgtgagcccctgggatcgcagacccgccaggcggtcaagaacggcgtcgtagccgtctcccagatctaccgccgcccgccagctggaggcctgcgccggaggctggttcggaagtcggaggcgcgcttcgtcggcgaggggggtgtagaaccaatcgctcttccaatcgtcccactttttgcgaaggacgcagggaatgtagcggttcagcacctgcccccgcggctggaagtagcagccaccgactaccgtcggcggcgacaccggctgtacggtgaagaaccaccggaacagccggagagatgggcgcaccccgacaaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgcggcgccgggcgtccctcgcccagcgtgaccacctcccggccggtggcagattccggcatgaatcggcgcggcagcccggcctgcctctcgctcacgatgcgggaaggcggcagcacgctaccctcgagcggtgcggagccccgtgccatgacgccggcggaggaggagcttgagagcgagcgagtatggcaagggtagggcgcaggaaacggagagtcagagcacaagtggcaaaggcaaggggaagagtggtgagaggaaggaaacaaatcccttccttggcgtctttgtacccttgccaacgctatgcccggctcctggcttcccgcgcccactacctcgccccctcgtttctcgcgcccacgcctccactaaccccacttgcccgtttgcggcgcacgcggcagatgtgcggccgtggcgtttgagatggggcagatcgtgcgcgcattaactgcgctcgccaaccgcgaaaaacgccatcatcgtgtccccaggcgaaacaaaccggctcgtcccgattcgcgcgctgctcgagtaatgtagcggtcttgaagaggccgctcattattgtcgatcggtttttcccttgccgatgcgcgcgatttgcgaccgttgggtttccgcccgcctgtggggaccggccccacctgtcaccgggcctaaggagtggcatcacgcccgagcgcctccctcgaggggggcggtcgccctggcgtaacgccgggggctactgtcggtgacatggggccgggggtatcgtgactagaggcttgggtagccgcggtcacccacgtggcctgaccccctcggggggggggtcgggcccgacggtgacgtggccacccctccctctgtctccccgaggggtcgggccgctcccgtttcggccccgagggctggggtgccccgaccccctgtggttttggcgccacgtgtgtgggttaggtgagcacagcgggctcacctaaccgcatttatagcaggttggacgagtgcgccac

SEQ ID NO: 15431 - DNA, 1501 bp, Oryza sativa
attttccaatattcaaatggtagaaattatgcagaacaaattatcaaaacacgtcgttctgtccttcctgttgttactactctcctcatctccatcatccggacaagaccgtcacggctccgctccacacacccaaaccccaagcgcccagcaattgttaacaggtggctagggttttgagctccccagctccaccactaccgcctcactccccctaccgcaggcaaccaggaacgacgcccactcaagcacgaaccaacgcaagcacgccccccaaatccggacgccgaaaacctagggttcgggcgcgggaggcccccccgggggggagagaacaaaacgagcggggaggggagggaaacggggggggggggcgctcacgatgtgctccttgtggtcggcggagcccccgtactccgggcacctgtcgccgatccgcagcagcagcgtcctccagcccgcgctcatggcggcggcggcggcgcggcgcggcgaggagggagagtagagagagagagagagtggtggtcgggatactcgtcgggttcgagggttttggttcgggagcgggcgcggcgggggttttgatatcgggttcgtcacgtgacgcggtgcgacgcgaacgcgaactcgaccggcttgggttgggacgttgggtcgagtcgagttgggagatgcgtgtgggcggccggtcgccgagggggtttgtgttaagtttgcgtattaaagtgtcgttgatgaagcacggtaatttgtgtgactagtccaactcaaaacaaaataattgtgtatgtgacatatatatagcactagcgtaggtttccgtgatacacataaaggatgatcacaaatcaaatacactctgctaagctgattaacttttgtaaaaagatgtcatcgattaaatacgcggactcaaacgtaatagatatgtgtgaattatatggtacttaaatttgttatagatatgtcactaaacattgagttaggcaaggcatagaaaatgaatggaggttgtgatactcttggacctccatcgtattatacctaaagattggacaccgccttgtataagagtcgcgggatacaaagctacatggtaagctacttagcttttagaagtataaattatatgaaattgggtatttatggacggtatgtgcccatttattaattgctaaattttactcacttttgatagccatttgagatagatccaaccgtcaagctgataactttgatctctatataaactccctcctagagctaatttcattttaggacaccagtattctcccttgggagcaaaggaggcgcacccaccagggcctctcatcgtaatatagacccgttcaccacaacacctcctaacatctccgtaacatctgcaaccaatcatggactcgaagaccagtcaccactctacgcgacaatgaagcccatagcaaccaacatcttcctccaaaccctagtgatcgaaagtttcattgcctttttcatg

SEQ ID NO: 15432 - DNA, 1501 bp, Oryza sativa
tcttgaggtcatcactggcaaaatcaaaataatgagtgccttttgtaagttcacttcttgaaaacctttgaataccaggcgcaatgaatagacaaggcaattcttagtggtgctgacatcatttggcttctctgagtgccaccctcttgcaagcaaacgaggccagacagcttccccaaaaagattatttgatcttgtcttgcttcttttgaaatcacccgttaagaattcgattatatctcttgaagcaagagaggaacaatctttgcctgcaggtatgccaggctgaatagaaaggacttggtttggtttggatgtgtccaaaacaaaaccagtcaaatcatccttccctttaccgattgcaaccgcctcaacaaaagcttctattccaacaacagatttcaaataaaaacaaaatccattagcgatgtttggccgtcgttgaaagatttgaacatctgcaacatgaaaaaggcaatgaaactttcgatcactagggtttggaggaagatgttggttgctatgggcttcattgtcgcgtagagtggtgactggtcttcgagtccatgattggttgcagatgttacggagatgttaggaggtgttgtggtgaacgggtctatattacgatgagaggccctggtgggtgcgcctcctttgctcccaagggagaatactggtgtcctaaaatgaaattagctctaggagggagtttatatagagatcaaagttatcagcttgacggttggatctatctcaaatggctatcaaaagtgagtaaaatttagcaattaataaatgggcacataccgtccataaatacccaatttcatataatttatacttctaaaagctaagtagcttaccatgtagctttgtatcccgcgactcttatacaaggcggtgtccaatctttaggtataatacgatggaggtccaagagtatcacaacctccattcattttctatgccttgcctaactcaatgtttagtgacatatctataacaaatttaagtaccatataattcacacatatctattacgtttgagtccgcgtatttaatcgatgacatctttttacaaaagttaatcagcttagcagagtgtatttgatttgtgatcatcctttatgtgtatcacggaaacctacgctagtgctatatatatgtcacatacacaattattttgttttgagttggactagtcacacaaattaccgtgcttcatcaacgacactttaatacgcaaacttaacacaaaccccctcggcgaccggccgcccacacgcatctcccaactcgactcgacccaacgtcccaacccaagccggtcgagttcgcgttcgcgtcgcaccgcgtcacgtgacgaacccgatatcaaaacccccgccgcgcccgctcccgaaccaaaaccctcgaacccgacgagtatcccgaccaccactctctctctctctctactctccctcctcgccgcgccgcgccgccgccgccgccatga

SEQ ID NO: 15433 - DNA, 1501 bp, Oryza sativa
cacatctaatacaaacaaacgcagattaaccaaaagatgactcattatttaataatagtacaaaattattcaaggcatattcaacaagcaaacatttatttggctcgaaacctgtacaacaaacgttgagggattaagaactaagcctaacaacaagggaaaggtatgactgcaccattgggccgtatgaatgcattgtgccaaagcaagcagtgtccaggactagcaaaaagacatgggcacaaggcagcacatataaacatcagaaaagcaaagctcagtgaatttaaatcaacaaaatcagttgcctacttgccttaatcttcactgtttatatacaatactattgacagtattaatcaaccagtaaaagctctgatggaatttaatccctacaataatatggcaaagcatgcacgaactatatttgttacaagattgtcttgtgttagttttatttcagagccaccatctatattagttaagatatagagcaaaaacacgaatcgcattgaaaaatataaagctaatatcttagttaagtctggtgttaaggaaaaaatcaattaggcttacagcacaaatcttgcttacaccattgataattcatactagatcagagatgaagaaagaaatgaattaacaattaaagattaaccactacaaaacacaataccacaaaatatcaatttaattaaaacacaatgacaatataaattatcaatggctgttagacatgtagattgtagagtaacctaagaaaacagagaaaacaaaaataaatattaaaaaaaatgcctacactaaataacatgtatattaaagttaataataaccatctagacataataacatgtctattaatgttgacaatctccatcaaaacagaataacatgtctatgaaagttgacaatctccatcaagacagaataacatatatctactaaatacaacaatctccatcaagaaaaattatctggaatacaagatataagtgaaaacagtaagaacaagaagacttagcctgaaacatcaataatgaaatcagtataaattccatgtccaaaaagaaggcagacagatacaaatagtgttggctttaaacatcttaccaagttaatccccatagcccgcttgttcttggggtgccgtttcttgggagtgtgttgctgtggtcgtgtaacaaaaccaaagtttggccgacaaatcaagaactcagcatcatcgtctttctttgtcaccgatgaatactgcgccaagattgacgcgtctgcctcagagatgacctcatcaggaaggagagaggcctcctgctgctgctgctggaggtcgacaatcttcgggttaatctcagggctgcaatcctccgtccccgccaacaagtcccactgggcaacagaggaggcctctgctatctcgatcatcttaatctcgggcgcgcccaccatcgccggtttgagggagggctcctcccccagcttgatgccttcgtaacccgca

SEQ ID NO: 15434 - DNA, 1501 bp, Oryza sativa; identical to SEQ ID NO: 15433

SEQ ID NO: 15435 - DNA, 1501 bp, Oryza sativa
tttaatgttcataacatcacatgagactaatcttgaatgaaaaatcagttgggaaactctccccctttgatcaatcttagctaaaaacatcacatcggaatatcctctttgcctgaaaaccctctctaatcttctaggccaaaaaggcaaaaaatcggtcatggcccttcccatttttgtactgtttgatgaaagttttaagtaatatcatcgtgcgagacatccgacagtgcgaagtttggtgtgtcgttgtcacgtaaccttccctcgtttcctcatattcctaccgccggttgcgggtcgtctttttctcgcccgtttcatgggctccctttcatgtcagcatcggattgcgtccgaacaaagtccactcaaactctcaaaggaagatcctgaatggtctccgatcgaagctgtattggctatctgcgaagtgtcattgccggctcagtggatacacacacaggacacgaatgtacaatcactaaccacgcagcaggtacgcaataaccagcgttagtttaagcaaaaaaagggtcgtcgattacgtataatttccgctcgatagagccaaaaccgaacgtgcccataatccccccgtgcgtggatttacgtgacgcgcgacagcgcaattctctcccacttccgatctcttcttccgcttggactcatcgccgtgacgtcgacgttccacgaggaaaaggacggcgtcgaagccaccgggcaacttctcactcccgctcgcgtctctgacaagtgggccccacgcctcgctttcttccccccacctcccgcccggctgatggcccaaaccccaacaaaacctcctccgcgaaagctacaatccaaagggagtcgttaccgtctcgccattgtcctcctcctcctccgcccccacctctctttcctcgtgccttcctctttcgccgccggccgtgcgcctcttaaagccgctccccgcccgaaaccctacctcgggaaccctaccgcgcggctttgacccagggataatcccactactggctactgcattcgcttatctcgctcgcgatgtcgctcgaaatccatgaaggtgagtgatgggaatgtttggacaggtttggtggagtgtgcgtgctcgaggcgctgatttggtttgtttttggttgtttgggcgcagaggagggaggaggtacggcggcggcggcggcggtgaaggtgatgacggtgtcggggagcgggaagcgggggcggtacgtgcggcaggtgacggggcggcacaacgacaccgacctgcacgtggcggcccgcggaggggacgccggggcgctgcgccgcgcgctggacgaggcggcggcggccgtggccaccggggaggggagggaggcgctggaggaggtgcggcgggccgtggcggcggagcccaacgaggccggggagacgccgctcgtcgccgcggcggagagggggcacctggaggtggtaagggagctgctcaggcacctcgacgccgagggggtcg

SEQ ID NO: 15436 - DNA, 1501 bp, Oryza sativa
ttctctctccctttcccccatttttccctctctctctcgcgttcaaacgggcggacttgcccccgcaagtctcgccggcgccattgatggcggccgacatcccgcgccggtttccttccttccccggccgccctctctcgccccggctctatttaaacccaccccgcacctcctccgtccgtttccgcctctcgccgcccttcctcctcaccggaatcgagctcgcgccgtcgctctctctctccgccgtcgccgccgagctccggtccgccgccgtcgtcgccccagaccacctcccacctcggcgccgcctccttcggcttcgccgcatcctcgccgacctcatccacccctccgtttcgctcgccgaccgccggaacgccgtcgaccccgtcgacccgagccgcgccgccgccttcctccgctccggccgcctttttcgtcgtcgccgtggacctagggtgagccgtggaccgccgcctcttttcccccttcccttcccctctctcggccgccgctccgccgtgcctatggccgccgccggctgcgccggcttggctgccctcgggcgcgccgagtggctgccgcgtggggcccggccatcagccgctcgtgccctcgggtgcagctgacgcgtgggacccacggcgctggccggtgtgagcccgggtgcacccggtccaccgtggaccgtgagggtgccgcgtgggccccactcccgtggacccggtccgcgcgccccctcccctcggctgacgcaataaaccctttttaaattaaaatttaaatgaagaaattcgcaaatattcatttaaagagcatataaacttcaaatgaccataacttggccatttgaactcggaattggaccgttcaagtctctaattttttcttaagaagtcaagaacccatttttgtgctttgttcctgcttgttatacggagtttattagagtaaaagccttttcttttccgttggtcgtgtagacgctgcagcttcggaagatccgctcttcgtggaggttgaagccgacgtttgggaaagcgagcaaggcaagtcacatcatccttgaacatattgaatcccagtttataaaattattttgatttaaattattgcattaccgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctgattaattaggcaacattaggtggttttataactctagactttgggaatattctcatcacctggacactatggaatggttggattattgtggaattgggttcacacctccccctctattcaaaacccccaaaatggttttaggctgggctcggggtgcatggttttgatagtagcacctcggccatataaggaccggt

SEQ ID NO: 15437 - DNA, 1501 bp, Oryza sativa
ggaattgattcatgtgaggcttattaatcatgctcgtcctgtgccctgccggccgctttatggctagttcgatctggcatgcatgcgtggcaatggcaccaaaagggcgaagccagtcccatgtccgccgccccacgcggccgtgcgccctcagctcaattatttcaccctgatttccattcaatccatcgtcgccatggccctctctcttgttctcatcactgagtagtgccagtggccatccgtcctcagcgcctgcagcctctgctactgtcaatttcgaatattcgtattgatcgtagccacctctttcagttattaattccgtactaaatgagttcttgagaagttgtctcttcggttggtaatttggtattgtcgaaacatgaattcggcaataataaaaggggtagcgcacgagacctaaaagtagatgaatgaggagacaaaggatttagacaggttcaggccctctcaatgaaaggtaataacctactcctgtttggggatttgaatccgccgggtatagtatagatctgatgaacatatgtggtcatgcccctagagggcctcctgctcacattatataggatagggggcatgattacaagatagaagccttaaccaatacggtactggcttcctaaatctactttacaatattatcaaatcaggactttaggccattccatattatatagatataagttatcccctacaaccagtcggataaccatgccgtgtgggtatggggtacccataatctccacagtagcccctaagaccttcacaatcgagaagataatctttcctcgaaccagattactctaaagccgagtgcttcaatcatcttcgccatggtctcccgagtacttttaccaaatcagaggactgtggagggctgaaaaataaggtcaggtgcatctaatagatgcacctaataggtgtagcccccgactatggttagttgaacaaaccaagcatatagtcaaggaataaataatccaaccaactgagagtgatttttgataattatagtcaaccaagtgacttgatatcaatatatagcatatgcggtatgaaatcccgaataacatgatctatgtgatataccaaatgctttgtaaagcatgatgcatgcaatctaaagttgactatatcattgaaaattcacatagcaaaacagctctaaagaagcttgtatgttgtgaataaagaaatttccaaggtattgggcacacaccatgcgcacactgctttaacagatgtgcttaaatctctaaaagacacatggtttcaccacacctggaaatatatggcctatgtggtgtaaaatccgagtaaataaactcataaggatttaccaaccgtctgaaaaatgaccacattatttaatcagcctaagccataatattggtcaataataatgcacacttacgtgacaaaaagcaatgatagtgtatccaatcaattgctttataaacccaaacaacgcattgac

SEQ ID NO: 15438 - DNA, 1501 bp, Oryza sativa
tttgattttaaggaaaagctaccggcaggcacatccatgactgaatattggttcagactgaattcagtagtgcagatcattggcattatactaggagtaccaatttagcaacttgcaataccttgaagaaacaggacaatctgcagatgtcaaagataaaattgatctgtattccgcggagttgatgctctggaaaggttcagtgaaatgccaatccaacttgttagaatgtagattatcaccagaaaattagttcaggttaagtcagtcaatttgctttatttctgcagtcttgctttaacctttaggatggtaagtaataataagtacggatcgaagacactatggttggcagctcaagtatcctctggaaactaaaagagtaaaaaaaagttaggtgcagatggaagcacgcaatattcttagctgcaagatttgcaattaaaattcaaaatcagtctatactctttagaagcacattaattcctctttgtttaaaaaatagagaagtgtgctttcagaaggaatcgagatggcaacgtactctgcatttctggaacctgcagaatgatctggtaaactggttctagatattggttacacattaaattcagtagcgcagatcattgattcatctagccattgagataaggggctccctacttatatattaggtcatttgcccttccacaaccaatgtgggactattcaacacatccggcccaggtggcgttggccgaggcccaataaattaaggttgattcatcattcatgggcattgatatatccggcctaggtggcgttggccgaagcccaataaattaaggttgtccggaccccaacagttcttaggcacacccactcgggaaaatgaccaatctccctaaaatacagtccaatagaggaatggtggctctcccttttaaggtggcttaatcctcccaagctaagcaaggtgggattattcagaggctcacacggtcgccgcccaactacaactggaccacttggccccttattgcgtctttgccagcggttaatagtggaggatatcctcatcaggcatagtacttcttcagataataatgacaatttgcagatgccaaatatacaattatcttatctgtattccacacagttgagatgctctacaaaacttcagtgcaatatcaaagaatgttggcatgcagattattattagggtaagtttatcatcattgagaagatacctagagatatcatattttctagtgtaaaatttgatacttctatatactaattcccaaaagtaccaaaatttaagtatctgaaggtactttcttaatgaccataaaattcctcttattattaactcttatgaacagaatatgagttcataacttcaggttaagtgggttattttgcttcgtttcagcttgaaaccttcgatgtgttgacgtttttttacagagtttactcagagaactcggaacatggtgaatcaattaaggcccggtttagc

SEQ ID NO: 15439 - DNA, 1501 bp, Oryza sativa
ttacttagaccaatcattagtgttgtcgacaggtggtacccgtagaccggatatagagggtattggggtacgttggtacaaggatctacgtaatacgacatcaagtaaacaaaagacgaggattatactggttcaggccccttgataggtaatagccctaatccagttgatgtgggattatatggtggaaaacacaggttacaaaggggacaatggaacttgtcggatccggcaagatcgtagtcgagttggttcgactagatcccgatggcttggctccttgcatgctccgacttcataggctgtgtgggttgtgttggctctgatattcgatgccttaagcccttcccggggggtcccttttatattgcagatctggaggtctccaagtagaactcggagatatcagaccctatacgatacatcaacgacccagtcttgtccgagtaggattcttcccatccgtagattccgtgaaggatttccttggaatacgaaggaagtatccgtatgcgcgtgggtataccatactgatatgtgacgtatatcgaagtgtaaagggtatgcctaaccataaccctgacagtagccctcgacatctgcttaaaatgagctcgcgtaaccattcgcgacttcgggtgtcgagactgttgtcgttcccggtgcgaggaccgcggagacaggccgtagtcgagcacgccatttgaagcccaatggtcacgagcgaatttaaattgaagtccaaaaaactgccgcgcgtaacggacccagaaatttccggcgggcatctctctctattccttggaattcgcaccgtcggtagtgcgcctatttaaaggaattttgggggtccatcttcaagtccgcccaccgtgctgaaaacattccgcctgtaagcgctcttcgccttcttcgccgccacaagaaaccctagttcatcaacctaggccctttctctagcgatcttcgatcagcgatggacctcggcaaatcatcttccaccagtgcgtcgctgaagaagcttcaggaagacgacgcccctcctggtcttggaaccatggagagggaagcaggatgtactaatccccagcccgtcttaggtcacatggttgcgatcgaagactatattctctgcggttttctccctccgcctttcgaatttattctcctagttttgaacttctatggtctttctcttctccatttgaaccccaattttatcgcctttcttagcatctttgctcatctttgcgaggcctatattggggtagagcctttccttgatctctttcgcttctactacgagctgcgttggatggagtccaacagggtatctggttgcgtcgggttccgacttcgggatggcctgaagtcacgttatatccccttccagtgcccttcttctcgcagcaagtggcggaataggtggttctatcttgagatcaaagacttggaccctgtcttcgttgttcccaaagagcaaccagacaagatttcgtct

SEQ ID NO: 15440 - DNA, 1501 bp, Oryza sativa
cacggctacatacacacggtaggggtgcaccgccaccgccacggccactgtgcccgcgggtgctttttcttgaggctggcaccggtgcacgagttgtgtgtgatgacgtgttcgattggatatacattatattcacacacctcaggccgggctggctttgacctgctcagaaatccgtgacgaaagcgggcataactatccttgtacccacgcagagctcacctattttgacaaatagcagagatcagtttccttgtacggactcgctcactgttcgtgcttcgtttcgttgtttttttaggggtgtttgtggagcgggagctggacacacagcgctactacgctacgacccctcgctgaacattaaatagaatttcagggttttctccacgcgaaatccctgtcccaaaacagtggtagcacgtaccaccatgcacttcaaacacaacagcaaaaatggcctttgggcttggggtggtatgcgtatgatgcacttttgcatgattgcccacccgagctctaaatttttttgctgagagcgaggaatagtagcagaccaaacggtcttaggtctcctgtcattgtgatcccttttcatgattagatttcctgtactttctcctcctgttgcagggaaaaggaaaacgatgaagagactggagaggggaagaagaagaagagaacaccacctcccgtttcccgatgccccccctgacgcgcagaatgatgcaccgtctccgaatggaaacgccacggggccccacctgccagcttgacccctgctgctgctgctgcactgcacatgttattccccctccgcctccggtgtcacgcacgcacgcgacgcgacgcgatgccgaggcgtccgtaccaccaccgccagcatcagcggccgtcagctcgagatcggacggcacgggacagatggcagcaggcgtcacgctggcgtgtgccgcccccccgccgctaagggccccacgtgccagcgatggaggcaggcgccgtggggtggtcaaagggggcgcggggacggacacgtgtcggtcgccgcaacgtctgaatgttcgaccggtgcgcggcggtttgacccacgtgaccggctaccgccggtgcacgccgctgactcagcgcacccgtgaccgtggaccgtgttcccacacacacacccccaccgtttactgtagcggttgcaattatcagtacggccacctacaggggctaatcactgttctgacagtctcgccgagatctaagcaagggattattttgagattagaagaaggaagaaaaaccaaacaagctaagccaaggagtgggcgtctcatttggggcataaataatcaacttgttcctctcaaaaaaagctgaaatcaatttaatcgaaaagcaaaccaaaagtgtgagagaaaaaaaaatcctctcacccaaccatcctctcctccatccctctatctatctatatccatctctctcccttgcctcatcaccctagttatagcta

SEQ ID NO: 15441 - DNA, 1501 bp, Oryza sativa
cggctcgtcgtctcgcggcgccgcctccgtcatcgtcatcatagcggcgtgttccacgtcatcctcgtccccgtgcagccgctgccggctgtcctcgtcgcctcctcgccggccccggtcgtcgtcgccctcgtcctctcgtcgttcccgatcgtcgtggcgttcgtccctccgtcaagccgttctcgtccgtcgtccgcgttcgtcaagcgagtcgctgcagccccgtcctcgtgttcgtcctcggctccgcgtcgtcaagcctcgtgccggccgcgtctcgccttcgcccaaggatcgccgccgaagccgtcccctcgccgttcgtctccgttgtgcccgtctgtctccgccgcgcccgttcgtcgttgtcgttcccacgcctcgtcgcgtggtggtaaggtttcctcccctcgctgccccgtcctcgccctttcggtgtcgcccgtgctcgttgtgcggtcgtcgaccccggtacccgtgtaccggtgtcggtagtcgttcacgtgtgcgggtggtgaccgtgtagtgtccgtgttagtgtgcccgctcggtagccgcgtggtttccacgtgtgcaggccgtgtggtgtctagtggagtccgtttgttggccactcgcctcggttgacacacggggtccgcttccgtcgacccgtggaccgtctctgtgtatccggtctaccgcggtcctttaggttgacatgtggggtccgcatgtcaacggcgcagccttcctgtcttttccaggctagcgcttacacatgttttataattgcaaagcttaattataataattcgcaaatctccatataacagcattaaacttcggatgatcatatcctggtcatacgagctccgaatcgacccgttcaagtctcttaatgtttgttataacctaaagaaccatgtgctttctttttatgtgttgttattgcttctttataggcttgtagctttgcttgtgtgcttcgcgtagctttcgtcgttccggaggttcccgaagcgtggtttgcggtcgttgccgaaggttcggaaggccgttctccctgagcaaggcaagtcacatcatccttgaacatattgaatcccagtttgtaaaattatgttgatttaaattattgcattatcgctttatttaaattcccgcgttgtcactgttttatttagccatgcctatttacctttgttatgaccatattattattgttattgttattattattaccttgttcaccctagaataaataaaaccccaactagtgggtactctactcgtggtatccctagtttaaatttaggtagatgcttcgctgattaattaggcaacattaggtggttttataactttagacttgggaaattctcatatcatttggacactatggaatggtcggcttatgttggaattggacacacacctctcttcctctttcaaaacccctaaaacctgttttcggtggggtttgggtgcatgccagttatgggaagtagcaccccgg

SEQ ID NO: 15442 - DNA, 1501 bp, Oryza sativa; identical to SEQ ID NO: 15441

SEQ ID NO: 15443 - DNA, 1501 bp, Oryza sativa
tatgccactgatcttgtcccacgtctacgatttactatcgtttgtcacgttctacaatataccatcgacttttgtttaacttctacgatttaccattgccgtccggttagcctttattaggactgtacaattttgtccaaatgagcaaaataccctaggacaaaaacttcctaaatttggataaaaatttaaaaatatcatattataacatccaaaattttgccaaaacaaaatatgatagttcagaatgtttatccaatttttatctaccgcgacaacctatcagccaccgccgctgggataggaatccatttttcttgcgatttgtttctgggatttttcttggataatctagactcctctagcatcacacgttttgtaaaaaaaccctctaggaacttgcatttacatttaggtccgccagattttttttcaccgctgatatttcatcaaacgactgtgaaagggttgcaaatacgtggcgcgttcttgggccgagaattccgacggagcgcaatgagtggtgacacgtggctcaattagaggcccgagattagaccttgaaatcggtttataagattctttattaaagttctatgatcgggtcctagtttgttcatttatagaagatgtatgatcatcccattaatactatggcggactaaacatggtacgttttcacaatttatgcgcaatgagacgcgcactatttatttatttaaaaatgataggatacatttattgtattttttatatcttcgtcctttattaaatgttctatgaggcatagtttttcatttatagaagatatacgatcctctcattaatattatgttagatacacatggtttgtcgcaatttatgcacattgagccatgcattactttatattttgagattgtaggacgcaattattgtatttttcggatctccggccattcttcattaaatgttctataagacgaaattttacatttaatagagaagatgtatgattacacatggattatcataatttatgcacaatgagccttgtatttgttttttattttaaagtaccaggatatatttatttgtttgtctagatctctttctttactaaatgatctacgattgatatttttacataatatgcatattacattttatagaatatgtatggcactcacattaattccatgatagaatacacatggtttgtcgcaatttatgtgcaaagaaacatgtgtcagggttatggataccacatacctaatagtagtcgactaaatctcggcaggacccaccatataccatgtcctatacggaaacaacttgcggatataggaggagttccggataaggaaagacaaccagagttctaaatggaaacgacaaggactactcggattatatccatattggtttctctagttctacttggacaagtggacacctatggttataaatacaaggcccaccatagaagacacggaataatagatcaagtcacaagatcaac

SEQ ID NO: 15444 - DNA, 1501 bp, Oryza sativa
tttcccttctcctgtacggatccggaggaggaggagctcttgcggtcttgccacctggacggtagtctgaaaatatccacctagtcgggccgggccagctgttgctgcagcccggcccaatagcttctgcttgagttctccactgcgtaacttttgacctttgactttcgaaggattgccttttggactcaccaccaggttcaaccaaacaaattactccctcggtccctccgtttttaatttatttaccacttttaaccatgcatataaacctatataatcaactttttttaagtaaaatgaccaaaataccaacagttttgtgcgacatctagaatttagaagttccatccaaaacccatcaagaacaaaatagcaatcaccaccctgatcagcgcgtcgggataagaatttataaactttattaaaactggtcgaaactcgaaaataatgaaaatgaaaaacggaagtagtgtaatttgaaattttaaattaaaccaaattttaatttactccggtagagtaacatcagatgtaactacggatttgtctatgctcatccttgtccattgttaggtttgcgaatcaaatttgctaccaccatacaagtatacatcacccgatacatcttgagacgaatttcaaacaattagcgtattatttttttaataaatatagtatataacttttggcctttgcaccaactaaaagtgcacagaactcatatttagagacaccgatacatgttttgtgaaaattaacattgactcgtatggttataatatggaaacataactaataaactctgtattaattcaaatatgcttatcaaatccagttattattgaagggagaagtgtgagaggggccatgatagatgaagattaagattatgtaaagcacataaaacaagaaagacattagcatatagctaattaagttttaattattataaacttattttagagcaactttcaaatagaatttttttttcacaaacgtaccatttagcagtttgaaaaacatgctaatggaagccgagatagaatctactccatctgtcccagtatactcgacgttctagcatagttgagccaaatcaagcctaggtgaaaattaccatatagccctaagggtatgctcaggccctgtttagttccaaagtttttttttcaaacttccaactttccatcacatcaaatatttcatacacacacaacttttctatcatatcgtaccaatttcaaccaaactttcaaacttcagtatgaactaaacacaacctcaatgtataatgtctacttgggtaataaggtaggacccaatattagtatatggtaagagaatgcattagcctggattccactgtcccactcgaatatatggcatgtgagagagaagaggagagagaagataaagtattattactttatttttatgggtagacattatgcatatggctagctcatcttaaagactaatatatggactactatcacaa

SEQ ID NO: 15445 - DNA, 1501 bp, Oryza sativa
cggttttaaaagatggaaggatatgtatgttatatacttatatcaggcttcgtggttaagggacgtgattataactcgactcttagatcagggaccaggcctggttaagtgaacttttgccttttgcttggaccttttgttttttttttccttctgcttgaacctctccctttttccgggttatataaatcaggtaagatcaattttgttctcccaatggacagaaaagaaacatgtggccaacaggccaagtaaacccgaggggagctaggaatgtccaagcaaaacaaaagggcacgtgaagtgaagagattggttggcattgtgacaacagctcacctcgacgagcgtttaagcttagtatattctgcaagcccccccacctaaccctgaaagtcctcaagaccacaactaaacaacatcaagcaaatcaaaccggacaacccacaggataactagtcagtttttccaatgaatccatcctcctctgcaaaagctgttttttttagaagttgcaaaagctgttaggacgcacattttccttccttgagacgagtaaactatagtgtagtacagtacattattgctgccccgtcgatctcaaatcatcagcaagcatgaaggcacatacaccctcctagctactagtctttcttttttgtgctagtaaagaaataaaaactagatctatttcaggttataaaactttttagtattacacatattcatatgaatgttaatgaatttagacgtatatgcatatatgtctagattcatgaatatatatatatatatatatatatatatatatatatatatatatatatatatatatatatatatatatatatatatatatgagcaatgctagaaaatcttataacttaccatggaggaagtaacagatatacagctgggcatcgtcacaccagacgactttcaggttccagcttgcgagaacatatattaaaaaaacgcccaaaattcccaaactataaaagaatcgacgccaaacaaccaggccgacacagcaacaacctacaaggggcatgattagcctgctccccccgtacatcaatcccgaccgtacagtgaacgcattgcccaatacagatcgaggctgaggccgaatcaaggccgttgattttatagtttcagtatagctggacgtcggtcaggtgaagaaaagaaacagctgctgctggattcctgggattcataggtgcgcgccatgtcgcgctctgtcggtcactcggtgtctcgcggtcgccgcgacgaaaatttgcaggccaaacgcgggccgcggccggcaggcggcagcaggtggcctactcccgcaatccgcggccgcgcgcgcgcccacacgcataccaaacggccagttggttactggtcgatcagcttgtcgtgcatgatgatagttttcatattttagacgtttatttattgatctccaattaacaagacttgtcggtacacggttatttgttatattgatatt

SEQ ID NO: 15446 - DNA, 1501 bp, Oryza sativa
aaaggggccctaaaagggtctgttctgatgggtgctaaaataaaccttaacaaaatttggcaatgccaaaattttaacaaattagcaacattgccaaaattttggtaggattggcttaataatgttgtcaaaattctatacatattgccaatatttggtaacaaactaaacgtaaccacataattatcaattttactaaataatgatatgattgaaaatgtcatcaatctgaataggctctaaggttttttctctttttgagggtttgtttgtaatttatatttctctgaggaccctgctgtaaaactcctactgtatcacttttgcaacatccatccagatctttcaaggccctagtctgggcccttgccgtttaaaaaaaaaacacaattccacgtaattattccacttcgcaacgcgtctcttattcgcagatcagccatgttacgccgtgtttagtttcaaactttcttaaaactttcaacttttttatcacatcaaaactttcctacacacaaatttctaactcttccatcacatcgttccaattgcaaccaaacttataattttagtgtgaactgaacacacccttagatcactgcccctagaaaaaaaaacatctgatctatgggcacttgagcttgtttagtactccatccatcctactaactccgttactccgtttcaggttgtaagactctgattaaagtcaaactgttttaagtttaactaagtttatagacagatgcaataatatttataatactaaattagtttcatcaaattaataattaaatatattttcataataaatttgtcttgagttaaaaatgtaactactttttcctataaacttggtcaaacttaaaacagaagtcaaaacgtctcataacatgaaataaagtaaaatataaaaacctagtaacagatgagatatttttaatagtattatgaatctgttcaaattcataatagtaggaaatgtcttatctatttctagattcttatattttagggcggaagaagtactagcatatcaactacttatattaattaacgtcattttgtcaacgttttgtagcttctatgagtatcatgactaccctttgcacatgttgtcatataaaatgttacatcgtaccgtcttatggaagcccttgaggcgtgagctgcaattttgtactccctccgtttcacaatgtgagtcattctaacattttccacatttatattgatgttaataaatctagacatatatatttatttagattcattaaaatcaatataaatgtgaaaaataatagaataacttacattgtgaattactagtagtacgtaagcataaatacgccacccaacataaacacacatcatttcctgtcccttgcacgctacgagctcgatctagcaaccactccctcgtagtaattgtttcggtggagccagtctgccaatggcagcgaaaggcatctcgaccatcggcgcggcctcgcggagcctg

SEQ ID NO: 15447 - DNA, 1501 bp, Oryza sativa
taatttataattaaaacttttacaaataacttaaacatcaatgctgaaaaatgaaatataataaaatatctcaaaatcaactagtaagttttaaaatttaaattttaacattggcatatacgttataggcaaaagatgtgatccttatgctctgtttctgtagttcaaactcatcatgttctcggccataatatgcaacatatgacagttcggcccagaattcagagatcactattctcttcagaaaatgaccagctataatcactttaaacagtaaacaatgagatgcgccaacaccaaaacaatgtggacatcagatgcatgtttgcttttctttttcttattaaaggaagtacactcttcaattcatgtgaatccatttctcccttgcagatttgatcacctagtttgctgctgcacaattagggatgaaaacggttggaaaatatctcgattatttccatagccatgtttttttcccaaaaactgaataaaaaatggtaaaagcggaaacaaaaacaattaaaaaaccagaaatgaactatacgaacagaaacatatcagtatcaataggaagccataacaaatattggaaatattgaactataaaatcacacatttaactttgcataactatataatatgttaaaataaattcaaggttatgctatgtaaattataaattatcttcttttaatcttgtactcgagttaaggatttggttgtgaagttgatagacctctaaactatgtcaaataagaaaatagatcataaatgcatatttagaaatacgataattatcataatatgaaatatggtaattaccataagaataaaagtcggatatggttagtttgaagcaaaatcattttcaatttcattttttttctcatttatatttttgttttcgtttgtacccacccatgtacacaataatatcacaagcccacaatcccccgggccctggtttgcagatttgtttcgatcttacaaagcggccgacccaatcacccaacacgaacagtggtccctccctcacgcgagcttgccttggatctcacgtccaaagattccagctccctgcgccgctttattcccaggtttcgcgcaagacagcgtaaacaatcattgcccgatctgccgtacaggccgcgcgcagtgcacgcttcgcggaccaaacgtttccgtggtggccgtgcaccagtgcgcgcgcgcgcatgcgtgcatcgatccacacacacagacacactccccgcgtgtcgcgcctagccgcgagcccgcgacccgtgcgcatgcacacggccggaatggtaacgcaggcagaacacgccgcgcgtacgcgagagcgcagcagccgcgacgagcaacagagacgtgtaccgatccgtcacgacgtgcgcgcgcgcgagcgagaggatgagcgcggcggaggagagaggagatcggcaggagcgggacgatggggaaggtggagaggaggagcggcgggagcgaggcgggg

SEQ ID NO: 15448 - DNA, 1501 bp, Oryza sativa
atatgattccggctcatacagatagtctaggtaactgatacagtacctgatagctaggctaggaagaacagtcggtctgaatttgagtgacccaatggcaacaaaaaaaatatgttctatagcagcaacatactctaagtaaggtacctagagagataaaaattgatgatggggtattggggttggaaggttaggatggcatatttaatactcctaattaagtagatcagtcgcagttggtaggcttgttgatgatcgatgagcgtcattggccgggttgcagcttgttagtttaaccgtacatatatatacatgggtggtttcctcgtcagaacatcacagcacagcacatcggtgacggtgatatatgtactcacgttaattaatttggattgacaaatatacaccgaaagaatgcgttggcgatcgacgatggatggatagtactatatgttacaaggaaagcaagttaataatctactaagtacgatattattagtgatcgatgctgatgagtagtagtcaattagatctgcaaaatggtgcctgcctgcttggatatttgttgtttcgtgtgtgggctgtggctgctgatggctggatcggtaggaggcggacagcatgagcaggtaaggttgccatccacctatccatccatccatgtgtggtgtcgtgtcagcgttagacatatatagtggttgccctttagcatatgcaacagtgcgtttggaaagcaaacatcgagcagctaacattaattaaccggccggaatatatatattgaggtcgttgtacacagtggtagttaattaattagtccatccaaggaaggagtatatgattaactgtacactagctagcacagtactccctccgtcccaaaataactatagtcatagttttccgcgtccaactttaattattcgtcttatttaaaaaaattaaaaaaaattagtcaagagtaaagtactattcatgttttatcaccttataacaacaaaaatactaattataaaaaaatttcaaataagacgaacgattaaagttggacgcggaaactcatggttgcccttaatttaacttgggacggaggtagtagtaactgaaaggtacagacagacagacaaacagcagtggtcgccatctaccatagcttagtactactcccaagagattaacagcggtgatgattgatcagttgaaaattaatgagcatgcaaatgaggagaaatatggaaattccgaccgagtcgtgcgctggttgcatccatccttttcgcacaaggccggccggctggctttcctcttattctttcagcctgtccgtcgtctatctgtctgcaggttatctgcgtcgtcgtctgtcatctcctcctcatcttcttgctctgctctgcttctttcctccagatactgttcctcctgcagaagcagaagcagaaggagaaggagaattgaaagcaagaaattaagtgagaggagaagaagaggaggtaggata

SEQ ID NO: 15449 - DNA, 1501 bp, Oryza sativa
aattctgcgaaacctgtagcttgtcctgtgtataaacaacgagaatatcatctgtttttcgttccaatttccaagtatcaacttctacctcgaccaggagtaatacagattctgaagtttataaacacatctctgcctgaacaagatggacacctactgttttcagttcaccatttgatctttaccagataaacctgaagttcaaaccgtgcagcactgcatccatgtttcccaagatagaatgacgcgtacacaaacttccagcgtgtcgagggcgaggtcaacggcggcgccgcaccgcgtgtgccagcaaccccgggcgccgcaccccgggagcggcccgctcttgggcgccgccaccgacgcctgcctgctgtacagaaactgcagcacgagcacgagcaccagcaccttgtaccgcaccagccgcggcaaccccctagcctccgccgccgcgcccaccttcttccccgacgcctaggacgacgacgacgacagtgccacgacctcctcctcggcaccgccgccgcccacctctgccgcgtgccccccgcagcaccaccctccccggtggcgccgccgcgccactatgttcgttgccggccggcttgcaacaggagaaaagagtgagagagagaagaggaagggaggatgctgacggcggcgttgcctccgccggcgcgacgccggctgccggacctcctcctctcccctccccccggcggcctcttcccccacagcgctgcccgtcgccggctgagaaaagtgagagagagagagagaaagggagaagaggggaaataagagggaagagatgaggtggcgtgggtttcacgtgggtcccacgctgactcgtccgccacatagtacaaatccggcattaaaaacgccgaaggatgtcgggtgaccgattttgtatagttaagggactccgcatatctgcatatctggttttgcggtttgaggatgatttcgctgacaagttgagggaccttcggtgtacttcttcctaacacaaacatattggatcgtaacatctgttctcctcaaggcctactcacgatgacgggctgaattttctgggccacagcgtaatgaatggcccaagtaaattctagggcctagaagggatcgggaggacgccctggcccagctagcctttccgcccctcctacacatcgacaaagctatcgatcaggattcaggagaagcctgccagccatcagccgcctctgcctccggcctcctgcagtctgcagatgaacaacaagctaggctgccacagccggtgatggtgagggtgaaagaagaagatgactcaaaatgttatgttgtccaacacgctgcctgtatgtgtgttgtccaactcgcatccttagctgttagttgactggcatgtgctctcctttgtaatttagtaattttaatttcacttttttcttgtgtaagttaatgatataattcaggagtataagcattcacatccaacagagtcgagaat

SEQ ID NO: 15450 - DNA, 1501 bp, Oryza sativa
tgattcactttcagagtttctaaaactaggaatcctttgctgtacagcaactcatgtttccaaagtgaaccctttgctgtactacatcacatcattattgccttcatcttttccattcaaggaggaataaaatggctggctggcaagtctcagcttcaatctaggacttgcgttcggagtgcctattcagattcgaacttgtgtgattgatgtccatcttttcccttttttggaggttgagacctttttgttgttgagttgacgaaagcccccaggaggtgtcaacaaagattgggtcaattgggcatgattcggttcacttttatgtgtgtttgggccttgtaaagattgcagcccagcaacaaagcaggttcttgacaagatgtaaattagtatatgtagcgtgaatttgtgctgttatatgatgcgatggcatcattccatcatgcccatcgtgtgttgttatactcaatcagcgactacacataggagtacgtacatacagatacagatacaggtgaggagtgagaggctgggggagcaaaggcattcagaagagtagtagcgttgttaagatgacgagaattgtaacaaaaccatgcaaacattgaaaccttggagtgcagtcttagagtcttgagcacagaagaacatctgcaatcgaactacaaagaaacattcgagatttgcagtctctatcagtcacaaataggggtgtctagtacaggttaacctaacctaaacctttcttggtcctggtccacatcacgattgttaaagaaagggcagtattattagtagttgtatagtagtaatacatacagaggaacagtagtagtgtagtatattatagtgataataaaagaagcaaagcaggagacgcagcctagttaatcccagtcataattcattagcactgagtgggcagatctactcaactgcctagggagtggtaaaaccgtaaaaaaaaaaacggcagagggattcagaatagcatagcagttactatgacagtagtaattcagattagcaggagtaacaattggattagcaaggactcctccagtccagactccagagagaggagaagaaatcggggagagagattaattagggaagtactccactccctccagtggactactggagttgagcggtgcggtgctgtgctttatctagggagccggagggagctctctctctctacttacacacacaaacacacagagagagaccaaaagcaaaccctcgcctcgcctcgcctctctcaaccatcgtcttccaccgccgccgccgccaccgaacgaacgcgccgaccgaccgcgcgaagatctgggcagctgggacgagacatagggagtataacggaggaactgaagaaggagacaaacgccggatttaactccacggaacgggaacacattgctgctgctaccattcaagcttggactccggtctcctcctcctcctagggtagggtggtaagggagaaaattgcaga

SEQ ID NO: 15451 - DNA, 1501 bp, Oryza sativa
gagagagagagagagagagagagagagagagagagctcgaagcttttcccaaataactttgccacagtgcctcctgcttcccccctgtgcttgcagacttgcagcgcagagctcagcgtagcgtgctctcgcctccacactccacaccacaccacagtcgcctctctcctctttcaccgagaagcgaagcgagagagagactggcaccgccgcaagaagccaaccggcgggggagggagaagcagagcaagcggcagaaagaagaatcattggttaggctctgcagaggagaggcggcactgcactggaggtgagaggctgagaacgagaggtagaagaagaatcgggagaaggatcgtcttcacgggaggagcaaggaggggataattaggctcggattgccattaggctgaggggggattcgcgaggcttgtgttgagaggcttgagaggtgtgtgctcgcgtccctctgcttcttcttcttcttctccatcttactgtattctttatgctgcttctagatttgtctcttgtatctgtgatgttgatggagttcgtcagaaatgtcccttcttttcttctcttcctcccatgatttcttcgagcagcatctttctatattctgttctgtttttcccccctctgaagtacgttttggaactatgatgattccataacaagttgctagtcgaagattgcttgttactctatcgatcaatggcagttctgcagctgctgcttaaaatgggttcttttgctcaagatttgattgtgctttctccttctgtatctctgttggtatatagttctgggacaggtccactttgattctatcatgggactcctatttgattgtgtttgaggtcctcactggatctgctcacaccttacttgtactcgtatagtatcccattcggattgaattaaatgcatttcctagaaaaaaaattgctctacttagtccttgctccttgcagcctccatttcgagtacacctctatttattcgatgcttgacttcattccaagcagtattgttgggcagctaggtgtacttgtcttctcctttctgcactcaaaatgttgtagttaatggcacctttcgtgctcattgagtttggtatgctttttatggttcagcaaaatgggagtagcaaattgttgtgctttggtttcaattccagtgacaatttccagccatattactagttagcatttactgacaaaatgcattggtttcgtgttcactgtgagccatcaaaacggtttgtgctaccgacatgttagcctggattgagtttcactgtaaagttgcaacctttattacatttggttgttggtgatttcattttcgttaggactacccaggttgtcgactattaactcattagacttttgtcactttcaagttctaataattctttgaagtcctctgtatgattactgtgatttctgaattgtgcttaacatttgcaggtaatgtgctttagagtcgacagcaa

SEQ ID NO: 15452 - DNA, 1501 bp, Oryza sativa
ttacacgacatcttggtcgttttcatccattaaaagaatgttcctcctatatacccggaaatcttagtatattacgagcacctcgtgtgacacgtctataaccacacactgatatgaaatctgaaacatcaatatgtctcaatgagttcatgactaatcatatcttgatttatgttagtagatatctcattgttcataactagaagatttagatttaatatggtgtttggacttataagagttttatgaatgtaattagcatatgtgaagattgaaaatagacaattaggaacattagaacaccctacaagtgcatctggcccctaagtgggttttgagtgattaacgaaatgtaattagagatctgattgtttcatgaagtaaaagtgcattgttatagtcccgaaaagtttttgagatgaaaaaaacctccaccggcatttaaatttttgcaacttttaagatgtggcaattaaggatttgtcactcacaatttatgacatgtgggccctcgtgtgtatatgacatgtggctccagtgacaaatccttaattgccacttgtaagagtggcaaattgttaaatatctcacgcaattgtggatctctatgatgtgaaaaacagagtcataggattatcatactattaagagaggttcttaatcttagccaaagttcgtatcatgtgctcaattccaatcctttgatatttatcgagagacattaggcaccgcactcacaagggaaaatgagtgattttcttaagtttcgtcggagcgtgtctggtcaaaatgtttggaatctatgttcaaaacatgccgtctcacacttctatgtttttcctaccctgcgtttcaaaaagaccttactatgtgaggttgatacttgagctgataacgaatgattcatatataatgtcaatcactttatattgcaatgtagattgggttgaatgcatgtggtacacaatgacattgtagctctagagcttaagcatcaatgctatgcttgcaaattaaaccaaacatcagtaaacagaatcagaaacctgaacacaagcaaaccaaatcatgaaatcatgatcactgcgccgtacttggcgacgaacgcggcaatgttggcgtcggagctgccagttaagtgtaatacaagctatgtaatgttgatgagtccaaccaacctttccacaactgaatcttgcaagggagtctggtaactggcatttcccaagatgacagacaaaactatcatttattcattttgacaaacgatttcaaattcgacactcagatgacacggaaaattcaggaattctcagctgttaaagctagctcagagtattatgtaccagtagcacaatatgtactacctccggccccaaatatatatttgtccagattcatagctaaatcttgttatattttgggacaaagggagtatcattcgggaacatgcaaggaaaaaagggtaacagagggtgcagacacacacaaaatttttcag

SEQ ID NO: 15453 - DNA, 1501 bp, Oryza sativa; identical to SEQ ID NO: 15451

SEQ ID NO: 15454 - DNA, 1501 bp, Oryza sativa
aattcaatgtgggaatttgcttgaatatatatattttaaaaaaatcatgagttacaattaggatttttgtgtacataatataattaaattaaaattttgaattaaaaactagttcattataagattttataatcatcaaaaaattgttgaagaaagaggtgctatagttttgatttttcatcaaccggatgtgcatgttccgtgctagtggtcgaggaaaaaaaaatttgcgcgcaaatatgatttgacaggagggagggaaagtagacttattccaggagaggcccacatatacacagtgcaagtaatatatgtgtaaaaaggagagaggtgattacatggaagatacatatactatatcaaccgcggttttgacccgacaattaaacagatcacccgaaatccttacgtatttttttattaggtatagaggtatagattagaattagaattaaataacatgttattattaaaataaaatactgaatatattttttattaaattcttcacgaatgaaccatactatctagacttgttttgaatttttcaaagctcaattgctaattttaataatacaaatataattttaataattaatttaaagtaaaaacaaactaaaaaccctctcctaattctgggccaaatctggcccattcttccttctcctccctcttgggctgccatccctccctcttgggccgtcatccctatctctacttgggcccagcagccacctctcttcctttcctcctcctcgggccaccatcctcgggcccaacagccatgccaacccatgaaaagaagcggatgggaataaaaccgaaaaagacgacgaaaaaaaaaacggcgaaaagaatacgcacggacgaaaaaaaattgtcggaacccttatgtattttttaattaggtatagatataaatatagatatagatttgtaatgcaataaatttggattttttagcaagatttacagatattgccattataaagtatatattgcgttattaacgttagttggaatgtaatactaaaatatagaagaaagtgaaaaaggaatatggggagaggattttttttttctggatagccatccaattggatggaaaatataacggatcaaatttagatttgcggctaggaatgctcctatataaccccaccctccacctcgtgtgcaccgtgggctgaatccgcagcctgcactcgaggtacgtacgcgggcgcatgcgtccacgggctttcttccttcctacacctctcctgtaatagcattgggtcctcgttttgctatgcatcgtcgagtcctttcttggcatcgatgatctggatcgggatatcgtatataggtagtagcttgatattgtagtcaaattcgagctgtggtggtatcgatggtccatgtcaacgatcttgttgatttagtcatctctagcatcgatctatccatgagcaaatatttctttcctgtgtgaggcatttcctgatatgatcgaatcatt

SEQ ID NO: 15455 - DNA, 1501 bp, Oryza sativa
acaaacgatcgcgcggttcccgcgggtcgcgagccgcgcgaggagccacgtgatctgagctaccgctgcctgcggcgcccgcgccgaaaaatccaccgagtctctcatcaagcaaaatcgcggtggtttggcacgcaaaacctctcacgtcgtcgtcctcgacaccaaacgcgatcccatcttaccagtagtcccagtacacgagtactaagggggtgtttagatggggctaaaactttttagcccatgtcacattggatgtttggacgctaatttggagtattaaacatagactagtaaaaaaattaatttttataaatgagagctaatccgcgagacgaattttttaagcctaattaatccataattatcaaaagtttactgtagcatcacattgtcaaaatcatgacgtaattagactcaaaagattcgtctcgcgaattagtccaaggttatggaatgggttttgtaattagtgtatgtttaatactctaaattagtgtctaaacatccgatgtgacagggacttgaagtaagtccctagaaaccaaacaggccctaatcctgtactatgagctaaccttagccagtgaactaacgagacctccattgatcatcctagtagtactagacggtagccctggtacaaaagtcccggcaccaagggcattacttctaagttacagagcgtgtctacctgtccaacgcatttatatatactctctctacgacgaacccgggcggtgtacgtgcacgtacatatacgttgcatactgctgcccactaaggccagtagacggtcgactctctccaagcgtcgtcttatatatacaggcagcagtacacccctagctagctactgcttgcaagtaacaattcaccgtcaagcgtcaaagttgtatccaacctcttccgtatagcagcgaccggaggagtcctcctcgcagagagtcgcagtcttcaattcgtacgtgctttagcattgtaagatttgggtagtattagtagtaccagttcttaatgcacggcgacgaaactacactcgcattggttatcctagcgccgagacacagtacagcttaaatgcgatagcccaagaacagatgaatggtagtagtaccaagagcttgagttattgctcctcgttaaggcaagcttaacaattgcagcgtttagtctgaactttttctttcttttttgcagtactgcagatatatgcagtgtgctgctacagtgtagagtagcaggtacgagctgccctagatgccaacggcaggtaattaatgctaagtaccaagctggcaagctgccctaacggaaaattactgtattggttaattctccatcacgtcaatgagtacagtaaccgcatgctaccggccatgcatagatatgctcctgcagagtcctaatctactcctcccgatgatatctccccgcatattaatcatctccaatgtccagctgagcgtgcaacgcaacaggctgtagttaacgaccg

SEQ ID NO: 15456 - DNA, 1501 bp, Oryza sativa
ccctttcttctctctttttcctccagtcccctctcttggtaggcatggtcctccttttatatctcaaggggataccacatacaccatttctacctacccttcttttgggtggggacccatcctactttgaccaaaacttggctcgtaccttcgcctgacaccgggataaccctgtccttccttcattaatgggcggagatttgcaatggctgctgtccgaatgaccctccgatgggatgggtcataccaacctccactccgccggaagcaggtgcaacgtgggagcacggttatttgctgatgacgtgaccggcgtcagaccagtcacaaaccggtcattcttgtctaccacgcgtcagtttagcatgccacacgtcagcccttcttcataaaatgacttccttgtaatggttgcgatgaagcctggtatgaatctagccgagaccgatgtgctaactccaggagttcccacgccggctccgtctagggacgagtgcctagaggctctcatcattccgacgggacggagcgaggcgtgcgacaggccgcctgttgccacctaacccgcgatctgaccggtctgtgaccggtcacataccgcgactggtcacagaccggataagcatgcgctgcgccgcattgaatgcggcgtgacgcgctcgtctaacccgctataaatgtggttaggtgagggccgctttgctcacctaacccacacacgtggcgccgacgccacagggggtcggggcgccccagccctcggggccgaaacgggagcggcccgacccctcggggagacagagggaggggtggccatgtcaccgttgggcccgacccccccgagggggtcgggccacgtgagtgatcgcggctacccaagcctctagtcacgatacccctggccccatgtcaccgacagtagccgccggcgtcacgctagggcgaccgcccccctcgagggaggcgatcgggcgagatgccactccttaggcccggtgacaggtggggccggtccccacaggcgggcagaaacccaacggtcgcaaatcgcgcgcatcggcaagggagaaaccgatcgacaataatgagcggcctcttcaagaccgctacattacttgagtagcgcgcgaatcgggacgaaccggttcgtttcgcctagagatgtgatgatggtgcatcggtcggcgagcgtagttaacgcgcgcacgatatgtcccatctcgactgccacggccgcacatccgcctcgtgcgccgcaaacgggcgaacgggattagtggaggagtgggcgcgagaaacgagggggcgagatagtgggcgcgggaagcgaggagccgggcatagcgttggcaagggtataaagacgccgaggaagagattcgtttccttcctcttcgccattattccccttgccttcgccgcttgcgctctaacttctcgtttcctgtgccctaccctcgccgcactcactcgctctcaaacccctcctccgccggtgtca

SEQ ID NO: 15457 - DNA, 1501 bp, Oryza sativa
gaggccgctcattattgtcgatcggtttctcccttgccgatgcgcgcgatttgcgaccgttgggtttctgcccgcctgtggggaccggccccacctgtcaccgggcctaaggagtggcatctcgcccgatcgcctccctcgaggggggcggtcgccctagcgtgacgccggcggctactgtcggtgacatggggccaggggtatcgtgactagaggcttgggtagccgcgatcactcacgtggcccgaccccctcgggggggtcgggcccaacggtgacatggccacccctccctctgtctccccgaggggtcgggccgctcccgtttcggccccgagggctggggcgccccgaccccctgtggcgtcggcgccacgtgtgtgggttaggtgagcaaagcggccctcacctaaccacatttatagcgggttagacgagcgcgtcacgccgcattcaatgcggcgcagcgcatgcttatccggtctgtgaccagtcgcggtatgtgaccggtcacagaccggtcagatcgcgggttaggtggcaacaggcggcctgtcgcacgcctcgctccgtcccgtcggaatgatgagagcctctaggcactcgtccctagacggagccggcgtgggaactcctggagttagcacatcggtctcggctagattcataccaggcttcatcgcaaccattacaaggaagtcattttatgaagaagggctgacgtgtggcatgctaaactgacgcgtggtagacaagaatgaccggtttgtgactggtctgacgccggtcacgtcatcagcaaataaccgtgctcccacgttgcacctgcttccggcggagtggaggttggtatgacccatcccatcggagggtcattcggacagcagccattgcaaatctccgcccattaatgaaggaaggacagggttatcccggtgtcaggcgaaggtacgagccaagttttggtcaaagtaggatgggtccccacccaaaagaagggtaggtagaaatggtgtatgtggtatccccttgagatataaaaggaggaccatgcctaccaagagaggggactggaggaaaaagagagaagaaagggagaagaaaagaaggagagctcgtaaaaggaagagcggagctcgtagaggagagaaagagtgagagggtctctctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacaaatcgagggcttagaatctcacctagcgcccccggccgaaccggcaaaggggggcccgcgcggtctcccggtgaggagccccacgctccgtcatctggcgcgccaggtagggggcatgtgtgtttttctaagctctcgtcctctttcgtgtgcgccaagcttttcccgctcagcccaa

SEQ ID NO: 15458 - DNA, 1501 bp, Oryza sativa
aacctgcaacgtttggcaccgttcgaacgtgacaccgtcgatctgtcagttactctcggtgtcaccgtcaagaaactacggtgaagttggaatttttttccatttttaaattttttatttttaatatttatagaaatattgtaccggcgaaaatttttacaaaagtataccctgccgagggcggcagtgtgacatgagggacgaacaagataaaaaaaacctagaaaaatgcatctttggtagggcgaaaattgcatttgcccctttacagcccttgcagaggacggcaagggacctcagtgcaaaatgcgcacaccttgccgtccttcacttgggcgacagaggccatttctgtaaatattttggatggtataatatttttgtaaatattaaaaaataaaaattttaaaatgaaaaaaattcggtgaagttgatgtgacatcgatgggccgaagacgagacggttttctgagccaggcctactactgggcgaattctggagaacggcccactggagtactctctgtctctctcccactggacagaccgggctcaacgcagacacggaacggagccagccatggtgaggtcggggcaggcgtcatgtgcccctgacacctgggcccccccgcgacatcatcctccagtcacgtcgtcctcctccacctcgggtccccaaccttttcaaccacacccacccaacacgccatgatgagggcagcagacaagtgggtcccaccaaacagtgtcgacgggtagatgcggctagcagccgtaacaatccgggcccaccttatcaccaacgcggagtcacccgagcccacatcgcgtgacctcactgacatgtggggcccagacggttaactgccggtgggaccacggaaacagagagggcgggggagaggtggggccaaggctccacctgtgcgtggaaaccttttggactgctttggtgtgcccagctttttatgggggcaggagcgcgtccggaaatagaaacatctcgccgaatttgaactccacctgagcacaggagaagccgcagccactgaggtaaactgctcctcctcgccgatttcccccctcctttttctctaataccaaattactcgagaaattgtgttggttcggtccgcgggtagcgtgattcggccagatctggcgtctgtgtgtgtggagaattcgagggttttgtttgggtttgtggggggagtaaatccggacgaatctgtggtggtttgggggggaattcggtgtgtgtttgagttgatttgagttcgtggatgattccgttggatattgataggtcctagttctgatccagaagtggcggctacgcctttgctgtagcctcaccgatccgccgccgccgccgccatgaagttccgctctgattcgtcaggcggcgacgagccccgcgctccggctgccggcgacggcggcggcggcggcgacgagccggccaagaggcagcggaccgatccgtcctccagttcgagcc

SEQ ID NO: 15459 - DNA, 1501 bp, Oryza sativa
tccctttcttctctctttttcctccagtcccctctcttggtaggcatggtcctccttttatatctcaaggggataccacatacaccatttctacctacccttcttttgggtggggacccatcctactttgaccaaaacttggctcgtaccttcgcctgacaccgggataaccctgtccttccttcattaatgggcggagatttgcaatggctgctgtccgaatgaccctccgatgggatgggtcataccaacctccactccgccggaagcaggtgcaacgtgggagcacggttatttgctgatgacgtgaccggcgtcagaccagtcacaaaccggtcattcttgtctaccacgcgtcagtttagcatgccacacgtcagcccttcttcataaaatgacttccttgtaatggttgcgatgaagcctggtatgaatctagccgagaccgatgtgctaactccaggagttcccacgccggctccgtctagggacgagtgcctagaggctctcatcattccgacgggacggagcgaggcgtgcgacaggccgcctgttgccacctaacccgcgatctgaccggtctgtgaccggtcacataccgcgactggtcacagaccggataagcatgcgctgcgccgcattgaatgcggcgtgacgcgctcgtctaacccgctataaatgtggttaggtgagggccgctttgctcacctaacccacacacgtggcgccgacgccacagggggtcggggcgccccagccctcggggccgaaacgggagcggccgacccctcggggagacagagggaggggtggccatgtcaccgttgggcccgacccccccgagggggtcgggccacgtgagtgatcgcggctacccaagcctctagtcacgatacccctggccccatgtcaccgacagtagccgccggcgtcacgctagggcgaccgcccccctcgagggaggcgatcgggcgagatgccactccttaggcccggtgacaggtggggccggtccccacaggcgggcagaaacccaacggtcgcaaatcgcgcgcatcggcaagggagaaaccgatcgacaataatgagcgggctcttcaagaccgctacattacttgagtagcgcgcgaatcgggacgaaccggttcgtttcgcctagagatgtgatgatggtgcatcggtcggcgagcgtagttaacgcgcgcacgatatgtcccatctcgactgccacggccgcacatccgcctcgtgcgccgcaaacgggcgaacgggattagtggaggagtgggcgcgagaaacgagggggcgagatagtgggcgcgggaagcgaggagccgggcatagcgttggcaagggtataaagacgccgaggaagagattcgtttccttcctcttcgccattattccccttgccttcgccgcttgcgctctaacttctcgtttcctgtgccctaccctcgccgcactcactcgctctcaaacccctcctccgccggtgtca

SEQ ID NO: 15460 - DNA, 1501 bp, Oryza sativa
atatatagtttcggcccccttaactgacaagtaatagccctactcatattagccaaatccagagttacctttatatatcaatatctcattagtacaataattggatgacttaatccaatccttgttagcatagcggcattgcacccttacatgcagccaacagctagtgtagtctttttcttcgaatgtgaactcggtgagattggaggtagctctagatccctcatgtttgcctttgtagcttcagattggatttgtctaggcttgttctggtgtatatatgttggcttgtcttggattctctaaatctgtattggcttgtgtagatttgttctagatctatcttctggcttgccatctctcatctccttctagggggtcatgtatttataccctcaggtgcccccttgtccaaatagaactagagagacaaagtatgaatatgatccgagtagtccttatagtgcccgagtagaactttacttccccttccttatccaaaatatcttccgtatataatgtatgattccgtatagaactgggtatatggtgggtcccgcagagactaacccaagattattgggtatgacttatttataacattaacagacgggtacacgtaatctatcccttattaatttagggcagacatataatctcgtactaggatgtgacacatcgtaatacaacgaatctggacatacaatattggcttttttcgggatgtacgaagggagtatatactattatactgtcatatgtctagattagatcagccatggaattaatttatatgagaaattttataatttttaatactaagaggtactaaattttttagtgatttattacaatacctcgactggaaggtacaacattttagtgtaaaatttgatacctctcgctacctctaattttaaaaggtaccaatgttagtataaaaaaaaattagtaccggcctcttattacctcccaatgatagtaaaatttctcaaaatttttaatacgaattttggtatctattagtaccgaatggtataaagagatatcaaattatacacctaaaatcactctacttatatataagtactgattaaggcatttaagcggaacagaagctagattgattagtttgttcagcggtgatcagtactgatcaagggtgatcagcctccttttccagtatcaggctctgtacgcgtacataatgattaatgcattttttttctgcctccaaagtagctggcaaaccggcgatcgatctgtgtgctgcaggcagcagctgagtaggccgaaaagaaatactctcccgccacccttcccttgagccacgaagccaccaggaagaagaagaagcattaatatacaaataatgagcaaactattaaggaatataaggagcaataattaatgtagtcttatctttaaactaattttctagtgatagtctttctggggaacgcatctcagccactggaaagaacgaggaacgtacatctca

SEQ ID NO: 15461 - DNA, 1501 bp, Oryza sativa
ctagtacgagattatatgtctgccctaaattaataagggatagattacgtgtacccgtctgttaatgttataaataagtcatacccaataatcttgggttagtctctgcgggacccaccatatacccagttctatacggaatcatacattatatacggaagatattttggataaggaaggggaagtaaagttctactcgggcactataaggactactcggatcatattcatactttgtctctctagttctatttggacaagggggcacctgagggtataaatacatgaccccctagaaggagatgagagatggcaagccagaagatagatctagaacaaatctacacaagccaatacagatttagagaatccaagacaagccaacatatatacaccagaacaagcctagacaaatccaatctgaagctacaaaggcaaacatgagggatctagagctacctccaatctcaccgagttcacattcgaagaaaaagactacactagctgttggctgcatgtaagggtgcaatgccgctatgctaacaaggattggattaagtcatccaattattgtactaatgagatattgatatataaaggtaactctggatttggctaatatgagtagggctattacttgtcagttaagggggccgaaactatatataaattcttgcctattgtctcttttaccctaatatcgcgtacaccctgataccgacgaacaccataccctacaaataccgtagtcacgatatagcctatcgacatcgtcaaaattgttacttccttcatcttaaaatataaacttttagttatctaaacaactatatatctaaatttataactaaaagttgcttataatattataggacggcagtaatactaccaacaaaagcacccatgcgctagtctatgactagggatcatcggttggcctaataagccaaagccaaatttaaattttttatcttaattttgaagctaattttaagatatttttaattttttatattggtatttaaattttatatataaattaatttttattttttaataaaccgttttgatttattagaaaatgtggacaaccggccgtagaaccccgtggtatgtcgcttcgtccagaactatccagacctcccatatgcatgatcatggagctagttaaacgcatacacagaatacaaaaagaagcgacacacactacgtacataattaaattggatttacgaatccaccaggggccgcaaaacggaaggttcgaagctaggcagcgcgcctaactatttatggttgcaatttgcaacatagtttatccttaactttaatcctacattgtaaaagagctgtcctacgtgcatggtggcatctataaaatgttcgacattttgtgtaaagaaattgagaagtggaagtggcgatcgaatttggataccccactttgatctcttctcatatcattggacaacggtatgtacgtacaccgatcatatcgaac

SEQ ID NO: 15462 - DNA, 1501 bp, Oryza sativa
tttgttttattcgggagacatttcctggttcaattctcttctcattttctttacggagaaagtgagagctttcttactcaattaaagatgctttcgttcaccaagaattaaagattcaattaatggccggtggaatatcacccaaattaactatttaaccaaaccgctaatccagctgaggaattttttttttagaatgggaaatcgcaaaaatatagatcggttaggcaaaatcgtaagtttagcaccctgtcaaacaaccgtggtttgacggggacctatcaaactgcaacagttcaatagggtagttggtcaaaataaaaaataaaaaaagtacataaacagtgacgctacagtgattggtaggggcatgtcgaactacccatgttcgatatgtttgatgaacagtgccactacagtgataattctcttttttaaaatttttttatcacctcgacaagtaccatgtcgaagatagataccctgtcgaacaaccgacctatatttttgtgattttcgtctaaccgacctatatttttgtgattttacttaaaatcgtattatttcttaaaataaattctgcagctgagtgctacactgttttgctctctccgcatctttgataaagtcgatgtagcccaattctgtgaagatataaacaacattcacaaaaatagtacgatcaattgttacgaacttacaaactgaatcgcaaaaccaagaacggtgttcagccaacagaaaattaactcggggttttgcaggcggcagcttgcgctgcatcacggaaacatccgattgtgcatcacgcacgggttaattaacaaaactcaacttgtttctaagtagggaaaaacaaactagagaacgaaagaaattaatgtttgtttttgaaaaaaaaaaaagagaacgaaatggaagagattgaagatacatgcatgcatgaatcgttgatagtctgatgaagttggattgaccaaaaaataataattgtcaactcctaactccaacctccactggatgattttttttttttgagccgataatcatttgagttatcatttttctcacctgcactcgagcttatcactttcagctcaccaaaaacccgaaccttgtaacccatttttgtacaccccgatcggaccgtccgatacaccgactgtcctgcatccaacggccgagatcgatcgctctgcaccaatcaaatggagtacaagcgacacgtacccacgtaacatccattaaattacttggagtcttcctcgcagtcaaccgtccataaaaaattttcggctcccgccgtgttcgttgataattggttcggatccccgctgcttcgtcgcaaattaaaagaatctcttgaaaaagatgtgccacccaacgccgcaaccgcaaggtgaattggaattgccctgaaaccggtagtagcatctgtgtgcacgcataatctcagtataaaagcccgcgacatcacgctatatctgctaatctgctctgc

SEQ ID NO: 15463 - DNA, 1501 bp, Oryza sativa
acaccataggtatcagatcatgacatcaactattttatttgaactgtatacatttttctagtaattttgaataatatttaattaaggagaagtgtttatttatgaaccaccatgtgtgatctgcttcatatgagttgtacggagctcgctccatcggcctacggcgagcagcactcgccggaccagtcgcatcagtcctagacacccttgcatgggcagcatggcggcggcggcggtggtttgccatatccaccgcctccgccgtagtacggcgacggtggcgggtcgtagtagtccggtgatggcggcgggtcgtagtagtccggtgagtgcggcgggtcatagtagtccggcgatggcggtgggtcgtagtattcaggggagggcggtgggtcttcgtggtccggcgactccggcggattgtcaccgtcgtcatctgcagcattaattgggagcacgcgttacctacatattaaatgcaaaaacaaatatgtacttcctccgtttcacaatgtaagtcattctattattttctatattcatattggtattaatgaatctagatagatgtatatgtctagattcattaacatcactatgaatatgagaaatgttagaatgacttacatcgtgaaacggagagagtacgtgcctatgttcaagttcatcaaaccgacgagcacaatatataattcatcgatgagccggttcgttaaatttttttttgaaaaaagatgaaattatgcatgcatgtgtgtgtgtgtgtgagaaaaacgatcgaattgattaagaaaatatttcaactccagtatgaaaatcaaactaaattatatgcacgaattaatgaggtacggtgtgtcggtgtgtgctcacgagtttgttcggcagaggcgacgaaagcagcagcgagcaggagagcgaaaacaagcaaagccttggacgacgacgacgaggaggacgacgccatgtattcttttaatttctctcctcacgaagtgaagatatatgtaatcgaaattgctagtttaatttgaactatttcgagtgtgtgatgagaatcgatcgataacgtaactagacgtgtttatataggcaggatgaggcacatacatgtgatctagtactgtatacgtactcttagtagatgacgaaccggtgcttaattttgagcttcttgacgccgtcgatcgaccgattcaaggtaaagaaatatgtactgtaatatactagcaggctaataactgcatgcaagtacttcatatatgcaagtacgcttggcatctaccatacgtacgtgctcgttcgattcaccggaaattaatcgagttgcaaattaagtgaaagtcaatcgttcgatttgatcgatttaaccacaaatggaggtgctcagctacaaaagcaaactcaattatatttgccagggccgtcggccacaaatgtggcaagtttagttaattcatcctcacaatatgtacacatataatttctggatatatatatg

SEQ ID NO: 15464 - DNA, 1501 bp, Oryza sativa
acccagcattactatctcacggccggtggcggattctggcatgaagcggcgcggcagcccagcctgcctctcgctcacaatgcgggaaggcggtagtacgctaccgtcgagcagagcggagccccgtgccatgtcgtcggagaaagagagggttgagaacgagtgtgtgtggcgaaggtgaggcgcagcaaagagagagttaggggcgcaaacggcgaaggaaaggggaatagtggcgaaaaggaagggagcaagtcctttcctcgatagctttatacccttgccatcgctgagcccggctcctcgtttctcgtgcccactatctcgctccctcgttactcgctatctcgctccctcgtttctcgcgcccacgcttccactaaattccattcgcccgcttgcggcgcataaggtagatatgcggttgtggcagtcgagatagatcgtatcgtgtgtgcgttaattacgctcgctgaccgaagcgacgttaccatatctccagacgaaacgaatctacacgcccagattcgagcgctgctcaagtgatgtggcagtcttgaagagaccgcccatgactgacggccaagacaccgttaccgatatgcgtggtttgagaccgttgggtttctgcccaatcacggagaccggtcccacctgtcaccaggctttatgagtggcgtcatgcccgaccgcttcccttgagaaggatgattgccctgacataacgccgggggctactgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcctgccccgaccccgagggccgaggtgccccgaccccctgtggggtttgcactatgtacataggttgggtgaacacggtagggctcacctaaccgcatttattgcggtctggtcaagcgtgtcacgttgcatgcagcgcaatgcagcgcgctcttttatccggtctgtgaccagtcacagaccggtcggatcaacggttaggtggcgactggtggtctgaggcacgcctcgccccgtcccgtcaagacgagagcctttaggcacacgtctccagccggagctagcgtgttacctcttagagatggcacgttagccctggttagatgaataccaggcttcatcccaaccattacaggcaagatgctacaaaaagaagggtgatcatgcagatcgctgaactgacgcatagaggacaagaatgaccgatctgtgaccggtctgacactggtcgcgtcagcaacagacagccacgatcccacgttgcgcctgtctccgccgggagtggaggtaggtgtgggttgtcccatcgaaatgtcattcggacggcaaccataccaatctccgtccataaagagaagaaaagtccagtttggaaaggaaagggtacatgtggtat

SEQ ID NO: 15465 - DNA, 1501 bp, Oryza sativa
cagaaaatacaaaaatgtatagattctagcaaggaaataaagcccaaatgatctcaagttggtgaagctatgaagcccaaataatgaacaggcagactgctaacttgccaataactgagagcaaaccaaaacatgcatgtttttacaactaaaagagtaatgattagacaaatcggaggtgctagctgcattagtacttccaataacaaaatttattagatctaaatagagtacttgtggtaaaaataatacataaaaaatatataaaattacttgtggtaatttaataaaaaatttattaaattacttaaattttttgaataagacgaacggacaaacatttttaaaaaagctaacggcgtcaaacattttaggatggaggtagtagcttcgttcagaaaaaaaggaaaagaaaatggaaaaagttaatcccagaaccaatcatggagaggtagaaatgggccaacgaactttcctcaccgaggaacgaaggaagctggtgtctagcgacggtggcgttgtgccctgtgatggtgtccgcgttgtgtccagtagagatggtggaacgccttgcagaggtggcgctacagccggcgtccaggcgtatggcgacggcggcgctacagggcgacgacggcagcgctacgttcgatgttcgcagcgctgacgctgggagccgcgaatcgagccccagccgagaaccacggaggcaatacgcagcgcagatgattaccaggatgaaacaatgaatcgattgtgtagttctttgatcgcatctgggagttatcagaccgtatcagggacgtatcctgctttttttctttttcggaaaatcgcgaaattggctgatacgtacggatccgatacgtatccgtatcctattacgtatccgatatggatacgtggttttttaccgtatctaaatatcatagattttaatttcaatcaaattttcaattttaacgtgaactaaacacaccgacatgcagcacttcaaacttcctagcggtgaacattcaatacaccgcaacaaaaaaacggcagcttcacactttcacatccagcgagacctgctatagcgagcgagtgaacaactgaaaagctgacagcccaccaccactccaccagtggaccagcaaccaaatcctcacatcctgaggggcttacccgcataaatcccctcctctgtacgcgtgcgctccgttccgtttcgccatttccaacccgtcgtctcgccttcgcctcgcctcgtctgctccaccatccaccaccaccacgctacgctttcctcctccccctccactccagattttgctcccctcgagaccaccaccaaaagcagcagcaccaccgaaagaggaagcaaagcaaagcaaagcaggcgaggtttcagtctcccaggaatccccttccaagaactcccacccgattcgaagcgctcgaggaggttctttgctcaatcagagtggatcttctgctgggaggattgggaagagcgggg

SEQ ID NO: 15466 - DNA, 1501 bp, Oryza sativa
tataaaaaacccaatcctaccaacgaacctagacacatgttcattgctagggttggctttttttttgacagagtagtagtagattgtgacgcactttaatgagttaaatcttttgaaactcgtcgaactacagattcaaattgaagctgatcattttagttttgtttccgccacttctccccggagctactattagatggtgtttgaatctcctgaagatgaatatgaagataaagtgtttcatgcaaaacgaggtggtaattacgtgtgattaattgagttttaattattacaaacttgaaatttgtattaatctgatactttagaacaacttttatatagaaagttttcgcacaaaatgcaccgtttagcagtttgaaaagcatgtcacttttatctaaaagtttatccaacttttgttggagaaaagaatagggccgtagcccatggtgtaccacttccgtttttaaatatatatcgtcgctaatttttatgatgatatttgactatttatcttattaagaaaattataaaaatgctatttgtttttattgtgacttgtgtcgaagtttgatgtcgcgattccggtatttgcatggtatggggatcgttggtactagggtatacgcgagactgaggtaaaagagatagagacgaggatttttatacaggttcgggcccctgaattgtcagctaatagccctacatcctgttggccgaagccggtattgatcttattcaccataatcataccagtacaatatttggggtagcctatctaactgttgtcgacatggcggtctgaaggtctgactcgtagtcgacaacagggtagtcttcctcctcgaatctgtgcccggcgagatcagagatagcgctttcgtttctcttgacagtatccggagacaccgtaggggactagccgtgcttatccctgaagccgatatccggcgtcttgtcttggcgtatgttggcttgtattggctttgtggtgtctatgttgcccgtgtctgttgattgtggtgtcgattgaggtggttgtgtcccctctcctcctagggggcattgtatttatacccataggtatcccctgtccaagtagaattagggaaaccaatatggatacaatctgagtagtacttgtcgtttccatgtagaactctgattgtcttcccttatccggaactccttctatattcgcaggttgtttccgtataggatatggtatgtggtgggtcctgccgagatttagtcaactactattaggtatatggtatccataaccctgacaacttgtattattataaaaaaaactccagccttaacttatattttttttacatatttacaatatatttttgaataagacgaatgatcgaacgttatgtgaaaaatgacatcgtatataaaaaatgaggtagtactattttaaccaaaaaagaaactcccgtcatttcatattataatacactttgatcaaattttttaagttcgatcaagt

SEQ ID NO: 15467 - DNA, 1501 bp, Oryza sativa
ttaccttacccctgtgctctcctctgcttaccttacctctgtgctcagcttgtagctcatgatacctccttgtttgcagctcgaaggagtcctcgctgcaaagtcttcaagagacggcgacatcagttttcgcaaagaaatctgaacctccctctgaacctccaagtaacaagaaaatggctaatacaccttccttggctgcccctaccgtaagccctttggcgaggttccttcttacaaggtttgtttagagaaattgtttcccttttcttattattgctttcccacaacaaagagtgagttgatgccattggtgcaggtggcaaaaccaagtttcccaagatcttaactccgtctgaagacaatacaaaaaaaaaaaaacccgtcatgattcaatgtataattaattttgagtgtacataacgctatggttagaaatctctttgttgctagctgttctcagcagcttgtgctgctaccggttgtttcatttgtttgtgttcgcggtgaataacacattttctacccattttataatgtaactttgcacccactgtacctgtatatcacctgaggaacattaataacacatcaatttttttccattttctgatgcccgagaatttatgaattaatctggcctcctatatctgttcggccctgtttaataggcaacaggctggcaagaaccggaatatttgtgtcacgctttgaaaactattattcctccaaaaagaaattatttaaactttttccaatttaacttgttactccctctcctaaaatataaggcatgtaagatttttattctccaatgtaaaacttttatcatatagaagagatagaaagatgaatctaatgtatttttgtacaattaagtagatatatggcacattcgttgtctttgaatgtcacatttatgttaggccgcacttatattaggacgaagaggagataatttatttaaacagaccaaacttaagattcttcttctcagctataagaataatatttgatttgattgagaatgtttttaccgaaatgagaatgtgagctgactccagtttgagataatgtagaacatgacaggtaggagtagtaattagtaagactcgcctctcccccacagtggcactaatctccctgggcctagcatgtcagtcacaccccacaaaaatagccgttgcgaccccgcgccggctccgagccgccgacccgttcacacacaagcgccgcacacctccctttgttaaaccgtttaaaactctcccgaccgttagagcctcctccccctctatccccccaacgttcgtctcctcttcccccgatccaaccaccaccaccttcttctcctcctcttccgctcgacgccatcaccacgcacttgagagagagagagagagagagagagagagaaaccctaagcctcgcccgctatccagccaagcaccgatggcgacggacgcgaacccggaggcggcggcgccgccgccgcagttac

SEQ ID NO: 15468 - DNA, 1501 bp, Oryza sativa
gctatagctggctacaaatctgtaatctgctactcttctctctccttatttatcttcttaaaatatgtttgcagctggcttatagcctactattgtacctgctcttagcagacttcttttcgaaacatttactcattgagtacatgtttccgcgtgaaatcaaaacccacgccaagacgaacacgtgagcgacagaaattggttttattgtggctccaagttctatccaaagctagctagctacgcaaacattcagattgtgccacccactgctagctgtatcatgtggtcttaagtgaatcatgtgtgcagctagcagccaagacattgtagcccaggacacaggcaatttcagttcttctacagcagagtagcaaacacaacacacaaagatagtgcctgcagacagaatttagatcaatgatgatgacgatgacattacctaatgctcgcgacatggcgaggatgccacgcaccctcggcccgttgaggtacaccacccggccacccaccgcctcgatccgcgccttctcgtccggccggtccggctgcataattcaccgtcaattatagtaccatgtaatctaggttcgtcagcagcaagatcacacttatgattagcaagatacaagagcaagattaggttaatcacactaccacatccagcacgaatattgtcgcaccaaccactgcccccatctcctacccccctcatggacctaccacagccaaccacacccagccaattttccccttcttttttccccctttccacagaaaaggaagctctgaccagtgtgggtccacaatccatctcaggaagagcaaaaataaaaaagaaaaaaagaaaaaaaaagaggcaaagggacagcaacttcacagtacacaggagcagggacaggtggcagaggtggcggccaaccccctctcactgctcacgtgggccccaccagacagcagcaaagcagctggccccacactctgaccagtcttatccccccacgtgccccgcgcgagagcaacacgtgtccccctccaggaaagcgatggattaaggccctgtatagatgggactaaaactttcaagtccctatcacatcggatgtttgaaaattaattataaatattaaacgtagactattaataaaactcatccataatcttggactaatttgcgagacgaatctaatgagcctaattaatccatgattagcctatgtgatgctacagtaaacattctctaattatagattaattagtcttaaaaaatttgtctcgtgaattagcttttatttatgtaattagttttgtaagtagtctatatttaatactctaaattagtgtctaaagacaggaactaaagttaagtccctggatctaaacaccacctaaaacacttcggaatcccccccccctcccccgcccaacaccacgtgggccgcgcccctccgcagccacccccgaggttcccacaaattctccaaattgccactgccctttc

SEQ ID NO: 15469 - DNA, 1501 bp, Oryza sativa
actgctacaaaagcagatgcacaatgcaaatgttaacttgggacaagttatatatttgtgtcccctaacctagtaagctgtggtcaccgatcctattgtaattgaagtattgagagggtgctgcaggcttaatacaaaagcctgaagaatagagtcgaaaagaagaattatagtgggaggttttggctcttgatgatgcctgctcccgtgaagcccggtttgccacgttcagatgcacaaaagtaacctgctgataatagtactccagtagcatacaggatgtgcagtgcatgcttcctccgtttgcatatatcccgaatcacgaggcattcatggccggcgacagaatgagttgtgattagacgataggtggagattagtccagtttcagtcagctcttgccctctctagagcccatgataattaaccatgcccgctttgaagttcgtgtaaccttttcatccagcatgcgcgccccactcgtcccctctcgaagagaaaaacggcaaatcaaattctcgatcgatccggcagcatctacatggcgaacagtgaagtgtttgtgtttgtccatctagtagatcaatcttttacagttcatgtgatgatatatttgcctgagttcatgtgcaaggtccgtgtggtgactgtagcgagtccctacagaggaggtgacgagacaactgcagaacattgcctgtctgctacagggttggacatgaatttgtgtagatgcagcttgtgtttgtcgtcagtccatggaaaagcattcttgtttggcttggcctggctgcactgcatgcatgcatgctactactcctttcaggctttcacaatcttctcctttttatcatgcttgctagcttagcctgtggaaacgttgaatggcagagctaacatcgtagcacccccatcattttgttcttgacagatatacaaataagatgagaattaaaagggagatggattagttaatgaaagatcagcaacactgtcaatgagcgtcaaatattttgttggattggagctttacagccttaccaagatgagcaaagctctcagttgatgccgtcttacgtcttttccatcgcgtcctttgcgtccttttgctgctccgtcctccatgatcaactttttcctgcgagctcgcgaccgacaaaagtaaatactcgaagcaattgtaaatttctcacacacctagcgagtgcaatcatacatctgcagtacgtagtacaatgcagatgttgattcacgctcatacagtcatagtactacgtactccatactgcaagtaattagcatgcgtatgcatgcaatggatatagctacagtagcagtacaatctaggggcatgtcttgctgaggcgtctacaaagccatcgatgtatggtgatgatgctgtcagatacacgatggatcacacaaagctctctcagctgcttctcttcacgggcagtagataagaagcagccacccctgctccgtgcctttgcatacacat

SEQ ID NO: 15470 - DNA, 567 bp, Oryza sativa
ctcactctcactctctcagcgtgtgtgagctcagctagctcttgtaccgtggagacaatgcaagcaggcagctgttctattctttccaggattcacacatgggttggctacttggcttctctggagtctggaccaaaagtttgggtttcttgctttgcttgcttgcttgcaggtgaaatgggagatgaccatgtgtatgcaaaggcacggagcaggggtggctgcttcttatctactgcccgtgaagagaagcagctgagagagctttgtgtgatccatcgtgtatctgacagcatcatcaccatacatcgatggctttgtagacgcctcagcaagacatgcccctagattgtactgctactgtagctatatccattgcatgcatacgcatgctaattacttgcagtatggagtacgtagtactatgactgtatgagcgtgaatcaacatctgcattgtactacgtactgcagatgtatgattgcactcgctaggtgtgtgagaaatttacaattgcttcgagtatttacttttgtcggtcgcgagctcgcaggaaaaagttgatca

SEQ ID NO: 15471 - DNA, 1501 bp, Oryza sativa
tttttatcacatcattctaatttcaaccaaacttttaattttggtgtcaactaaacacagccttaattaaccagcaagcgagcagttctttgtctcgtcaaagatatcacgaactgaaggactgtacactagaaatctttccctaggggtactggaaattaagcgaatatgatcgacctacccacatgtagtacagtcgtgcgtgtgttcattacgcatgccatgagaaaaaaattatcgtatcggatcatcgaaattaataaactgaacacggaaaacccttagacttataatatgatgtgctatctaggttcacaaacccttaaaatatagtttcgaatctcaaatttgttttggatgtcatgtcacgatgatgtctatgtgttgtgagactatgattttaaggacctatataccagtcacatagaaaaacaattaaaaataaagaggggagagaggacataaggatgtttttaattttgaaaaataaaattagaaaaagatagagaggagaaaaatatgttttttatttttttatatgtgtgtcagggttatagataccacatacctaatagtagttgactaaatcccggcaggacccaccacataccatgtcttgtatggaaataaccttcgaatataggaggagttccacataaggaaggatgaatagagttctacatggaaacgacaaggactactcagattatatccatattggtttccctagttctacttggacaatgggacacttatgggtataaatacaaggccccctaggaggagaggggacacgaaacaatagatcaagacacaagatcaacatacaagccaacatacgccaagacaagacgctggatatcgacttcagagataagcatggctagtcccctacggtgtctatggatactgataggagagacatagcgctatctttgatcttgccggatgcagattcgaggaggaaggctaccctgttgtcgactacgagtcagcacttcagaccgccaagtcgacaacagttagataggctaccccaaatattgtactggtgtaattatagtgaataagagcaacgaccggcttcggccaacaggagtagagttattacctgacaattcaggggcccaaacctatataaaaatcatcatccccatctcttttattacaatctcgcatatatcctaataccaacgatccccatactatgtaaataccggaatcgcgacatcaaacgtcgacagtgtgattgacacatgggtcctactaactttttatatgtaattttctatggctaattggtcacagccaatcaaagcgtaactatgcccattctttgtaccgggcgtgtttgtctctaaatatatactccatctttttccctacaatgttaagttaatatatagtatttgattagaagatcaatatatcattgttttatctataattcactcaagttcatgctacaatgttaaaaggctctacaatgtgaaattgtcga

SEQ ID NO: 15472 - DNA, 1501 bp, Oryza sativa
catatcagcttagcatctagggaggcactcgagaattaagacatcctacattgacttctcttctaagtctcaacatatatatgaaaaaattgtgctccctgtattacattgtatcccttatctattacgggctttatggtaacaaccaaaacacatgtccaacagaatatctcgctaacagtctgaaacttgacacccccaaaatgattcaaccatgacaataaagcaatggtaataaaatttataggtggtactgaagtaacatagaatcccttttgcaagaatcagtttatcctgcacgtaacaaataaagatcaccatctagcaacaaggcaaaaagaaaaggcacgatttccaagggaggttaccattctgaagtcggaaacacaagagaaaaaaacaactgtgtcatgtaatttattgaggagtgctgcagcaaatagtgtgtacatcagctgtaaggtgaaacaggctagtgctaaatgtctgagtcagcaatgcactcatcttcacacaagtatctgaaacatcatttgatgtcataaaactaagagaacatgcagttaatgacacctgataagcgatactgcatatggttgcagaaaaaaatgcacatatatacttctgctttaaatactgagttctgacacagtctgagttactacggcaggggtcaactgtttattggactaatggcttcgataaagagatgtcaaaactaaagatgacagtataagaggacagatatagcacagtttttaaatatctttgatccacataacatgatactccaatatattctgtattttctttaaaatcgctcactgaaaatagtggcagtcataccagtagtgtcaagtaatgtgaatccaattaagaggtattccaccacattcatgtcaacatttcttgatgtggtcaacaaccattctgtgctttcatgtttgtttaaatgggaataaaagagcatgggacctgacaccacacaaattgaagctccacacacataactttctgatcacggaaagtgcagtaatacaaacacaaaacgtagttctaattcaaagtttctcttatatctattgaagaggggttatgtccctttaggtatgtcaaagagacatgtccagtggaaagttgacagtaataccaataagcagcaactaccaaatataattgctagaagtaaacccaggagcacaatacctggtacaactaacatgtgcaagggcgctgttccaaactttgtcctgaaaaaaaaatgtgaaagtaaaggttgtgaagaaaggaaaatattaagtagagcgaagaggaaatttcaccgaaaggatgtcatccactgaagtccagagaggttcaaacggccaatccgatacactccactgaactgtgtactgagagtcacgcatttttgtctccaggatgcacaaaccagttaaccacttcgacagaaggcacttggatggtacaaaaatgccaatgaaaggcagaaacataaata

SEQ ID NO: 15473 - DNA, 1501 bp, Oryza sativa
agccttgatgccgagagacatgtggattcgccggggtggtgtcggggaggacccttgggcttcctggcacagtatagtctgggacctaacctgttgttggtctgggacccctctcgtcggcatatggtaaacctgtgtcggctttcgaaatgccttgacatgaaagcttggaggtctcccgacgtggctgatccccacgggctgggtgatccgggttagtaatgtcgtgtaggtaaagtgtaccccctctgcagaggttaacaaactgttcgaacagccgtgcccacggtcatgggtggatgtgaggtgattcctagcgtagttttgtttgcctactgtttgtgaaattgctgttgtggaaaggggatcgatgtttggaaaatctgcagctgatgggatcagctaggcccaggtggccgtttgaaagttgttggcccgggtggccgtttgaaagttgttggcccgggtggccgtttgaaagctgttggccgggtgccaatcttgatcaattttaaagactgatacattgcacatactccgaccggacgagacgcactatctcaaccgtgtcgtttgaaaagcactcacttagttgttttcagaaaagagttcaaataaaatcaattgcaaaaacaacagcctttccttgaagcctgcattaaacacttatttcccatggcttgctgagtactcccgtactcacccttgctctatataaataatccccccccagttgctgaagaagatgaagcggatcctgctgatgaggagtttttccaggagcaagccggctacgatgagatttagggtttcggcctagttcccaagtcgcgcctgtgttgtttggcccaagtcttggcttccgcttcccttttgtaatgcagttgtgagctcgggatctgtccgcagcccaacatgactgtactcctactctataataaagagacctctgttgctgtgatattctgtcttcctgtgataccagcactgtttcctgatactggtatcgattaacaggttaatttggagcgtcacgggctagttccggtcggtactagttcggggcgtgacactatgtaactagagtgtaaatgctatataagtagattaagaaacatgaagttgtgctggcttagtggtttgaatgctgccatatgtatgagcaaggccaaggatcgattcctgtccacgacacattatatgctgttttttatcttgttgcacgcacgaatcttgaagcggatctaagggctgaaaatttgacagtagcaagttttctagcaattccgttaaaaaataaagtcgctctctcgttctcatcacggtaggtggcttcgaatttaattggcggtagtagaattatacaaggcgcgatggaggcgtatagaagagatcgaggttggccaacaacaccaacaagaaacgaaacgcgtttcttcatttggttaattttgcgcgttccttccttccttcctcaacacgtagtaggcggtaagcaagt

SEQ ID NO: 15474 - DNA, 1501 bp, Oryza sativa
ggctgttgtttttgcaattgattttatttgaactcttttctgaaaacaactaagtgagtgcttttcaaacgacacggttgagatagtgcgtctcgtccggtcggagtatgtgcaatgtatcagtctttaaaattgatcaagattggcacccggccaacagctttcaaacggccacccgggccaacaactttcaaacggccacccgggccaacaactttcaaacggccacctgggcctagctgatcccatcagctgcagattttccaaacatcgatcccctttccacaacagcaatttcacaaacagtaggcaaacaaaactacgctaggaatcacctcacatccacccatgaccgtgggcacggctgttcgaacagtttgttaacctctgcagagggggtacactttacctacacgacattactaacccggatcacccagcccgtggggatcagccacgtcgggagacctccaagctttcatgtcaaggcatttcgaaagccgacacaggtttaccatatgccgacgagaggggtcccagaccaacaacaggttaggtcccagactatactgtgccaggaagcccaagggtcctccccgacaccaccccggcgaatccacatgtctctcggcatcaaggctcccctgataagctagttactcagccaggggtgtcccattccacccatgtggtcatacttgtcttatattcggatgaaattccaaggaaacggtccttaagtgcaagagcgggaaaccgtacacccggtacgttcctcggtccgcggttttggaaaattcatttagttcgtaagcaccgacccaggtgtcgggttttccaagtcttttgtaaaacccaagttttacccaagatgttttttagattttaagtttgaaggcgaccgtcgatactcgtgtagagtgcacgatttccgaggcgcaactgggtggttacaaggaaacatggtataacaattaacagaggaaggatcaaatgcaacaagctaggtaggtccgccaatctgccttgcagacgggacaaacagattaagtgcgatcctatcaatgcataatatttttcaagcaacataattaaattcaaatataggctcaagatgtttaaaggtggcttgccttgctcgagatttggagcttgatcctcgaaatcctcgcactgcgggtcttcgggctccgaaactacgcgcaaaacgggacaactcaacaaacggcgaaaataaggccctattaatgacctctaagcgtgccattagatagatctcgagatttgaggaattttggaagttgaacggagtcaaacggatttacggttgggaagatattgaatttctaagattattggatttttggtctaaaggaaaaaggatttatttaaatcctttttgaaaaagaaaagaaaagaaaagaaggagagggaaaattagacttccctcgggcggcgagggcgcggcccgagagaaaagaggcggctcggccgagctaaa

SEQ ID NO: 15475 - DNA, 1501 bp, Oryza sativa
gctccaaattaacctgttaatcgataccagtcccaggaaacagtgctggtatcacagggagacagaatatcacagcaacagaagtctctttattatagagtagaagtacagtcatgttgggctgcggacagatcccgagctcacaactgcattacaaaaggaaggcggaagccaggacttggaccaatcaatcacaggcgcgacttgggaactaggccgaaaccctaaaactcatcgtagccggctggctcctggaagaactcctcatcagcaggatctgcttcatcttcttcagcaactgagggggggaaatatttatatagagcaagggtgagtacgggagtactcagcaagccaggggaaataagtatttaatgcaggcttcaaggaaaggctgttgtttttgcaattgattttatttgaactcttttctaaaagcaactaagtgagtgcttctcaaacgacacggatgagacagtgcgtctcgtccggtcggagtatgtgcaatgtgtcagtctttagatcttgaaacaaggttggcacccggccaaaagctttttgaacggccacccgggccaactcttttcaaacagccacctgggccaacaacttttaaactgccacccgggcctagctgatcccatcagctgcaggttttccaaacatcgaacccagtttcacaacagcaatttcacaagcagaagtcaaacaaaactacgctaggaatcacctcacatccgcccatgaccgtgggcacggctgttcgaacagtttaatgacctctgcagagggggtacactttacccacacgacattactaacccgggtcacccagcccgtggggatcagccacgtcgggagacctccaagctttcatgacaaggcatttcgaaagccgatgcaggtttaccatatgccgacgagaggggtcctagaccaacaacaggttaggccccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaagtgtcgggttttccaagtcttttgtaaaactccagttttacccaagttgttactcagattttaagtttgaaggcgaccgtcggtactcgcacagagtgcgcgagtatcgaggcgcaactgggtggttacaaggggacatggtatagcaattaacaatggaaggatcaaatgcgacaaattaggtaagtccgccaatctgcttcgcagacgggacaacagattaagtgtgatcctatcaatgcataatattttgcaagcaacataattaaatttcaaatatag

SEQ ID NO: 15476 - DNA, 1501 bp, Oryza sativa
cgatcgatgaatggtaggttccacgaggcgacaacgaccgcgcggccgggttggcgaaaaaaaaggcgaaccagtaacgcgaccgcgcgagatgggagcggcaatcgcagcactgttcgggcgggacaggattaggtcacgcccggttgggagctcgagaattttctcatctctactcgatcggtcgccagctatcatgcaacaggccaatcgatcgcaaaagcgcgcgccgtggctatcgcctgtatatcgcgaggtggggtggtggattggccgcgggcaacgcaagtagcgcgagcgacacggtggcggggctcggcgcgttgcggcaacgtacgggggctcggttgttgcgagcgcgcgcgcgcgcggacaccgccgttttctgcgcaaccaccgggcacggtggctggctgggcggccgtggggatgggatggatagccccgatgagtacgtcgtccgatgagaatgccatgtgcgccgtgccgggcggtggggatgggctcccggttgttggcggtgttttggctttggctcatggctccgttgcgccgccagttcacaacttcggatccatcccgtcccgtccgtacgtggccccccgcgtcggattcattccgcccgtcgtctggccgtcggatcaaagacggatggctcgacgtttttcgctgtagtttttgctttgttgtcttattttatctgtgttttttgcgggtcctttcggtttcggataggaaagggcgagcggaaagtgagaaaagaagggggtgaaaggcgtaggatccctttctccgaacgggacgcttctatggggcttgtgacgtgctacggtattccatttcccatagtttgtttttgtcctggttttggacgcacgagtcttacaccacggcatttgttattgggaagacgaccaatggaactgtgagttgaatggtagccatggaccatggttctcaataacaacatgtgaaaaagagataaaatggctcatgattcttgaaccattgaaccttacgcattgcccagataaatgtacgctttcaaactcaaccaatttagagcatcaccaacaaattatgtataattttctcctaaaaaattgtttttggttttctaaactgaaaataagaagtgaaaaaattcttccgtctaacagatagcctaaattcaatcctcaaaacttaaaagtgggcccttctattaaactaccaagagaaaattctgtttttttttctttcacgcgcagaaagatcgctatctcccacgcgcgggaatgaaggagagaggcgggattgcatgattgggagcgactttcgcgcccgcatataaacggagcgagcaaccgggggaagagaactccaaaactcgagtaggagggtaggggatctgttggaactgatttagactaaaatccctcaattagttttaggaatcatataggtagcctgttggtgatgctcttagtgcttgggtcgcctgtgcggcatgtataccaac

SEQ ID NO: 15477 - DNA, 1501 bp, Oryza sativa
aaggatgacaaatttatgagatgacggttcaaatgctgttgttatccgtgaagctagggactttgtttccgttttgatgtagtaaagagatgtacgttctgtcctagagcttgtaacaatattgcccatgaaatggtgacgtttggcactgcgttgggtccctctggactggttgtatggttccctctgtttatctgtactctagtgaacagttctttggagtaatggaagcttcttttcgggaggctggaaactgaagcaacatcaatccagtgataattatcgtattattcatttgggtgtgtgtttttagaactcgggtagtgcccattagagaaagaaatagtagaccagttatacacttgattaatcacgtggtatcgcatgagaacgtagtttagtcattactatatacttgacataagcaaaatagacaagtatcaaatttcagaaacatggggggtacttgtttgtttcttggaaactggtaggcagatggtaggagatttttagggagaatgagtcaagcaagaaaagaaagaggagctacgtccacgctgccctttgctgaccagtcccagacctttgctactctgacttgggttactccatgcatccattccatctaatctacaactttaatcactccaattagcaataaacacaatctctcagtgtcaaattaacacgactgaaaatcctaacacgtgtgcatatttctctccaaaaaatatctgatccatactatggcttaaaacacgcactcagttgtcatctactgcaactacgagtaaaaatcgacgtccaaattaatcagaaacgcgacgcgtggcacaagcatgacaaatctacacatgtattagcattttttttaacacgtactacacatgtattaacattgacgtgatgacaagtgacagccgcccgtaatgagtactcactcactcccttccattttaaggaggatggccatgattttccgtgtctaactttaattgtttgtcttatttaaaatatttttaaaaaaagttaaaaacataagtttcgcataaagtactatttatgtgttatcatcttataacaataaaagtactaattataaataaaattaaataagatatatgatcaaagtttgttaggcacagaaatggaacttgagggagtaaggagcacctagatttccatttttcctttcgaagagctgtgcgctacagtagccgtccgatccaaatcgtgcggctactgggtcacaggctacacgtcagcctgtcctgctgtactcgatcagtataaaatttgggctttgactccgcgtacccaaatacgcggccttctcctatcaaaaaaaaaaaaacgcggcctttttctcctcttcttcctccgcctcggccggcgactcctcgccgccgtcgtaaccgcgtcctccctctctctctctctcccgaacccggaaacttctggaagcttctagaagcccagcccagcgcggcgcggcgcacga

SEQ ID NO: 15478 - DNA, 1501 bp, Oryza sativa
gggcaggcggtggatttttagtagcgctgaaacatatttttttgtagcggtgctcttcacggtccgccacctaaaatcggattttccgtggcggacacttaagaggtccgcaacgaaaaatagagtttcttttatggcgaaccttttagcgtggccgccaatgaaaattggttttcgctagcggtccgtaactcccctcccctcgttatatttttgctgctggtttttgcgtatggccgccagcgaaaattatatggtaacgccatgaaaaatcgtttttctagtagtgataataatatttttaacacaaaacaaatatactatatacttcctctgttttatattataaaattttctagcattattcacattcatatatatatgttaatgaatctagatatatatattaagattatattgatgtaggtaatgctagaaaattttataatatgtaactgatggagtatttattaaagtgttttataaatatgtgatatgaaacggaaagggtgtatatattaattcgctcaagtcacattcgtaccttagcgtaccgcctaccgcttacgtttccgcgctgctggaagatagggagtgtatagtcttggacaataattgagaaactaaccgagaacagattagtagctaagctaggattagaattgatttgcaaatccctttattaataaactggggcctccgaccacaataatgcaaatgacagatggccggccacataatcggatcacacctagctttgcatgattggatcgtacctacgtacgtacatcggtcaaagatctgatcgatccaccgatcgatggataccctatcccccaccctcaatcgaaattcgtacgtacaaactagctcgcgtctcgcgacgtcgtgcataccctatccagatacgcatcgactgatgttgcaaatactaagcgcaaggtcaataagaagaaactataatcttcgatatatgtccatatcagctaaaataaactagcttatcatataaatatcatgttttctgtcttttaatgcacgtacgataccgttgatttttgacacaagttaacaattcgtcttatttaaattgtttacgtagttatcgtttattgactctggtgttgggcacaattacaaaggtgtgacgaagacggagaggtcctaaaagttgcatgccgcaagcttgagtcgacggttatgcagttttttgccaattatgagtggagattcacaaatagacttcaataatatattcaccttattatttattggttcatttttatctttccgtgatgtttgctttcttttttgaactacactcgatgtggagtgctagattgtaataatagattgtagctctcttaagcaaagaccgggatgttatatttcattatctaaaaaaaagttttgttgtgagttattttatcactgaaagtattttgagtataatttatatcatgcattttgcacaaaatttttgaataaaatgaatagtcaa

SEQ ID NO: 15479 - DNA, 1501 bp, Oryza sativa
acaagtatcaaatttcagaaacatggggggtacttgtttgtttcttggaaactggtaggcagatggtaggagatttttagggagaatgagtcaagcaagaaaagaaagaggagctacgtccacgctgccctttgctgaccagtcccagacctttgctactctgacttgggttactccatgcatccattccatctaatctacaactttaatcactccaattagcaataaacacaatctctcagtgtcaaattaacacgactgaaaatcctaacacgtgtgcatatttctctccaaaaaatatctgatccatactatggcttaaaacacgcactcagttgtcatctactgcaactacgagtaaaaatcgacgtccaaattaatcagaaacgcgacgcgtggcacaagcatgacaaatctacacatgtattagcattttttttaacacgtactacacatgtattaaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggcctaacattgacgtgatgacaagtgacagccgcccgtaatgagtactcactcactcccttccattttaaggaggatggccatgattttccgtgtctaactttaattgtttgtcttatttaaaatatttttaaaaaaagttaaaaacataagtttcgcataaagtactatttatgtgttatcatcttataacaataaaagtactaattataaataaaattaaataagatatatgatcaaagtttgttaggcacagaaatggaacttgagggagtaaggagcacctagatttccatttttcctttcgaagagctgtgcgctacagtagccgtccgatccaaatcgtgcggctactgggtcacaggctacacgtcagcctgtcctgctgtactcgatcagtataaaatttgggctttgactccgcgtacccaaatacgcggccttctcctatcaaaaaaaaaaaaacgcggcctttttctcctcttcttcctccgcctcggccggcgactcctcgccgccgtcgtaaccgcgtcctccctctctctctctctcccgaacccggaaacttctggaagcttctagaagcccagcccagcgcggcgcggcgcacga

SEQ ID NO: 15480 - DNA, 1501 bp, Oryza sativa
tatctctttgctaggtcattacccctcttaatagtacggcgaaactaaaaataaactagcaaatttgatcgccctacacctcgatcaattctaaattaaagcgctagttttaccgtcttctttccctttgctttgcgacgtcaattttaatccatcgataatcatccatgcgcacattcgacgtggacctaacttaaaatgtatagctcaaagacaacggttagtccacaattagcgcttgtcattaattaccaaaattaacaccgggggcctagatgcttcagcgtcccacccgtactccctctgtcccaaaaaagacaaaccctgggtttctatatctaacgtttgaccgtccgtcttatttgaaaaaaatatgaaaaaaaataaaaagacaaatcacgcataaaataataattatgttttatcatctaacaacaatgaaaatactaattataaaaaaaattcatataagacggacagaaacgtaaattcaaggtttttttttattttttttatacggaaggaataggtgacacggcacgacaaactcgacgacgcagaaggccgtgagaaggggcggcatgcagcgccgtatacttgtttgtcagggtcaatatgccggacaccctgttgcgccgtaacgcttcaaggcgaaaaggagacgtatgcagccaagcaccgcctcgaattaaacgagccggccggccgacacgtacgtcgtaccgcgcgcgccacccccctagcttgggtcgtgatgatcctccaactccggccgaaaatcaacgccgccgatttcgctgtggcgacgcatgcaccaacgcgtgggtcgccgatggcggacgtcgttattacgtacaccgtcggctccgatcacgtacgccgaggtgacacgcaccggacgatgaggctgccgtgttgctcatatcatcagccggtgtctctctggccggtaatctggtggagctctcgctgtcggcgccatcaatcgtacgtgtggacagccgcgtgcagggggacaccggacacggtcacacggggttcgcggcttcgcgcacgaacactgaactagcttctcacatcagccttcgcactgttcacaaagctaagttcgttttcctggtaggctgatagaaaccttgtcgatgtcaagacgtacaccaattaatctgatgatgcgatacaaagcggttcacggtgccgagccgactcgttttcatgcctcacctcatgtacgttgtgcgcagtactccctccatttcaaattgatctacatatttcatagatacaccaagaccaaaaaaactaataactctctcataccatatttactctagcaacaaactcaatgtatacaccatccccactattttctagccaattgcaaatcaagatattgcatgtgggttataaatacttgtgtgcatggatagatgcatcaatgtccatttatttcaatgcacaaataacgaatagacttaataaataaattcaaatatgtaaa

SEQ ID NO: 15481 - DNA, 1501 bp, Oryza sativa
aattgaaccgatttaattatgtgaaatcctgtaaaattcttgccttacaaagtaacactaatagattttatttctttggactttatgcatttcattaattttcaaataggctagctatacattgacatgaatatatatataggtggtggcatgggttctagcttacaaatcgagcataaacatccaagaaacctttagagagtattatatagtactccctccgtcccaaaatgtaagtatttttggatctcgacacggtctccaagacaatatctacaaaagtaaaatattttaaataaaaagagttgcatattatgatagttcgtttaatgataaatatagtaacatcaagtttacatgattaatatttcttaatttatcgctattaatagtcaaaatttaaaaagtttgacttgacactattctaaaaatgtttacattttgggacggagggagtagatggcaaatttaaatactcctatataattcataaaattggactaattgtcaaaattttaaatttcattaggaagttgaattgataagtgttgatgtaaaattcgtcacatacacaaaggcataagagatttgtttagatctagtgcaagtcctatcaatcgggttcagggcatgccagttagtttgatcttagaattaacaagatagacaacgaaaagattagattgtggagtcaattggtcatagggccgatattgtatcgtgtgcccatccgatgccgatgaaattttggatcgattggctgtaaccgatggatataaatatttaggatcaaagtgacatcgaccaaaatctacataatatatatttgcaaaatcttctaactttattataaccaatcttgatagatcaaatcaaactgagacaatataagattgaaagtagtaaagatatcaacttaacaattatatatattcctagatgtaggccaatgcactaaaatattaattgaagcttatcatcattcgcaaagtaaagaaaaaaacaacatcagctataacaagttaaagtataatcattaacaacctatgattattaaccacaatcttgatagatcggatcaaatcgagacagtatatgtcggtgacatggggccgggggtatcgtgactagaggcttgggtagccgcggtcacccacgtggcctgaccccctcgggggggtcgggcccgaaggtgacgtggccacccctccctctgtctccccgaggggtcggcccgctcccgtttcggccccgagggctggggcgccccgaccccctgtggttttggcgccacgtgtgtgggttaggtgagcacagcggggctcacctaaccgcatttatagcaggttggacgagtgcaccacgccgcatttaatgcggcgcagcgcacgcttatccggtccgtgaccggtcgcggtgtgtgaccggtcacagaccggtcagatcgctggttaggtggcaataggcggcctgtcacacgcctcgccccgtcccgtcggaa

SEQ ID NO: 15482 - DNA, 1501 bp, Oryza sativa
tagtactagtagtactacagtactactactactgctataataatactactagtactactgttatactactattagtactactgtgttttttggtttttatatgtatatattttttatgtataaaaaatatacacatatacaaactttgtatacaacatgtgcaaactttgtatacgtacatattaaaaaattgaaaaaaccataaaacacatcatgtgtatacatatacaagtatacaaactttatatacatacgtgtatacaaactttatatatagcgtatacaaagtttttatacgtatgtatacaaactttgtagacgtttgtataaaagtttgtatacgtatatgttatgaaaaaccgaaaaggaaaaaaaaaggaaaactgcaaaaaacgagaaagaaaaaacgaaacaggaaaaaggaaaaaaaatcgcgcgggccccaccctgcgcgctgccgccaccgcggccctctccacgcgcgccacgtgcctcgccgcgcgggagggcgcgcgcgcggtcagtcgcgcattagcattttcgtcatagggcctgtgaaaaatgtcatccgaaaaatgcctgaaacatgtactacagtctacaattgtgtgcatgagtcgatgaacattgagagtttaggtggtgtttagatccagggacttaactttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggccttagatggggcaaaaactttttagcccatgtcacatcggatgtttggacgctaatttggagtattaaatatagactaataaaaaaactaatttcataaatgagagctaatccgcgaaacgaattttttaagcctacttaatccataattatcaaaagtttactgtagcatcgcattgtcaaaatcatagcgtaattagactcaaaagattcgtctcgcgaattagtccaaggttatgaaatgggttttgtaattagtgtatgtttaatactttaaattagtatccaaacattcgatgtgtggaaaccaaatagacctggagccacctatcgtgtttacgcagcagtagcctgtagccgccaaggaaaagcccgcgaggcgtgaccccgcgatgcgcattctcacggatcggcggtcgccacaggacgcacgctcaccggttcacaccacgttgcgacatgtcatgatgcgacgtagaggaaaaagtataccggaggtcccatcttgccaccgaattacaaaatcgtctc

SEQ ID NO: 15483 - DNA, 1501 bp, Oryza sativa
gccggctgcgccgacctcgccctctagttcttccgcttcgcctaccgccgcaccggctttagccccgagccgtccaccttcgccctcgccaaggcagaaaaattcttggctaggcgccgaacaatccaagaacgcacaccccacacatcgtcgatgacattgatcgcgcaaaagaaaaagacaaagagcgcggtggccggtggattggatatataacttagcctcgtcgtctccagatgacggagtgtcgcccgccttgaagcagacgatgccgcggcgaaggcatgcgccggccggccccccaccaccgccctggtgcagcgcgacgctgggcgccgcggccagcaccatgcgcctcgcggtcgtcgtcatcgcacaagcaccaccgcccggcgccaccatggcgacgaacgtggcaccggggacgccgacgagcgctccggcggggagagccagcatggagatggggaagagaaacatggggctgcactgtacctccatgaggatttcacgagacgagacgagaagcccttgaagatattctctcctcctacacgaacgaaacgaactaaccaaagctaacaccaggttcgagttggtgagctagctaaggtcctttatatagcccagcgatgcatatgcgtggtctaccgtcgtggactcatggggaacaggttctgggcgtattccgaccgccgccgccgccgttcccaccgccgccgctgccgctccccatcgccgtccatgccgccgctccggccaagagaaaggccgagaggagagagaaataagggagagagaggggagaggaagaaaggaaggagagggaggatgacatgtgggtcccacatgttagtggtcccacaacactttttttttgtgtgaatgatatatgggtcccacatattttttttattttgtttttattctaatgccacgtaagcgccacataggacaaagaatcggtcaagactgccacgtgggcgtcacgtcagacaaaaccacctctaaaaccaccgagggacattgtttgcaccggtttcgatagttggaggattcgatattcccggttttgtggttggaggttatgaatgatactcaggcgatagttgagggagtcaaagtgtactttttccttttagatataaactgctactagtagttagtactgtattactgtaagcccaaaagtaataatataacgattttgctatatctcatttgaaagattttttcttatctctcactcgattttctcactcaaatttacagtgtattttcttgtaagttacagtgtaatttatgaaacttacactgtaacttttgtaagttacactgtaatttttgaatcttcacatgtaaattttaaattttgtatttgatttggtctttttcttgaggatatggtaatttaatgttcattatggtgtttcttaattgcttttttctttttattatatctatcggattttaatacaaagattaaaaatctgtgtgatac

SEQ ID NO: 15484 - DNA, 1501 bp, Oryza sativa
ggcggcgccgacaggcggggcccgcatgtcagcggttcaagagagaggaagggggcgccggcaagcgggccccatgggtcagcggcacaaggtggccggtccaccgtggaccgggaccacgcggggggggtccaccgccggtccacgggaccgacggtccggatcggccgggaggccgatcggacggcacggcggcggctaggcacggctcggctcggcttcaaaaccggccggccggccatggcaaccggcggcgacgcgcacggtcgccggcgacggcaatcggcggcgcaggaagcgacacggacggggcgaaaagcggcggcagcggctgaaggcgacagcgcacgcgcgataggacggcggcgcacacgggagagagggaaaaaggggagcggaggggagcgtcaccggtgagcacggcgaccaaagcggaggatgaaaggcggcggcgatgaccggcgacgcggaggcacggacagcggcggcgacaccctaggagaagatggagaggcgttaggagaggagacgacgaccacggcggcttgaattgccggccggagatggaggggagggaagaactcaccggctcgcgaggggagaagcgctccggtgggattccggcgacgcgaggcggcggccgggaaagctcttgcggcggcgaagctaacggcggcggcggtttggcgcggcggcgactctagcggcggcggctcgcggccgaaggcggcggcaagcggcggagctcgggtgtgacggcgcgggcgcggtagggggcgtgggagaggacggcaaatgggggaaacgagggaggggactcgggggagtgcttttatgggcgagggaggggaggacgtggccgggaaccctcccgatttggccggcgacgtggggaggagagagagagagaggtggattcaaatcgattcccgcccatttgcgggcgcgcatgcgggccgggagatgcgggggagagggcggcgacgtgggcgcgaggtgcgggcggagtggggcgcggagaacggcgggaaacggcagcggcgacgagggcggtttcgacggcagcagcggttgccggaggaaggagacgaccgacaggtggggcccacctgtcggcgtcccgagagaggagggaggggcggcttgggccggcccaacaaaggggaggccgggcgcgggagggagtgggccgacggcccaacagagaaagaaggaaaagaaaaagaaaaggaagaaaggatttttcctgggattaaaaattgcactttggtgatttttaattggtaaaaattatttccaaggctctgaaaattccactaaaaatcctgttaatatattgtgacatgtggaacccaagaaaaatcccacaatgccaattccaattattaattgcatttattaattagggaattagctctaggttaattaagataatttcttcggacgatttatttagccaatttttaaagcaaggagagggggaaacttcagggcgtgacac

SEQ ID NO: 15485 - DNA, 1501 bp, Oryza sativa
aactttaatcgtccgtcttatttgaaatttttttatgattagtatttttgttgttatgatatgataaaacatgaatagtactttactcgtggttattttttaaagttttttcaaaaattttttatataaaacgaacgattaaagttggacacggaaactcatggctgcacttattttgggacggagggagcagtgactagacgcacgcgtctccacccgcgcaactagttcactgttttctcgtttcttttccttttttattgatttttttcttttcttttaccttctttttttgggcttatttaagaaaaattgtggcccaatctgaaacagctgatttcttgtttacgaaatttatctatacaaagtttctataaagtagaaagtttcatattgtattgaactcggcttgtttgcattttttcatgtgctatccaaaattttttatacatatatatatgtacacgtatatgtatatatacatactttatacacatatatatacaaagtttgtatatatgcgagcaaactttttatatccaaaatacatatgtatacatataaaatttacacatataattctgtttgatacatacataaaaatacacttacatttatctctactattataaaaattgaagatgtttttgccggtattttggtacatcatccgtgtttgagtcggtttttaagttcgttcgcttttgcaaatacaaatccgtatttgagttggattttaagctcgtttgcttttttaaatacaaaatgagttgtataagaaacttttaaaaaactcgcatgctaacttgagataaagtcagactcctaattgcagctcataattttctaaaaaaaatattcaagcaaatttccacaatcaattttatcctaactaaatagtataacaataatacgattaaaatatcatttacccgttgcaacgcacgggtctttttttctactccctccgcccccctgatataagggattttgacatttttctttcactgtttgaaattttggaattattatttattttatttgtgacttactttattatccaaagtactttaagcataactttttgttttttatatttacacaaatagagtgcaagcaaaatgttaaaacccattatattagggtacggagggagtagtaaatataaattttatacgtatacgtataaaactggtatacaaagtacgtaagggctggactagtcgcgcgcgcgcgcattagcgacacccagtatataatctgtatcactgtgtctgtatggctgagttgtgtaggcaatcgctccacttgtcgcctatatacgccttggcctctcggcgtccgatgctagtggtagtggcccgcaaatcctcctcctccgctcgcgtcgccgcccaccaaacccgatcccaccgcgccgcgatgccggccggccagccgcacgcgcacgagcccgacggcggcggcgcgagccaccgccggccccagtcgccgccgtcgc

SEQ ID NO: 15486 - DNA, 1501 bp, Oryza sativa
acgtcgcggccccgtacgtgcccacccccacactgtgcgtgcgtacatgtgcctttgcccggtgggagttgcccacgcgctggcgacccatactgcttttttttctttggtccatataggtgtacgtgcaggttaatcgatcgcctcgtcatttttactcgcgaactcgctggtggaacccgccacatttcaagtagtagtggtagcacgtacgagacataaatacatcacgtttcacataatcacatgaaaccgaaggaaaaaaaaaagggaaagtgaagagctgatctgtagtacttctcgaacgctctgttggatttggacatgacacgaactacgacagggtcgtagaggcaagctaattacggctgtgtttatattcaaactttgatccaaacttctaactttttttcatcgcatcaacatgtcatacacacataacttttcagtcacatcgtaccaattttaacccaaacttccaactacacagcctaagctcaaccgaaaatactcatactccgtacgtattcatccacgtaaaaaagtatacacgcctgtgaccgtgatcatgacaatgtacagtgcaccagtactagtactagatcaatcctttctcttcgtataaccgtataatctcgtttcctagacgagtcacgaacagctgtgactctcattcattcgatggacgtttacaaaactgtatggttatcgtgattatcacgtgtaatatttattttagtttttaaaataacggtataccacacgataatatacgcggtttttacagtaaccacatggttacatggttacagttaaactgtaaaacgatgataattccaccccgaaagatttgataaatcctggattcgatcaacctttccatctactaccagctgaaagaccgatcgatcctggtacacgcaaacgttatcctcggaattctaccaagtgtgcgacacttggctttctccttggatcgagcagccgtatgtcacactcttctcacttctcatcgtgacaaaagttacaaggctgaggggttgtttgttttccggggacttattccaagtccctgtcacatcggatgtttggacactaatttgaagtattaaacatatactaattacaaaacccattccataagcttggactaatttgcgagacgaatcttttgagtctaattacgccatgattttaacaatgtgatgctacagtaaacttttgataattatggattaattaggcttaaaaaaatcgtctagcgaattagctctcatttatgaaattagtttttttattaatctatgtttaatactctaaattagcgtccaaacatccgatgtgacataggaagttttagtccgatctaaacgcccgctgagacccggcacagaaagcaactgctgctgctagtcctttctgtgttcgcatccgacgtggacaagtggcgggctcgcattggccggagggggagtgggcccggcctcctagaaaggtgcga

SEQ ID NO: 15487 - DNA, 1501 bp, Oryza sativa
ggtggcggcaacggcggcggcttccatcagctgcaaccttctacctattttaacacataagaaattaattacatgtactaactaacaactcattaaaccatacgactactttaatatctctactaacatttaacaatgacaaatgttaacaaaccatacttactaactgtcggtgacatgggatcgggggtatcgtgactagaggcttgggcagccgcggtcacccacgtggcctgaccccctcgggggggtcgggcccgagggagacttggccaccccctcctctgtctccccgaggggtcgggccgctcctgtttcggccccgagggctggggcgccccgaccccctgtggtattggcgccacgtgtgtgggttaggtgggcacagcggcgctcacctaaccgcatttattgcgggatgaacaagcgcgccacgccgcatttaatgcggcatggcgcacgcatatccggtccgtgaccggtcgcagtgtgtgaccggtcacagaccggtcagatcgcgggttagatggcagcaggcagcctgtcatacgcctcgccccgtcccgtcggaatgatgagagcctcttggcactcatccctagctggagccggcgtggtaactcctgggattagcacgtcagtcccggctcgattcatgccaggcttcatcgcaaccattgcaaggaaggcactgtatgaagaagggcaggtgtgtggcatgccgaactgacgcgtagtggacaagaatgaccggtctgtcactggtccgacgccggtcacgtcatcagcagacaaccgtgctctcatattgcatcagcttccggcggagtggaggcaggtatgacccatcccatcggagggtcattcgaacagcggccattgcaaatctccgccggaagatgaagaaatgacagggtgatcccctgtgtctgacaagtgacggcgttgggcatcattcaaagacaggcgttgattcagcttcaaggcggaggcgcgtgtcaagatttggtcaagatagggtgggtctccacccaaaggaagagtagttagaagtggtgcatgtggtatccccttgaaatataaaaggaggaccttgcccacgagaagagggggagaaaaaaggaaagagaagaaaaagaggaggaaaaggaggaggaaaaaggaggggttctagagctggaactctcttgcttgccggctctctgtaactttttctcacacatgcccaccagaacacaggagtagggtattacgcttcccagcggcccgaacctgtctacatcgcccgtgtctcgtgcgtttgctctctcgcgtacattccacagatcgagggtgaagaacctcactcagcgcccccggccgaaccggcaaaggggggcctgcgcggtctcccggtgaggagcctcacgctccgtcatctggcgcgccaggtagggggcgcgtgtgtttttcgggccctcgtcctctttcgtgtgcgccaagtttctcccgctcagcccaa

SEQ ID NO: 15488 - DNA, 1501 bp, Oryza sativa
ataaattactaatccctaagtatgaggcctatgaaattaaaaagggcttgtgatttgttaattgtttctcattgttcaatgttagtgacggagcgtgaggctcctcaccgggagaccgcgcaggcccccctttgccggttcggccgggggcgctgagtgaggttcttcaccctcgatctgtggaatgtacgcgagagagcaaacgcacgagacacaggcgatgtagacaggttcgggccgctgggaagcgtaataccctactcctgtgttctggtgggcatgtgtgagaaaaagttacagagagccggcaagcaagagagttccagctctagaacccctcctttttcctcctccttttcctcctctttttcttctctttccttttttctccccctcttctcgtgggcaaggtcctccttttatatttcaaggggataccacatgcaccacttctaactactcttcctttgggtggagacccaccctatcttgaccaaatcttgacacgcgcctccgccttgaagctgaatcaacgcctgtctttgaatgatgcccagcgccgtcacttgtcagacacaggggatcaccctgtcatttcttcatcttccggcggagatttgcaatggccgctgttcgaatgaccctccgatgggatgggtcatacctgcctccactccgccggaagctgatgcaatatgagagcacggttgtctgctgatgacgtgaccggcgtcggaccagtgacagaccggtcattcttgtccaccacgcgtcagttcggcatgccacacacctgcccttcttcatacagtgccttccttgcaatggttgcgatgaagcctggcatgaatcgagccgggactgacgtgctaatcccaggagttaccatgctggctccagctagggatgagtgccaagaggctctcatcattccgacgggacggggcgaggcgtatgacaggctgcctgctgccatctaacccgcgatctgaccggtctgtgaccggtcacacactgcgaccggtcacggaccggatatgcgtgcgccatgccgcattaaatgcggcgtggcgcgcttgttcatcccgcaataaatgcggttaggtgagcgccgctgtgcccacctaacccacacacgtggcgccaataccacagggggtcggggcgccccagccctcggggccgaaacaggagcggcccgacccctcggggagacagaggagggggtggccaagtctccctcgggcccgacccccccgagggggtcaggccacgtgggtgaccgcggctgcccaagcctctagtcacgatacccccgatcccatgtcaccgacagtagcccccggcgttatgccagggcgatcgcccccctcgagggaagcgctcgggcgtgacgccactccttaggtctggtgaccggtgggaccggcctctacaggcgggcaggaacccagcggtcgcaaatcgcgcgcatcggctagggaaaaatgaccgataataa

SEQ ID NO: 15489 - DNA, 570 bp, Oryza sativa
aagttacacgcatgggttcgaacccgagacctttgcttttgaaggaaaccacctcaaccaccgagctatcataaagggaggttaaaatttcaacctatacagaggtcaccaccgagctatcataaagggaggttaacatttcaacctatacagaggtcaacgccaatgagagtggcgctgacctttgatgatgtggctaacttatgacacctcggactgagtttagcgccaaaattggtggcgctgaaatgttagatctcagcgccagttcatttttgaaataaatttttgacacggtttattcttataataaatttttgtaaagagtcaaactgtcaaaatttgtgaatccaaggagtgtttcagacacgttcactgcaatcgcaccgcaccgcaccgcatcccgcatcccgcagcaggccagcagccgatcgcgagtgtctagtagtactactactcggcaccgagagctgcattcccgagctccaggttccagcaaagtagggtttagggtccttaggtttaggaggaggaggaggaggcggcggcggtgagaaggagagtgggata

SEQ ID NO: 15490 - DNA, 1501 bp, Oryza sativa
gtctccaacctccctcgcccgctcaccatcaccgacctctcccccgcgcccatgcacggcagccagctgcgcgtcgcctaccagggtgtcccgggggcatacagcgaggcggcggcggcgaaggcctacccctcctgcgacgccatcccctgcgaccagttcgaggtggccttccaggccgtcgagctctggatcgccgaccgcgccgtcctccccgtcgagaactccctcggcggcagcatccaccgcaactacgacctcctcctccgccaccgcctccacatcgtcggcgaggtccagctccccgtccaccactgcctcctcgcgctcccgggcgtccgcagggacctcctcacccgcgtcatctcccacccgcaggcgctcgcccagtgcgagctcaccctcaacgccatgggcctcaacgtcgcccgcgaggccttcgacgacaccgcggccgccgccgagcacgtcgccgccgcggggctccgcgacaccgccgccatcgcgtcctcccgcgccgccgagctgtacgggctccaggtgctcgcggacggcatccaggacgacgccgggaacgtgacgcggttcgtgatgctggcgcgggagcccatcatcccgcgaacggaccggccattcaagacgagcatcgtgttcgcgcacgacagggagggcacgtcggtgctcttcaaggtgctgtcggccttcgcgttccgggacatcagcctcaccaagatcgagagccgcccacaccgccaccgccccatccggctcgtcgacgacgccaacgtgggcacggccaagcacttcgagtacatgttctacatcgacttccaggcgtccatggcggaggtcagggcgcagaacgcgctgtcggagatacaggagttcacctccttcctccgggtgctcggcagctaccccatggacatgacgccatgggagtattcctcctcatcgtcaccatcaccggcgcccggcggcgacaccagcagataatgctgatcgatcgacaagactgatgctcaaattctgttagtgactaattgcttctttctcttctttttttttctgtcaaattagagaaaggggaggaagactctcttcctcatgtttactttcggttgcggatgatactctgattaattagtcaaagttatgctcggtgaggatcggagtagatgagatgccatagcggagaggggagacagcgatcccatctcattaccagaaatgaatttttgtactctgaacattagaaaaaagggaatgaattaggataactgatggttcaactggagtactagctggcaaatgaatcaattgatgatttgctgttctttgatcttccagccagacataagaaggaaacttgatttttcaaatttggtttacaaacagtccattactctggccgaccccggtttagtctccgtattactccactattagcgtacctgactcggactcgtagtcggattcaattctacttccgccggccgcc

SEQ ID NO: 15491 - DNA, 1501 bp, Oryza sativa
acaaactttgtgtacgtgtatgcaaactttgtgtacgcgcatgcaaactttgtatacgtgtatacaaactttatatacgacacgtatataaactttgtatgtgtatattttttatacatcaaaaatatataaatataatatatatatatatatatatatatatatatatatatatataatatatatatatatatatatagtaataatattagtattattataacattagtgtagtagtactacttgtaatagactagtactagtacgttgatgacgaaaaacacgaggcctgggagatctgcttaattccagtgtaggtccaaaactcgtcttcgggtatgctagcgtgccagttgatttgatcctgcaatcaacaagaaataaatataaagaaaccgcagtttaaacctataaatgatagccgatcggctaagtgccgatgacgtatcatttatctctgagccgatgtcatatgtaaatcgatcggcggttgcaaataggtaataaagaactaaatctattcgatcggctgtagatattaacaatatataatttttatatcgatacatacttaaatcaagtgattgggatagattcggtcgccatgccgagaccgtataaatcacttagatcgaaatatacattaataacaggattatatatgttcatagcatagccgatcagatagatctagcatataatggctaatactcctatacgactctatgttaagatgttaaaacaggcagaatatactaaacagaagcttaatataattagatgcaataatattttgacataaagggcagatttaacgtgtcaatgaaacatatagagcaaatatagttaaatcagataagatcggctgaaactccgattctaagcacgacttaatagatcaaactcaactgatgcagcattaagtacgaaaagaagaacaatatctagacaatcaagccgctgggagtttcatagagtggtagatatcttatataatctaaatcaacgtcaaaatttaacctaatcggctgccttctactaacagatgttagtcgatagtaggttagataacgatattgtcaaagattatgtaagatatatgataactcgacgaatctcgagaacgtaagccgtcataacaagttttacctcttgtcgaagatcgaaaccgatgcagctcaacacgaaagcaagaacttgtcaaaataaaattaaagcgaaagggtggcgatgcgccgaaattgtattgaacgtgtgtttaaaattacatagggctcggggtctatttatacccgagaattacaagatatgcccataccggacacgactattatctctaacaaactctaagataccataagtctttgcggcagacttttacccatatttatctctaaggaatttacataaaatatcttaattaatagatacaattaatcgccttcccaggactctatccatgtatggcaatcatcttgaagtacgtcaactcaaacccgat

SEQ ID NO: 15492 - DNA, 1501 bp, Oryza sativa
gaaaggctgttgtttttgcaattgattttatttgaactcttttctaaaaacgactaagtgagtgcttctcaaacgacacggatgagacagtgcatctcgtccggtcggagtatgtgcaatgcatcagtctttagaattgaaacaaggttggcacccggccaacagcttttcaatggccacccgggccaacaacttttcaaacggccacctgggccaacaacttttcaaacggccacccgggcctagctgatcccatcagctacagatttttcaaacatcgaatcccttttcacaacagcaatttcacaagcagtagtcaaacaaaactacgctaggaatcacctcacatccgcccatgaccgtgggcacggctgttcgaacagtttgttaacctctgcagagggggtacactttatccacacgacattactaacccggatcaccagcccgtggggatcagccacgtcgggagacctccaagctttcgtgacaaggcatttcgaaagccgacacaggtttaccatatgccgacgacaggggtcccagaccaacaacaggttaggtcccagaccatactgtgccaggaagcccaggggtcctccccgacaccaccccggcgaatccacatgtctctcggcatcaaggctcccctgataagctagttactcagccaggagtgtcccattccacccatgtggtcgtacttgacttatgtttggatgaaattccaaggaaacggtccttaagtgcaagagcgggaaatcgtacacccggtacgttccccggtctgcggttttggaaattcatttagttcgtaagcaccgacccaggtgtcgggttttccaagtcttttgtaaaacccaagttttacccaagatgtttatcatattttaagtttgaaggcgaccgtcgatactcgcacagagtgcacggataccgaggcgcaactgggtggttacaagggaacatggtgtaacgattaacaaaggaaggatcaaatgcaacaagttaggtatgcccactaatctgcctcgcagacggggcaaacatattacgtgcaatcctatcaatgcatgatattttgcaagcaatataatttaagttcaaatataggctcaagatgttcaagggtggcttgccttgtcgagatctgaagcttgatcctcgaaatcctcgcactgcgggtcttcgggctcggaaactacacgcgaaacggaacaactcaatatacgtgcgaagaataaagccctattaatgacctctaagcgggccattagatagctctcgaaattcgaggaattttggaagttgaacggagccaacggatttacggttggaaagatattgaatttctaagattattggatttttggtctaaaggaaaatcctttttggaaaagaaaagaaaagaaaagaaaagaaaagaggaagggaatatagacttttcctcggccggctagggcacggcccgagagaaacggagcggtccggccgagctaaa

SEQ ID NO: 15493 - DNA, 1501 bp, Oryza sativa
gaatctttggacacatgcatggagcattaaatatagattaaaaaaactagttgcacagttaggggggaaatagcgagacgaatcttttgagtctaattagtccatgattagctataagtgctacagtaacccacatgtgctaactcggcaaacccatggaagttggactcagggtagacccaattcaacatccaaaaacctaaacttaacaacagattgcaaatatatctctgtttcttacttgtgcatgcagtacttgtactcgtggccacggatgtagtccagctccccttcctcaagctgccacaacacaaaacacccaaaataaaattcaaaggaatcctgattttttttttagaaaaaaaactcctctgaaacatcacatctcactctcacgccgccactcaccgggtcgccgccgtatatgagatcgtagcactccggcgagaggcaccgcagcacgcagttctccttctccgtcgccgaggacttgcacgcccatccccacaatccactgtcccaccgagagagagagagagagagagagagaaacaattagaaacttccccatcaaaaccacccccaccgaacacagacggggggaagcgtaattccggcgcacgtacttctcgacgtcggtgtagcaggcgctcttcttctcccggatctcgttgtcctggaccacgggattcgcagcacaagaacggtgagacggacaggggccgccaaggaaaggcagggattaggtagggagacgtacggtgatggggcggcgggatgacttggcggcggcggaggggaggagaacgagagcgaggaggagtaggaagaggcagcaggcggcggggactcgccggtggctccggtgaggcggacgcggcggtggcaggggagccatggctggcggggaggatggattcggtcgggtcggttgcagaattgctggtgcggccggtggggcggaccctgagatgtgccgtcgcggacgcgcgttcggatggatttgattccggcggaagttggaacagggggcttgagccttgacgagaagttttattttgttttaccctttttagtttttaattaaaaaaataaactctcacaaaaaaatattttcaaatctgaatctttttaattttaaaaataaactctctcaaaaaattattttcaaatctgaatctttttagccatttgaaaccaactttaaaaaaagtctatttttgaaatttaaaatattgaccatacttaatagtaattatagttaaaaaaatttaaaaaggaagaaagagattttaaaaaggagctaacaaacatgaatcggcgagctctcatcgacgcttcaaatacgtgaacatgtttgtgtcaccggaactgtttagaacttctttttttggccgcgcaaactgttcagagtccagaagttgttgtggtaagatagtggagtagtagtactacgtagcattccccgactgctatacaacggaaacccgttggaacggga

SEQ ID NO: 15494 - DNA, 1223 bp, Oryza sativa
agctaagtgcctgagccgtgaggaggaggcggctgctggtgagacctccggcgagggccggggaagaggacccgctcggcgagaggaggatgcagccactggcgacgagccccaacacagtgagatcccgcgacgtcgacgcagcagtgcgtcatggctgagctggtggcaaggagacatcaatgaaaagaggaggggcggcggtggccgaagccaggagagggagggacggcggtggccggagctaggggagggaggggcagcggcggtggtagccgaagccgagaaagggagcggaggcagtggccggagctaggggagggaggtggtagtggtcgttggcgtcgggtaggtgtccggtttctgatacctagtagaaatcacctgatatttgataggtatcgcatgatacctcataagtatcatttgatacctcgcaagtatcacattctagtggtaagaatcgtatgatacctgacaggtatcatctaatacttcgcaagtatcacatgatacatgataggaatcgcatgataccttataagtatcacatgataccgagtaagtattaagacatgatatgtcagaggtatcaggatctaatacctaaccggtatcatcccgttccaacgggtttccgttgtatagcagtcggggaatgctacgtagtactactactccactatcttaccacaacaacttctggactctgaacagtttgcgcggccaaaaaaagaagttctaaacagttccggtgacacaaacatgttcacgtatttgaagcgtcgatgagagctcgccgattcatgtttgttagctcctttttaaaatctctttcttcctttttaaatttttttaactataattactattaagtatggtcaatattttaaatttcaaaaatagactttttttaaagttggtttcaaatggctaaaaagattcagatttgaaaataattttttgagagagtttatttttaaaattaaaaagattcagatttgaaaatatttttttgtgagagtttatttttttaattaaaaactaaaaagggtaaaacaaaataaaacttctcgtcaaggctcaagccccctgttccaacttccgccggaatcaaatccatccgaacgcgcgtccgcgacggcacatctcagggtccgccccaccggccgcaccagcaattctgcaaccgacccgaccgaatccatcctccccgccagcca

SEQ ID NO: 15495 - DNA, 420 bp, Oryza sativa
ccgccaccgcgcgtgccgccatgagcgccctgtctgtgccgactgcctgcgcctgccgcaccgcccgtccccgcgccgccgaccagctcctgcccctacgtgccgccccatgagagagagtgtgtgtgtgtgtgaagagataaaggaagaggggaagaggagaatgacaggtgggtctcatatttttttaataaataaaatattgaccggattaccacgcatacgccacgtaggataaaactgctcctagattaggtcgagggggtaattcgtccggtattgaaagttctgagtaagcaatgtctggtttttaggtttatgggggtaattcggtcgccgcgatagtttaggaggtaatttttttttgagacaatggagtaaagcacttgcactgtaaatgcgtagcagagcaccgccaca

SEQ ID NO: 15496 - DNA, 1070 bp, Oryza sativa
agcctatatttggacttaattatattgcttgcaaaatatcatgcattgataggattgcacgtaatatgtttgccccgtctgcgaggcagattagtgggcatacctaacttgttgcatttgatccttcctttgttaatcgttacaccatgttcccttgtaaccacccagttgcgcctcggtatccgtgcactctgtgcgagtatcgacggtcgccttcaaacttaaaatatgataaacatcttgggtaaaacttgggttttacaaaagacttggaaaacccgacacctgggtcggtgcttacgaactaaatgaatttccaaaaccgcagaccggggaacgtaccgggtgtacgatttcccgctcttgcacttaaggaccgtttccttggaatttcatccaaacataagtcaagtacgaccacatgggtggaatgggacactcctggctgagtaactagcttatcaggggagccttgatgccgagagacatgtggattcgccggggtggtgtcggggaggacccctgggcttcctggcacagtatggtctgggacctaacctgttgttggtctgggacccctgtcgtcggcatatggtaaacctgtgtcggctttcgaaatgccttgtcacgaaagcttggaggtctcccgacgtggctgatccccacgggctggtgatccgggttagtaatgtcgtgtggataaagtgtaccccctctgcagaggttaacaaactgttcgaacagccgtgcccacggtcatgggcggatgtgaggtgattcctagcgtagttttgtttgactactgcttgtgaaattgctgttgtgaaaagggattcgatgtttgaaaaatctgtagctgatgggatcagctaggcccgggtggccgtttgaaaagttgttggcccaggtggccgtttgaaaagttgttggcccgggtggccattgaaaagctgttggccgggtgccaaccttgtttcaattctaaagactgatgcattgcacatactccgaccggacgagatgcactgtctcatccgtgtcgtttgagaagcactcacttagtcgttttt

SEQ ID NO: 15497 - DNA, 1501 bp, Oryza sativa
ttggttaattcagtactccacaaagacagcatatatagctatacgtatatagaccagctgttcttcagtcctcatctagaattttctgccatgcatatatatggaacttaatcatccgacgtgcgtgaagtcagtcatctatataataatctacagtagaaacgttgccgccgcgcgccgccgctctggcagccggcgagtacgtcaccaagtcatcatcaccaaccaccgaagcgtgacgccgcgcctgtccggcgtaagatacgtgcaggtacgccagtagtgactgatatggtttcaactttagtacaagcttagatcggtagtacgtccaggactgaacggtatctctcacctctcacccggatcggacttttcccggctgaccagtgaccagaaatgtcaactaaactaatcgcatgcagaaaaggagggttgaagtgagcagatttactacgatagcatggtaatttaattcgtactatcttctattttgtccatttcgaaacataacgtattgtatatgcaaaggcgttctaatttgaaaacattctcaccgcgtccccactaatgcaccttccatactatacatagtagctcagatgtgtgtttgaacagttcaattcaaactcatcacgcatctttgttaactggtgtcacgccccgaactagtaccgaccggaactagcccgtgacgctccaaattaacctgttgatcgataccagtcccaggaaacagtgctggtatcacagggagacagaatatcacagcaacaacggtctctttattatagagtacggatacagtcatgttgggctacggacagatcccgagctcacaactgcattacaaaagggaaacggaagcaggacttggaccaaacaacacaggcgcgacttgggaactaggccgaaaccctaaaactcatcgtagccggcttgctcctgaaagaactcctcatcagcaggatccgcttcatcttcttcagcaactgggggggatttatttatatagagcaagggtgagtacgggagtactcagcaagccaagggaaattagtgtttaatgcaggcttcaaggaaaggctgttgtttttgcaattgattttatttgaactcttttctaaaaacgactaagtgagtgcttctcaaacgacacggatgagacagtgcatctcgtccggtcggagtatgtgcaatgcatcagtctttagaattgaaacaaggttggcacccggccaacagcttttcaatggccacccgggccaacaacttttcaaacggccacctgggccaacaacttttcaaacggccacccgggcctagctgatcccatcagctacagatttttcaaacatcgaatcccttttcacaacagcaatttcacaagcagtagtcaaacaaaactacgctaggaatcacctcacatccgcccatgaccgtgggcacggctgttcgaacagtttgttaacctctgcagagggggtacactttatccaca

SEQ ID NO: 15498 - DNA, 1501 bp, Oryza sativa
actacatttagtggagataaactttatagatatataggatgtgataagataacaaggtgtagcatggtaattctctcagcagccaattcacaaaacaaaaacaacagaaactctcacatcatattaaaaacaacacaaactcttcaatgcacaaatcctccgggctaaacgccgcgcaactgctaaaatggaagatcaaagcttcctaatcctatgacaacaattttctttcttgtgctagtcatattccctttgctgatacatacatggaacggaatgcaaagtagtatatagctgtgtaaagttgcaaatgaaatcccctggaatgccagtgctgcatctgcatgtatataaattaaccgggtgttcttcacgagcgcacaccgttggggaaggacgcgtccagccatccacccttcttggcgcgctcgacgtagcagcataactgcttgccggcgtccggcacgtcgagcgcgaggtcgtcgacgcagccggccacccgctcgaagcccttggtcatctggttcggcgtgatgaggccgcggccgtagcactcggcgaggaggccccacagccgctcgtccttgccacgcttctccatgatcgccaccagcgccttcttcaccacctcgtggtggaagaatggcatcccgagctccttgatgcactggcacgcctcccggatgtcgccgccgcagtcgtactcctgcagcagcctgccgatcttgtccttcacgtcgtccagctcccacccggccttgccggtggcgccgccgccccagcaacgcagtatccgctccgcagagagcttcgcgccgagcagggcacgggcgttccggagcgccaataagccggtggaggatccccctggcttgccgcggccggcctcctcctccattttctctaggttcgatggcgcgatcacctcgtcgaccactgacctggcgaagaacatggtcaggtcctcgacgatggcggggttgtccagcgcggcgtcctcggcggactcgatcaggaggtggaaccccgacacgacgtcctccggcggcattccgagcgaggacagcagcacggacgccatctccttctcgcggctcttccggtccatcgcggaggtgatcagcttcttgacgaagatggcgttgtaggaggaggaacacgcgtagttctcggcctccaggctgctcatcacctcgatgatgtcccctgtcaagaagtactcctttatgatcgacaatgtcttcgccttgaactgccgcaccgcagcgtcgtcctcgacgacggccttcttcggctcggggcccagcggcttcagcgacgacgcgcagagccatccctccgacgaggccttcaggatcatcgatttcaggaggcgcctcgcgtttggcacgtcgagcgtcagatcgtcgacggaatcgatgaggcggttgaaccctttggtgatctggctctcgttgatgatgccttcgtcggacgccgacttgaggagatccaggatgtg

SEQ ID NO: 15499 - DNA, 1501 bp, Oryza sativa
gccgaggaagggacaaatcgatgatcgtttgtgtgtacagctcgcaagttcatcgcatttttagcaaccatacgtttttgctgtagttctgtgtgcccgattggaatttttcattttcgccgtccaacgcgagtagtagaaaactgccaggtggggcccgagggcagtgagcgccggggctttgcgcaccccatcggcagcacgcgatccagaaagcttcgccttttgcttgccctctggcatcgatctgctgtccttagctttcccttttgagtttttcgtggatcttttctcagtcctttccatccttctgcttttttatgtaattgcctgaaaaagtccagagcagaaagtttttgggctctgcttggctattttggttggtgtcttttcagtaaatctggttattttcagttggtgtcttccccatgaatagacgaaaaaccgttgtttagtttttaatgagttttaggattttgggagtgaattgtttattttgcagaaggcaactaaagggtgatttaatcttaaattcaactctgaatgaccgaatttgaatagagtgttgtttcatcatcaccatctcatcctcaaagcgacatgcttaaaatagaaatgaaaacaatatagtaactcatctcatttatatattagaccaactagacataccaaccatacggtttaattaaaaacatacaagaaaaatagctccgatatatagtcaagatagtactagctactcgcacacaccataccaaataccaaaaagaaatcatcccacaaaaggaaataaataaaactaaaataaaaaaaaagaagaaaacaaagacagccacccgaggaaaacgtcacgcgacagcatttgacaccaaattagcgaaccgccgcctcggttaaactgatttttacagcggaaaatcccgctaaaaatcccgaaacagctagaaacccatgttccagacatcgcagctcgcaccgcggggcctaaccgtggcggttaaaaagcgtacggcgtcgtcgcgttccctcccccatttcatccctccccttctcctccccttctcctcgccttttacccccacacctcgcctcgcctcgcctcgtctcgcctcggcgctccgctcccctcctcccatctcgctcgccgtctgagccaaaacccactcggctagccaccggcggcggccgatcggacccggggccaagctgcggcgaagcggcgggtcacctccggctgcgtcgtcgctggcggcggccacttggatgggcggtggatcgggggcgagctcgtcgttgtgttgagggcgtctgcgggaggcttgaggggcgtgatgccgggtgtggcggcggagacggcggtggcgtcggcgtcgggatcggggatctggtcgcggcggcgggacgagatcacgttggatcgcctccagaaggtaggctcgcgtgggcaacgactttggtctggtcggggggctgggtttgatgtgagcggtgggaattcggg

SEQ ID NO: 15500 - DNA, 1501 bp, Oryza sativa
cattaatgaccacaggtttacagcgaattcttcttggcacatgaaacctgacacgacgtgttggtcgatccggaaaccaaaaaaaaaaaaaactgcagggaagaagggcgtgagggacgcggcgccggggccggcgctgaactggagccagcgggtgaaggtggcgtacggcgccgcgagagggctcgagtacctccacgagaaggcccagccgcccatcgtccaccgcgacgtgcggtcgagcaacgttctcctcttcgacggctacgagtccaagctcgccgacttcaacctcaccacccagcctcccgacggcgccgcgcggttgcactccacccgcgtcctcggaaccttcggctaccacgcgcccgagtaatacattctctgtctgaatccacactgtgtttgattggagaaaaacatgatcagaagattagtagattaattgactttcggtaagaaaggtcaaggttaatttttgaccgggcaaatggattctctctttcgctttctgaaggtacgcgatgacgggacagcttaatcagaagagcgatgtgtacagtttcggagtcatcctactggagttactgaccggcaggaagccagtggaccataccatgccgaagagacagcagagtcttgtaacctgggtagtgtagtaggccatgttcttgcacatcttgttggagcttttcatgtgttccaagagccatatgctcttgtggttgtctgaattctggttttttttttttggacaatgctgaatttctgaacattttctactggtgaaatggactaggcgacgccaaggttgagcgaggacaaggtgaggcagtgcgtggatccgaaactcggggatgactatcctccaaaagcagttgccaaggtaatacaagaccatcagtttcttgcaagtttgcaggaacgatctgagatgctatcttgtcgtgcattgtgtgtgttttcagatggcggcggtagcggcgttgtgcgtgcaatacgagtcagatttccggccgaacatgaccatcgtggtgaaggcgctgcagccacttctcagcaagccagccggagcaggagggccctagcagcacatgcatactaacaccagcccatgcatcaaaccaacttagcatccaaaacacattatgtgctctgttcttcttggatgctgagacttgttaaacagctggtgattgtaccatgtactactcacaaatcaatcaaactgctaaaagggtccaagggctcacagagtttcaggtcattggctgtgattctccattgttccttcagtccttacctttgtttaggtttcagatcagtagatatttttgcaatttcgctgtcccgttctgtaggtacgtaagggtccattccactgcatgactgcaagctacgtcgtgttcttatcttaagacatttattgacatcacaccgatgggagacaaactgacaaccgaaggactgtagagaaaataggaggcctccttatcaaaga

SEQ ID NO: 15501 - DNA, 1501 bp, Oryza sativa
ggctcgatctttcggtgagttgtgataactacgatttgggagaaacgttgacgatccgactacaactgtacgagacgttgtgttgcgccttagcgatcgatacacctctccgtgggttgttgatcttgccggtgcagatcaaccctattcctgcaagcaaatcgaagaaacaagtaagaacaacataaaagcaatctgatattgcaaataggaatttaatacaaataataagttggggttctgaagaacaagaagacggacggtctagccgacacgcgcgctgcaagtaagtagcaatggctaaactttaatctatcaaaacccgagaaaccctgaaagggtacctagctacttataagggtgggagaacgaccaagagggtcctagggttgtgctccacctggttggggcgcacctcacatgggccccacttgggccggggtcccaaacgaagttacaagcccaaaggcccatgacaggtgatgttgcaccttgtttcttcatctgcggttgactgggatggaatttggtgatgaggttggatccgttggaaagaggactccgagagctttccatcaagtactcacgggccgaaaacggagcttgtatggagatttggcggccgtttgaaatcagcagtgtagcaggtggccgaatcggattccagcacttggatgccttgaccttgatatcttcttgttcatccatgatgtgagcaatggttgcatccgtggtagccatggtcacatcactttccttcaagattgaagatctgcaaattacaaacggctgagaatgacaacaagcaatctagatcaagtgtcctttggtaaactaagcaagcactgttttataatttctttatcaaatgatcatgtacaagattgattcctttttccagttaaatgcaacaatcaactagctagattgagaaagccataaggaatatgtggctgagagtgaaatgttgtactctcctgccttttctaccccacaagattaaagatcattctggccaataagagaaattccagaaacaaaaaagtcaaaatttttagaaacatgggaatgacaactcaacttaatacttcctaaagggatagtcatcttcacaaaatatataaaatgtactaatacattatcaaatgaagttatttgcacatcttgcaatattagggcctaaattcatcatctaaattaaagacctaaaagtgcaacaaaaaagaagaatagcagattattgtatcaatctttgtttcataaattaatatttagcaactaaagagaaaacaaagttaaaaatacctgtgcccacatcatcaaacacccaggtacaatctcttgcagagaaaatgtatttgcctggacagcataatgtcattgtcaagttatgtccctcatatagaaacgaacagagggaaatacacatgtaaatatccagacataaaaaaaatcatataacagtatcagaaccaaggcccatatccatatgcatttacta

SEQ ID NO: 15502 - DNA, 1501 bp, Oryza sativa
caagtttaatagtatagccaactactagctccaaattatctataaccaattcatataatagttgcttgctatactattaatatctgatcccacctgtcatacacacattacgtcttggagtccgtgctgcagctggctacaaatctatagcacactgctcttctctttcttctattatatctaaaatatatttatagctagcttatagccttgctattgtagctgctcttagttggagcgtccttctctcttgccaatgcaatataatgccatccatctctctcttggtgtcaaattaaagcgaatcagggctcagtgcatgcatgctagcggcaaatattgggagatcttccaaacgcactcatgcatgcatgcatgccaacaacgacgacaccactactgcatgcagctactagtaaaaatgggcgaagggcacggagaatctgattgatcgatacggtgtacgcgtcgctcgatcatctaaccattcgtagtgcagttatgcacgctagatatatatatactctcttgcttaattcctcccttcattcatttatctttttttttctaaaaaaaactccttacattccctaagggattatttggttgcctaacatcttggatgtcgagccatccatataaggggtttgttttggggagcttccagtagctacaacttctcacaaaatctccatctctcctaaacaattcaaattgtcatccagattctaagaatctgtagtcgtagaatccagaaaatgaactagaacccagaaactagaaaatccaacttctccaaattctcagaagctggctaccaaacagtagattctcagaatcttaagctcccgtaatcaggggcaagggttagtctggctaagaggttgactcagcttggatatatatgaggttgatatctggaatgcaacatgggattgttgtatgtgggaatcttctttgtttagttgtataaaactggttgttgttacctcttgcatctcaaaatttgtcaattctaaatttctcaaagattagttgatttaaactaaattcaattgttaaataattcatacaaaagtacagttggcaaataattcatcacacgctgtcacatggtaaaattaagttttatataatggcaattaggggttgtaaaaaaagaagaaaagaaagaaaataatgttcctctcacactcctctccgccgctcatcgttgcgctatttctcacccactggctactcccccacccattctggtcctttagccccaccgcttgccacttctttgacctctctggctactgttcgttgctcacacttctcgtccccgtcgctcgaaccaaccttgacgggcaaagccactagatccaacaaccacgagttgaagcctgccagatataacagcttcatggctcgtggacagtggagccggcggtcctgtggttaattatgaggggtttggctattggaggcagctagtgtcacctagagctcgtcacct

SEQ ID NO: 15503 - DNA, 1501 bp, Oryza sativa
ctctctctctctctctctctctctctctctctctctctctctctctctctctctctcatcttataagctacggacactaaggcaagcatcatcaaattttggttatgatatagatcctttcttcccacataagggttatattccacatttctacatctgcacagaaagtataaattcatgctagctagtgtgatccttttaccctcgagagagcacttcttgtgtggtgagcaatggcaaattaatatttgtggcaagagccttttgatcaaaaggtttatctcaatatagaagacatgagaaactgagtcacacgcaccatctttcctttgcacgaggagccagaaataaataaaaaggtgcatatgcagtagtaatatttaaaaatcgcaaaacaccaagggtgcctttttttcgcccaagtgcttgtagatatcaaatggttgcgactttatcaaaaggaagaaaggtagctagctaggtagctgtgctagccatctcggagaaaacttaaaggagggccaatgcgagttttttctcttagcgatgttggaacagttgggaaatggccgaaatggggcaccaccattggttgtcacgtatgtaaccactaggggaacagcgatatatacaggtcccaaagccacacacacccccactctcaacacaacaaacagtactgccacatcatgccaaacagcaacatgcatgcacttgtcaattcttaattaatcaccatcaattgatttaattataatttacacccaaactaattagtatttgtacatagaagtataattaattaagaaaaataagggaagaatatatatgtttttttctccctctttttttttcctgaatactctcattaattagctgctcagcttggttatacagacaaaactaaacctcacccccaaatcaagatggagagaaagatgaaatggagaccggccgatcagtgtcaaacatagcctacgtacgtacgatcaaaacctctccagaattaatcgatggatggatcgaccacgctggttgattagcagctagctagacgtggccacctccaccgccgtcgccgtcgttctcctccccggcctcctcgtcgtcccccacactgatcagcggggccctctccgacgacgccgagcccctcctctgccccgcatttccctccgccgtaccggcaccaccgttgctgcactgctgcttgtccccagccttcgtgtcgacgcctaacgcgtcgccgcagccgcagcagccgccactcgtggccaccatgagcccttcctccagcttctccaggtcgtcgctgccgtcgttgtggccgctctcgctgatgggcacgtaaccgcggttgtcgctgctgccgccgccaccggcattgatgttattggcggcgggagacgttgtcgttttggtgttagcctttgcgttggcggtgttggtgttgctgttgttgcactcgtgctggtggttggtgccgctgcctgtagtggac

SEQ ID NO: 15504 - DNA, 1501 bp, Oryza sativa
tttggtacagaatcggcacctatatgcttgcgagggcagcactttctctattataggtgccgattctttatcgaaaccggcacctacaatatcacataggcgccagtttggaaaccgataccaccgactttgatcattagtgttgactaataggtgccggcatcaaaaccattacctattaggtcttcccaaccgttacatatatggttttctgtactagtggtgaccggctggttcgtttctagcaggtacgtggctcagttctcccggagccttcacgtcgagtatgcaagtaaagggatccatgtgcaatgccaggtaacttaattcatcagaaatataattcgtaactttcagttgaatcatttactcattgacagattctgataaaatctggaaagtatgtgcatgcaaatagggaatcaaataggagtatgtatggctcttatgtatgtgcatgcatgcaggcaccgttcctcgtggacacgaggctgatgttcaggttcgaggaggcggcgggcggcgtgtcgctgttcacggtgaccccggacgcgtacgcgcgcgcggcggtggcgtggatcggccgcggcggcgcgctctgcacgccgggcgtccggcaccagctgctgcggcgcatggccgccgccgttccggactccgtccacgactggatcctcctgcacttaaccacctggaacagaaagcgtcgtttcagcggatcagagtgacaagttctatcgacagattatgcgatgctaaagaattgccaacaaataaatgtgtcttcgaaaagtacacttgccgatatattgtttgttgcccattttattcacactaggaaggtggcccgcgcgcatacgcgggcacttatattattgcaagctaagattattgtttgttcaaaattttcatctaatagattaagggcaaactaaagtttggataatgttatttcataataatttaagggttctattttgcttaagatatcttagaaaaccattcacaaaattttgagtaggagatacattaagtacttacgacttttgaatcatgttttttttcgagtaaataaaaaactattgtgacttttgaatcatgtttaactcaaaattcttgtgattaaatcgtctcatgaagacgcatgatatagttagaaagggagggaagcgtatgtatggaaaaaaaagaagaaagggaaaaatgaaaaaagggagggaaagcgcacgtacccacgtatgtaggtgcgtacctatgccgcgtatgtaggtgcgtacccacgtaggacctcgtagtatttagtttgttccaagatcaatttaatctaatagtttataatattgaacgtaccgatttaagtgaaaattaaataatagatactttgcttttttttttagaatttatagtactttctctaatttattagagcaccatgtggtagcttgagagcattttaagaaaatttaaaggacttaacacatgtaattagaatattaaccat

SEQ ID NO: 15505 - DNA, 1501 bp, Oryza sativa
ccccgcgtcgccgcccaccatgagctccggctgcctcctccacgggcggccaaagggaagaaaagggcggcgatagctggatttgggggaatcggctcgcctccgtccccagccgcgtgaaagagctccgccgctggccatccgagtacgcgcatgagagagagagagagcaagggggctgggagaagttgggttaaacaaagggatgacaggtgggcctagggattttttttaatttttttttgctgactaggttgccacgttagcgccacgtgtgatagctcaaatcaaaaccgcctagaacagtgttcatggggtcgtttgtttggtatgtatagtttatggtgtaaaatgttcggtatttgagtttagagaggtaattcggttgaccgcgataattcagaggtaattcgtactttttcctaaattaaatgccggtgatgactgcataagtgtactataataaatccactcattattatctcgcatctcacatatgtcctaattcgaattaaccaatgcaaaaggatatcgatcgaacgaatagataagtttgtaccatacttgtattcgagcatgcatccattgacagtgtatgtcgaggtgagcatggatcgacatgaatgcgaggcataattgaaaaaaaaagagatcgaaatggccatgattcagatgaagacaacgacacgtcacgtaaccacgctagttagttgctgctttgctttgatcgtgtatatatatgtcagtgtcgcacatcctgcccaatttggaccatatatagtggagtacatcttagcttaattactattactactgtaatgatgtttcatcatacgactcctggatccgcatgatatccaagatgtttgcatccgaattgtacgaaatttgatcctcttttttctcctttcatcatctttttgaagatcggattggatagaaaccctaggatcgatcgatcgatggatttcaggatcatgcacgcacgattcatggggagagaaaacagaaaagggaggggagaagaaaaagacactgtagaaaagaagaaagaagagacaagaatctttgaatctctgacggcgacgcggggaaggagagagaggcgcccccaccatgcacgcagccgagcggttttcgcgccatcggggcggcatgaatggaggtgttttcgcgccaaaataggggccgcgcggcgcgggaaaacgaagcctaacctccacgtgatggaactatggcagtgtttggttcctctgaacttccaaaaatttcgtcagattaaatgtttggacacttgtactaagtattaaatataaaaaaaatcaattgtctagtttgcatgtaaattacgagaagaatcttttaagcttaagtacgccatgatttgataaggtgatgctatagtaaacatttgctaatgataaattagttaggcttaataaattcatctcgcggaatctgtaatttattttattattagtttatattgaatactttaaat

SEQ ID NO: 15506 - DNA, 1501 bp, Oryza sativa
atcaccaaacaagtcgccggaaccaactagtcttggtccccccccccttgtggatcatttctaccgaatccttgttaaaagaagagagaaacagattatggtgttggagtagtttccctgctcaaaaccacatcgattgccagctgcttttatatcggtgagaactgagaaaggatataagaaaattcagaacacattaattaattatatctgacaatgttgttatcatactgataaactaatatagcaagaaagcattgttggcatgcggcaacaaacacaagtaatttgcctctagctatatgttttgaataaaagccacaaatcttctaaaccatactcctgacaaatttttagtacacgactgattactgaacatattaaggccagttttagagtttagtatacatataaaagcatgaaacagattttcaaagctcacacataatcaaatgacgtgtaatttgatcaactaataacttgtactagtactcctaccaccctgatacaaacttgtactatgggttaatgacaaacattttccgagtcaaaaaagttaaatcacacctcaggctacacgacaatagtcctatctttttagtcatcctgttgccaaaattctatgacagaggataaaagagaatcacaacaaaataaaaaaaagaaaaaaaacaaattattgcagcacaggtggcaagagatgaaaaaaatcagtaaaaaaaaaaagcagcagcggtggggtcacggggcctcgcatgccgcaacagtaaatctgacgacaccgccacgcccttcgcaacgtctccccccacccacgtcgccctctcactgacaggtgggcccggggcccacctgtcatcaacctgtacccgcgccaccgccgctccacgctgtcccgtccgttttacggttcggggttgtgccacggacggagccacgaaatgacggaaacgcccctcgaatcccccgcgtatttacgggtgggtgccatcgtggcctcctcttcttctccctcctccctcggcctggacagaaaactcgtggctcgataactcgttcgactcgtgcctagctcggctcggctcgtttaaatttgtcaacgagccgagctagggttttagctcgtttgttataacgagccagctcgagctggctcgtgagctgctcacgagcctaacgagccaagcccaacagccaaagatcccagctgcccaatagtccaaagagataatatgaagcggtcgagctggcccatcaagaaaaaaaatagcactagccctagatggagaaacacacgcacgtgacttgtctacgcactgtgattctgtgaatcccagatcccctttctactctagcgccgcttgctctccgctcctcacgccgccgcgcgacgagagcgccgctcgctccccgcgtctcacggcgccttgcgccgcccgccgacgaggtcgcgtgtagattgctcgtaggccatagtgacgccaaccctcgcctcaatcgg

SEQ ID NO: 15507 - DNA, 1305 bp, Oryza sativa
ataacaattgctatggaccgcaaaaacagggagaaagagatggcttcaattcttctatcctcattaagcatggaattgttctcaacagaagacattgtcaagggtttcataatgcttcttgaatctgcagaagataccgcacttgatatattggatgcctcagatgagctgggactgttcctagccagagcagtgattgatgatgtgcttgcgcctctgaacttagatgagataagcggcaagcttccaccaaactgcagcggggctgaaacattgaacatggcgcgctcccttgccactgcccgccatgcaggagagaggcttctgagatgctggggcggtgggacaggatgggttgtggaggacacaaaggacaagatagcaaagcttctggaggagtacgagagcggaggcgatgtaggagaagcttgcaactgcatccgcgagctgcacatgccgttcttcaatcatgaggtggtcaagaaggcgcttgtcatggcaatggaaaagaagaacgacaggatcctcggtctgctgcaggagtgctttggtgaagggatcatcaccatcaaccagatgaccaaggggttctcaagggtgagggatgggcttgatgatctggctctcgatattcctgatgccagggagaagttcctgtcctatgtggagcatgccaagaagagcggatggcttctaccctcattcggcgtcgctacttcagcttgaaccaatgttatgagtgagcaggaagcatcaagctggaccggaccgatgaacaacgaagcaagaaggcacatgccgtgatatttgctgcatccaagatattccaagttgatgattttcatttgcgttttctgatgcttgtcgttgtgcttgcgcgtgtaggtagcggagcgagcccctcttacttgtggttgttgtggtggcttatgtgtctagatctttcacctctgacacacccgttgctgttgttagttgcattccatttttaacttcccccatagacccttttttacttcacaagtaaaaacagagaaaagaacccccgtcatgtaaaagttgctccctgcctcagcatttgcatctgttgcttacctcatttactgtacgttctcgcctgcagcgataagtagcttgatgtgttcttttttaaaaaaaaaatactaggagtagatgttaattgtctttctgtgatgatcaaggcgacagagcacagttgcgctttgtttagctggttttacaatggggattggattggcaccaacattgtgtcagtgaatcatatctgttgggctgttgggtcag

SEQ ID NO: 15508 - DNA, 1501 bp, Oryza sativa
attatgcaatttgaaaatgagcgaagttgtaattcgacggtactaaaagagaagatggagatgatcaaaagatttttttttttaagttttgagtagattcctggtatagagtagacaccatgtgtgtttatggtgttaaacatttatattttgacaaacatctatagtttagcgcttggtttattttcaatacttattgttgataatcacatgagacacctttactaattcgaagaatatatttatttttttcaaatttattaataataactaatatgtgggagtatatgggagttttttattttttttgtatgatactatatacgtatattttttttggttctatcttttttgacacgatggctttattcttttaccgtacgtatgtaggttttattgttccttttcattcttacgtacttacttttttttttggcgaacctattctctctcgtatgtataggtggaaagtattagtattagagatataaatatctaatctaatgatctaaataatggatccatcaatttaagtgaaaatcaacggtatagatatagatataatctaatggtctaaaataacgggtccaccaatttaaatgaaaatcgacggtgagattaaatagtaccacgtggcggtttaggagcgtttataagaatgccacgtatcgtcttgagagtgtttgtaggtcgttcaatagacttttagtatatgatagatagatagatagatggcgtaaggatatcaagatcgagaatggccttgtaaaatacgggcctttagtgggctaggagcttatggtggagtatagcaatatgggcttctgatacaaggccctggagctcgcttggtgcttaatcatccggctatgctatataagcaagctctttgatctaaaaaccagcttgagaaagaattatttgcattttagccggtcatgttttggtactatactagtataatttgaacaaaaatacacatttatatttgaactctctaggctattcccctattacatgtagcatgacatcagagtcaaaacagatacgcactataaatttagtttcatcatatgcaacaaatgacattatacatagcaatgacatcagagttaaaatgaagagaacaaaaagaaaaaaaattcaaataacctccccaaaaatcaaatccaaatcaactggctctctagaaagcaaccctgttccttaagcaacttccctttgtcttcttcccagcggcccataagtagtccacatctccactctcttgaccacgaaacggcccaacacccaaaacccccgggcccacatgtcatcctctcccccaaccctagcgccaccggcattccgatccctcctacccctggccccacatgtcagtgacccgaaaacgcctcagggtatatatacccagctgtgcctaagccgggcacacgccctctgaccccgatagaaagggaggaaaaaaaaaagagaaggcgaaaccccaaatccgccgcga

SEQ ID NO: 15509 - DNA, 875 bp, Oryza sativa
atccccgcgccgaggaggcggctactcattgtggccacggcctccgcctccgcgtcccgcatcactcgccaccgcctcctcgtctcccgccacctcctcgtcccacgctgccgccgcctccgcttcacctcgccaccgccacctccgcgtccaccgccagccgccgactcgcgagagagagtaaggaagagtgagagagagagagagagaagagagaggaagagtggaagagaagtatgacaggtgggtcccagatttttttataaataaaatcctgactggactgccacgcgtacgccacgtaagacaaaactgttctggattgggtcgaggggggtaatttatctggtatcgaaagttcagggtgaacgatgtctgattttcgggtttagagaggtaattcggtcgtccgtaatagttcagggggtaattcgtactttttcctatttcataatatgattttgtcatgcagtgttttttattgaatttttgacatggtacataagacaacacgcacattcatggaccagccgtgacacgcatcaacgagatatgctagtggagtagtgggacatttgcttctttttttttggcaaggaaagtttattagtttgttaaatctaattagtgcacacggccacattgctacttatagaacatttcaaaaaaaaacatgatcttaatcacttttcacacagtagaattgcatcaaaatttatgcatggaaaataacacagagaaggtaaattaatagatacgggtacatatggttgaagtcttatttatatgataggtccagcctcttcccctgtccctcccttatgtttaggagcgagatctgcccaagaacaacccccccctccccgtcctgcagc

SEQ ID NO: 15510 - DNA, 1501 bp, Oryza sativa
ttttgataccctcaacaaatggttcgctttttctttaatggaattacaattgaattcacataaccttcacataccaagcacataaacataaaaacatgcagtaatgcacaactacgccaactgaccaacagccaccagagcatgtaatcgcaaaatctagcttcttgtcaaaaatggcttgggtaccatgtcttttcttgttttttttttaaacaccgtctttgtacacatataaagatagaagatgattggtgagctcacaaaatagcatgttgtcttttccccgacacatttgggtgcttaggaaatgaaaacataccggctacatattataactataataattaagtgctataacatttacaggagagtggctggtcttataagtatgatattatgcgagactatgtgccaagtagactaaagctacaatcaacgacgacatcccttcttaatacacaataggatgaatataatggtgaaaaaactactacaataaatactacattactcgcacacaactaggttctcgagattgctctcctctctggattgatgtgttcgtttggccattcctaacccaagacactaaatataatttccaaaaacttcacatcaccaagaaactagtactaagacacaacttttccaatgcaaacatcattattctatacttaaatttaatgctacttatttcacatgatgtcttggatgttgtgtagaaattctctttcctcatttattcatttgctatatcattttttattctagatggcaatttatttaatactatggataccatcttagtcattgggttgggaatggcctaagatcactcaccatgtcattaagcaagctctctagggctccgcgtcccctgtctcagcaaatttcactaaatttaaaagacttttttgagtaaaattcaactcaaacatatctgagtggcaagtgcgtgggtccgccatgatctacaccaacaagctccccggtttggatcgtgtgtgcatgacggtgcagccgccgacgcggcgcgccgacgcgatctgaaacccatccccctctctctctctctgtgtgtccgaaggagatatttttcgcatcgaatggagcagcgacaagtcatgtgaaacagtgactgtccaaaccagcacgcgtggattcttcagatctcgatgtcctcctcctcagatgggccatgatgggccggcccccgcaaccaacggcccggatcacctcttccccccacccccatcacaaaaccccaaacccatcaccaacttcccaatctcacccaccccaccaatccccaccagatccaacggcccagatctccccctcacccagatccaacgcctccccttcgtcttctccctccataaaaccccacctcacccccaccctcccactccgcctcctcctcctcctccctcctctctacccacccaccctctcgccgtcgcagatccgatccaggaagagctcgccgccgccgctgcca

SEQ ID NO: 15511 - DNA, 1501 bp, Oryza sativa
gtaaagtttgcgagaatgcttttcatcgggcgtccgggccgacgcaagaaatcggacggtagtaacggtgtctcttcacccgagacaacagaagtcctcgcgtgcatgcagggagctagtgcacgtaagcacacgtcaagtgcatgcatccatgcatattcaaatattcaaaatttaaatacatgtttctctacaatcatttatccaacctactatttaattataccattagattcgttataattaaatatttatataatgatcttacatggttatatcagatagcggctggcgcggtaggcggcgagcgggggcgaacgggcaatagcacgcgggggcggacgatgggcggcggcagcgggggtggacgggcggcggcccgtggctcgtggagagcagctcgtttgccgtcggcatgaacgcgcggcttgtctccggttacatggcgcagctcgtggacgatggcgacgactacaaggtcgttggccgtgaccaccagggtggtcggagtagacggcggcacacttagtggcacgcacggcagcagccaggcctccagccaccgcctccgccaccggtcaccctaccatcccgagccctacctccagctgcatccgccaccggccgccgcccccatccgagccccgtctccagcctcctccgccaccagccgccgcccccatcccgcgcgccatcccgacggcgaagaagaccggactgcggcgccgaacgcctacctgccgccgtctgcgccgctgcgccgtgcgtgctgccgtgcctgccgccgcccaccgccacccccatcctgacggtgaagaagaagaccggaccatcctctctgtgtcccgcgcctccattgctccctcccggaggagttcaacgtcgctgcctctgcgtcccgcgcggtcgccgcctccgtatcccgcgccatcgctgcttcctcctggactgcggtgcctaacgcctgcctcgccgaccacccacgcccactgcccgtccccacaccgccgtgcgcgctacgagagaggaatagctagagagaggaagagcgatagatagaagaagagaggggaagaggggtatgacatgtgggtcccatattttttaataaataaaatactaactggattgccacacgtatgctatgtaggacaaaatcgctctggattgggtcgagaggggtaatttgttcggtattaaaagttcagggtgaacgatgactggttttcgggtttagggggtaatggcaaggaagttgctagatatcccatgatcccaaggccacatgcttaggaacctatcagtctgtcacaccaatggcaccttttcatttttaaccctataaatatttctctttagatgtataggtttagagattgagttttccatactagtaactttttatatactttatctataataaaaaccacatatacatgaaacaccttggaagtttcaagtcttactattgaaattgtattctttactaattttctttacc

SEQ ID NO: 15512 - DNA, 1501 bp, Oryza sativa
ttttcctcttcaaacaaagttttctctcaaattacttatccaatatacaatccgattacaccatgtgttcgttacaattaaatcttcacaacaacaagatcttacatgattatattataacgaaaaatatttatatttgtaaattacttttatcatatatatatatacatatatatatatatatataaaagttacttttagatttaactaaattacgtcttagacatttaaaagtaaattcaataaagtctaaaagtaatttgcatctctactattataaaaattgaagatgtttttgtcggtattttggtacgtcatccgtgtatgagtcgattttcaagttcttttggaaatacatattcatatttgagttagtttttaagttcgttcgcttttgagaagtagtcatattagaaatctcttaaaaaaaactcacatgctaacttaatacgatcagactccttattgttactcataattttctaaagaaaaaatatatatccaagcgaattctcacagtgaattttatcttaactaaattgtataacaacatggttaaaatagccttcacccgttgtaacgcacggacatttttttctagtattaaaacaaaacggaagtaactttgtcacaacattagaagtaaattcgttgtaggaataaaaatatgacttcacgtccaatgaaaaaaggcattcattaaagttactttctttttgttataagttacttctataatatatgtaaattacttttacgctttattgaatttacttttatatgtctaagaagtaatttaatgaaatctaaaagtaatttagatatattataaaagcaatttatattttttatcaaaatataatcatgtaagatcttgttataaagatttaattgttacgaacataacggtacaatcagatcgtagatcggatgagtagtttaagagaaaattgtatttaaagtataggtagatagtgttttctagagtaaccaactggcactagctatgttacatccatttccattatgtaccttgtaccgaatgtctgtctccccgtcctccatggctgtagctgcacagttgattatactgtacatcaatataattcccacataacacgacttggcgtaaaacatttgattcttttcgtgacgtttcacgtgtcgatcagcagttgcccaacatcaacactgctattaattcccgcccggcccagccaaacaacgtagtaactgcttcgcccagctcgagtcgtagcaccaaaagaagcaagcacgcctagctcgttatcgatcatggcggccacgtcgccactgccacggtgggcgccgacgccaagtccgtcgcggccgctctggcgctggggctggggcggcggcgccacgccggacgcccgggcggacggaggtgtcaccggttggacctcgtcgttcttcgccgccgtcttcccgtggacgaggagacgacgtgtcgatgacagatgggcgccgtcggccggcg

SEQ ID NO: 15513 - DNA, 1501 bp, Oryza sativa
atgctagccgcgcaatctgcgcgggccaccatgctagttaaccgaacaagacctaagacctaaggtgggggttgtggaagtggggatagactatgcccttttacggagaaacgcgaggcttgaagttgctgcggaataagcacaatccaatccgagttacggtataggcgtggacgacagaatggcgggatggttgggtcggttgggttgagttgagctgggaaggggtgtgtgatagttattttagattcacatcgatcaaatttgatacaagcgacttacaaccagctaaaaatcaaatcaaacacagactacgcaccaaaattttgataaaaatatctcaaatttttataatagtagagaagagataaacactctaagattgtgttctgcacggaaatgtggtggcttattaatgtatgattaattaagtattagcaaacacaacttaaaaaaaataaaataatacgattctgaaatcaactttcagatagaatttttttttaaaaaaaacatgcacgcgaaaaacaagaaatatgagttgggaatggaaagggaagagtacgggtggggatgctttggagttcactccaactccatccgaaggatttgatgaaatctctgtcatctctatataagaatggttgggatgaagtaactaattcctaatagttttttttctgcatcttaatatttgtaacaaatctaacgaatactatatatatatctagagaatatacaaactgattttacttgcataacctagaaatttcatggttcatccacagtataaaaatcgtattgggctttgtggctataatattttagcaacatttttgtgtgtatatggtttatgtatgtttgcacgtactaaatgtttaacatagttttttatacatgaccatagcttcttatttggagaagagagcgtgcatactttgttaatgttgttggcagaaacatactcactaggaacataaaaaggaagaaaaggtaagtaattttcattcaagcatatgtgattgagggagttaattaggacaagttaataagtggcttcatcttagccataggaaataattgatggtatggatttagtcaaatccacctggtggagttgtagctaactctagggggatctggacccggaagagcaacaccctaatactcgtaataaaatagcaatgtacgttgctaatgccaattcgagggtgcgatttgttttgggaatacgaaattgagccctataaattgtccaccctataggccgcagattcctcaatccttactgcaagcggcaaagccctcctcttcagctcttctgacggaaaagaccacagcgatggccaattacacatggataatacaatttaagtagtgcacgttggcaatgccaaatcaagagatgcaattgcactccacccaaccctacaaatatccacccgcagcttagctcgatccttgcccacttcaaagttcaaacaacaaagccgtcctcttc

SEQ ID NO: 15514 - DNA, 1501 bp, Oryza sativa; identical to SEQ ID NO: 15513

SEQ ID NO: 15515 - DNA, 1501 bp, Oryza sativa
gttgtctcgtcgcgcgccggcgcctcctctcgtcgcgcaccggcggcggcgccagcgcctcccaccgcatccgcctgcttcccctaaggcaccgcatccccttccttcccagtgccggcgccgcctcccttccatcctcggtgcaggcgcctcctcccttcatccccgctgtacagtgctgcacagagtcgaaacagtcttcttcaagcccagatccacggcaccaggtacaccttgatcctctcctcacccgcttctcgtgtgtggacagaagcatagcagttgatatgccatacatgccttctttggggttctttggtggaatggcttgatacattctgtttgagatgcttgatttctactgcattttaactgtatatacttttcaatcaatgtcttgtctagttccatatatgtacatggatatcttttctcctgctgttagaacttgtatggttaagttcgctgcaaagtgattttcttgattctttcactattcagagcgtatgttagttcatctgttgctaagttaagatcttaaaagtctgatcaaagaaaagaaaaactcagaaatggtatatatcatagaactctaagttgttagttcagtgtttaacttgcaatgagatgtttttataaatgaagagttaattttaatcatgcctggaatttttacaagtttataaataaagaaaccatccgaagttttattacccaagcgatgcatttcaagtatgaaaaataagttggaaataggtttaaatttattgtccttactttttgtttttcatcatcttagactagatgtttttgttttcatgaaactagaaactcaaaaaagatttatagtgctgtgtggttatagcactcatgaacctattcctatcatatttggtcttgatttgtttcagtttattcatcaggttggttggggaatgcagttcattagtgagatatcattatcagtgctattcaactactgcaattcattatcagcagccactgtgttctgctaaacacatgtggtgctcaggttatgaacttgataggtgaagttaatggttgggtcaatatatctcaactgtggaaacaacgtagcacatgtatctgctcatgaagtttgcactttcggtggcaaataaaatttaatttaaattgtgtactttaagcatttttactgaggagtgagaagagatgtttcccagtctaagtttccatatattcctatgacatctatatttttgttgtttcatctgtgctccagttgctataacctggtttgctaatttgttatcaagaaatcgtgttgtctttcttttgtcttcctgttttgttaaataggccactgtagtgacactggtttgttattgaaacaaccgtgtataagtcaatttcgataatttttttttggccaaatgattgttatactgacttctgctgttaccatgttactatttaatagattttgtgagttctagctactagccaagaagcatggctg

SEQ ID NO: 15516 - DNA, 1501 bp, Oryza sativa
gccagataagtgcggcagcaatattggagcacttatgttgccattttgttaggtacaatgaactatcagagctatgtgtggttaaactgttgagaatggtaaacttctactattttcttttactaaaaccattaacacgaattaaccaaatgcagttatatgacacttgattataagtatactgttaatatattattattcctgcagatacttgatctaattagtaaaatggaaataaaggaggaaactgtaccaggggcaggggaaagcaatagttttgacgtacataacgatgaagaaagcaagcctccaaaacaatctggtccgaagaagccctgggttccgaaaaatgatgagctatctgaagaaacgaaatttctagcagctctgatgtcccttcttgtggtgatatgcaacaaaatggttgatgcacatgtattttgttatgtcacatcagtggatgcagcactggtgaagaagctcaagaagataatcgaagcaaataacaaaaacacagctgactgtctaagaatagtgaaacttgcctgtcaggtggttatagcgataattcatctcaaacctagctgcatcaaagacttcaatggaaatcatttcgatgctgtactgtccacggctttgaagaacatgtcagacatcgataactgcatgctctttgcagtccaagattgtcagataacaaagcctgccagaactctctcttctcttgtaaaagaagcccagggactcctccagaatgcacaagatgtaacagtcctatctgattaaaatcatgtattgcatctccaagaataacagatcatcgagtgtactacttgtcatctgaagactgaagttatctattttctgaactacacgagcaaatggagtgtgctgccgtgtctattttctgtacctagtgtgcaaatggagtgtaccttctatattctgtactatgcatgtcaattgtcgaacattgtatgaatactttaaaagtgtagtatctctgaaacatttattgacataagtactgttatatgtttggaatggcaatgttattattgattgtttcaaaactatggtctgaagttcatgttgagctcaaatctaaattggtggatccagcccataattgtaagtatgccatagcagtgagtgagtcaatatgcattctgtaagatatataacagaaattcttacagacagagcggaagatcatttcatatattcaacacatgtattctctcttacggaaattcttacagttagagcactagatccatttcagtccagaaattctgtcttattcgaaacaaaagcaatagatcatttcatatattcaacacatgtacttagaatttgaaacaatttaggattaaaaatacaccgtgctaggacgtacttacagttaacgcctgctgctgcggcttcttcacctgttgcccgatgcttttgtcgacgggcacggcaagccgtccgcaaaccaccaccgcatgctacaagc

SEQ ID NO: 15517 - DNA, 1501 bp, Oryza sativa
accttgtcgcagtgaagaggtggctgtttcccttggcggtggcaaaggattcccccgagtggcagaggagcggcgtggcagagagggcctgacgacggagatccatgcgtcgacggtcgccatcggaggtgcgggcggcggatggccacagggccggatgtcggaggactgtggggctgggcgccaggcggtcggtggcctccatccggaagaacaaggccgcgaccgaccctcgcttgccgttgtcccactgccatctgccgttgtcctcgacgccccgagcgacctccgccgccatgccaccgccccaagctgtgtccgcccctgccgccgtcccgccgcccttgtcctccaacgccctcctcggtgccgcccactgccgccgcgtcctccttgcactccgccaccgcccgcacaccgccgagagggaggggggaagcgcgccgagcggccgcctcctcatcccctgccgccgctgctctgtgtccccccctccccccgccggccgctgacctgtgagagagagagaggaagagtgagacagagagtgagagagagagaagagagagaggaagagtgagagattgaggaagagtggaaggagtataataggtgggtcccatattttttttataaatagaatgctgactggactaccacgcatacgccatgtagaccaaaaccaccgcggattgagtcgagggggggtaattcgtccggtttatatagttcggggtgaagaatgttcggttctgttgttcggggggtaatttgatcgaccgcgatagttcgggggtgggggtaattcgtactttttcctttctatgatgtactccctccgtattttaatgtatgacgccgttgacttttcgaccaacgtttgaccattcgttttatttaatatttgtgtgcaaatatgaaaatatttatgtcatacttaaagaacatttgatgacgaatcaagtcataataaaataaatgataattacataaatatttttgaataagacgaatggtcaaacgttagacaaaaaatcaacagcgtcatacattaaaatatggagatagtatataatatgcattcagtcacatgtcccgtagcaaagcaaggcgcggagtatcgactggttctaaatatattcattacctcgtctagggagcttccaaaagcttgagcatccctttcctttatctcccgcttcagtaagcaccgatatgccttagtaattaatgtccccacctcaagaatcaaattcttttcgtgttcattttttgatatggccccacccatcctgccttatggggcgcactatttctctcaactccttttaaaagatcattaagaaattagaggggctcttcttcttctatcactaacaagacaaggtttctaccaccagctataggcacatttccataaccaatcgaagttgtatgcatctgtgtaactagctctgccatttggttggaactgcccaaagaaatctacggtatgcgttac

SEQ ID NO: 15518 - DNA, 1501 bp, Oryza sativa
gtggatgatggcggttctggaggcggttttagaggagaagaagaagaggagcacgttagcggcgacgtgaggaagaggaagacggcatcgttctcgttctatgattgggcatcgatgtcggtttgcttcagaggctgacgtcggcggcgtgagatggcggtgacgtcggcggcgatgccttggcgacgacggcaggacgttggcggcggcgtgtgaaaccacggcgatggtagcggcatgcgcgggtatgccgtgcgtgcccacgacgcacggtgacggcgcccacaggaggagatggagcggctgcttctgttgggccaaactgggccagtgggccaaaaaggaagaaaaagaagactttggcccagattagaaataaatgtttttctaaattttgacaagggtttgggtgattagaatttaaatttggagaagatttggaaggaatttgaatagggaagtttgaaaggaaattatgtaggagatattttctagtttgagtgcaatattttgagggagaggatataatggaatttatttgttgcactcaaatgagaagaagagaatatatatattggcatgaatagtatgattcctaaaatagaggatataattgagaatatgggaggagatggatggatgaagataaataggatttttagcctcgaaatatatggcatgggtttcaaagaattgtttgaggctaaaaggaaatttggatgacaaagatataatctattttcttagcacaagagcaattattttaatatttataatattgcttattcttgtgccgaataggagatcaagccacagagattaaattagtggctagattaaaaggaggaatttagatatttggatcgggaatcaaagataggtttaagatcaaaggatgggttaacaattaattcaatagaatcagaatttcggtggtttaggttcaagggtaatatgggaagatttattggaccataattcataataataaaaatggttttcaaactaaatttgaataaaagagctttagtcgaaagaaggtttaataaatagaattccaacaggaaataccaaatatgtttttaaatgaaaaacacaaaagagattaaataccagagaggttttatgcgagttagttttaggaggtcccactaattatattttcctaggtttagaaggttattaagaacataagaattaacatgatgcaagattagaaaatagctaattttcagtatgttacattcgaattcggagaatatttgaataagaaggtttgaaaggaaattatatccaaatataatttccagaagagagattttctggtttatttgagtgcaatattttggagtgggagtttgtttgatgcactcaaaataggaattcaaaatattcaacaccataaataatatggctctagatttgaatatttttgagtatgtggagcgaatatggagggagtagaataaatagaattttagcccaaaatatatggcatgga

SEQ ID NO: 15519 - DNA, 1501 bp, Oryza sativa
cagaagcagcacttcaggaagaacttgcagctgaaaagcaaagttcagccattctccatgcagaagttgtcgcactaaaagaacaagcaaatcttgcaaatgaagcactggcaaagactcaaaaggagttggcagagttcaagcagcagcaggaagagaacaatttgctccttcgatgtatcttgagcctttcccagggtaacttaaatctgtcctagtctcctttatgatcttctgcactgtgatgaactccatctacttatattagttgtttgatggttctgtgaacttattgtcatgtggtggacttgattatgtgaaatgatgtttggtgctatggtggacttaatgtcatcctatggcaaacttttgtggacttaatgtgaacatatgtgtgctaggttctgtgaacttttttgtaatatggtgctatgtgaagttggtatatgtgatatatgttgatgttgggcctatttgtaatgtgctgtgaagttctgattgtttgtccatgtgatcaatcttgatgttgggcctattttcttatgtgctgcgaagttctgattaattgttgcttgaaatgggtgaatgctaaaaatttcctagatctcatagtgggatgggccacaacaatatgtgaagtatgtggccaaatgggctgggctaagaaaaaaaaaatgagcgggccgtcatccctactgtgctaacgtgtcatccaaacaaatcaacacgtggcaacatcaggtaaagacgtgtgtcacaaatcagatatgtacacgtggcgcttcaaaatgagagcacgtggtgcctccaccttcggcaatgtggcgttaaatatgactgccacgtggtgtctccacctttggccacgtggcatcagcgcgctccaccacgtggacataagaaatgccaacacgtggcattaatatggctgccacgtggcgccaccacgttcgaccacgtggcatcagcttgcaccaccacgtggacataccaaatgccaacacgtggcgttaaatacgactgccacttggctctagcgtacgggagatgatgatccagcgtggcgtacacgtcatccgccacatcacagccaacatggactccacgtgtgatagccacgtggcatggacgacgtctgtcctagccagctggaaagcagttctatgacgagcaccttcgtcatggatataagcatttctatgacgaaatctactgtttagtcatagaaaaacatatgtgacgcgacttctatgacgaatcccatttcgtcataaattcgtcatagaagttactttatgacgatttgcgcgtcttccgtgacaaaagtagattgtcatagatgtgcctatctccactagtgagatacgctcacctcgttagctagatccccggtggagatacgctcttgatcatcgcaccttatcctacggccgaactcacaaagggggggtctcacgccctcccgctagagaggattactcctcgacagctagcgcgccag

SEQ ID NO: 15520 - DNA, 1501 bp, Oryza sativa
acttactgtttactttttcgaagttattctgaaggtgtgacctcctatatgatatcaactatttatattatatgatgtacctcaattaaccacaggtactagcatgttcttcctgggactagtaccagcatcgcacagtttcctaggaatcggttcacgttcattttctgctgcatacttcctttggtgtcactgtagatggtgctagagcaaggagtgacagagttgtggtgatacagatgcgctaagacaaggtggcagttggataaacttgagaggcaaaggttgggacagggaaagtgaggtgtgccggtgaccatggtgatgtctcctcatcaatgccagatgaagcatgtatgtagcaagaacttattttttggggttcaaaaccatcaaccatcatcagtatcgggttttgtcaaaccagcactgataagagggtactaatgtgctcttttgtgatggtgccagtgttttgagctgtgcaaggcttgacaacagcgagagcagcgggaaaacatttttgggttgcaagcggtaaactacattagggttgtagatgtgacaagtgaagatggaaggtcaacgtcgtgtgtagttcagtgatctctgttcaggaggaggggttgggaactcatcctccccgacacacgaaacagagcgatggattaacgcatgcactactggagaaaccatccttggtcggttgccaaaaaccacaatagtcccgattgcttaaaaatccaagactaaagaatatttttagtcttggtttaaaagcacaatgggactatgtgatctttagtcccagttgattccatgtcaagccgtgtcagggcgatcgggatctttagtcccggttagtaacaccaattactaaccaggaataaaaatcaaaatgcagtatataatcctccatagcacttatcctcttctcccgtccacacaaactcctctctctatttcttttttccttatctctttccttcgctgagagctgagccttattggctaggaacgagcgctggagaaggagtgctggagcgggaagaccgggcggcgcagggcgcggtagagggccggtcgtccgggcgacgggcagcagcctgcgtgacgacatggagggcagtgcggaggggaggcgggaggtggcaatggccggcgtggacgggaggaggggaggcggtagcggccggccggcgcctctgccggagaggaggcgggaggctgcagcaacaattttttttaaagaatttgtgattcattgcatgatcctgcgatgtattttatttgtgtgtgatgtgaatatgtgatgtatttatgatgaattttttagaacttatgatgtaatttttttaggaatttgtgatgtatttggagatgatcgatttgaggatttggagatgatccttttgatctgtgatctgtgatgacttaggatgtacttggagatgatcgatttgaggatttgggatttcaggatttagggatgattcgagga

SEQ ID NO: 15521 - DNA, 1501 bp, Oryza sativa
gaacatgaagcagtaatcatatagctatattagaactgcatgacttcatccgttgcaattggtcagatgacccaaaatagcaggtttcaatacagtttaatcagaaattaaaaccacttaatcaaatgcaaaagggacctattgacaaatcatcacgatgagcggaactcggctaatttcgcacgagatgctccaggaatcaagtatgtgtagagagaagtggctaaatcaaaccaaggtgaattaggaggtaggaatttgcaacaaatcttcttaaggggacatttcaaatttagagtgatatttggggtgctttttggaattttcccattaaataatggaaggacgtgtgcattgtatcgctgaattgtgggacccgtttgtcagttggccatctcttatcgttttgcgtttgcattttcctgtttctttcattctttctttccccgtcgctttcatcggattcctcgtgagtgagatgcccctggcgccggcgcgccgccggtgtaggccggtggtgggggaggcaggctcaccggagcatttaccaccaccatagaagcggggcccccgccgcggaggaggagcgcaggaggcgaggcggccgccgacgcagagttgggcggggcaaccggcaacgtcctgacggacgctgtccggcgagagcgcggcgccctgaacctgaagtgaaatctccaatgctatgggctccgaagaaatcctaggtgcgttcttgagaccgatctagaagccccaaacatttcaactgcaacaatttgtccttttcatttgtcttgcagttcttgcggctgggctcaaagttttagacctgtatagaaatttatattttgttttctttcgattgcctttgcaaatcgcaattcttggctactcagaaagtcttaccacgcaaaagattaatcatatagtagtatattgtgtgctgagttttaggtgatcttggtagtaataggaggagaggctgcatgaaatccgggcacagccgtgtggaattggtgaagaacctagtcagtagtcaccatcgattattgtctgattgtctggagataggcttgctggtcatggtaagtagggatgcaagcgggacgggcaagcgggcttgtttatcccgcttatcccacttctaattcattttttcttttaaattttgtactaccatgcgaaaaatagactagcaagcaggtttttatgtgggtagcgggactacccacttgcatccctaatggtaaggtgtatgatgtatccgtgtatgcaacttgcaaggcatgtccatattctggatggatggaccctgataaaggtactagtttgtgcgaaagagtgcagctggattccatgtgccaagatgaacatttcttttccatgtggaacgaacctctcagctaccaccatgtgcattcccacccccaaattcttagaaattagcttgcatataagttggaacggtatgaagaatgaactttccatctagccacagtcg

SEQ ID NO: 15522 - DNA, 1501 bp, Oryza sativa
ttcatggtaatttattttttaagtttaaaaataataatcaattaatcatgcactaatgacttatctcgttttacgtatcttctcaatattatctttttctcttaactcaaacagatcctaaggagacatagagagagatctcacccaatgacgatcccaaaggggggcaaggtgggctagcttgagtccctcctactgttggccaaacccactatatgtactatccaattctattagataaaaaaattgctagagggaagaaaaagataaataagtatcaggccattatttatgtacaaattttatgtatgacacataatctatttatgtatgaattttagatttgttttatatttaatcagcttggcatgtattttgcctatggttgtgttcgcatatgccagttctcatcctaaacagtacatacggaaaacggagcggttcattagtatgtgattaattaagtatttgctattcttttaaaaaaatagattaatacgatttttttaagcaacttttgtacagaaaccttttttaaaaaaacgaactgtttaaccgtttgaaaagcgtgcgtgcggaaaacgaagcaatggagtttagaacttggagttccaaacatagcacccactaaaatttagtcatgtgttcactgctgatctcacctatacatgacaaccttttttttaaaggtaaagctacggcaactttcaacagctttgtcggataggaaagtgtcatggttatggataccacatacctaatagtagttgactaaatctcggcaggacccaccacatacatgtcctatacggaaacaacctgcggatataggaggagttccgataaggaaagacaaccagagttctacatggaaacgacaaggactattcggattgtatccatattggttttcctagttctacttggacaaggggacacctatgggtataaatacaagaccctctagaaggaccagagggagaaccaacacaatcaacatacacccaccagaagccacaacatacaagcctacatacgccaagacaagccgccggatatcgacatcagagatatgcctggatcggccctatctggtacctacagaagccggccgtagggatctagcgctatctctgatttcgtcgggcgcgagcttgaggagaaaggctaccttgttgtcgactacgagtcagaccttcagaccgccatgtcgacaacagctagataggctaccccacatattgtactggtgtgattatggtgaataagagcaataccggctccggccaacaggatgtagggttattacctaacaattcaggggcccgaacctgtataaaaatcctcgtctccatctcttttacctcagtctcgcgtatatcctagcaccgacgatccccatactatgcaaataccagaattgcgacatcaaacgtcgacagtggcgcgccaggtaggggactttggtgctctaggatttcgacgagattggtttaagaga

SEQ ID NO: 15523 - DNA, 1501 bp, Oryza sativa
cggtgtaggtagccggcgtggtggtgtaggccctcaggtggcgacgaagtagtcgtcctgcacggagacagcgtcacccgacagcgacgtaggtggccggcatggaggcgcaagccttcaggcggcgatgaagtagccatcttgcacagagaggacgtcacctggcagcggcgtaggtggccggcgtggaggtgcaagccaccgggaggcgatgatgtagccgtctagcacggggacgaggtcacccggcggcggcgaaggtggccggcgtggtggtgtaggcctctaggcggtgacgaagtagccgtctagcatggggacggcgtcacccgacagcggtgtaggtggccgtcgtggaggtgcgagcctccaggaggcgatgaagtagccgtcctgcacatagacgacgtcatccgacggcggcgtaggtggccggcgtggaggtgcaagccaccgggcggcgacgaagtagctgtccagcatggggacgacatcacccggtggcggtgaaggtagccagcatggtggtataggcctccaggcagtgacgaagtagctgccctgcgccaagatgacgtcacccggcggcggtgtaggtggccagcgtggaggtgcaagccaccgggcagtgacgtagtagccgtccagcacaggggtgacatcactgggcagcggcaaaggtggccggcgtggtggtgtaggcctccaggcggtggcaaagtagccttccagcacggggacggcgtcacccgacagcatcctaggtggctagcgtggaggtgcaagcctccaggcggcgatgaagtagccgtcctgcacatagacgacgtcatccggcggcggcatgggtggccggcgtggaggtgtaggcctccaggcggcgacgaactagccgtccagcacagggacgacatcacccggagaaggccataggtaaccggcgtggaggtgtaagcctcccggcgacgaagtggtggccaagtaaggctaccctccagggcacatctcccgagtacgcccacccagacctgggtctcatgcccgatcttcagcaaatgcaagtcagtagctatacctagtaggcccctgactccatgtcgcaatgactggggtcatcgcggagtggagttgtcttgacgaacttgaagcgaagccgggtagcatcctgactccgtaccggggtgactggggttgtcgcggggcagagttgacttgaagaactcaaagcgaagccgggtagcgtcccgactccatgccgggacgatgtaacgccccgattttcgttcgggattaaaaatcattaaatactacattttctagaaattaaataaaaattaaagcaatttaatcaagtgaattatcgagggaattaaaatttcctttaaaaatcatggtcggaaataatttgtaatattctctgtgccctaatgtactctctgaaatttcccgtgaattttcggagctcaagaaataattttaaaagcataaaattcatttaatc

SEQ ID NO: 15524 - DNA, 1501 bp, Oryza sativa
gcatggcagtccgcgagatcatggagggaggtgttgtggacggagcaccacttgccggctgagcgctccctgctgggagtaccagcctctttctttttgtcgctcgcaggcctcccctttcgggtggcccgtggagcgccctcgacggcgaggacatgaccctcgtcgccggaatggaccgacctcttcttcctcctcctgtcacgccgccctgtttgagcggcggatccgggggcggccgaagctgccacaccggaaccggaggggttccaggtccaagcctcctccttacgagccactcggtccgcgagctgaaaaagctctgcggtagtctggggctctttggaagcgatcttttcgagcatgcggttgtgccgcacaccccccctgaacgcgtagatcaccgcgtgtgcagggatgcatggtatggtattgcggacttggcagaaccgctgaatgtacgagcgaagtgactcatcatcccctcgctgtactgcgtgcaagtccgcttcttcgcctgggcgcggatatgtgccttgaaagttcatggtgaactgttggcacaaatcttcccaggagtggaccgacgcgggtggcaggttcattagccaaccccgcgcctgtcccttcaggaccatgggaaagaaattcgccataaccctgtcgtcacccccagcggcctcaatcccggtcgtgtagacctggagaaactcggtggggttgacgctcccatcatacttctcggtgatggtgggccggaaccttgggggccaacggacattccgaagactcgccacaaaggctctacagccgacaccaccagccgggggcacggagggctggtcctcacgtccatgtcgaggcgacactctggacgaagaggcgccctccgttgcgcggggagtacgccggttattacgccggcgctcgatgtcgaggcgggcatccggctctccatgctgatcctcccgagtcgggggtgtcgacgagggagtggcagccgaatgacgtgcaaccgccgccgctcgccgcgccctccgccttgatgacacggagccggtggtggcggcgccggaggtcttggtggtggcggaccgtccaccagcacccaggcgctgctgtgccgtcatgaccaagttggccacgtcgtccagccatcgctgggctggagactccgggtcaggaacgacgggcgggtgacgtaggagcgcgccagcagcctgaagcgcgccctgaggcgtgctgccgtcgccgtagacgaggaggcgacgctccccatctcgccgttctcctgcatcacccgcgaccggtgatgctatggatttatcaaccctctcgagcgcctccccctgcttaggactttggtgtggaggaggtgggggagtacgagctcgacggcgtgggtttggctccccgtcgtcgccgctcacactcggagagaggtcgtgcgcctttgcttgctcggccattaggctgaacaagggaaacttggcgcacacgg

SEQ ID NO: 15525 - DNA, 1501 bp, Oryza sativa
gtgattccttccccctttccccccaattttccctccctctctcccttggattcgtttgaaaaccctcccctaatcccgccggcgccattgatggagcccgagagcgccgcgccggtttccttcccctccggccgccctctcccccttccaaccctatataaaccctccccgcacctcctccgttcgtttccgcctctcgccgcccttcctcctcaccggaatcgatctcgcgccgtcgctctctctctccgccgtcgacgccgagcaccggtccgccgccgtcgtcgccccggaccacctcccacctcggcgccgcctccttcggcttcgccgcatcctcgccgacctcgtccacccctccgtttcgctcgtcgaccgccggagcaccgtcgaccccgtcgacccgagccgcaccgccgccttcctccgctccggccgcctttttcgtcgtcgccgtcgacctagggtgagccgtggaccgccgcttcttttcccccttcccttcccctctctcggccgccactccgccgcgccgcctcccgccggctgcgccggcttggccgccctcgggcgcgccgagtggctgccgcgtggggcccggccgtcagccgcccgcgcccttaggtgcggctgacgcgtgggacccacggcgccggccggtgtgagcccgggtgcacccggtccaccgtggaccgtaaggctgccgcgtgggtcccacccccatggacccggtccgcgtgccccctcccctcggctgacgcaataaacttttttttaaattaaaatttaaatgaggaaattcgcaaatattcatttaaagagcatataaacttcaaatggccataacttggccatatgaactcggaattggaccattcaagtctctaatttttccttaagaagtcaagaacccatttttgtgctttgttcctgcttgttatatggagttttttagagtaaaagacttttcttttccgttggtcatgtagacgctgcagcttcggaagatccgcttttcgtggaagttgaagccgacgtttgggaaagcgagcaaggcatgtcgcatcatccttgaacatattgaatcccagtttataaaattatgttgatttaaattattgcattatcgctttatttaaattcccgcgttatcactgttttatctagccatgcctatttacctttgttatgaccttattattgttattgttattatttccttgttcaccctagagtaaacaaaaccccaactagtggatactctactcatggtaccactagtatcattttaggtagacgcttcgccgcttaattaggcaacattaggtggttttataactctagactttgggatactcttatcacctggacactatggaatggttggactattgtggaattagattcacacctcccccactattcaaaatcttcaatggttttaggctgggctcggggtgcatggttttgatagtagcacctcggccatataaggaccggt

SEQ ID NO: 15526 - DNA, 1501 bp, Oryza sativa
ggcgccacctccgtcatcgtcgttgtagcggcgtgttccacgtcatcctcgtccccgtgcagccgctgccggctgtcctcgtcgcctcctcgccggtcctggtcatcgtcgtcgtcgtcgtcctctcgtcgttcccggtcgtcgtggcgttcgtccctccgtcgagccgttctcgtccgtcgtccgcgttcgtcaagcgagccgctgcagccccgtcctcgtcttcgtcctcggctccgcgtcgtcaagccccgtgccggccgcgtctcgccttcgttcaaggatcgccgccgaagccgtcccctcgccgttcgtctccgttgtgcccgtctgtctccgctgcgcccgttcgtcgttgtcgttcccgcgcctcgtcgcgtggtggtaaggatccctctccctcgctgccccgtcctcgtcctttcggtgtcgcccgtgctcgttgtgcggttgtcggccccggtacccgtgtaccggtgtcggtagtcgttcacgcgtgcgggtggtgaccgtgtagtgtccgcgttagtgtgcccgctcggtagccgcgtggtttccacgtgtgcaggccgtgtggtgtctagtggagtccgtttgtcggccactcgcctcggttgacacacggggtccgcctccgtcgacccgtggaccgtctctgtgtacccggtctaccgcggtccttttggttgacatgtggggtccgcatgtcaacggcgcagccttcctgtcttttccaggctagcgcttacacatgttttataattgcaaagcttaattataataatccgcaaatctccatataacagcattaaacctcggatgatcatatcttggtcatacgaactctgaatcgacccgttcaagtctcctaatgtttgttataacctaaagaaccctgtgcgttctttttatgtattgttattgcttctttataggcttgtagctttgcttgtgtgcttcgcgtagctttcgtcgttccggaggttcccgaagcgtggttcgcggtcgtcgctgaaggttcggaaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttaagacattattattgctattgttattattaccttgttcaccctagaataaacaaaaccccaactagtggacactctatttatggttctactagtatgaattagggtagatgcttcgctgattaataggacaacattaggtggtttttataactttagactttgggaattctcatatcatttggacactatggaatggttggcttatggtggaattggacatacccctctcttcctctttcaaaacccctaaaacctgtttttcggtggggtttgggtgcatgccagttgtgggaagtggcaccccggccaatataaggattaa

SEQ ID NO: 15527 - DNA, 1501 bp, Oryza sativa
ttagctccaaactctaaactccaactccagttagagctggctcctataggagttgaagtggaatagaaagtgtttggcttgatggttagctccactccaccacgtcccttgttggtattttgttaaacacctgataggtgtcgctgctgctgctcagcccatgcactgccgatgccgccgcccgtcccgccggcgccggtctgctcgtgagctgaccaccacccgtgcgctgctcgtggaccgcagccgccgctcccgctcagcccatgcgccacccgccgccgcggctgccaccgcacgtgcgtcgaccccgcgccactgccacccgtgcacctacccccaccgttgcctgtggcccttgccgccacgccacccgcccgccgctaccgccgttggtgtctaccgaggaagacgtaggaggagagagaacgggaggagatggggtaggaaggggtattttagtgtaaatacactaaaaaattaaagggtagtgggttttttgggtggagtgaagctgtggagcagaaaaactcagctccaccctcgtaatacaattttgtggagcagctctaccaactccgctcctaaaatcagaggatctagactgtttggcacaactccggctccaggtaagttggagctagatatgtgacaaacgagaccttattaccgaccttttctccatatcgtgcacgtgaggaaaaagcaggtaatgggccaagatgcgttcgccggctgaacgcacaccctgggccgtacatgggccgcttgtcaacttccgaggcgagcgtacggccgagcaacagagaccacccgaacgagagttcggcccgccccccgacccaacgaaacccctaggcgacggcgggagttcgacggcggcggcggcgtcggcggcggcggaggaggctgcgaccggattagccggtcggtgacgctccatgatttggcgctaccgtgtggagcggagacaatgatagcgcgggcgtttggccttgtgggcaaagcatggaagcgaacaccggcctcgacgccgccgcgccgccgctccgacttaccggcgctgcttcgtcgcctccacagcaggtcggcacaaccggaaatattccgcgaagaacggccccacctacaaaataatagcgggtaagatctccgtgcctgtttcatctaggagtgggatcgattttcggtgtggttggagtagataaactcactcatgctcggaaaagaatgttaaatctcatgagttgttatgatgaaattggggaaggaaaaaaaatacatctttctcaccgcaacctgattattttgctactaacagaggagctccgccaaggctggacttaatctcagaacaaaactggagcaagcagtgctataatgtcaacactatgacttcagccgattctgccgtcgactctattaggtaaccttgctcttctgaacttcaatcttgacccaagctttgtaatgttacgattgtttacatccagggatactg

SEQ ID NO: 15528 - DNA, 1501 bp, Oryza sativa
ctccctatcaaatccggccgaatctttctcgatgtcctataattagttgagaattttttatctactcaatctcctctttccgtttctccaaaatcagagaaaattagcaaaactcaagataaaaagttcagggaagctcgccgatcggccatctttaatggagatcaaatccgaagaattaaaatggaattgaaaggggaaatcatggagagaataatgaggaagaagtgcggaacaattttttgcaatcaatctacctatttattctatactaaaagtccattaaacttcttaaaaacactctcaaacagtcacgtggtactctacaaacgctcctacgctgcaacatggcactctaataaattagacaaaatcatagaaattctaagaaaaaagaaaaatatccaaccatcgatttccatttaaattggtggaccctttattatcaaccgttaatcggatctattaactaattactccatgctaaaaccggctaatatcttctctctcagtacgcgcacgtatgcaagagatatattggaaaaaagagaaaaacgcctgcctacaggcgctaataacccatgtacgtacgtagtataagcaggcgctaataacccatgtatacgtacgtagtataagcaagacatgtaaaaaaggtaaacaaaaactgtgtgcgtacgatcggcccacgggattttcacgagttcctttttcttctatccatctagctagctatctatgtatctttctatctgtctctacttattataaaaattgaagatatttttactggtactttgatacgttataaaattgaagattttttatcggtactttgatatattactcgtgtatgagtctcgtgtatgagtcggtttttaagtttgttcgtttttgaaaatacagatttgtatttgagtcgggttttaaatttgtttgcttttggaaacaaaggagtcgtataagaaatccctttaagaaaactcggatgctaacttgagataattaatcggactcctaattatagctcatgattttctggaaatatatatatacaagctaattctcacagtgaatttcactttaagtaaaccgtataataataataataatgataagattaatataacattcacccgttgtaacgcacggacatttttctagttgaaggaaaaaagcatagggaggtagatcgatatcgcggtggcgctaggatttggctagggtagtggccggaggggcattgtgcgtgtgcagcacattggatcgaactgagatcggtaaaaaaaaaaggcaacgaacaaaccaaatcgacaaaaaaaggaaagcccgaaaaaaaaaaaaacccttggacatgaaaaaaaaacctaattaaaacgtgaccatcctacggcggcaagccgccgccgcaagagaacaatcgcctggaatgaatcttgccgaaggcttcaacaccccccttatggcaatgttgtcgtcgttgcctcgaccaagttgccca

SEQ ID NO: 15529 - DNA, 1501 bp, Oryza sativa
gtgccggagatggagaactgtgccaccttgacgctgagcggcctggcgacgtcgacggtccacggcgtggggaagtcgaagagcgcaacatccaggaggatcctttcccttctcccctctctctcctaggatgcgggcggcaggcagtgagcatcggctgccggcgggagaaggcggcaccgatggcgacaccaccaccacctcgcggcgagcgggacggcatcggctgtcggcgggagaaggcggcaccggcggcgacaccaccaccacctcgcgacgagcgggacggcatcggctgccggcgggagaaggcggcaccgccaccacctcgcggcgaacaagacagcggcggcgttcggagagtacaagatctcccaggtccagccgaccgcgaccaccctgtgcgctcctcccaccgcccggccaaccgtggccacccggcgagctcctccccggtgcccagccggctgaggcatcccagcgagctccatccgcgcgtccaggcggccgtggcctcccggcgagctctatccacgcgtccgagcggccacgacctcccggcgagctcctcccctgcgctcggctggccgcgactacccagcaagctcttcccccgcgtccagccggccgcaacatcccggcgagcttctcccctacgcccagccggtcgcggcctcccagcgaggtcctcccccacgcccggcaagccggggcctcccggcgagctcctcccccgccgtgccgctcgagccaatggaaggcggctgtgagagatgagaagatgaaagagagaggggaggggtgataggtgggtcccacctaattttttacagtgaatgccacctagatgccacgtggatgccacataagctaaaactggactcaatactgccttggaagtcgatttgcaccggtttttggagatgagggagtcgttatacctggttgtggttgagggatgttattcgacaaagggtaagagatgagggaggtaaaatggacttattccattccttcttccaccgccataagtgggccacaaaagaccaatggctcataggcagacaattttcgtctccgagtaaatcatgggctttatatgcggccgaatttcaaaccaccggtcaatgggggtatctagcctgctacatcaattgaacgtaggtcaaaactgaacgtgtccacaagaaactgaattccgcttccattttagtatagctggacaaattccagtatttttctcagctaagatgaatcagataaacatttaggagtactaagtactgcgagtcacacattacaacatacaaaagaaagctggtaataaacgagggttacagtcctccaaagaacagattctaggaatacaacagtagcaatatctatagcaatatagaaaatgcacagatttgaaattgtataataacaacagtgttgatacaccttatcaagcaacaatgaccacaggctccaagcgttcggctctgcagcttgctttgcg

SEQ ID NO: 15530 - DNA, 1501 bp, Oryza sativa
gcctccgctcagccgttgccgcgacgccaccgtccgccgcccgccctgtgcgccgtgcttgcagccgcctccgctcggccatcgccgcgacgcgcgccgccgcccgcccccgtgcaccgccgtccgcccgcccacccctcagtgtctcccgccgccgccgatccttgagagagacagacgaagagtgggagagagagaagagatgaagagagggagaggggaaagtgaaagagtatgacaggcgggtcacaccattgtttaatttaaaaaacgctgactgggattccacgtgtacgccacgtagaccaaaaccaccgcggattggatcgaggggggtaattcgtccggtttgcatagttgggggtaaagaatgtccggttttatggttcagggggtaattcggacgaccacgatagttcgggggggggggtaattcgtactttttccttaaataaaatatggcaagctttggtaacgtgagtataccaatcaaacaacaccttacagtttgctatattgtcggtgttcctttggtgcgcaagaaatttaaatgatttctttatgtaatttagttcagttgacattcctctattcgaaatttgcataagctacggtgattctcaggcttggaaccaaaaacctgtgtaatttgacaaaccgcgatcttatttctatgagaaacagagagtgagaggcctgttagaaaatgatagacatacaaatgataaaaaaacaatagatcaatcatataaggcacgagatttaacgtggaaaaccctctcaaaacaggagagaaagaaccatgggcaccagacagaaaaatatattcactatatcggggcgaggttacaacgtcaaacggcggcttacaagaagtatatatgaaggtgaaacttaaaaggataacgatccgtaacgcggggcccctacaccccaggcgtcctcaggcctctggcccaagcctctggcgacggacctctgctttgctccagcagaagttggcctttatatatgtgcaaatgaatttagatcacaactcaacaattacaatgctacactttttaagtaatggaattacgtggatatatgccccatttcaaatagctgaaattatagacggatgagtaatctggttcttatgacagctatttaagagtataaaataaataaattagctactaaaaacatttcacaaaatcttatataaatttcttttgtatcaacacatcatttagtaacctgctgagcgagtaaataaagatctaaaatacagaataaaataaaaatatacagagctacaaagtgaggaagagagggaaagtagtattcgggaaaaaaaaacgagattggagggagagccatcccaaacatttatttttaaagaagaaattataagtgtgttggggattaaatatgagacgtgagggaccgagggttaaaccacacacccctttccactatattaccatgcatctcgaaagtagtattcggtattcacagt

SEQ ID NO: 15531 - DNA, 1501 bp, Oryza sativa
gtgacgccccctgatgtctaatctcgcttattagatgatcagccgaacactgtgtttggtggctggttgcacaagcgaaaaacggcatgtacgtgtggttggctgcaacgtgtaataacaacttatttttctgacaagggctgatcatccggttgatgctttccaactgtgaataccgaatactactttcgagatgcatggtaatatagtggaaaggggtgtgtggtttaaccctcggtccctcacgtctcatatttaatccccaacacacttataatttcttctttaaaaataaatgtttgggatggctctccctccaatctcgtttttttttcccgaatactactttccctctcttcctcactttgtagctctgtatatttttattttattctgtattttagatctttatttactcgctcagcaggttactaaatgatgtgttgatacaaaagaaatttatataagattttgtgaaatgtttttagtagctaatttatttattttatactcttaaatagctgtcataagaaccagattactcatccgtctataatttcagctatttgaaatggggcatatatccacgtaattccattacttaaaaagtgtagcattgtaattgttgagttgtgatctaaattcatttgcacatatataaaggccaacttctgctggagcaaagcagaggtccgtcgccagaggcttgggccagaggcctgaggacgcctggggtgtaggggccccgcgttacggatcgttatccttttaagtttcaccttcatatatacttcttgtaagccgccgtttgacgttgtaacctcgccccgatatagtgaatatatttttctgtctggtgcccatggttctttctctcctgttttgagagggttttccacgttaaatctcgtgccttatatgattgatctattgtttttttatcatttgtatgtctatcattttctaacaggcctctcactctctgtttctcatagaaataagatcgcggtttgtcaaattacacaggtttttggttccaagcctgagaatcaccgtagcttatgcaaatttcgaatagaggaatgtcaactgaactaaattacataaagaaatcatttaaatttcttgcgcaccaaaggaacaccgacaatatagcaaactgtaaggtgttgtttgattggtatactcacgttaccaaagcttgccatattttatttaaggaaaaagtacgaattacccccccccccgaactatcgtggtcgtccgaattaccccctgaaccataaaaccggacattctttacccccaactatgcaaaccggacgaattacccccctcgatccaatccgcggtggttttggtctacgtggcgtacacgtggaatcccagtcagcgttttttaaattaaacaatggtgtgacccgcctgtcatactctttcactttcccctctccctctcttcatctcttctctctctcccactcttcgtctgtctctctca

SEQ ID NO: 15532 - DNA, 1501 bp, Oryza sativa
tctcttcatctcttctctctctcccactcttcgtctgtctctctcaaggatcggcggcggcgggagacactgaggggtgggcgggcggacggcggtgcacgggggcgggcggcggcgcgcgtcgcggcgatggccgagcggaggcggctgcaagcacggcgcacagggcgggcggcggacggtggcgtcgcggcaacggctgagcggaggcgactgtggcggcggctgccggcgctactgggtgagtggcggcgggcacggctgggcgagcggaggtggcagcagcgacgggctcgattgggcgccaacgtcgcctcgcgtcgcaccatgcccgtggtgcccgtggtgcgcgtggagctgaagctgctcccagtggtgcgtgggggcgacggcgcccgccgcccgcagtggatttccggccgccagccgccggacgcggcccaactctccaccacgcccgccgtgcctagcactggccaccaactcgcgggccacatctgagacagagagagattgagaggaagagggaaagagagagagattgagaggaaagtggggaagagagagaggtgggacagtatgacaggcaggtcccaccattttttttaattaaaaaacgctgactgggatgccacgcgtacgccacatagaccaaaaccatcgtggattgggtcgagggggtaattcgtccggtttacatagttggggggtgaataatgttcggttttatggttcaggggggtaattcggacgactgcgatagttcgggggggggtaattcgtactttttcctttatttaactaacatgcctaacatgtggctcataaaattaaagccacacttcagctgtatgaaagcaagtttgctacacttttactccatctatcccataatataagggattttgatattttgcttatactatttgaccactcatcttattcaaaaaatttgtgcaaatataaaaaatgaaaagttgtgtttaaagtactttgtataataaattaagtaaaaaactaaataataattctaaaattttttgacgaatggtcaaacagtgcaagcaaaatattaaaatcccttatattagaagacatagggagtatataccaataacacatgggacccacatcatggtgaaggaatcttaccttagaggttgtttggtttgctcctaaaatttgccaaacgttgacacacctcatgttagacaagtttgaccaagttaatttattgtttggttcatagccacacttgtggcaagattccttcttatctattataaccccacgtgccattaactcaataaggtgtggcgcaatcctatttcgctagttaaggtgtgatttacttattgtaagccacaacttagataagtgtgacataaaaatacggtgaatggtggcaaacttagtataacatccaaacagtcaaatctggctaacttgagttgtagcaatagtcaggcaataagtggtagtgaaacaaacaatccctagg

SEQ ID NO: 15533 - DNA, 1501 bp, Oryza sativa
gggggcgacggcgcccgccgcccgcagtggatttccggccgccagccgccggacgcggcccaactctccaccacgcccgccgtgcctagcactggccaccaactcgcgggccacatctgagacagagagagattgagaggaagagggaaagagagagagattgagaggaaagtggggaagagagagaggtgggacagtatgacaggcaggtcccaccattttttttaattaaaaaacgctgactgggatgccacgcgtacgccacatagaccaaaaccatcgtggattgggtcgagggggtaattcgtccggtttacatagttggggggtgaataatgttcggttttatggttcaggggggtaattcggacgactgcgatagttcgggggggggtaattcgtactttttcctttatttaactaacatgcctaacatgtggctcataaaattaaagccacacttcagctgtatgaaagcaagtttgctacacttttactccatctatcccataatataagggattttgatattttgcttatactatttgaccactcatcttattcaaaaaatttgtgcaaatataaaaaatgaaaagttgtgtttaaagtactttgtataataaattaagtaaaaaactaaataataattctaaaattttttgacgaatggtcaaacagtgcaagcaaaatattaaaatcccttatattagaagacatagggagtatataccaataacacatgggacccacatcatggtgaaggaatcttaccttagaggttgtttggtttgctcctaaaatttgccaaacgttgacacacctcatgttagacaagtttgaccaagttaatttattgtttggttcatagccacacttgtggcaagattccttcttatctattataaccccacgtgccattaactcaataaggtgtggcgcaatcctatttcgctagttaaggtgtgatttacttattgtaagccacaacttagataagtgtgacataaaaatacggtgaatggtggcaaacttagtataacatccaaacagtcaaatctggctaacttgagttgtagcaatagtcaggcaataagtggtagtgaaacaaacaatccctagggtgtgttctgaccaaagggttctcaacccctctcaatcgtattccgcgcgcacgctttttaaactgctaaacgatatgttttttataaaaagtttctatacaaaagttgcttaaaaaattatattgatctatttttttaaaaaaaaattagctaatacttaattaatcgtgctatggactgttctgttttcgtgctagggtgatatgttcccatccatcagcagcgaacacaccctatgtccctatctgtggattgccagtgcgaatctcgacgtacgtggtggcaaatgcagccgcagtgctaggtggagccccaagcgggcgtccaggtcgccggaaaactccatggcgcgctctggcggtgtcaggtcacgggcgcca

SEQ ID NO: 15534 - DNA, 1501 bp, Oryza sativa
ttaattttgataataataaatgaaataaagtgcaattaaatttaattttccgtccccttctccctcctctctgcccgctcgagctcgccgccgcctccccttcttcggtcacattgtcgacgaggcgtggcccgcccagttcatggtggtgaagagatctccgacgtcgagctccatgtggcagagggcgacgggatcggcggcgcttgagctctctggcgtggatccgacatcatgcttgctggatctagcagagctcgagcgccaaacaggtccacagatctggcatcatgctcgtcggatctagccgagctgccgctgtcgtcggcatcttcccggagatggcgtcgatatgttcagagctgttgtcatcaatgcgaatcgagttggcttcctccttggctaccgccgccgggctccctctcctccctccctggcagcgtgggccacagcgaggtgtgggctggctatggcgacgacaacctctagctcgttgtctcgtcggtagcctccagttcctcctttttctcctctacaacttcccggaccatacaaatcgtcttctctctctcctagaaccaccattcaaccactgttttctctgcatgaacctctgtcaccctgtgagaccactccaaacctttagcgtggtatctgaatctaagtgtaacttaaaaccacgggtgtgagacaccgcattgtaggtgtgtttggttgggtggatgaactcggatgggagatggccacccgatttttttgtggtgtttggttggaggtcagggtggatggggcagcccaaaatagggaatattccctcaatatactggatgagtgcatccggccgatttggctggatgaagccatccagttttggtctgggtgatgtgtcatgttctgattggctgtggttggtttgattttctgttaagcaagctccaaatgactttttctcctaaaccgttttatctaatttatgatttgattacaccattatatttgttacaattaaatctttaaaacaagatctcggatgattatatcttgataaaaaaattatatgataaatgggtctcactaacttttggttgttttcatccatgctatatctctccaaccaaacaagaaattagatcgccatatccatacaaaccaaataaaaaaaataaatcgtcatattcaataaaatatggatggctatatgctatccatacgtgaccgtaaacatagaatggtcttatgggacggagggaccagggagtactcctcgggggtcaggtcatcggcggggtgcgtggattgcgccacttgtagaccgggccccacatgccagacgcatcgatgcttcgctttgtttacgcggcgcgcctctctttttccttagccaccaaggctcagaaaccgcctacaaaacggcgcccggcgtcccacggatcaagcgaccccctaaaaaaccaaccgaaaaagaaaaaaaaaagaagcagagaaaaaagctctcgcggca

SEQ ID NO: 15535 - DNA, 1501 bp, Oryza sativa
ttagtgtcgcatactatttcttttttattactcccctctccgctccaacttatccaatgcactaggcagacgggcgcacggcaacgaagacgacaagcttgagcgggatgaggggaggcggcggtagacggcttcggcgggctaggagctagccaccggtgtggcccaaggcagagcgtcgacgacgtgggctcgagtcagagcggccacgcgcagcgcgcttcaacatggagcggccaagaaggaggaagatgatagcgcgcccccgccagctcctcctctccctcatttccaccttctacaagctaccctagcgaaggaggtggtgcgcggaagagatggtcgcggatctggatgttgatgagcactgctgctcctccgcggatctggatcagtgcttattctatcatattactgttagctgattggtttctactggatattactattgttttattgcataaccattagtcgattgtgtcgacgagtggtacccgtagaccagatatagagggtattggggtacgttggtacaaggatctacgtaatacgacacaaacagacaaaagacgaggattatactggttcaggccccttggtaggtaatagccctaatccagttgatgtgggattatatggtggaaaacacaggttacaaagggaacaatggaacttgacggatccggcgagatcgtggtcgagttggttcgactagatccccggcgatttggctccttgcaagctccgacttcgtaggctgtgagggttgtgttggctctgagattcgatgcctcaggtcctcctcggggggtcccttttatatcgcaagtcaggcggtttccaagtagaactcggagatagcagaccctatacgatacattgatgacacagtcttgtccgagtaagactcttcccatctgtagacttcgtgaaggatttccttagtgtacgcggaaagtatccgtatgcgcgtgggtatgccataccgatatgtaacgtatatcgaagggtaaagggtatgcctaacccgtaaccctgacagtagcccccgacttctgcttaaatgaactcgtgtaaccattcgcgacttgtcgtgtcgagactgttgtcattcccggtgtgaggaccatagagacaggacgtagtcgagaacaccgtgtgaagcccaacggtcacgagtgaatttaaactgaagtccaaaaaactgccgcacgtaacggacccagaaatctccggcgggcatctctcccctttccttggaattcgcacagtcgtaagtgcgtctatttaaaggaattttggggatccattttgaagtccgcctattgtgaagaaaacatcccacctgtaagcgctcttcgtcttctccgttgccacaagaaaccctagttcatcgatctgagccctttctccggcgatctctgatcagcgatggatctcggcaaatcatcctccaccagtgcgtcgctgaagaagcttcaggaagacagcgcccttcccg

SEQ ID NO: 15536 - DNA, 1501 bp, Oryza sativa
cgtgtcagggtctaaaaatgcttatattttgagatagagtgagtactattttaggacaaaattgacatgcatctcggggtttcctgcgtcgtccttgttgcgctcctccggcattttgtagtgatttcttatattcttctgagcagctgttgcagaacacgttcgaatacaactcgcccatcaatttatagcacacgctacaacgtggggttctctacttaagcacacacatgtgatagatcaggatgtgacgtaggaaccttaacggccaatgacgcacgcgtatatgttttgacccagttgggaacttgggaatatgagtagccgcgacctggcaagtacatatatccgttgcatatatactccctccgtttctaaatatttgacaccgttgactttttaagcacatgtttgacctttcgtcttatttaaaaatttttgatatatgtaaaactatatgtatacatgaaaatatatttaacaatgaatcaaatgataggaaaaaaatataataattacttaattttttaataagacgaatgatcaaacatgtttaaaaaagtcaacagcgtcaaatatttagaaacggagggggtacaagatattttgtttttttacaagtcaaacttaagtttgattaagtttataattggaaaaaatacgaattacccccatgaactatctcgacagtataaattaccccccttaaaccacaaaaccagacatttgacactctaaacaattaaaaccggacaaattacccccttggctcaatccgtagctgttttgatcttacgtggcatacacgtgacaccaacgtggcaatctaattagaaaaagaaataataaaaaactatgggaccacttgtcatatctcctacctcacccctctctctcttttcttttctctgccgctgggggtgcggcgggcacaacgggtaggacgggtggcggctggagggcattgcggaggcgggacacgagtgtcggttgccgcgtctatggcggctggcagcataggaggcggacggcagcgaggagggccgccacagtgccaccaccattcctccctttcccctctccttctcttccaactccctcccctttcctgtagtggaagcggcggtggttcgggaaagactatagttgaattaatagaattatcttctttatttatttatgctcatggtttatatatttctttattgaatatatgttctgagtagtagatacttcgtatatttgcatcatcctaggctagtctcatgctacggtaatagtccaatgacctttataggttgatctagctctaacttgttcattcatagggtgagagacctaggggagttagtgatattatttcggccctgtttctttcagcttgggattattataatctagattattgagtcagattactataagcttgattgttataaattatagtagaataagcggttagttgtttctttcctagattattagagcttagattattggg

SEQ ID NO: 15537 - DNA, 1501 bp, Oryza sativa
tcaggctctcactgacaccgggccccaccaccccacaaccccaccgtgcaccacgcccaccacgtgtggccccacacgattagcgcttaatcccccactcccccacgcttaattagcccaataatagtaaataaattaaaactcgaagaggaaaaaaataattaatagaaaagcgcaccgttatttcatttccccccgttctcctttccgctttacctctctcctctctcctctcgcctcgccgagccattcgattcctccgccgaatcgccgccattacgcccaattccggccgcctcctagggtttcgcccgcgctccgccaccgtcgccctccccccggcactgcgccgccttccccacgccgccctggaggagctgctctgactgcggggaggtgtaggaggaggagggcggaggaggtggtggtggtggtggtggagagagagaggagtgcgtcgccgacgaggtgggtggtggtggtgcgaggagagggcgttgatgaggttgtggtggtagggaggcaaagcagtgtggtggtcgcggcggcgggcggcggcggagatgtttttcaccaggctggatgactcgcccatgttcaggaagcaggtgagtgagtggagatctcggttcgtggcggtttgggggcgctcgtgcgccgtggttgggaggttggtgtcaggcgagtggaagcgtaggggaagaagaaaaaaagggatgcagcttttggtgtaatgcttgccgctggtggcttctgggttgcgctgagagtggcgggttggatctatcgaatgttttttgggctgtgacgatgggaatggctggagaaagtgtgatctccctctatctcgggggggtctaatttgtggatttgaaattgaaatggagctgctcgtatcgtaggtttcttaaaatttttttgttgctgttctgacggtttcattcctagatggaagaatttagcgtcattagttctgtatttttcgtatgagcgtgtgagtaaagtatctcctgtaagcgttatttttggcttgggttcctcacaactgcagtagattttgcattctgttagaatatcttcttttctcatgtgtgtgttcggcactcgattattatcctgaattcctgatgcaaaggggaccttaggttatttctgtgtgaattttggcgaataatgttatattggtatgggtcctgtttgaaattccagaatgacaggggcattgttcaattccatcaggagataatcctgcaccctaaaactgaatcatacattatttgggttctttgattctttcgctgattgtgaacaagtggtttataattatcgtgattcatagagaaaatggagggactcttttattcaagggttatggggaatatattataaacgtttgcagtttgggcaaatgtggtgtattgatttgaatcatgtcttctaaagtttttggttcatgaacactgtttaaatggttatccttgcaatatgtagatacaatccc

SEQ ID NO: 15538 - DNA, 1501 bp, Oryza sativa
tactattcccaaatgactagtaaatccagaatctcacattaaagtagataagtcatacaactggctgacaatatctgaaagagtgacaacttagaaaagaacattcagaatttcagattttccagaagagagaatgcatgtatagtaatgtatatatgaatgtttacctgtgagcgcaatacttccttgtaagttccaatttctctcagggcaattgtaaatttggtcatgacgggtcctggaaaaaagtgaatgccacacttactaaaggatcactaattttgaaggcaacaagctggggaatgaaatttactgaatcctaggatcactattttgaaggcaataagctggagaatgaaatctactgaaacctattttgtagttctcaacgattcgtgccaattgtccagtttggaaataacaaaaggattcctcgatcccatgttataaaaacttgaataaatatatctgaataagaactgcattactaacctccaaaagcaacactgattggatcattatgcccccctccaaatgcttccagtgaacttgcaaatgcaatatctccatcatatgcttcccctagtccttcactgtaataagcaaacatatatgtttttaatgctagatagcaaagcataagcaaaacgaggagagaagaatatagagagcccaatggttcttgagttaagagtccagaccatattttccaacagaatttgcaaataaatgagcaaacaaacttttggtttttgtaagtctaaaactgcagactaagttaccacttacgtgtatttgcggcaacctttatgaaacctcaaacatctctctctcagcaattcagaaccttcttcaagggattgtatctacatattgcaaggataaccatttaaacagtgttcatgaaccaaaaactttagaagacatgattcaaatcaatacaccacatttgcccaaactgcaaacgtttataatatattccccataacccttgaataaaagagtccctccattttctctatgaatcacgataattataaaccacttgttcacaatcagcgaaagaatcaaagaacccaaataatgtatgattcagttttagggtgcaggattatctcctgatggaattgaacaatgcccctgtcattctggaatttcaaacaggacccataccaatataacattattcgccaaaattcacacagaaataacctaaggtcccctttgcatcaggaattcaggataataatcgagtgccgaacacacacatgagaaaagaagatattctaacagaatgcaaaatctactgcagttgtgaggaacccaagccaaaaataacgcttacaggagatactttactcacacgctcatacgaaaaatacagaactaatgacgctaaattcttccatctaggaatgaaaccgtcagaacagcaacaaaaaaattttaagaaacctacgatacgagcagctccatttcaatttcaaatccacaaattaga

SEQ ID NO: 15539 - DNA, 1341 bp, Oryza sativa
cagaggggggatgaatggttggtatacccaaaaaccgataacttttagcggaaataaaagttaccctcgaaatcgatggatcgcggtctaaccgaagtagttgcgccggtctgaccgcctgatgaacgtcggtctgaccgatgtagatcgatcggtcgaaccgccgaaaatgcctgtcgccgactcctgtagccgtcggtctgaccgccgtgtgcccgccggtcggaccaccgagatgccgccggtctgaccgccggtgcgccgccggttagaccgccgaaacccggtgaaacacaaatcgaagaactcttaaagtggatgacgactttattacttctctctgtgtttacaaagtgcaccaacagcactccttacaaaaatttcgactaaactcgaaaccctaactcaaaactcaactcaattgctctctaaagcgataccgggaagcctcacgctccccctctatttatacataaggtaggcagcctaaagccacgaaccaaactcatactaggagtcctaaacaccttaggaaacccactaatacaagaaagaaactttacataaccaaacgtaccaaatttggactccttccaaattcgactccgcatcccatacgcacacaattcctccatcgtatgccatatggaatctccattaaccacgtgcatcaactcttgcctaagtatcccgcatgatctctgaccaccacggacgtcgtcttatcctcaagccgactcccggtccatcaccgcaaatactcttccgagacatcgagtcacctatacatggaacaaacaaagaaatcatattccgagaccaagctatctccaacttgactcattagcagcaaacaatagtattacatacgtatagtatccatctagaagccataatcatggaataaactcggatatccaaataaacaacccgaaaccgaaaatgtaatgtaactctgcagcagctagatgtcagcttgcttgaccagcaaaatcaatccgagcgacttcagcaaaactgctactagtagtatgtaatgtacctctgtatacgatatagttgatttgatccagatggaagaattcaaatacgtagtagattgtggcaccaatgacatggccctggtacaagtttacaacctttgatacagaaaaaggttcagttcaatacatgatccagagggctctctgcctcgccggagaccgtcttctaatgggaattccccatgctcctacaattgcaatggcaaatccaaggccaaatcctattccagaaaagaggaacagcataacatctacagatttcttctcggaaggtatcacattcggcaatgtcatgttg

SEQ ID NO: 15540 - DNA, 1501 bp, Oryza sativa
cctcctcgtccagcatgaacttggcgttcgccaccaggaagtggtacttcttcggcttcgcctcctgcgcgcgcccaatccaccacaattctccgtctcaaccgggacgggaaaattatcaaaattagggcgggaggcgaggggcggtttggtttacctgatcgggaggctcgggggagccctgctggtcggagtcgacggccacggcgcggagcgacaggcgccgccgcctcggctggcacgagacggcgggcgggagcgcgaacccggcgccgacgcggggcagcgcggcgcgggacggcgcgagggtcgcgaaggggcggagggacagcgtcgcgggagccaccattgccccactcgcctcggctgccgaactcggggacggagccgaactgaagtgctgaagctggtcgtgtcagctcggagagggggcttgaggtcggaggacgacgatggacggtgagctttagccttatctctggacacgaggggtgggcgcctttaatactactgtgccgtgccattactggttaaatggctccatgacagcacacgggttttcgcactgtgccgttttgaggcccatagattttttttttgggcacacgtggaccctactttgggttttatataggaataagttcatctgaggtccctcaatctctatatacgatttcaggtctaatcccaggcctctcactgagccacgtggcatcacgcttgcgctccatccaaattctcagcaggagaacatgccacgcattcaaaatgtcccatagccgtccgatgacatacgaacggtgagaaaaaggtccagcggacctaaatataaaatgcaagttttaagaagggtttttaaacaaaatggacaatgccatctagaagagcctggagtagaggaaaaaaatcccagaaccaaaaaaaaagaaggggctgtctatataggaatcgaatgatttctgaagctccaatcatacagattttatctaccataggatgcacatccaacaactcagaaaaagtgatacaaatagatattacacttaaaaacagatatattatttgattatttgaacgccatttttttaaagcctaaatccagatccagatccataaaagcccaaatccatatccagatccataaaagcccattagtaaaaagaaggcccaaaatacaaaatttgaatcaaacacaaataaacaaagcccatgattttttcgcccatgcgaattatttgaaggcccaagtctatatccagatccataaaagcccattagtaaaaagcaggcccaagatacaaaattagaagcaaaacacaaggaaataaagcccaaatcataatccaacagcctatccaaaaaagtagtagggaccaaacttggaagccaagtagatgaaaaacatgtcacgtgaatcaaccatgtatgggaccacacttttcaatcccctacttttcaacagcactactagttcacaaacagatctagcacgaatcaaaca

SEQ ID NO: 15541 - DNA, 1501 bp, Oryza sativa
aggtttaagaataatgttggtccacagtacagcattacaaacttcatgatagagtatgaaagagtaatggatacaattcaaaacttggaacagtttgatgatcacatttcaaggacaaagaaaccaagcaaactttggtcccattactacattgagtaccaagcaatgagaatgtataatcgcaaaatcttcatcaagtttcaagttgagttgaaaagaacaactagatttcaaataaatgaagtagagaagttcaaaacttatgaagttttttttggcattgaatcaaaatattcaagtaatcagaagaaggaagtaccttgttattgtggacttggaaaaggaggatttcaactgcatttgctcaaagtttgagaaagatggacttctatgctgccatgtattgaaagtaatgctccacctcaatgcaatgaagataccagaaaaatatattattgaaagatggacaaaaaaagagtacaaaggtcttgggggaaaaggcaatggaaatatacctttagcacagagctcaatcctgagattcaacattttgtcaaggaaaagtgcagaaatagcatcaaatggatcgaaaagcaatgaaactttccagtttgcagtggaagagatggacaaaattgctaaacaattggaattaatgtgttcaaataaagatgctgagcaggagatcaatgattcagatccaaatgcagaagacaatttgaactcacatgaaaaaggcaatcaacaatctgaggaaaatacagaagaaatattgttggatccagatattgcaaaatccaaaggcaggccagctcaaagatataagacaatcagggaagaaatacagcaaaaagaactatatcattgcagtcattgtcagaggacagatcacacatttccaacgtgccctctgaaacacgttgagtttgacttgccaaggaagaagagaagaaaggttaaaaatacaagagaacaggtaacaaaaattacaaatccatatgaattgaatttttttaaaaaagtaataaagaaagatattatttgttgcaggatggtgtagagcagaaaaagaaagatgtttcaaacaaaagaaaagatttgcaacaagatatatcacaggagaagcataattctggggctgaattagaaggcaaaaagaagagaaattcatcttcatcaaaaaggggtggcacaaaagaatagaaatggaaatgactgaaaatagagagaggtttacttgaatacaatggaaatagacatattccataagtttctgtaatattccagaacatgtactctggtgtcacaccccaatctgataccgccgtacaacggcacctgacaggagcgtgtcgtagggaaaacggcgtgaaccgtttcctacgaaaccgcgatctcggtaccagtcccaggacatagtgctggtacccacggtgacaaatatgaatcatagcaatccttaaaataaatagaggacttatttaccttaacttaggttgca

SEQ ID NO: 15542 - DNA, 1501 bp, Oryza sativa
  unsure (1)..(1501): unsure at all n locations
cctagccaccccaagtcacgctgtcgccgccgctcgcttcgcagcgccgaggagcacctcggccgccgcttttcacggccgggatcccaccggaacatggttccccttgcgccggtgcgcatncgccggccgttctcacctncgaccagcgattcatgccgctgggagccctctccccctcctaacctctcccccatcctccccaggtccttccggccgccgtccgccggttcccgttcgcggaacgccgccgggccgccgttccgccttcgtcccgaggagcgccgacgccgagctcccccgcctttccccgccccttgtcgccgccctcggtgagcactcctcccctcttccctctttcttcccttggctggccgcctcccgtgcttgcgcgcgccgtgccgccgccgccggtggccgcccagcccgtgtgccgccgtcgctttggtccctgccgccgccgccgccagccttgtgtgcgcgctggccaggccgcgccgctcggccgtccccagtcgtccgatcggccctggccgatctgggccatccacgtggtggacgcgcacccgaggccacgtgtggaccatgtccaccgtgcgccctccccctttgactcgctgacgtgtggggcccacgtgtcggcgccggccgcccctttgctgacgtcagcgaagtccatttcctttgtaaaaataaataataattgcgcaataaatcgagtttaattttagaaattcatttaaatggctcaaaacttctaaaattcatatctaattcattcgaactccgaattgagccattcaacttgcaaaattcatctaaaattgagctctacatgtttgtttactttttatgtactgtttccttagtttttattagagtttttcctcgttttgcgtgccagcgtgtagttcccgtcgtttcggaagatcgcgttcgcaaggataagagttcagaagatccaagtgaagaagcaaggcaagtcacacattccccttgaacatgttgatcccaatttataaatggtttaccgtttacaaataaatatgcatgttttgctaattacatgggatccgggtattacctatctgcttgcttgtgccatgtttacttgatatctgttctttgtcaaccttgggtaataaatcgactagctcatattacttatgtgacctagctagaactatatgcttagccatgcttaattagcactagctcagttgatgggataattacagtattagacctttttagtatcagaatgagctgcgtgctcgagacatctggccatgcttcatggtcgtaattatccaactaaaatgcgactgaatgatgggctgtgggtgcatggttttgctagtcgcacccatggcaattaaggaccggttcgcgggatgccctggaagaacttatcgtacttaccacaagccagcgtgggcaacggctggacttgtagtgtagctttcctctagccgacgcatccaggcaagggtgggcgtga

SEQ ID NO: 15543 - DNA, 1501 bp, Oryza sativa
ttgattgagtgcaagtggttgaatgcctgtaaagtagggcgtgaaggattataccataccaaaataagcatggtccatacagattaggaactatttttttccctcaaagtatgattgttctgtattttttttagatttgcactgccatgagtgttcacggattaagtaatggttagtgagaatgtaattattggcattagaaactgtacataaaagttgatagtgcatggctactatgttgatattttgttacctttttacttatgctataaatggttgacaaatactagaaaagagttcaggggaacaattactagatattttaggttctattcaagtattatgcatttctcgctgtagtttgctgaaacctcgatgctgatggtaggcataagtttatcttgtcattaaagtatatcttcaaggtctaatgatttgagcacaatgtgttgaagacaccttgtgtatttaattgaactctaaaccttagagtttagccttttagcagctatttaaactgaaaaccatgaggttagcctttacaggatctcaaaagctggtagatgggtgtctttttgccagttatgtctaacagagcactagataagatgattaaaacacgagttcaagaaggttaggcctctactaacaaaccaaaccccttaggtttgttatcttctactgcattgtacagtagctggactctctgtacttaaactctatagatttaatcatcgcatcaggcatctatagactagatcactagatggacaaggctgaggcatgatgcagcccatggaggattgtcagagccatttgttagctttggaaagcttgtcttgcaagcaccctacagcatggcacaagcacgtcccccacagaatcatatgttctgtcctctgtctacctctgtctatatatatatctcttctcccgttgcagtaacttcatcgtgtaaaggcaatggctgtttttctgcttcttctcattgtttcctttctctcatatcatcccattcaatccactcaagaatcacattcgcatgtagatttttcttgcagatgttactactgttttttcatctttttgtgaaatcatgtgtttcatgttatagttatacctgtgctttctattgtctttcaggttcatattgtgtacttgggccacaacgatggcctcaatgcttcccttactgcaagtcttcatctccaacttctatcaggagtctttacaaggtaattgattgtccttttttctactcaaattaaagacaaataacaaaagacacaccaggtatacttgaagttgaatgtgccaaaatagtcatatggagtgcaaaaacttcatcatctcacatgagctattgttgcgcaacactgtatctagattaaaaaaaggctaaagttgaattattaatttagaaaattcaaaccccttagcttagagaatctagatatatttgttcttatttggcgagaaaatgtggctgaagagtgaagcg

SEQ ID NO: 15544 - DNA, 1501 bp, Oryza sativa
  unsure (1)..(1501): unsure at all n locations
ctgacggagcaatggcagagccaaccttcttctagatggcacaaggaccatacgacacgccactggctcttttcatctccatcgccgcaggaatctttgagagggggagccccaaggaaaacatagaactatgcataacaatttgctctgccaggctagtttaccatatagttattcttaaaacccaaaggaattttggttgttaacttaagcagattttaattagagttattttgttcactttccatgttaattagcaacgaaaaaaaagagagctcgacaacaaaggctgtgaagaaaacccctaaaattccatatcaattgtttcatctctcccctatattctatcatcaattacctttttcaacactagatcgatatgaaacaactctcaagtgtattttttactttttctggatgaaataaataatgctgtaacttaaaattgaaacttatacacctttaccatggatccttgtcaatatgaagaaaaaaaagatattgctatacattngttgatattttcttctcctaaaactttatcaaatgtaaatacggtataattatcgcgtaattacattgtaacttgcatgtattttcctaaaattttaaattgttagatgtgcttcaagattcatgcaagcgggaattaaaaaaccatggcaagcataaaggtgatgggattccgtcgcatgatgtccggtttgcggaaataaggtattaccgcgcgtccctccatcacgtacgaaacgtctgcttcccacaaataacgtgttaccgtgcgatttttaaaagttacatgcaaattttattatagttaaattcaaattataatataattacactatgattatgttatatttacatctattaatcttttagaagaaaatttatcaataaatataatgaaaaaatagagtaaaatttacaaaaatacagatacttttactaaattatcacaaaactgcagatttaaggtggtgtatcacaaagctatatattttatataatattatcataaaactacaagtttaaaactaggtatggcaaaactataaatttaataataaaattaattaaactacagattttagagtttaaattcttagtactaatgttatgtttgaattatcaacatccaagttttgtgattaaattgatgttaaacatttagttttgtgatactcaacttttgtggtaattttagtgttaaatatatagttttatgatatattattttaaatctgtagcttacaataaattactcaaatatacttgtagttttgtgaaatttatataaaataaattgcacacgtgttaagcgcaacaacacatctagactattctttcgagtttcaagtgcatgctccgggtgaatgtggctaactcacgtacttatcacatttaccgtgtatacaaatcataattttgacatatcttttgtctgtattggaaaaaaaaaacaccactaagaccgatgactcgaaagtcgaaactacta

SEQ ID NO: 15545 - DNA, 407 bp, Oryza sativa
cgatgtgcaaatgctgagcaccgttgctcgcagggaaatcaaatgcaaaactacaatctacaaatccgatgagaaggctggaaatgactggaaatggaaggggaaaacaaaaatcgaaagctcaagtgacgctggctcatgagagcttcagattctattaactccatgaaccaaacggcgattttcactaattcgatgtggacatcctgtaaactattgttgctacgagagtaacagtcaaattcaaacacgatagatcatcttaaactctggagagaaaaaaaaaagctccatatgtctcccaatctcccatcaatggcgccatggcgcgggagaatcatcgagcaatcatcgagcacgacaaagatcctcttagcatggagcggtatacggttggctgttcatac

SEQ ID NO: 15546 - DNA, 1501 bp, Oryza sativa
tctctccatcccttgtgcgtggatttgcctacgacgacgatgagaagggttgttctagcggcctttccccctacggcgacaatggtgatgggccttgggaagtgtggatcaggtagcagggagggcggcagtggatggccactcccgagctaggttcctaggatttttcttttgtttttttttgccgaaaattgtttttgcagtcagtcatatgcgaaaatctcttttacatgcggttgtacaatccacttggtaaaattcctatttctacatacaccacaggtgctatacccatatgcgaaaatgcattgtagtcgtttgggaaaattatttgtgtagtaatgtgctaacatagaataggcgttttagaagctgtacttgcttaattatctgcacacacactgctcgcgcagtttacttttatcgttctggaatgaattaaaggtttcaactaaccacggacaattagcggtaaaagagaaggtaatttacaagatggggttgacgacattccacgtgatcacaacctcggtaaattaaaacactggtcatcaaacgagtcttgagccagttcgcagtgtgccacatttgccactgtcctactagatcttggtcttatttgagaagtaacattccaattagcttgtgagaatctaaagaaactgaaaaatctgtagtattaatttcttgtttattttctaaattttataattacagctttttaaaatttaaataaaattgtatagtttgagaaaggttctagcggatgaagattctagaagaagcttcagccgtcgtaaactcaccaaacagaacccttatctcttcaggcgccgtgacaccgattctacaaaccactaaatgacacacacatttgctatcctgtctcctgttaattagacattttaggcgttaagtaagcagaggctgcagatcttgcttgctatgtttgggcttaaaaaggctgcaaatcccaaaggaagagtacagatccagctgcctgaccaaggcggcagcagcagcagcgcatcacaccacaccacacaccggccagctcaggaatagggggcccacatcgcacgcctaatcacccactggcaggtggggcccaccacctggccggcgcgctttgtttagcgccgaagcgatgggctctgctcgggctaagcaaagcgcgcgcgccccctcctcgcgcggagccgtacccacgtgcgccccacgcgtgcacgtgcctacgtgtcggctatccatgcagtggggcccatggcggcgtggtcggccgcgccgtggcgccctccgattggccggagacgcgacgccgcccgatgggtgactgccacgtggcagcgatgctcggctctataaatgagcgccgagtcgtgctcgatcacctccattgccagcttcttctccttcctcttcttcttcacctcgcaagcgagaaagttcgattccaacgatccgatggggaactcgtacagcaacggcggctcgccggcgg

SEQ ID NO: 15547 - DNA, 1501 bp, Oryza sativa
ccatgccgccgaatcatgctctgccgcttcgccttgttcacctctctgccgcgccgccacatcgggtttgtctgttccttctctattccgatcctacccccgcttaatcaacggctggattagttttggtactgcgcggtacctgtacctcacggtacaaaacgcaggatggtaacaacactcttttaaaaattaagggagttcttgtttttgtatgttactacagtatatactagtataaaggtaaatgaaaatttctcatcaaaattaagagtggttgcataattttacgaaaaataagaggggttgctgtcaggtgtgatgcttcatcttactgcttggctggatcatcggagaggaatgaatggttccgtgctttctacttctactgaactcgtattgtgtataagtgcatcacgcacgcaagtaagtaaagtacgtacttacacaggaatatgtacgtacgtacgtacggcagatggagaaggatgcatatgcgatcgatgaggttggcgttcgtgttgaaaaaacgtgccaactggttggttgaggaatatcaaaatccttgtccactttgtaagccagggatagtcgtaccgccaaacagaagtatgatggaaaagcaagtaacagaatctaatgacatcaattataatcacgtcaggtatagagcgagcggtagcagatcgagtatccatgacacgatccatcgatctcgcgttggcctggcctgaccgtaatctatggtattttgacatccaatgatcaccaatttgattgttttattattttaaatcttcagtactaatataaagtgattgatgaagaaaacaaatttgatagtcatatatacatgtcgtcggtggctgcagaggcggtgatcgatcaaacgttgcaactggcggaacagatgccgcgcaccttacacgaacgaaaaattggcaaaatgttccgccgtcgctatcgcaaacacaccctcttctctcctggttcgatcgatgaggtgagcgcgcgagatctccggcgtccctttccctccgtcaccatcaaccacggttgcttcgcccagccgcgatgccgcagccgcaggccgtccaaatcatcagcttcacagaccagccagacgagtgtgcagagcgagcgccatgcccgcatatgcacgggacgaacccaagattcacggcatgttaaccatgtcggagaggtggcgctgagccatcaccccttccgtcatgcaatgagtcctcctcaagaaacccaaccgacgatcaatccatcgaggtgtgacgcgccatctcgccgctcggtggcttcttcttcttctaccttctcctccctcttcctggccagccagtgcacgccttctcattcaattccctgctcacctcgatcgagtagctgctgctgctgtgctagcttgctcgccggccggtgaggtcgacgatggagctgcacagatgctctctcctcgctctgctcctcgccgtgacatgctcggttg

SEQ ID NO: 15548 - DNA, 1501 bp, Oryza sativa
cggatcatacgccactgcaagcacacacacatgcatgattgattaatcaacagcaaaagtataatttaattaggaataatgggcaagaagatcgaagaagtaattaacctgcaaccgagcatgtcacggcgaggagcagagcgaggagagagcatctgtgcagctccatcgtcgacctcaccggccggcgagcaagctagcacagcagcagcagctactcgatcgaggtgagcagggaattgaatgagaaggcgtgcactggctggccaggaagagggaggagaaggtagaagaagaagaagccaccgagcggcgagatggcgcgtcacacctcgatggattgatcgtcggttgggtttcttgaggaggactcattgcatgacggaaggggtgatggctcagcgccacctctccgacatggttaacatgccgtgaatcttgggttcgtcccgtgcatatgcgggcatggcgctcgctctgcacactcgtctggctggtctgtgaagctgatgatttggacggcctgcggctgcggcatcgcggctgggcgaagcaaccgtggttgatggtgacggagggaaagggacgccggagatctcgcgcgctcacctcatcgatcgaaccaggagagaagagggtgtgtttgcgatagcgacggcggaacattttgccaatttttcgttcgtgtaaggtgcgcggcatctgttccgccagttgcaacgtttgatcgatcaccgcctctgcagccaccgacgacatgtatatatgactatcaaatttgttttcttcatcaatcactttatattagtactgaagatttaaaataataaaacaatcaaattggtgatcattggatgtcaaaataccatagattacggtcaggccaggccaacgcgagatcgatggatcgtgtcatggatactcgatctgctaccgctcgctctatacctgacgtgattataattgatgtcattagattctgttacttgcttttccatcatacttctgtttggcggtacgactatccctggcttacaaagtggacaaggattttgatattcctcaaccaaccagttggcacgttttttcaacacgaacgccaacctcatcgatcgcatatgcatccttctccatctgccgtacgtacgtacgtacatattcctgtgtaagtacgtactttacttacttgcgtgcgtgatgcacttatacacaatacgagttcagtagaagtagaaagcacggaaccattcattcctctccgatgatccagccaagcagtaagatgaagcatcacacctgacagcaacccctcttatttttcgtaaaattatgcaaccactcttaattttgatgagaaattttcatttacctttatactagtatatactgtagtaacatacaaaaacaagaactcccttaatttttaaaagagtgttgttaccatcctgcgttttgtaccgtgaggtacaggtaccgcgcagtaccaaaactaatccagccg

SEQ ID NO: 15549 - DNA, 1501 bp, Oryza sativa
ttgtgctccagctcagtggtctatgtagagggtctacaggataattacagatgttatgcagtgggaaaatatatgttctagaataagcaagtttaagttaaacaacagcatattacatggatcatatgcaaactgtgcaaactggcgagtgatatatcttgttctgtaacacggcattgtcattgtggatatgggttgacctttactgggttccactgttacataccttctctggaaaaacaaattctcttgatcttacagttcacaactacgcaggtggcattttgcggcacagttcacaattttctttgtttgcctgttacgcttgctagcaccttaatttgtcaacttattgctagtgttaatacttatacatctgatggtgtaaatcaaaatagtttctttcatctgagaatccctgattgatctgtttgtaagctgtgttcttgttttgtatggtctgagtaccagctgctttaggtagagtaactgactgtcagttcctgagaatgccgtaatgctagttgtattccatagaactgtgattccttgcagtttacattgtctttattttatattcgatttcttattattattcggctagtaaatgcgagtttcctctggaatctgaatgtaccactttgagctcttaggagttgaagtgagttggagctagattgttagatcctgacgtttttttcttgttactgtgaagaacctgtttgtgctttctctaaaattggacttatatgcacgatatccttgattattttgtctactgtcaaaatctgatcacccatttatcagaaatcatgcattagtcacatttgtgataattgatcgtaggcaagaagtctatattgatgtttgacatccttgagtagtggttgctgatttgtcagctattgtctagacatggaaaagctactgctgaaaggccttcgagttctgaaggttatatactcctacatcttacatagaatttggatagaatgcgtctgttttgtttgtagttagtggcttagtgcacactgttgaatttgatagtatttgcaatacagtgttatatgctgctaaactaaggctgtgttcgtttgtgtgagatagggtgagaaaacacctcgttttccgcgcgcacgcttcctaaactactaaacgatgcgttttttgcaaaaattttctataggaaagttgctttaaaaaatcatataaatccatttttgaaatttaaaatagtttatactcaattaatcatgcgctaatggctcatctcgttttgcgtatcttcccaatcttctcaatctcctatctctcaaactcaccctaagtgaaaatggatttccttgtgaagattgtagaaacttcactaattgccaggattggtctaatttgttccaaggtttatggcattttttgtatttctttactcctttaaacgtttctggtggcgccgccaccaccaaatgacatttgggctccacataactagttgcagaaaaaa

SEQ ID NO: 15550 - DNA, 1145 bp, Oryza sativa
aaattttggttgctcacttcagttccaaatcaaactacataagaactccaaatccaaataacacacctagcactcaaaaattggctgctcagcttagtttcagagtagacaattgaaaaaaaaaactaacatcttaggtcagttttcaattacggagctgataaacacaaacatatgaactcagcttttagaccattacaaagaagttgaaaaaacatatagttcagttcagtaccaaactcagcttttaaattatcacatagaagttgaaaaaacatacaactcagttcagtaccaaattacaaaaaaaaaaataagttgaaaaaacatacaactcagttcagtaccaaattaaaaaaaaaattatagaaaaatcagttcagtaccaaatttaaaaaattaaaagaagttgaaaaaacatacaactcagttcagaaccaaattacaaaaaaaattatagaaaaataatggagatgcgggggatcgaaccccgtgcctctcgcatgcaaagcgagcgctctaccatttgagctacatccccttttatgacaaaacaattcaaatcaactaactcaagtaaaattaacaagttgggcctagtgagattacggcccaatgtggtgatgccacttcacttggcagtagagagcagcaggtttagtcccacctcggcgggagagagcgagggggcatcggagacaggctataaaaggaggtcgatctcgccttacataggcatgatccttcaggcagttaaagggagatgaggagtggtaacatctcgcaacttttactgcgagaggggtgcccgccccaacccaagcctgttacgacaacaggggcatccccatcattttaccatctgatcccgaaattttaactgaatttgtttggattttgtttttttgttgtggctttttgtttttttgttgttgctttactccatttcttgattgtttatttggtttatttggccaaatgttttctattaattgccggtttttatttgctttgttcctcttaagttgctggtttttatttaccaatttcaagctgtactattgtcgctctcttcgttgttgagatcacgcagcaagcatgatcaaaatacgaggaaaactaacaaggtgctgcgacacctgtaa

SEQ ID NO: 15551 - DNA, 1501 bp, Oryza sativa
tttctcaccgatatatctttcacgtatgatagttcattttagactaatttgtcattcaaattttatttcatacagataggcaagtcctctattttccagattaatacgggggagacatcgaaaagatatgcacctcttccttctttgtacagctgaagtaatgccttatgatagcacaccaaccacatgcaatttcttctaatgaacacacaattgtttatactttgctacatacagtggacagttacacctcaaatccctcctagaataaatcgaatgaaacagttacataccagtctgtactatgacatcagtatggcccttttggtctgtatagctgtcattattgtaaactatgcactatgtgtacatgtgcttaagattactagctacctattcatgttttcatgctatattatggtatgacatgtacattcattgtacaaataccacactaaaacttttttccttccgtgttcaggtacatcttgaacggcagttaatttccaaactgaaatcatgtttcttcaggttcaaagaaaaaaaaagccatgtttctggaaattcactttatttgattatcaacaccctttcacactgttaaattgtttgactcctatcatggatatagtatcaatacatgtactctattattgaacgtgtattactgacactgaaagtttctattatttcacaattcctattatcttcttcgttctaatgatttcctattattcaccatgcgatttttaaattattgcaccatgtattatgctattgaacttattaaattacatgtccttgcagaagaagttgacattggcattgtgcaagctctattgatgctatccaacctccacataaacattgtgccttcttttggtaatatgggcgctttaggcatagacctctgtagggatcttcatcctgtagtcaacggttatgcattcttctaattgttgtatattactcttagtctggtggtatatatgcagaaagatattcatacccttaccataaccccaaaaaatgtaattgttaagataaatgaaaatttttcaagatttattgtgacttagaacttcaattttcactttagtaatgatatctcactttcatggtacaaatctatatataaagatttgtactttggtatatcttttagtcggtgtaatatttcttttgttataacaaatttgttttgcgtggtttattgtaaaattagtgatgtaacaaataatgtgcccgcgcaacgcgcgggccgggcatcacctagttagggcacccacaatgttgtaaaaaaccaggtagtaagcattaaatggttgcttactacctggtattagtcattgtgggagtagttcattcttaaagccaggaagtagcgctgctgccggcaagaagggaataaaaaatgaaatgtgtacagtggagttctgacaaaaaattttaaattgcaagtagccgttgcttcttccaaccgttgctctcctccccagcc

SEQ ID NO: 15552 - DNA, 635 bp, Oryza sativa
aacttattgtaagccatccttgaaattgttatccatattccttactgcctgagtctattatttataggatcgtaaagggccttttccaccccaaaagctagccattaaagtgaggggctcccccacttatatcttaagtcctttgcccttccacaaccaatgtgagactattcaacaatctcccccttcacacattggtgtccctcagcccttcaccgccccttcactgtattcgggccccaccgcccacggtccatcaggtatacgggccccgcaggcacccacggtactattcaacaatctcccccttcacacattggtgtccctcagcccttcaccgccccttcactgtattcgggccccaccgcccacggtccatcaggtatacgggccccgcaggcacccacggtacatcaggccttcacacgtgtccatcgggtcagagatgttaacctagcctggctctgataccaattgcaggatcgtaaagggcctttcccaccccaaaagctagccattgaggtgaggggctcccccacttatatcttaggtcctttgcccttccacaaccaatgtgggactattcaacattatctacgcgtagtcaattattgacactgcttagagatgaattt

SEQ ID NO: 15553 - DNA, 1501 bp, Oryza sativa
gaagtttctcttcatgttgctggcaactacgtcaacacattcttcatcatgaatctccgttgtttctaccctacccgattcatcaacaaacacatcaaccttacatcaatctttgtggtctgaggtaggcactgcgatctgtcaaccaccttgcactacactgccaaagttcgtctgagactctgaagaagttcgaaatttattattggaacctcctgaagacctttgcagcctgaacataaacatacctagtatagccaccagatgcaaaaacatcttggttgttctagatattgttcaaccatgcgttgctacggaaaactgttgctacggaaaactaatactccctccgtttcgaaatgtttgatgccgttgactttttagcacatgtttgaccgttcgtcttattcaaaaaatttaagtaattattaattcttttcctatcatttgattcattgttaaatatatttttatgtagacatataattttacatatttcaaaaaagtttttgaataagacgaatggtcaaacatgtgctaaaaagtcaacggtgtcaaacatttcgaaacggagggagtattatgataaacaatcgagcagagttcaactttcagcatccaagtgctttaagaaaatattctccatgctgcgagcgaatacaatctcgtgtcaagatacagacaccaggcaatttttcatttcaaaacaacctatttcacgttataccaggtaaattatcctcgttccaaatggccccactggaatttattttttgtatgttccaaaggagcccttaagtcgctagcatatacttccatcttcatcgactgtggatcagggttttgctttctatttaaaaaacacaaccaaattttgataaaaataaaagtataaaatgattgaattattattaaccggtactccgacatgttttccgagtcaaaattaaatcggcgtgtttttacgaggaaagagatcgattagctttcggtaattaattacgaaccgagtcgagtaggtttttgcacactccgatcgatcgacggcctctgtcgagttatcaaaaccggcggcatcgtcgtcttctccccccatcgatcgatccatcgactcaagtctcaagtctcaagtgatctttttagctagctaattaattttttttagataatactctctccatctatttttgatagtcatatttctaaatctgaaaaatctatttttgataggcatatttcaatccaacaacctatcatcttaatgattttctcggatttaatgcatgactctccattcttccatacaagattggttgcatggacatcgagaaatgtaaatattaatgaatcgcttgtttacgaggaatgactagtagcatgtttaaatgaatgataagtaaaatcacttatcattgttctgtgtgtcaagataaaatatgactataaaaaaaaagtagatggagggagtactagctagctagctatagttaataagtagtca

SEQ ID NO: 15554 - DNA, 1501 bp, Oryza sativa
gtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctggaatcgtgtttacaaaatagctttgagcaactaagtgtcttttaatgctgtttactgcaaaccctaaccctttatattataacccccttgtactcccttgcatttatcctgcacttgtggatgtgtcttgttgagtacggtggttgtactcagtcttgctcaatttttttcccaaacccagaagaggagcccctggaagatgaaggctttggtgtctagctcgtgcctgccgtcaagcgcctgtggtggtcgccctagtcttccgctgtttcccgtttgtctttgtgtgtgatgggccttcgccgcccatgtaataaattaactatttacgcttccgcttgataaactctgaaatgtatcaacttttggtgtaccttgcctcctgggacaaggaataatacacgcacgtaaggaacgcccgttgggttaattccggtcgtgacacttttttactgtgccgctcggacgatggaaatttaccgtttcgcctacctttgcgacacgtggcgctttattactggtgggtaggcgaacggtcgcccggtgagctatatattcccaccgctctttccttttcaccgccacacttgccattttaccgcgtgcactctcttcctccgtttctttcttccacagcatctcttgacccctcaagcgtttcgcccattctcttacttcgccgctgcaaacgcaccgatcaccatggcccctcgcaaaccaaaccctgcttcggcgaaagggccggatcccggccgagtcgatgacgacaacaccgcctttttgggggtttctctcgcggacgacgtcgagctggcgaagtaggtcaactctggggcgttggttgaggggcaggctttcgccccagggaaagccgtagtgccaaaacctgtcgacaatcggacggtggtgttcgccgtcttttttgaggcaaggctacggtttccgtgcaacgtgttgttgccggagatccttcgcctcttccatgtggaacttccgcagctgagctcgtcggtgctagttcggatctctatcttcgactgggcgtgccggacttccgggtttgagcctaacgccgagctcttcggcgccatattttcgccaccgtgaactcgaagcggtgattaccccggccggaacgaagaagacagtgttcaggagcgtg

SEQ ID NO: 15555 - DNA, 1501 bp, Oryza sativa
  unsure (1)..(1501): unsure at all n locations
tctcgcgttcaaacgggcggatttgcccccgcaaatatcgccggcgccattgatggcggccggacctcccgcgcctattccttccccgccgaccgctctctccgcctttcaaccgtatttaaaccctcnccgcacctcgtccgtccgtttccgcctctcgccgccattcctcctcgccggaatcgagctcgcgctgtcgctctctctatccgccgtcgccgtcgagctccggaccgccgccgtcgtcgccccggaccacctcccacctcggcgccgcctccttcggcttcgccgcatcctcgccgacctcgtccacccctccgtttcgctcgccgaccgccggaacgccgtcgaccccgtcgacccgagccgcgccgccgccttcctccgctccggctgcctttttcgtcgtcgccgtcgacctagggtgagccgtggaccgccgcttcttttcccccttcccttcccctctctcggccgccgctccgccgtgcctatggccgccgccggcgaccataggggcgcgggcgccgcctcccgccggctgcgctggcttggccgccctcgggcgcgccgagtggctgccgcgtggggctcggccgtcagctgcccgcgcccgcgggtgcgactgatgcgtgggacccacggcgccggtcggtgtgagcccgggtgcacccggtccaccgtggaccgtaaggctgccgcgtgggccccactcccgtggacccggtccgcgcgccccctcccctcggctgacgcaataagcccttttaaaattaaaatttaaatgaagaaattcacaattattcatttaaagagcatataaacttcaaatgaccataacttggccatttgaactcggaattggaccgttcaagtctctaatttttccttaagaagtcaagaacccatttttgtgctttgttccagcttgttatatggagtttattagagtaaaagcattttcttttccgttggtcgtgtagacgccgcagcttcggaagatccgctcttcgtggaagttgaagccgacgtttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgttattgttattatttccttgttccccctagactaaacaaaaccccaactagtggacactctactcatggtaccactagtatgattttaggtagatgcttcgctggttaattaggcaacattaggtggttttacaactctagactttgggaatattctcatcacctggacaatttggaatggatggattattgtggaattggattcacacctccccctctattcaaaatcctcaaaatggttttaggctgggctcggggtgcatggttttgatagtagcacctcggccatataaggaccggt

SEQ ID NO: 15556 - DNA, 1501 bp, Oryza sativa
attataataatatcgtaagacttattagaatttataaacttattataattgccaaaattacaaaagtttgacaacattttgtcctaaaccgttaaatatttatgatcgaaagtagaaggatggtttgttcaatttctatgaaattaaggctctgtttgtttcagcttaagattattataatctagattattaaattagattactttaagctggattataataagctgacataaaataagttatgtgttgtttatttctttagattattagaggcatctaaggttagtgagtctttagccactcaataatctgaaaaaagctcctctagaggagattattggattatagcaaaatctggcttatagattataataatctaccataataatctacttgtttgttttagcttacgcctaataatttagattataataattctaagctaaatcaaacagggcctaaaaggtagtatagagtattctattaggttttttatgttgagacacgcctacgagtaaggttcatatctctgcatccaaattttggggtaaaagaacacgattactattgttgactactactctctctagtcaataatatttgacgtgagagaagattagttagtactctcaacgttaaatattattaactggagtgagtataaaagcatgggtacatgtttcatttcccacaaaatatatatccatcacatttctcttttttaaaactttttattgagcgagagataaatcacatttcccttgtaccttgttctcaccttctacattcaatccaacaaggcacctacaaagtacacgtatatagtagttgaacaagaatgaattaagtggttgcaatatctaagctattgtttgtcgatcataatcatcatgtcgtcatcaacaaaatgtggcaagacattcacttgccacgagcccgtgtttttctgtaacttctctacatacctctaatttcttaattactaaagtttcattatttgacagaacactttagaagaagcagttaatcagttcaatcgatgtgacgacagacgactcaattatcatcaatctgtgaacgaatttaactcgacttcttctctgctaataattaattaattaattaaatttctggtcggtgaactaaacgatgatctagtacttgcatcgatcagcggtcgtcgcagccacgatcagctttaaaaacgcggtgatgttcttagtttcgtgttctggatactttggattaagtcaatcaaattcatcttacttttttttacctaattttggaccacgacggctgcgaaagagatgtcctagtaatcatcatccaacgaccacaaaggtctcctctttatagaatgcgagtttgaacgcttattgcctgcacgccaaactaattctacacctaatgactttccctcaataatttagcccctaatcttcagcatcatcctcttgcttaattgtttctagggttgctataatcacaggtgcaactg

SEQ ID NO: 15557 - DNA, 1501 bp, Oryza sativa
gagtttctcagaaattacaaagatttaaatgaaaatcatgtataaaattttatgccatacaaataagtagatgttaaagtttgaagcaccacattaacgctgagttcgataaaactttttggctagcctaatcaccaatgttctaaatctccggctaagcctcttaacggttgtgctctccaacagctaagagcggctatagcgggttatagctacaactaaggtatttagcagttttaaaaaatattaggggaaaaataaaaaaacttatagaatttgggctaaaatttgacatgtgactcactatttgattgcacatgttgctgctcgaggtgccgtaggagccgccaccgtcgccgcttgggggctggaccgtagaagccactgcagccacttgggggcaggaccactggagctgccgccatcaccacttggggcaagactacgttggagttgccgccatcaccacttggggcaagactacgttggagcagctgccgccgccgccgcttgggggcaagagagtaggagccgccgctgccaccgccagtcaccactgctgggggtaggagccaccatcaccgggagagcacaattctggagttgagactaaagaggagcctcgcacgagtagggggactagggagtgtgggggatttagggtttggttttgagctgaatttcgtggaccacgatgccaaaagcccattttcgcgggccatcgctaaatgctgtatctattttctgttagtttagcggctatctccggctaagcacaactattagcgcccaataaatcttagtgtcaaaactgaagtctcctagctgtcccctccctatccgctatctccggctatagtggcagtatagccagacatttagaacattgctaatcacccatacaaagcgagatggataattaagtattaactgttataaatttaataaatagattatttgatttttgtaaaaatatatatatatatacttcctccgtctcataatatagcaacttaaaactgaatgggtacaaatttgttgtactataaaatgtcctacattgttatattatgggacgaagggacgaagagagtatcatatttagcagtttggaaaacggtgtgagaaaacgagagtccgaatacttcagccgtcgcacgggcgcttgcgattgggctgcgcttcgatcttcgcggcccaatcacacagaaagcacaaagatgattgggccgttggaccgatgcgtgattgccatttcagcccgcacttcccaagggctccaagcccataacgcctgtctcacaaaacgagtagggccccacatgtcagtggccgtgagggagcacaacccgcatccggtaaaacccacccgtccccaacctctccgtccaatcccccaccgcgccgccgcatccgcctccgccgacgccggcgccgcccgtggtcttcctcccgcccgccgcgcgccgggagatcgatcgtcgcagctcaccggatatgg

SEQ ID NO: 15558 - DNA, 1501 bp, Oryza sativa
cttttttttttctctaggacaattctgtcagtttcagttgctggtgcccaaaatggcagggaagctcaatggactgttgataggactgtgtacacttatgctaacttctatgatgattttaaagccaaggtttttgactttggtgataggctcaagatttcgtttatagaattagttcagcgtcaagaaaatgatctattgcttggatcttttgagaaagagttaagattaaaagtacttctagcggatgaacatgatgaggtatccataaacatttgcttaatcccacccatgttcggttgttaagctaaacgattatctaaatttgttaggagttaaatgactatctaaatttgttaggagctagcatggttgttaagttaaatggctctatctaaatttgttaggagctccaaagtgagaggtttgtcaagatgcaggggaagcatcaacctgttggtttaaaaaatgagaaaaataagcaagtattgttccttttttttccatcttttttgtcagtgtttgtttaagttccatgtccttaatgttttgtgtatagctgttttggtaatgtagtgctccaatgtttggcaatcacggaaccatttgtttcaagactctttggacaacaatttggagaagaatgtatgatttaatcacaatttttttagtaaaaaaaatatttgtttaagtactaaacgtgtagtgttttaggcctaggaaactgtcacgcttgcgacctgcgccgtgatctgaagaggataagaaaaactggtgcaccagccttctttcccactatctttaagcatattcgatcattaggtggtgattttgaggatggcttgggacgtcatcgtgactcttctgagttcttattgtaataacttaactcaacttttgttgttttagtttgcatttcagttatttttgtgtgttatagattatttttcttttccaggttattactacaaaagttatttgatggtacacatggatgtttaacagatatgtttggtggaaaattccgtcgcagtaaagtatgtttgttgttttagcaattttgacatgtgtttcactgattttacatatagcaatgttttaatgtatgtgcaggtttgttccaaatgtggaatgctttctaattctgaagaagattttactttgctaatgtttaatatacctcatcgtgaacaagttgttgctgcaacattagaagattgtcttgatcacattgtggaagaaaacgtacatgattcattatcccgttgtgaaaggtaaaatttccgatttgtgaatcttaatcgtgtatcatcatgtttatagtaagttcaagttgtttatagtaagttctttgtttataaaatattttcttttgtgtagctgtatgaatgaccagaagtcaaccagtaagtgtacatttcatgaaactagagatgttgttattgtgttgcaaagatttgaaccacttacacttggggtaagtaaatactgttatttgttg

SEQ ID NO: 15559 - DNA, 387 bp, Oryza sativa
ccgtctgttaatgttataaataagtcatacccaataatcttgggttagtctctgcgggacccaccatatacccagttctatacggaatcatacattatatacggaagatattttggataaggaaggggaagtaaagttctactcgggcactataaggactactcggatcatattcatactttgtctctctagttctatttggacaagggggcacctgagggtataaatacatgaccccctagaaggagatgagagatggcaagccagaagatagatctagaacaaatctacacaagccaatacagatttagagaatccaagacaagccaacatatatacaccagaacaagcctagacaaatccaatctgaagctacaaaggcaaaca

SEQ ID NO: 15560 - DNA, 1501 bp, Oryza sativa
gcaccacttgccggccgggcgctccctgctgggagcaccagcctttttctctttgtcgctcgcaggcctcccctttcgggtggcccgcgaagcgccctcgacggcgaggacatgaccctcgtcgccggaatggaccgacctcttcttcctcctcctgtcacgccgccctatctgagcggtggacccgggggcggccgaagctgccacaccggaaccggaggggttccaggtccacgcttcctccttacgagccactcggtccgcgagctgaaaaagctccgcggtagtctggggctctttggaagcgatcttttcgagcatgcggttgtgccgcacaccccccctgaacgcgtagatcaccgcgtgtgcagggatgcatggtatggtattgcggacttggcagaaccgctgaatgtacgagcgaagtgactcatcatcccctcgctgtactgcgtgcaagtccgcttcttcacctgggcgcggataagtgccttgaaagttcatggtgaactgttggcacaaatcttcccaggagtggaccgacgcgggaggcaggttcattagccaaccccgcgcctgtcctttcagggccatgggaaagaaattcgccatgaccctgtcgtcacccccagcggcctcaatcccggtcgtatagacctggagaaactcggtggggttgacgctgccatcatacttctcggtgatggtgggccggaaccttgggggccaacggacattccgaagactcgccacaaaggctctacagccgacaccaccaaccgggggcacggagggctggtcctcacgtccatgtcgaggtgacactctggacgaagaggcgccctccgttgcgcggggagtacgccggctattacgccggcgctcgatgtcgaagcgggcatccggctctccatgctgatcctcccgagtcggaggcgccgacgagggagtggcagccgaatggcgtgcaacagccgccgctcgccgcgccctccgcctgacgacacggagccggtggtggcggcgccggaggtcctggtggtggcggaccgtccaccagcacccaggcgctgctgtgccgtcatgaccaagttggccacatcgtccagccatcgctgggctggagactccgggtcagggacgacgggcgggtgacgtaggagcgcgccagcagcctgaagcgcgccctgaggcgtgctgccgtcgcagtagacgagtaggcgacgctccccatctcgccgttctcctgcatcacccgcgactggtgatgctgcggatttttcgaccctctcgagcgcctccccctgcttaggactttggtgtggaggaggtgggggagtacgagctcgacggcgtgggtttggctccccgtcgtcgccgctcacactcggagagaggtcgtgcgcctttgcttgctcggccattaggctgaacaagaaaaacttggcgcacacggaagagtgcgagagctcagaaaacacacgctgagccccctacctgg

SEQ ID NO: 15561 - DNA, 1501 bp, Oryza sativa
atcaaacttatgtcctcactgatccttatgtatgtaagttctatatataagccactattcactgattgctaaataatattatttacgcagtatctatgcacaatgcacctaaaaattagctgatatccaataagcacgtgtgtcatctaacaccgaagataaatggtgacactaagtgcacaaccatcaacaaactatagagtaagtagacgatgcaaacaatagttaactacaagtagattacaactatgagtaataccattcctacacttctataaacgctcctaagatgtcatgtgatactctaataaatgatgaaccctgagttccactcgacactcaaggctgttgtttgcccgatctttcggtgagttgtagataactatgatttgagagaaacgttgacgacccgactacaatcgtacgagatgttgtgttgcgccttagcgatcgatacacctctccgagggttgttgatcttgccggtgcagatcaaccttattcctgcaagcaaatcaaagaaacaagcaaaaacaaaataaaatcaatctgaattgcaaataggaattgagtacacacgataagttggggtttcgaatacaagcagacggacggtctagccgacacgcgcgctgcaaggaagtagcaatggctaaactttcatctaaacaaaacccgagagttcttggcggcaactagaggtataagaagaggggaagaatgaccacagggtcgtgctccaaccctaggacgtgcccctaatgggcccaacttgatacatagcccattgggccaaaagaggtgacgcagcaccatggacataaaatagtcaggagtaaaatgacaattgcggccgcttcagaacatatatggacatgtggcttgatccatttgaaagtagacttgataagctttccatgaagtacttgcacgccaagctttccatgaagtacttgcacgcccaaatcagagttcgcatgaagtcgtggcggccgtcagaagttggcgctaccctgcaatccgaatccaccccgcgcgaatcctctcccctttggatcctctccatcattcctgagtaaaatgcgagtgcacgcgtctccggggtataaagaagaggaacatgaactcaagaaagaactcacctgatagtttagttgacgtgcacgagcgcgggtaataggaccatcatgctgtacttgggggacgtggatgtatcgatggtgttgatgtcctcatcaataaattagaaagaatatatgaaaagttatataaaaaagtaaacatacatccatcaatttacacttaaatagatgatccattattttcaaccattaaattaatttagatatatgaaagtaatccctctgtcctaaaaaccatataatatgtccctacatacatacacaactcctatataatttcgtacacgatatatatatatatatatatatatatatatatatatatatatatatatatatatatatatatatatatatat

SEQ ID NO: 15562 - DNA, 1501 bp, Oryza sativa
acacatccaagtctgtgtgctatcgattcaacctccttgtcagggttgctatcaccagtgatcatctgtgttgtgtcacatcctgatttttgtttcagggtttataaattatttaataaattaataatagaatttatattaaatgatctttaatttacaagtgaagttaaatgtgggaaataaaatttcctaaatataaagcatggatggatttaatttttattaaattctccatggttaattatactctctgaaattttctcggatttttcagagctcaattcttaaataatacaaagaacagttcagtaattatttgatcattaatgatctaattatttttgttaagtgcttttcttgtttaaaaaaaaatccttaaattataaattgttgtttaaaaggaattattagaaatgattttaaaagcttaaaagagaagatctaattttaatttgttaaatctcaatataaaattgggctagataaaattttgttaaatactttgcttaattctataattcctagatttttctgggatttatttgagctaaggaagtatttttaataaatagaattgcatttaagaaataatttaaattgaaaaaggtttttaaaagtcttcttttggctttgggccgaaagtcggcccaaaaccgctctctctctctccccggcccagtcggcccagtccgccgtgccgcccttccttctctctctcggccgctgacaggcgggacccacctgtcaggtcgttgtcttcctcgcgccgccgctgccgcccgaaaccctagcgcaagccgccgccgtctccttccaaattcggcctcatctttccttctccggccgaatcttttgaggggaaataatcctcttgatctcctcttccttttctcctttggaaacatcggctaaatcggcttggaaagtgtttgattcgaggtcgaatcggatcggcttttctctctccgagcccgatctttccttctcgtcgccggccgctgtgggccttcgccgccgcctccttgcccctttataaggacccccgagctctcctctacccgccgcctctctcgccttcgcccgccgtcgtgtgtagcgccctagcctcgtgagcttttgcaccgccgtcgccgccgttcgtccagccgtgcgccgccgtcgctacggtcgtcgtcgtcactcgggaaggccaccgtcgggatcgccaagtcgctgctgtccccgtccaccgtttcgccgccgccgaagaccgccggagcgccgttgccgccgtcgacccaatctccgccgtcgcttcttcctcgtcgccggcaccgtccgttgctcttccgccgtggttttggtcaccggtgagttcgctgcgtcgtcctctatctgttggtgccttccgttcgtgccgaagcgccgccgttcgccggcgagcgtgcgccgtccgagccgccgagccgccgccgccggaggtgacgtcgtcgctgacgtcatcgtcgccctctcccgtgag

SEQ ID NO: 15563 - DNA, 1501 bp, Oryza sativa
atgtgaaaacgcgcattcctgctgtgccggtggctatcaatataggtaagtgttgacatttgtaatttgtttgagcactagctagtcggtcgtgctttccccagcccaggcgcactactccattgacactgtctataaaggctgggaggcagcagaaagacgaaagtcaaaaggactaaaaagagagaggcatatatagtgacataaacatgggcactcgtccatttctggttccggagtcaaactaaacaccaagctaagcaagctatattgatagtgagtagagtgcaggcttcaattcagttgcatcgatgcatttgtgataaatcagcaagtgccttccctgtatatatgtatgacggtggatgcagctattgttagtgccccatgacgagatctcaccttaatactactacttacactagtattagtttttatcctcgctctgtccgtttgtctgctgactgactataactgattaactaggaatagttttgtatataggatgactagcaatagggattccttacagatgccgagaaagttttttaacacatagctatagctgatttctactgctactattttaagttttagttattattagtgcaggtggaggtggagggcttgcatcggagaaggattctaattatatccggatggacacttccattgtttatttcatgtcaactaaataactgtaacaaaattcaaaaaggatgacaaagacatattaatatgaaatatatcaatccacgaatataaaaaaaattcaaatttaacttctacaattgataacaaaaataacaaatttaattgtacgtatacatatgctaattagagtttaatttgttgttttttaactacttatacttaaacttgcatgtttgtgcatcgatataattacatattttaaaaaattacaaccatttaattaacatgacggagtgaacatatggatctaggtaattaaaagagtttcctttatggggtattatatactatctaatgtggtacgctacgtacggcttttaagtcaatgcgtccgtccgtaagtaagaaaacaaactgtacatcgtgcataaacagtaggactccagtatgtatgagtgttgtgtttgaggggtgtgtatgtgttgtgttgtaggtcaaccaatggaaaagcaaggagatgatgatgaatggttatagaggcagggcaccatcccaccttgaattgtcgcatcgcatcgcatccacaccaaatttcactgactactgatcgatcaactttccttttctcctctttctttcttcactaatcaatcaacttaatttgctctgtcaatgtgcatcatgtagctagctagctattcagattcagagtgatgaagtagtatatatttatgtcgccggtgcggtgccgcgtcgtccactggcttgctctactctattattccctttgcattgcattgatcgagtaggagtagtatgcccatggccatcgagtcatggctcacca

SEQ ID NO: 15564 - DNA, 1501 bp, Oryza sativa
tcagacagctcagatcaaagcaagaccgacgatccaatggctatgacatatcgatgatgtggctgcaccagagggctgctttatagcaataattgctagtagtgggtatcaactatctaggaagaagggattacttctgattttcttgagcagacttagcatattactgtttggcgttctccttcagctctcggcgacggcgaaggtgacggtggccatggctccttagatcgacgatgatgtgggcttcggcaatgacggcggcggggtcacggggcaccgtcgggagagctcgtctacatgccaattgccgtctacctcgtcctcttcgatagtttgctgatttgttgctttcaatttgtacatatattgtggatctgttgtgcatgagcttgggatctatattctatgaatttgtaatgtggatgaaatggttgattttgtgcataagcttggggaatctatcgatttgtgatccaatcccataattttttgaatttgaagttgggatttagatccgttttttctctttcttttttttttttgcgaaaagtaggttttcattggcgggcctcttacgctaacgcctctgataatcagatcttcacttgcggtacctctaaaggggccacctgccaaatgttttttttatagcgggcgtgttccacctatgaaaatcattgattttcacttgcctttgatctctgtaaaatcaaagtgtgtttgattcttattctatgatgaacaattggcatatgtgattgttggttttgatatttggagattatcggcgaagtggttttggagatgattggatttgcagatgatttacaggtgttgctgttgtcgggtccggtcagaccggcgctatgcgagcggtctgaccgaccagcccgcggtctgaccggccgactctatgtcggtttcggtttcgggttgtttgtttggatatccgtggatgtttcgtgtttatggcttctcgatggatactatgtgtatgtaatactgttgtttgttaacaatgagtcaagttggagatagcttggtctcggaatatatggtttctttgtttgattcatgtgtaggtaacttgatgtctcgggagagtattgtcggtgatggatcgggagtaaacttggagataaggtgacgtctggacggtcagatatcatgcgggatacttaggctaaagatcaatgcacgtggttggtaaagattccatatgtcatacgatggagatattgtgtgcgtgtgggatgcggagtcgaatttggaaagactccaaatttggtatgattggagtttgtaaagtttgtttcttgtacggaaatgttatctaggtggattaggacttcttgtatgagtttggttagtggctttaggctaactacctcatgtataaatagagagggagcgtgaggcttcatggtatcgcttttgagagcattgagctgagagtttagttagagttttgagtttagtcgagatttttgtgaggagt

SEQ ID NO: 15565 - DNA, 1407 bp, Oryza sativa
ggcgacgacgacaatgccggcgccggggcgagcgctaccggcggcgcggccaccggcgggggcaatgtgggcggcggcgcgccgagcaccggggccggcgccgggggagacggcgacaccgtcgtcggcgccggcgcggcggcgggaggcggcaatgcgggcgacggggaggtggccgcggcgggcggaggcgacgtcgtcggcgccggggaggtcgccggggaggtgagcttgttgccggagtgggacggggacgcggcgggggaggtggagatgtggcggtggcggttcttggaagaagacgaaggtgcggaggcggccggtgagtgcgccgcgccggagctgggcgcgccggccggagacgactgggaggtcaccgcggaggcggcggcgaggaggagcaccgggaggaggaggtggcgagccgccattggcaatggcagtgagatttcagtgtggaggagtgaaggaggagagagcaaagctgagctgaagtgaagaagtgaaggagagcaataaaaacactggctagtgagtggtggagaactgagagagaagaagcacactgaccagtggggcccactggcagcagcagctagcctctgtgtcagccactcgctggctcactgtgtgtgggccacaccaaggctgagtctctcacttccttttttttttttccttacagtggctttgcagttcattgtctggtgaaattaattttttcttctgctagaaaagaatgcaggtggccaggagagaagggagattttattcagggtttatattttcgacgaaagcccattcagaactgcgaatttttttactgtagatgtgagactaattttttacaggagagtagattctaagtgaaatttcaaatggtttttgagaattcgaatttgaaacagtaagctttgataaaaagattagcgaaaaatgttatacacttacaccactgggtacgaaatctagcactcgatcaaaaaaggtgaaatctagattgtttagcactagattgagatgatgctattaacggcttgctttggctttaacctttttttcctttagttactttgttcttgtttaagttgatggtaacacttaagtgccgaggaggcaaggaatgttggaggtgaggtgaagtcggtgaaaaggggaatttttttttatttataattttttttattaaaagttttacaaaaataattttccattttgaaaattgacggaagtagtcgcctaccgccctctgggaaaatcgccctctcagagggcggcgaaaatgacgtggcagacggccgttcactctcgggcgacggccgtcaacgaaatttgcaggcggcccccttgccgccctccgctagggcgattttatactgtgcggggggccgcctgcaaatgggcggc

SEQ ID NO: 15566 - DNA, 877 bp, Oryza sativa
agttacagcaagaaacgcggtcatctgaccgaacgccacaagttcctatccatccttttgttctcacaaaacactaatagaattccatttttcctcccagaatttggcaaaaagggaatcgacaaggtcgagattaggcgcaccttcaagccgcttgaactcggcggcgcgcatctcgtcgacgcccttgggcgcgcccgggtagccatagtcgccaccgaactgcctcaagaactcctccttgctcacctccatccctccccccctcgatgcaagaatctcctcagctcaaaccgcgaccggcaatccaatcatcccagctgagcccaatccaagaaggggaggcggggaatccagcggagcgggagggtctcggattgtccagaattgtgggattcccctcgattgcgactgattgatttgatttgattcttctcctcccctcgtgctgggagacgtggagtggagctggagaagtcagcgccgtggatgtgggatcgatggggatgggtctcgtgctctcgtctcaccgaggattaaaagaaattgtggcgcgcgtgtggcttcgacgacggcgagaggtgagcggcgcgaggtagacgacgtaatggctcacgcactcttcggttcggtttggttttcttcggttcttcgagattctggttttttttttattcacaggagaaaaatataagccggattaatttctgttggaaaaaacaaagaaaaaccacgcaggcgttgctgcagtgcagagggaaggggatggaagtaaaagatggaagttgggaacggccaaggtgaagtacgacaagtctacaacctgagtttatctagtttttttttcccttgagtactctctcctccatttcatagg

SEQ ID NO: 15567 - DNA, 1075 bp, Oryza sativa
tgtacatatgtggcccgcaatttgcgggctaccatcgttatattttctttcatatattagtatgtatgaattatatggtggtttaaggatatatatatagacacacacatgtaaataggtgtcaattaattgctactaattagacttctaatggcttgctagcaacatatttaatttctctctacatgtatataaacatggatgaagctagaacgaatattaacttatatcccatacatatatattacatggttaatattctaatcacatgtggtaagtccattaaaatttcttaaaatacccttaagctgccatgtggtgcactaataaattagagaaaatattagaaattctaaggaaaaaaacaaagtaattgatcttagaacaaactaaatactacgaggtcccacctctccaccttgggtacggacctaagtacgtgggtacctacgcttcccctccaccttctttttctccatgtatacgcttccctcctttccttactatatcatgcgccttcatgagacgatttaatcgcaagaattttgagtatcttgctctcgtgttttttatttgtagccatactacaagtaatagtttattaattactcgagaaaaaaacatgattcaaaagtcgtaagtacttaatctattttctactcaaaagtttgtgaatggttttttaagattccttaagaaaaatagaacccttaaattattaaaaaaatattacaaaataatagtatccgaacacttaatctataaaacaaaatttttaaataaacaataaaaatcttatctttcaataatataagtgcccgtgcatgcgtgtgggccatcttcctagttggattaaaaagaaaatttaaaggaaataccgttccttgtttttcaaattcctgcatgcgtgcatgcactccgtcggtcacgataaaaaattcgtagcatgcaatttggtggcatccagtatatactaaattcctctctagtagcatttaatttcgtggcatccagtatatactaaatccctcgttagagtactggggatttactagaacatgctaataattaacga

SEQ ID NO: 15568 - DNA, 1501 bp, Oryza sativa
tcaacttttccgtcacatcgttccaatttcaaccaaacatccaattttagcgtgaactaaacacaccctgagagagagaacttgatcatcattcatggcggagcgaagaggctttgatacgtaccctggtcatcattatcctgattgcccaacctagaacttgaaatcagaagctgaacacaggtagctaaatgctttgtgatcgctgtgccacacacgactgagcttgtactggtgtgcgctagcatttcagctgctcgcaatattctgagataggtgacctgttttgaaggagttgtgaacaatatatagagtataaagaggatcctcaaattgatgtagttttttttttttttttttttttgtgactgtggtcaatggacaaggtattctctccccacaactaggggtgaaatcgggtcgggttgggtcggatctcacacttctcatatcctaacccacattgtataatcggaatcgggtcagacacggatagcgtcgaatacggatataagttcggataatatcgggcaaaaatatggaccgaatacgtacccaaatggatacgtacactctcggttataaatacttattcggatatcaagtcgaagaaacaatcataaataccatatagacaataaccattcaacaaatctatatccataatgcgattatattaggtcattagggcttaggaaacaagacaccgtagtacagtacgtgacaggctcacagccacaagctaaaagtagtacagtacgtcagtcacagccacatgccaaaatatcaccaattcttcataacggagacttatagtcattacagtcacaggctcacagccacatagtactccagtacataataccataatactcagaaacatgtcttgccagatgccaaccaggaaacatcaccatttcacaagagtcttgagccaactaggaaacataaaccatttcacgtaaaccatatttaaggacaagacactcaaatcatcagtaggagacgacgaccggcgcacacggctgtcacggcaggcctgcacacggcaggacggcacgacggagatggcgaccgacgcaggccgtgcagcagcggtggtgacgagcaccgtgggagccggcgccgccggcgcgggtggcgccgctggcagccgtcgcaagggcgcggccgcggcaggagccaggaggagacgccgtcgccaagagcccgtgacggcaggagccaggagccgccgccgcccaggaataggaacagacgaacaatcactccactcggtctcctcatctctctcctatttcctcgggttagcaatactattgggccggtgagttttgggcctggttgttggctttttggctagcttgcctcaaatctggttggctggttgtacagactacgtaatacgggtactatccgtatatatattcgggtagtatccgtattttttactggataatccgtatccgtcggatactgcgctcccgaatccgatcccata

SEQ ID NO: 15569 - DNA, 1501 bp, Oryza sativa
tcgtgcatgacacgtcccgctgccagactagtcgctgttgcaagtctttttcggaaacgttcctattaccgggccagcgcaagcacgtgttactgaatcgttctgaaaacgatcacattttctgaacgagtacttgctcgttcaacttgagacgttcacagcacgctcacggtccgattgccattctcttacacggtaggactcacgatcgctcgattgacttggacttttaaataaaagggaacccggggactcgaaagtcgaaacccgaaaccgttccttgcatcgtcaacaaagcaagattgcttcgcaagaaaccttcgcggtttccactgcaaaccaacgtgctcgagccagtgacagtcgtccaacctatctgccagacttgccaccaccttgatcagtgatcactcgctcgtcaagaccagacggctcgtgcgtccacgcgccaccgttgccgtcaaaactaaaattaaaccaaactaatcacactgacacagtgacactcgtaggctcgaagtagatcggatggttggctaaggtttcgggctggtgtccgtgccgtcctggtgcaccaaagcaggcgcccattccaaaccgagcccgcgccgaggaggaaacgacacggcctggtacgtactgtgcgcgagctacccaagccagcacgaaattaattttcaccaacggaggctgacacgaaggccccgccgcgacgccgcacgcgagccggcatgtatgggttgggtggggagcaggcggtgcggttcgtcgtcgctgacgccgcgcgcgtgggtgtggtggcgtaaagcggcgcgacgccaccgccccgtgaccgtgtgtgaatgtggtgatccatccatgaatccgatcccgcaaccaccaaacccgcattatggcgtggagactcgccaaccgacacccacccagcccgccgcctcctccgcgcaaccccccgcatccctcggccgtccgttccgatgcgcgcggagcgatctaacggcaccgtgactctcaccagagtcttactgctaaccccgtttttctctcctacgtacacgcacgcgcggtaacgagttaaccacgcggggacagggcgctgacagtggggcctggccaccaaccactcactaatcgcctcaacggccatctccccggtttccgaatctcgaagcaaaagcctccacctcgcgagatcgttaggtttctcacaacccggtggctacgtgagccactgacaagccggtcccgctcctcctcctcctcgcctccagtttcgggaatcttccgttcccagatccgcctcttccctcctcctcttcacatctcgcgctgctgctctcctcttccgttccaacgccccaccaccagagacaaaacagcttgccttttgaaaaaggaaaaagaagaaaaagaagaagaagaagaagaaaaaacacggcaaaaccctagatctctcgctagtttcgttctccttcgctcgcattgctggttggggttcgcc

SEQ ID NO: 15570 - DNA, 1501 bp, Oryza sativa
tacacacgccatgataaaattagtgccagtttccttcaataaataaataaattagtgtcaggtagggtccattgagttgatcatcttctttttttttttttagaactgagttgatcatcttatttatacttgggtttctttcgacaggccagcaatgagtaatataatctcattacatcacatgcatggtgcgactatagtactttaattacatgatactattgtgtactattgctgcacacatatggtggataatattgcatattatattttaactagcaaataattaattagcataggctgaccaggtgtccacttgcaatttttttaggggagaaagttgcagcttaattaagttcagatcatgcatgatatagctagctattgcgaaggacgtgcatgcatgttccaatcgttagctaagcacgtaccccccaactgtcattaaccgttaattacaaccgccacattaaacttaaaattctgtaatgttaaattgtttatttattaaattaagataatcacttcgatccactcgatattgttgcatgtttttggataacataagtatcatgggcttaatttgcaaaatcttaattaattttttacgcgtcgccctatagtgtgtatatatatatagatactcggttagtacgcaacttcggctggagtataatttatcatcagatattcagatttctggaagcttaatatttaatttagttagtcgtaggtatatatttcacgtggcatcacactgaccgagggggggaacttggatgaattcgattatataaatatttatacagtatactgctcttgcaacgtggagtaaggacacatatatagctccaacttctaagtttggtgttgggtctggagtggagttgagctgtgagctgtctaaacccagctatacttctctagttccttttgtgatagggctccacctagctctgctactattttaggtggagctgaaactgtttggctgagaggtgaagctggagctgtgccaaacatgccctatatatactccttatgttctgaacaatcactacctccgctttaaaatagttatctttctaaaatttaaaatttatcctgaaagacttatcactctagttactacttatcacattcatctcttttcattcaaatttctttctattattgtatttttcaagtactactcaactttcaaccgtatatcatttaggccctgtttagatcccactctaaaatttttcatcctgccacatcgagtatttgaacaccagcatgaagtattaaatataggctaaaaataactaattacacagattgtgactaatttgcaagacgaatcttttaaacctaattgcttcatgatttaacaatgtggtgctacagtaaacatttgctaatgactgattaattaggcttaataaatttgtctcgcggtttaccgacggattatgtaattagttcttttattagtgtccgaataccccatatgaca

SEQ ID NO: 15571 - DNA, 1501 bp, Oryza sativa
ggggtgctatattaaagcaaagacctactaaattttccgctaaatcagaagaaaaaatatgtaggtatgcttctggaagttataaattaaaaactgtcaataatacagatagagagatcatggcaattatcaatgcaattaatgcctttaggttatacctagggtttaaagaattcacggttagaaccgattgtgaagccatctgtagatactataaccagcttaatagcaagaaaagctcaactagaagatggattttatttgaagacattattacaggaaatggttatagagttatatttgaacatattaaggggaaagataatagtttacctgacatgctttctcgtttacccatatttcaggtatgaaaagatcaatgaattacgccggagtcgagtgcttcacatttggagatgacaacaaactcagaatattcccaccaaattcatataaatttaagccaaaggaccatataatcctagatgaagttcaagagtgcatcttggacaatttctggtaccaatacaataataaaagggaagaaaaagggtatatgttatcaatattgaatagcctctctgaatattttcacctaataaatgggtcattaatgcctgccaatgaagatcatgaagtaatccaacagaagcctatatatgtagtatttgatggaagctccctggggtctacatttcttttgaagaaattgtggctcaaaaaatagatgctaaattaatgggaggaatatcttggaagaaatataaggatattgatgaagcattaagccaagctagaaaaatattaggaataaattattatctagagcctgctgcaaaagaatatattcaaaaatgcaaaaaagctaaaggaaagaagacttcagaaatacccattaagatgactataaaagaagaagggttttttaaaaaacccacatacaaggaatgcttaacaaaaggagtggatccattagatggggaatatattgattggaagataatagaaaaatttgaagaagcctccccacaattaaagaaggaattgaaggaagaaatacttaaagaattaaaacaagaaatggatcagaaattcgagcaaataaaaaaggcagtagatgagaaattagaagtttctttttctgatttggacacaatggatcttggtggccatgggcaaccagatgaataaattaatataagctaaatatgtttttcaatatatattgataatagaatatcaacaatttgggcgtggaagaagaataaaagaaattcagaagattacccaagaaagaatccagaagaattcagaagattacccaagaaagaatccagaaggacaccctataaagtataaggggacaatatagggtgcggtgaatgacatatccctgtgaagaataaaactttcggtggaaaggcctcgactttagccagctcccgtgaagatatagtagcgaagagataagcaggaggcacaggcgacgccatccctggcc

SEQ ID NO: 15572 - DNA, 1501 bp, Oryza sativa
acgtgtacccgctcggcgccgctacctgccgccggaactcctcccgcagcgccgcgtacaccggcgccgtccaccgcgtgatcaccgtgccggagtccaccaccgtgccggcgccggtggcggcgtcgaacgcgaacgatcccgcggggaccttcacccacgcgtgccccacgctgagccccgtcacgttcacgtagtagagagacgacctgtgcgggttcctcagcatcggcgtgtaccggacgctcctcggctgcccgccgccggcgcccagccggagcgagccggagaagtagtatgacctgtagctcgggaggcagtaggagaagacgccattgtacaagctcccggcctgggagagcagcgccatggggccacgcccgaggccgagcagcccttgccttggcatgttcgtcgtcggccccgtcaccgagctcacgcacccgaacgtgtagttcgggatggcgtccttgcccagcctcagcgtgtcgctggcgagcgccgcctggaacgacgcgtcggcgaacggcttggagaaggcgcacgtcggcagcgtcgccggcggcggcgccgcgtcgccgccgccctgcggcgccgggcacgcctggccctggaacagcgggcaccacgacgaggagcacgggagggaggcgtaggaggaggagttggccggggcgaagaggctgctgctcgggcacgtgccgcacggcgagcagtgcgcccacgtcgcgtcggcgctggtgtcgagcgccagcagcagctgctgcgacggcgagccgaggccggcccggacgacgtaggacgggggggcctggccggaggcgacgggggcggaggagacgccggcggtggctgccttggaggagaggaagaggaggcgggcgtcgtcgtcgcgggcgagcgcgatgatggactcgagcggggacggcgacgaggggtgcacgttgtggtacacggagagctcggcggcggcggcggcgacggtggcggccaggaggaggaggaggagagggatggtggtggtggccgccatggcaatggagctctcctggctaagctagcttgcttgctaagagagtgtcactgaggggagtgaggattgtgactgagcgagctgggtttatatagggtttctggctgttgatcctgtagtctttggcgccgatcgattgaatggtttgagcttaattacggcggcacggacaacatgacgggctaatagcgcacattcaaatcattaagtactactctagtactctgtccaaaagaaaaataaaatctctaacataagtagtatctaggttcgtagttagaattggacttgtttttgtttttagagacgaatgggtattttaaaaattttgaaatatatttattttttgacaatgaactttcgtaaatagtttctgtaaaaacagattatttattggcttgaaaaaacgtgctcacgaaaaagagagataccataagctaataagttcatcattattaaggtctcctt

SEQ ID NO: 15573 - DNA, 1501 bp, Oryza sativa
atcagaaacaaactgttgtgctacatccgagtagagacatcctccttagatcaaatcccaagattcactagattgtgatggaacggtgttgggggcaatccttacaatggaatcggacccataaactgaaattcccctctccacgatctagacacttgtctctggacccagcagagcgtatctaggaccatgttagttgagcatgcaaatcatttttgtgaccaagaaagtacatagtggtctcttatatggtgtagcctggtctctggctatgaagaaccagatgtttctagatcagttttattcactttgaagctagccatgcattgcatccagaatgatcatgggctatcccagtgacatgcttagccactcaaaaagaaccatcagtgatgatgctcatggctcaccctgttcactgcacagagtacttctactgatccctggcagccagctagctgcatggctacgatctagacagccggttgtttacactggttttgtgaaaaccatgagccaattttggggcataaatatttatttatttccaaaatcagatgtgtcctaggtaagaatgttatgctttcttctatcataaatatttaacatttaaaataaaatttgattaaacctttaaaattttaattattattccctccgtcctaaaataagcacccatctagtttaaaatatgaagtaaaagagtcttattttgagactgagggagtagttttgtattaaagcatgtttataaagtataatatatatcttttcaaggcaactctgttatattattttcaatagcttagattctcacgtctgtaacggttatatgcgatgggcctaagcgagccgttacaaatcactcatctgtaacgggcaatattgaaaccattagggattagcacttatctgtaacggctccagttgagaagcaattatagacatcagccacctcatatgtaaagggcctccaaccgttagtgatgattggccacgttttaaccaattggttgtaattgctggttgaacccgttatagatgtaacacaggtagacgtgtctgtgttagtgtcttttttttattaaactaaatatttatgaaattattggtggttataaattttaaagtttaatcaaatatgaaaaatatttataatcaaagggggtgcatttacctacccaaataatacattaaaaatattagcgtaccaaattttgaccgcccatatagttatccgaatatagcatattaattgtttgcataaagcctaaagcataatgaccatctttataattttgtaatgacactgtcaactgctaccatgcatctcactttaacaataaattgctttttaatgattagagtatgatggatgaaacactacgtatacacactttggtaatataacataatatatatcaagtattataatatattttagggaaaaaagaagttgtcaaaatttgaaattgaatagtaccaatatcagttatacata

SEQ ID NO: 15574 - DNA, 1501 bp, Oryza sativa
aatttcaaatattgttttcacctggaaagatgtgtaataaaaagttgcttttgtcaatggccttgggtaggttgtatcacccagagttacattctgcaatgtgacagtttgttttcttttaagacccaacgttttcgatgaccagagagagatagagtgagagagtcgttaaattgtggcccgtatattatccgtgaatcgttaaattgctgcagagcagaacaacgcaagaaaagacggaaacggtgccgccccactacgctacgctagtgctgttcctcctggtttttgtggacttgcagcaacgggcgtgcatttgtttatctgaattttctgattacatttcggcgtgcgctatggatggaggaggatcttcagatcaatccagcatccatcctttttctaaggccacgaattttcaggtttattcttctggatcatgttaagaggataattcagcgtcctaactttcagcttttctttctctgtgatcggctacgaagccaacggtttggtaaagaaagaaaaaggcaaagtctgctgctgctcatcactgtccactaatagtgaagttatggatcaaacatgatcagggttttgctgggggatttagcccggctaggcttcaatatgttgggcttgccgggcttcaatatggtagcaacaagaatgcagcctgtctggacaaagttgggagcctactcgtactgaacggcgattgttttttttaattgctcccactgatctatttatgttactatgtataactgatattggtactattcaatttcaaattttgacaacttcttttttccctaaaatatattataatacttgatatatattatgttatattaccaaagtgtgtatacgtagtgtttcatccatcatactctaatcattaaaaagcaatttattgttaaagtgagatgcatggtagcagttgacagtgtcattacaaaattataaagatggtcattatgctttaggctttatgcaaacaattaatatgctatattcggataactatatgggcggtcaaaatttggtacgctaatatttttaatgtattatttgggtaggtaaatgcaccccctttgattataaatatttttcatatttgattaaactttaaaatttataaccaccaataatttcataaatatttagtttaataaaaaaaagacactaacacagacacgtctacctgtgttacatctataacgggttcaaccagcaattacaaccaattggttaaaacgtggccaatcatcactaacggttggaggccctttacatatgaggtggctgatgtctataattgcttctcaactggagccgttacagataagtgctaatccctaatggtttcaatattgcccgttacagatgagtgatttgtaacggctcgcttaggcccatcgcatataaccgttacagacgtgagaatctaagctattgaaaataatataacagagttgccttgaaaagatatatatta

SEQ ID NO: 15575 - DNA, 1481 bp, Oryza sativa
aagatggttgattcggtttgattgtgactatatagtatagttgcctaaactggcaggtaacattggaatgttgccattcaaacaataactggtgctgggttcttagaattcatggtagatagcttggatccttatattagtattggcaattggctgatgggtattatctattagattactcttgaaatcatttggccattttggtgaggcacatattcttaaaatcattattatatactaagtcttagggggctgtaaatattatattatggattgtattttgatgcatatagattgtgttttagattcacatgtgagggaagaaaatatcatctgctggaacaaaatgttctttcagcatgctaattaaagttgaagcactgtgcttttattttacgtgcgtcactgcttatcacctaacaatggcaacaaaaacagcaatagtaacaagaagatgacgaaagagacatgagaatctcatctgaacacaattttcccacaatgcagttgcgtgctgcagtttggcttgagtcttgaggtcaacagatagggaaatatcaacttagggagctgccaatgttggtgccaggggaaatgttacatgcagggtatcaccataaacgcattatgcatctttgaggtggcgatgattaagttatggcaaactaactcctgctaggtttcaaacccctctagcttttcttcttcatggaaaacaatggttccctgcaaaagaaagagagaatgggaaatttggtggtatgcctgatatatgtttgtctatttgactggtttgctacattaattctgtgtacatttggcgcactgtgaaaattaccccataagggagacatgccacgttcaaccccatggaggatataaccctgcaaaggaaaaacaaagaatccctagccacatttaagaagtaatattagccacatgtacaattaaattcagaaacttccttaacaatgaccaaattgatgagaaaaccaaccacaacattgaaaaaaaccaacaaatgccagagataattcactataacaaccccccaatactaggcaagcaagaatgagaagctatgctcatctgaatcatcatccacacctacctaatctgcccatgggaaaaggtggatcctgcgctgtttgggcaaacaagcctaagctggccagctgtgtttttagggtccataagttgggatttatgataatctatttggtaggtttcagtacctaaactaccacaaagcatttagtgttattggaatgattttcttagatgatttatcctctgttgcataaagaagtttaagccttttccttctggttagaaattattttttcttctaccacttctctcaactagtgagtcaatgtggcccatctgttcagtaattatccatgcctgttcttttgctccattcttgaatttttttctgaagttgactcggttgtctgctgaccatgttattttatagg

SEQ ID NO: 15576 - DNA, 1501 bp, Oryza sativa
gcttagtctcctgtttcgaaatttgaatttcatctttcatctgttacccgaagttcctgtcctaagaacactggaagttccaggcctggcaggccggaagttccagagttccttaccaggaagttccgggtctatttgaattttaccgctgcgatttatttttaagttttcagggacagcctattcacccccccctctaggcttcatcagcgcgttcggtggtaagtacgataagttcttccaaggcatcccgcgaacggtccttaattgccatgggtgcgaccagcaaaaccatgcacccatagcccaccatttagtatattttaattaaccaacaccggaacggtggcactaaaccaatatcaatactagaatctgatatctatgcattaatgtagatcccccattgtgtactagttgaactaagcatggctacgcaatccctaatccaatatctagtcatgttatatccccaagctaacaaaggagcaaggtaacaaatagcatggctgaaacagtaggtaggcatcccatagtatcattataaaacaatgcagtatttaaagaaaaacaatagagcatttgcaatatgggaccaatatgttcaagtgacaagcattacttgccttgctctgctgctagagggacctcggcgactatctcaaagtacaccggagcgtcgggagagccggaatctaagcgacatacaaagcaaacaatacaaacaggctataagactactgaaacagagaacaaaaccatttttaatggattctttgcatttttttattgatttactgagacttgaatgggcttaaacggagctcggatgaaatttctatgaattttagaagattcattgtgttttttctataaacagaaaagtcctcaatgtatttattgcgcaataattaaccctggtgacgtcatcggagagagagagagggcggcgccaacaggcgagccccacatgtcataggctcggggcaccggttcatggtggaccgggtccatggaccgggaaggaggcggcgcaccacgtggtgctgacgtggcgggcacgcggtggccactcaggcggcaaggtggatggcctcaagccggcccgacggccatggcgcggcggcggcgcgacaccagcggacggcggcggcgatgcggcggacggcggtggcgcggcggcggacggcggtggcgcggcggcggctatgcggcggcgcacggcggcacggccccgaagcgaggcggcgcggcaaaagcggcagcggcggtacgggagatagagagggatgggaggggagttcctcgccgatggcgaatggcgagaggtggacgggcttcgagaggacctaaggaacaaaatgggagaaattagagagggagagagagaaagagagcacagagggcgggaacgctggccgaagccgcggccatggccgaactcaccggcggatggtgcagagtgggttccgggggcggagtccgacggcgaaggggtgga

SEQ ID NO: 15577 - DNA, 1501 bp, Oryza sativa
atctaagtcagtggcggagctagggcccggccagcgcgggcaagtgcccgggctctaccactatgcagcagtttatccgcacttagttacgctgtttagtcaccagctaatctgcatacaatagtaggtataaagtggttgattaccatgcttaactaaatgcctattactttcaagataattaattcaatttcacaccatcacaactgagatctaaaggcaaaattatataactttctggtatcagtcttttttctttcaataagatagtacaaactccatagtctaacctatatatccatcgtctctttgatatattctcgtacactagatttcctatcctaaattagaactcgatgaccgtcaattttacatacgtatatgataaaaggtatacatatttgtattgatttatgtatacttgtttttcgttgttagacttgcccaggctcaaaagtattcctagatccaccactgaatctaacctagtatattttcataactagaaaaaatgcccgtgcgttgcaatgggtgaagtctattttaatcttattattgttatatggttaagttaaaatgaaattcactgtgggagttcgcttggatatatataaatttagaaaattatgagctgcagttaggagtccgatcgtctgaagttagcatgcgagtgtttttaaacagatttcctatatgattccttctatattaccaaaagtgaatggtcttaaaaaccgactcaaatatgaatatgtatttctaaaagaaatcgaacttaaaaaccaactcatacacggatgacgtaccaaaataccggcaaaaacatctttagtttttataatactagaaaaaatgcacgtgcgttgcaacgggtgaagttaattttaatcttattattgttatatggtttagttaagatgaaatttactgtaagagttcgcttggatatatatttttaaaaaatcatgagctgcagttaggagttcgatcgtctcaagttagcatgtgagtttttttaaacagattttttatatgatttcttctgtgttaccaaaagtgaacgatcttaaaaatgactcaaatattcaaaaaatgactcaaatactaatatgtatttccaaaagcaaatggacgtaataactgactcatacacggatgatgtactgaaataccggtaaaaacatcttcaatttttacaacattagagactagaaaaaatgtccgtgcgttgcgacgggtgaaggctattttagtattattattgttatatagtttaattaaggtgaattttattcggggagttcgcttaaaatcatgagctgtaattagtgtccgatcgtcaagttagcatgtgagttttttttaaagagatttcctgtacgactcttctatatttccaaaagcaaacgaacttaataaacgactcaaatccagatatgtatttcgagaagcaaacgaacttaataaacaactcaaatacggatatatatttccaaaagtg

SEQ ID NO: 15578 - DNA, 376 bp, Oryza sativa
ccatattgtcagggttatggataccacatacccaatagtagttgactaaatctcggcaggacccaccacataccatgtcttatacggaaactgactttgagttggaggaagttctggataaggaaagacaactagagttctatatggaaacggcaaggactagtcggattgtatccatattggactccctagttctacttggacaaggggacacctatgggtataaatacaagaccccctaggaggagaggggacacgcaacaatagaaggaacaacagaagccaacatacgccaggacaagccgccggatattaacatcagagatatgcctaggaggaccctatctggtacctatggaggccggctgtagggatc

SEQ ID NO: 15579 - DNA, 383 bp, Oryza sativa
ccttatcggcgatataaatggcgataagatgggccatgcatgtcgttgacaatgatttgccatcgcttagctgttaccgatcccacaaccgacgattccttgagacgttttaaccgtacaaaaaatgaagggtaatttctacagcagcagtagaaattactgcctaaataaacattttcaaaaatttatattatcaaaaatttgataaattgacaacattattaagttttgataggataaattaaatatgatgttgctaaattctctatataacaaaggtaatatcgttatatatttgttaataacaaataatgatacgatttaaattaattgaacatattagtactacgaagaaaaaattactgcggctagatattgacaaa

SEQ ID NO: 15580 - DNA, 1501 bp, Oryza sativa
ccataaatccacgagttactaagtgctccttcactttaaaagcatcatcgaagtcccaggctattttattcttacagtcagcacatggacaaattatcttcctcatattatacttctcagcgtgtgccttggcaataccaataaatttagacacttcatttctatatggagacaaaaacctcggccaatgatacatccattcctaactttccatatctctaaaaaaatgcacataaaatatttgcacaattaataccaaatttgtagggtttattgaaaaaacttatcgctattcaaaactaattaacaaaaggttaattgtaaattaataaaaaaacaaagtttatttcaattttttttacacagacatgccaaattagtacattaggaaaagctaacaaaatcatatcatcggcatattacaaaatactataactattttttgattgcaccgaataaatagacattaaaaattttattctctctctatatatgacaagatctagatctagatctagaactaagaggtggatgtgataacaaaaataaaaaaatgagaatttatgttaccacattaaaccactacaacaagaggcatcaagtattacacatacatctaacatcaacatatcaaaagaaataaaattaaaaaacatggagctcttccttcacaattttgcatgcataaatccatcacaaattaaggtctaaaagcttaaaaaattacatacctagtgtggaaatgagtagatctaagcaccgtagaaaaatcccccgaagatttgaagttcaaaacctcccccctatatttaagtcactttaggagagagaaacttcggggagaatgaacagggctcggggaggaagaagactatataggggcatcttttcaggcggaccgccccctctaccccgggtactttttttgtcggcggggttttggctccgaataacatacccgcctgcaaaaatagatcccctacgacgccgaaaatgagttttctagtagtgtatgggaacgcaggagaagctagatagggcctacaggcctggccggtggactttgttgttttggaggtgcttattaacactacgacaaaataacacatcagtgtcccccatcatcagtgcctattagagaaaacctgacactaaaagatggttttccatccgccttgcgcttgccttgtacgtccatcccctcttcctccgccgtcgtcgcctccctccccgctagaacaaaactcctccgattttctatagccaactcctccgatccgacactcaatgcaactcgatcgatctccgaatccgattcatagtacaacagcaagtttggaggacgagggaaagcgggtggtcaccgttctcgccgctcgccggggtctatcccaaccgctggccatggatggcggcgtggtggggattggagtggagactgctggactggtcggctcctctggcctttaaagccgattcccctatgggcctagacttcatc

SEQ ID NO: 15581 - DNA, 1501 bp, Oryza sativa
ttcctctcttttcttctttttttctcgatgtgtgaggctatgaaaagttgtaataagggattcttcatgtgatgacgaatgaagtgagcacagccgagttcaatattatatatgatttataactttgttttgccattgttttgtttgtcttgttttggtttaccgtttaaattatcggagttttttattaatcatgaaaattattcatatgttgcaacgcacatgcattttcactagtataacaacataaaacatgcaaccatatatagtaaagtcataactcacttgagtaatatttatagtgcactatgatcattagatttataacaaatgtcgctctctaatttattctactttatccatataaattatagatatttatgtgactacatgtggcattgaatattatcttcatacataattagttaagagaattctagattatgttgaggtaaaatatctcctaaattctaaaaattagttatgcaacttgatatcacagtaattactagtaaataatgtaaaaattactactaatatgtcatgataactactactccctccattccatattataagtccttttgacatgaccaactttgtacaaaattattaacatctacaacactaaattaggttaagtaaatgtaatatattttgataatatgtttgttttgggttaaaaaatataatctatttgattaaaaaatattaattcaaataacatgcaagtaaaaatggaaaaaaatcaattagaaaatgttagaaaagatataaatataacatatttcaaggtggccaagtatccatgcgtaattgtgtccacgaaggaagagaaattgtcgtgatgggtgccttgaggatatttccccgtttgctcggcgtcgacctcgattccttgtgtggtgtggattccttagagttgttgctaaaaccacctactgtagttgcaaaaatgtctaccatccctttgtttctactagctaaaattatttcttaattaactctcataacaagtgttgatttagtgagaaaatattttccttttaactaatgtgataagcgacacaattttgtatatcctcatgagatctgtttatcctcattctacatattgaaatattttttcttagacaacgctacttggaattgatctaataaaacaataagaaaatagatatattttctagattacatcgtgtttgcatgtttttttgtgtaaagagtgtgttattttatttagtgttagctggagtgtaatcgctattgtcggtgacatggggccgggggtattgtgactagaggcttgggtagccgcgatcactcacgtggcccgacctcctcgggggggtcgggcccgacggtgacgtggccacccctccctctgtctccccgaggggtcgagccgctcccgtttcggccccgagggctggggcaccccgaccccccgtggtgttggcgccacgtgtgtgggttaggtgagcacaccgggctcacctaa

SEQ ID NO: 15582 - DNA, 1501 bp, Oryza sativa
tgatcaggcaggcgcaggcgcaggcgggcgtccacgtcgtcccgggcgcgtgggcgggcggcggcgcggtggcgtacccggcgtggggaatgcagcagccggagggcgggtactactactcgccgtcgacttaccctgcaggcggcttggtctacccctacgcggcggcgtatccacctcccggtcagcagctgctcggcaatggcggcggcgtggtgtcgccatggtacactcatggctactagcttagtagtacattaattcgtagtattagcgatgtttgttttgtaattagtgatacagtacgagctagtacttgtatccagatgagtatcagtagtggatcgagcaggagagtactccagttagtaatggtggttgtcatctatagttaattttggtggggtgatgaggctcatgtgtgtgcacatgtagtggtggttataacaagtgtgttaaatctctgtctcatcggaactgatggtattatacgtagaatcgcgatcgtattcggctggcagttgccaccttccccctgtttgaaatcatcatcatacaatgtgctagtatgctatacgacgaagcaaaaaaggcttttggattcggttcatggggttgcattggcaggcagtgtggcatgtacagtacactggccggagcggaagtagagcccaaaaagttgtttgatttggcctcctctgggaaacaattttaatcacctaggtgtacatccacctattcgttacatatcaactaaattggtataaaatatttaaaaaaatttgacaactaaattggtataaaagtattaaaaaaatttgacaggatagattcatatgtaatatatcaccccccacaaacatacaagttcaaattcaatttttacaagttataacaaaaacaacaaatcaaactctgattagtatacatatattcatagttaaatttgttatttttgttataacttataatagtgaattttaactgtgttacattatatatcattctatcttctatttttttaaaaaaaaaacttataattatttaattgacatgtattaaacaaatggacatccactcgagggattagaagcctatctccaggctcctctctctggtctggctggtttggcccggccagcttctttctacaggagtatcatcatctttgtgttctggctcctgtgttgtgctgcagcagcagcagcaggcaggggaattgaggccagatgaatcaaattgaccatggtggtggttgtggttgggttggtgtctgtcttttgtacttgaggctgatctcgctggtgccaatccgtccgtcgccacgatctcacgcaccgtatgttgccctacgtgctactactagtagttgtagaatcgtgcgtgattcacaacaccagcagcagcagcagcattaatttgttgatgatcgttgcggtgcctttactggagtgagtacgtacggaaggaaggaagggtcggtggggccccggtgtcagtc

SEQ ID NO: 15583 - DNA, 474 bp, Oryza sativa
catttccaaaatcttaactcgactactgctaatgatcaactcctgtgactttgggatggtacgtcgccacagtatcctgagtcacgtcagaggagcacagtatcctgagtcacgcgttacagtagaaaaggcgtagtattgaaatatactgttcaaagttactgtttggatattattgtaacataatgtagcaatcgatctcgtttgttcgctgcagatcgaacggctaaaaatatcccaagtcagagtactgtgcatgtgcatctctgacggatctcattcccccgtcttatcttatctcaggttgtagcgtatggaagaggaggttgaagcaccaccgcagcatcagcggtgtactcagacttaggcggtcaggttgtcaccatctttacggatacaagatctccccgagataactccatttgctttaacgtccagttcttgccctaaagattaatgtttcatgcctatagt

SEQ ID NO: 15584 - DNA, 1501 bp, Oryza sativa
tatggttcttgcgcgctcgccgggcatcgatgagtggcacaaagagctccttctgctgccgtcgcagggcgaggcctatttggaggcggcggcggaagatgtgcttggtgaccgccgggtagaacgcgaatacgctcgtcttcctcgcgacgtacaggagccagtcgcgctgcgcggcgccgatggcgcgcaccgcggcctcgtcgagccgctcgccgaagcacatgagcacgaggaggcagaacatggcgtaccggaacgtctccaccaccacgcgcgggcgtggcggctcggactcggggcgcgcgccgtccgcgagcttgtcgacgagcactcggcgaacccaggagcgcgcgggcgcgaacaggcggacgcgcgacgggtgcagcgtctcggcgacgaggttgcggcggaggacacgccacacggggccgtagctggagcgcgtgatggtgttgccggtctcgccgagcagcgagcgcgtgacgtccgggcggtcggcgagcgcggcgccgcgctccaccagggccgcgtgcgcgacgcggcggtcggcgacgaagatggagaggcgggagcccacgcgcagcgacacgacggggccgtaccgcgcgatcaggcgctggaggagcggctccaagttcgccgaggagtgcctcagccacaggaggcttccgagcaccggcacggcgagcgggccaggcgggatgcggcggctgccaccgccgctccggcgccgccgcgcgaggaggacgacgagcgggaggacgagagcgacgaggagcaggagccatgaggtgtccgtggccatggcgtcttcttgcctttgctctgctccgccgcctcgtcagttgagctttagtagcttcggagttcgagtcaaagttctttcggctgctgacgtcatggctgatggatctgattcggtggcgtttctagaggatgagcatgtgcgagatgcccttggcttcaaagctcgatgacagatgctttggttatcctggttattgaccttattaaaaagagaaaattcgatccataatacatgaaagaaagcggtaccaaaaaataacataaaaagtttccactttcaatctatagcataggccaccgatttttctttgtcccgtagcacttccgtcacattctgaagtaacggcgttagataggagtggagaaaattttcgttgcactcatttgccctttgttcccccaccaggtctcctcttttgctcccgcgtggacggtggtgcggcggccatcagcgtgccgagtgaccacctcgtctccccgccaccgccgagagggctgcggtgcacgctcttcaacaacatggacgcgtggctcaccatcgccaccgacggcgaggtggaccccgtctggcgctcggcgctgctgatcgagggtgagccacccacgccggcggtcgtttgacgacaaggacgacaacgatgacgtgggtggccctatcttcggcatggatagatgtggcccatggtggccg

SEQ ID NO: 15585 - DNA, 1501 bp, Oryza sativa
atctacctattcatctcacgtgcaccacgctagcatcgaaccaaatacgtcaattccaatttactcccttggaggctcattcgatttaaataatatccaaataatcattattgtatgaattgaaaccttacaattttttctatatgcatcattcatagatccttccaaattcacaagaataatggtaggattcttagcatgaagtgagatctcttagaaaaattcatatggattagagtagtgtcattctgttttttttttctattcctataatttgaaaatcttatgaaccgaataagcccctaggcgtgtttgagatgacgaaaaataacaagatacgcaaaactagatgagtcattacttattagcgcacgattaattcagtattaactatttcaaactttaaaaatgatgaagatgattttttgagtagcttttctataaatttttgggtaacacgtgtataaaaaagacaaggctgggggttagggagagtgtatgactcaacaaactgacttatcgaagtcggtaagagagaagacgctcatatacaaaacattggtctgtaaatttaactcatttctagttttccatacatattataacattggtcaccctttgagcattcgctcgggggctatttctatctaatattctttcctgagtattgatttcaggaaaattctattcgacattgacgaaggctccatgtctctatggttctacaccaagatcgactaagacgagtatgacaaatgttgacaaggcttcgtcgcagattctacaccttctcgatcgctcaagaacggttggtggatctcgacaaggaatacaaaatgaagaaatggtgtacccgtcgagataaaatttcttgacttcaatccaaattctcgattacagcaagacgggagacttagtcgtatgctatgtactttcttggttgacgtcggagattgactcagacaaaccctttaggtgcccgcacgaggctgataaaggaattctaacgttatctctgaactcaccgagaacggtcacgtgagcacgataacagttactccaaggtctgcgcgcggttgagaatatgaattcgttcatttgcatcgaagtcgggggctactgtcagggttatggataccacatacctaatagtagttgactaaatctcgacaggacccaccacataccatgtcttatacggatacaaccttcggatataggagaagtttcgcataaggaaggatgactagagttctacatggaaacgacaaggactactcggaatgtatccatattagtttccctaattctacttggacaagaggacacctatgggtataaatacaaggccccctaggaggagaggggacacagacaacatagacgccacaaagccacaagccaatacaagccaacaaacgccaagacaagccatcggatatcgacatcagagatacgcctggatcgaccctatccggtacctacagaggctggtcgtagg

SEQ ID NO: 15586 - DNA, 468 bp, Oryza sativa
attcctgcagcccatttagcaggcttactattatatttgctctaacccaaaaccaaccagaccattttcccagcgttgtgatttgccccattcgcacgccaccaccaccggtggatttacaccgcatcgctgcgcggccgcacgacgcacgtgatcccccccacgcagccacgctgcggaggcagaggtagcgcgcgccgccgccgaaacaacccaacccaacccaacgtcccgacccgatcgaacaaccaccgcgaaaacagcgagagacgtgcggcgcgtgcccgcaatttctcgtctttttttccgcgcgggcgccgcgcttccctccgctcgcgtttcacgtgccgctttcctacccgagaaacaaagattatactaggcgtttaggcctcgtcttccttccttccacatgtacacctagtatataacaagagggagacaggctacagattcacgggaaggttt

SEQ ID NO: 15587 - DNA, 1501 bp, Oryza sativa
ccccgtgacctcgtcgccgttttccccttctcccgccgccggttaccgccgccgcaatccgccgccgtcgagcaacccccggcaaatccgagccgttggctcgtctcccctcgtcacgtgcaaccacccggtgtactcgcttttgcctgtatcgccatggtttgctccgtcgctcgccgctgtcgaccgccgtccgttccggccggcgtcgtcgtctacctcccgccggcccgcgtggcagccacgtaggcgccacgtcggcgccagctcagcctagaccgggtcgagccgaccccggtcagtccctccccgtgcgcgcgttccaccgcgagccgtgaggctgcgcgtgggcccgccgcatccgcgtccaccgcgaaccgcgcgcatgcaccgcgtcccttccccaccctagcgccgcaccgcgtgctccctccgcacggtgagccgagccgctgacaagcgggtcccacccgggaccgcgcacggtgagcccggtccaccggccctctctctcctttcctcccgcgcgcgcgcacttgggccgccttcttgggtggccgtttgaaaagctgttggccgggtgccaaccttgtttcaattctaaagactgatacatactccgaccggacgagacgctctgtctcatccgagtcgtttgagaagcactcacttagttgttttcagaaaagagttcaaataaaatcaattgcaaaaacaacagccttcccttgaagcctgcattaaacacttaattcccttggcttgctgagtactcccgtactcacccttgctctatataaataattcccccccagttgctgaagaagatgaagcggatccggctgatgaggagttcttccaggagcaagccggctacgttgagttttagggtttcggcctagttcccaagtcgcgcctgtgatgtttggtctaagccctggcttccgtttcccttttgtaatgcagttgtgagctcgggatctgtccgcagcccaacatgactgtacctctactctataataaagagacctctgttgctgtgatattctgtcttcctgtgataccagcactatttcctgggactggtatcggttaacaggttaatttggagcgtcacgggctagttccgatcggtactagttcggggcgtgacaagagatggtatcagagcacaagcttggccctaggacgaaacccgacgcctaggacgaccctaaggatactaagttccaaactacttgcgaaaagctaaggtttcttttgttttctttattttcaatagtttgtttctaaaaatggttactgatcctttctccctttttcaaaattgtagatggcagtgagcgccagcttcagctcccacggttttggtgagggtcaccacgtcgcttagcttcgtgacctcgcccgtttccttggcttctcgtgtcccgagtacacggggtactccgtggaccgtgttccccctcactgtgagctctctgtgtacctttacccccgt

SEQ ID NO: 15588 - DNA, 1501 bp, Oryza sativa
atacttctcatactatttagagtttgatttgttccttttttccgtcaatatatagatcaactttaaaatatgcagtcccatcgtttcatctaaaactggttaaaatccgtaacgtttgttaatgataaaaaaaacaatttatatggaaaaaatttatatactccacccatccctaaatatttgacgccgttgacttttttaaacatgtttgaccgttcgtcttattaaaaacttttgtgaaatatgtaaaactatatgtatacatataagtatatttaacaattaataaaataataggaaaagaattaataattacttattttttttaataagatgaacggtcaaacatttttaagaaagtgaacagcgttaaatatttagggacggagggagtgtgttttcagcaacttaaaaactatgtaaaaaaataaaataagatgaaagttataaaaatcaactttgagattatgatttaaattttaaattttggatgtgactgataagctaatagggaaatctgagctaaatatccctgtaatttcagggtaaacgaggaggaatgtcctagaggtgtacatatctagctcaactaaacttttttttaaaagaaaatcaagttaagaaaggcacttgaagttgcccgaaaattaccgttttccttttgtactgaagaatgtagaactcaatgaacattggtcaacaacgaatgtacggtctgcctagtggcggaagctagtatccttgaagtgtcccagactttccaggaaataactcggtagaaataaattcagactactaaggccgtatttagatttagattttttcttcaaactttcaacttttccatcacatcaaatatttggacacatgcatgaagcattaaatatggatgaaaaaaaccaattacacagtttgcatgtaaatcgcgagacgaatcttttgagcctaattacaccatgatttgacaatatggtgctacagtaaacatttgttaatgacagattaattaggtttaatatattcgtctcgcagtttacaggcggaatctgtaatttgttttgttattagtctacaggcctgttcactttgatgaaaaaaatcttacccaattttagcaataccaaaattttggcatagttgccaaaattttagcaacttaccaaattttggtaggatttcttatatagttaacaaaatttgacagcaaactaaatgtaaccatttttttggcaactttaccaaaatttggtaaggttgaaaatggcatcaaagttaacaggtcatatatttaatacttcaaatatgtgtccgtatacttaaaaaaaaattggcaaaaaattggcaagagagtcttgtattcttgtcgcctgcttctgattgttgattttcaggcagctcacctggtcgacttccacaccgcatcatattctctagctccatgccttcatcttgttcaggttcctactgataataattaacaaggatataccgatcatatcga

SEQ ID NO: 15589 - DNA, 830 bp, Oryza sativa
tctagaaaattcatgggtcattagaagagcatatttttctcatttaatgatgtgcttcatgtttaattttttcaggtagagattactcgagagagattaaacagatggtatatggatgagaacggacgatcacagaattcaataggaaatgcatgatataaaacttctgcacacttgtaaagaattttgatgatttatgaatcaacctgtcaaaatgggattgtgctcggatttaagattttcaaggtttgaactttcaaaaaaaaatcatcaaggtcacgtatccaccaaagaacaattttaatcatatggcttggggtgatggcttttccgccaggaaaagttattgtatagagtaaagtccatcaccggtccctaaacttgtaccgttgtgtcatcccggtccctaaactcgcaaatcgaccgtttaggtcctcaaacttattcgattgtgtcatcccggtctctaaacttgcagatcactcgtttaggtcctccaacttattcaattgtgtcaccccggtccctaaacatgacggtctaaaaactttatataaaaaataattcataattttttcatgtgaactctaatgaagacaaactttatatcaaaattgtagccctcgacgcgacctacaactttgtagttgaaaagtaggccgtgaccgctacttcttccttaccccgccgtacccaccagcattccacgctcttctgggagaggctagtatgctagctaccgaggcagcaccttacctagtggacccggcaacgacacagccacctgtcccggagatgatacacactccactgatccctacaccttctcc

SEQ ID NO: 15590 - DNA, 984 bp, Oryza sativa
aatgtcttttttacttgagagttaacggtcaacacacggtcaactgacggtagtggcatgagatggtgcataaatttgaaccaatggcatataagggaagagccaattttcagtggcatataagggatcagaccaattttcagtagcatataagggattatcttatacatgagtaaagcatcctggttgaaaaaaaaaacataagtaaagcatgaaaaaacttacagtatttgcatatatagagcatataaaagagtattatggaacattataaaaaaaaagaacaaaaatacttgcctagaaaatccagtggaacctctcaactttattagatcaaataaaagcatcatggcatagcaaactaagacttgaaagctcatacaagaactgtattttaagcaacaggattactactacgcaagataattccaaaatttcacatgaacagaatgatatatctatcttctatctatctatcttctatctatctatctatctatctatctatctatcttctatctatctatctattatatactaaaagtccattaaacttcctataaacgctcctaagccgccacttggcgctctaataaattagagaaatcaaataaattctaagaaaaaagcaaaacatattttcacttaaattggtggacccgatattttagaccattagattaaatctattaaaatatttcctactaatatggatccgatgcatatggatggtgatcaaggtatgtatgtacgtactactcgcaaaaaaaaaaagaatcattccttttaatatggatccgatgcatatctatgcagactactctacttttacaaacgtaaagtacgattggaaattaaatgaggataaagccgagaaaaccatgaaaaccataaatactttttcttccctctttttcattcttttctccatgagtacaggtgagataacaattaatattagtgataataaattttaaataatta

SEQ ID NO: 15591 - DNA, 763 bp, Oryza sativa
gtgatggctagcgtcggcatcaacatgccgggtgtcacgcccagaaatttagcccaaatttctagactattttgtgtattaaatccatgtccaggcatcaaccaaggcacacaaaacgacaaattaatatacagatccaaacgtaaataaagcgtaaaatacttacataataggcagttagtcctcacaccgaaacgaaagcagcagcagcggaaaaaggcgatcttagcggagcttcagctccactccacaggcaaaactcaactggggtctgagccttggtcctctaacttcgtcttcagctcagaagcaatacacttctgaaaagggggaacaatagcaagactgagtacaactaccgtactcagcaagccacaccaacgatgcagacgtgcaaggggatacaaggacggtttgtggctatttgtataaaggcggttgtaaaacattttattgagcaaaacagtaaaactgttgagtaaataaagtaacattaaatctaaccaatcgcaccacacctcaggtttcacccccactcctcgcaaggcagcgggcagtcccctctcgtgccacggtgaatccggaagccgatcaaccggacaccccggccgacccaactccatcacgcccacccttgcctcgtgtcgagggaagatcctcaatagcggggagtcatgggaccccgctttcgtgagtttggccgggggcggaggcccgcctctcggaaatcactcgctcgtccctaagattaccggcaagcttg

SEQ ID NO: 15592 - DNA, 989 bp, Oryza sativa
tatgtaaacatggaggaagttggaatgaatattaacatatatcccatacatatatattacatggttaatattctaatcacatgtggtaagtccattaaaattttttaaaatgcccccaagctaccatgtggtgttctagtaaattagaaaaaatattagaaattctaaaaaaacaaagtatctattacttgattttcgtttaaatcggtgggtccaatattataaaccattagattaaattgatcttagaacaaactaaatattacgaggtcccacctctccacctttggtaggcacctatgtacgtgggtacctacgcttcccctccccattttcatttttccctttcttcttttctccatgtatacgcttccctccctttcttattatatcatgcgccttcatgagacaatttaatcgcaagaattttgagtatcttgatctcgcatttttcatttgtagccatactacaagcaatagtttattatttactcgagaaaaaaacatgattcaaaagtcgtaaaagtcgtaagtacttaatccatctcctactcaaaagtttgtgaatagatttttaagatatcttaagaaaaatagaacccttaaattattataaaattaatacaaaataacagtatccgaactttagttttcccttaatctatcatacaaaatttttgaacaaagaaaacaaatcttacctttcaataatacaagtgcccgcgcatacgcgcgggtcaccttcctagttaataagttaaagacactatggagcccacatgtcaatgaagcatgtcttccttccctatcctctctctcctctctcctttctccggttctccccacaacgagtcaatggcggtagcggccaacgaggaaggaaagcagcgacagtagctaatcaaggagggagctgcaacaacggaggagaggacagagtcgaggaagctatagtgagctcgaggttgcgaatcccgtccgccataagg

SEQ ID NO: 15593 - DNA, 1313 bp, Oryza sativa
tgccatgtgcggcggtggagcaatgaggaatggtcggacggcgccggcatgaccgtgcgacgacgagggcagaggcacggcgtgagcgacggtagtgcgtgccaaggcgcgcgtgtgagcgccgcggtctcggtgtgggctgcccggcggcagccgtatgccgtggtggcgtggcacggcacggcgtgctgttcgccggcggccacgcgatggctacaggttgctcttccttttttttttctcttgtcttcttcttctatttcttatctctttctctccttgtttagtccggtcatggcgtggcagctcgctggcatggggcagcggcatcagtgggactccagaacaagcaaaacgacacaggggtattttggtactttcaacactctctctctccgtttttataggaaataataaaataatacctccggtgtctagtagctaattatcacttttttgcggtgttctatagccaattcacgtttttacggtgtcccacagctaattacacgttttttaagagtcccgtagcaaattttgccataaatatatactccctctggacagaaatatacgtcgtttcagacaactcaattaaactacactcagtgcaaattgcttctcggaaacgacgagtaatgttgactagagaaagtatatttggacttgcagttaggcgtatatactaaatgttttaaattctccattttcttctccctaagattattttttatagggcactaagattttatttgaaagattgtcaatgttgacaaatgacgagctagtttgtataccctgctagtgccaaaacttagataaattttggtaccaccaatttttttttctgaggtagagttgcctttttaatgtcaacttagagcaaagctttgagtggaatctagaaattttaaattggacattggtaatgccaatgatataaaccaccgtatgcactattccaaataccaaaatatatctagaaaactatttaaatattggtagagtatgttttggcattaatctaaaatggcctgacaaacttggctaggatgtattccctccgtcccaaatccaaaaaaacctaacctagaaagggagtaggatctaacatctcacgcaagtaaaccgaagtaactcattagcgcacgattaaacatctcattcatcgtttctctgtcttttcttttttgttttgcaacatcgcttttagcatttttatctgtagactgcaacgtcccaaactccaatcccgtcaatgggacgtgaatgcctgcaagatcaaaaatcaagactagttaattgattaatta

SEQ ID NO: 15594 - DNA, 961 bp, Oryza sativa
aacgaacgcgaacgaacgcttaacgaacacgaacgaaacgttaaagaaacgtgaacgaacgtgaacgaacgcgaacgaacgtgactgaaacgtgaacgaacgcgaacgaaggtgaacgaacgcgaacgaacgcttaacggacgcgaacgaacgtgaacgaacgcgaacgaaacgttaaagaaacgtgaacgaacacgaatgaaacgtgaacgaacacgaacgaacgtgactgaaacgtgaacgaacgtgagtgttagtgaacgaacgcgaacgaacgtgaatgaaacacgaacgaacgtgattgaaacgttaacgaacgtgaatgcacttgaactaaaagtgtgagaacgaacgcgagcgaaatgtgtacgaacgagataattaaactattgttgaacttagcatatatatatgattatatatacttgaaaacgtgaaatacattatatgttcctttgcatttagactaatacattttttttgcatgttgcagagaagacgtcgtcgtcgtcgtccctcaagccgaagtggtagctagccctcgaaggaattcgcgcaggcaagtgatgtaaagatgtgattgttagagatataatataagattgttagatttctaatataagattattagattactagagttagcatatgtgagtgttagagattattagattattagacttagcatatttgagtgttagagatagttagagatttgatataagattattagaggtttaatatacgaaacttaattagacttagcatatgtgagtgttagagatttaatataagattattagagatgtaatattcgaaacttaattaaacttagcatatatgattatctaccgtacaaatacacgacacttagacttagcatatatgattatttgagttttaatacaagattagtatagtgttaatattacgcttagcaaatatttcttctatgaacaga

SEQ ID NO: 15595 - DNA, 1501 bp, Oryza sativa
aactatcccctataactagtctgataaccatgtcgtgtgggtatggggtacccataatctccacacacataaagacaattgatttacaagattttagacttatgaaagttataaaaatttctttcaattaaaattgcacgacattgctaaaccctaaaattgctgcaattttatttcactttactgtgattttcttgttatatatggttttactttatttttatgtatttggtttttttcatgtacttctgtaaaattttattaattataagtttgtttcatgtcatttgtaaatttttacatgttagaataatttattgttcaatcatttgggaatttatgagaaccataagattattagtatcatccaaggatgagaaatgtaactgtatttttgaaaaatccagacgcctgaaatgtccactccctgtaggaaaatgtaagcaaatttgaaatcactacttaagagcttttgcacgtagttttgtaaagttttattaattataagtttgtttcgtgtcatttgtaaatttttatatgttagaataatttatttttcaatcatttggggatttatgagaaccataagattattagtaccatccaaggatgagaaatgtaactgtatcttttgaaaaatccagacacctgaaatgtacactccctgaagaaaaatgtaagcaaatttgaaatcactactaataagcagcttttggaaagtccaaaaatatagtggaccgtagagactcccctctcccgtatatacacaaaggcaggagtatctccattctcaaacaagtcaaacttccgtgagtccaaaaacgaacagaaaaagaagaaaaaaacgcacacttttctacgtcaaaaatcgtgccaaaccgggaccttgctacgatgccgccgcaacccgcagcgaccagagccgcacctcgccgtcaaaactggcgctgcaaaccctccactcctcgtcgccgccgtcgtcgtcggcgcgacgcttcttctgcgccgtcacgagcgccgccgcgaccgacctgaccgcgctcccgtgcccgtcgatcaccgcgacgcaatagtacccgcgcccgtccgcgccgcgccgccaggcgcggaccgtctggtccgccgccccgctgaccaccagcgcgccgtcggcggcgtccccggccgcgcacgcgacggagagcaccgccctgcggtgcccgcgcagcgcgccgaccgcgaccatgtggctcgcgctgtcctcccgctcccacactacgacgcagcggtcgttgccgccggagtagagcacctggccgccgcacccgacggcgacggcgttgaccgccgccgcgtggcgggacagggtggccaccaggtggtaggcgggcttcttgcccgggcggcgcgaggccctgtctggcccggccgccggcgcccggggcgcccagacgcggacgcgcctgtcggcggaggcggtgtagaccgtgccgtcgtgcgcgacggcgacggcgttgacggc

SEQ ID NO: 15596 - DNA, 303 bp, Oryza sativa
acttggttggttggtttgttaccgcctttttgacgcccgcatctccgtccatcgatcgatcaaccaaccaaccgacggcccagatctcactccacgcagaccgcagcatcacgaaaatgaccaaaagcgaggtggtggtggggccgtgggggccttatccccccctcctcggtaactttcccgctgacgaatggggcccacttatggtgggccccgtgggccccacgtgtcactttctccggcacgggggtggatggagttaacgcagtgccggggctcctctcgtgtcgtcttcaccaaagc

SEQ ID NO: 15597 - DNA, 1501 bp, Oryza sativa
ttttgacaaacaagtgcaatttatggtgctttttgttaggaaaatgccaacattctttatagaaagttaacatgcaggttgtggttagttctctgatgcctgaatataattgcaattcgattacaaccaagcctgcatatttcaatttttgtccctacatattccaagtaaaattatacccttatttttcatttgttaaaattgttgctgttagactgcagtgttgacgctcagttaaagtggaattccttaggcttgctaaaaaagatatgtccacattaagtgaagtgcatgttgtgcaaacaaatatagtaggtagatatccgtcatatcaagtatcaagatgcatttgtgaggtataatgggtgaagcaggtgaaatgaagtgagataaatcagtaagattagttgtaaaatgaagctataacctattgtttgtattgtagtgttgtatttcatgcttttaacgaccttggcactgaaatgtctggtggttattttgtgcttgataatgattgctggtttctcttctcttagatcattatgtgcaggtaaaactagttcttttggttgtcgatattacttctcattgaatctgaacatattgtcacttggcacataatcttattatcaccctacttatctttctatcttttgagtttgtaatgaaatatattgtatcgttgtatgattaactgataaaacaactgtgcttgaaaattgtggcagcaatgcagcatgagttcaattctgagactatgatttgattgaatgactacacatatagcataagttacaaatagagcttactgagaacaactattacactttgttaaatgcatgttctaaaaatgaaatattccaaggtatgcatccatcgtacaaaaatgcatttggtgagatataccagctgaagatttaagagagcaaaagaaaaggagaggaatcaacgaagaagatgagctgcggctgcgagcaacaggaagtgcctaggaagagatccttatctccggacaagttcgtgactaggaccaaatcaagtgtcttgacgatgatgtctttaatggttggcatttttagtctagtttgtgtaagtttacatgcttgagttacaatcttagcatgttgcaagttatactctggtgcagaactagtgaatggcaagaaacattccttgccagcatcgtacaattcttttcaacctgcttatgtccaactgccattttcactttttcagcttgcctggagtatctcccattgcaaagtttgatctagctacagtttggagattgttactataatatttccttcttctgtcctagtaatatttgccaatttgcatccccttaaaatgtgtcacagttgatgtgtattagtgtttgtgtgtcagtgctagtgtgtcagtttgtgagtgtgtgttttgagaatatgttctgttaacaattggtcatcaattcattgagccccactcttaagatgttcccttagcagataacaccatg

SEQ ID NO: 15598 - DNA, 1501 bp, Oryza sativa
ctcgacaccaccgcccctgccgctgcctcccctccgccggatctagcggagaggagaccgctgggaaaaaaattgtatggcaccccatgccacaaagcatgcgtggcacccctatcaagatcttgccacctggcgtgcacaaatcttggagcactgatctaccttcaaaaccatactagggcaaaaactaattaacaggctatcgctaatctcgcgcgcgcggaaggatggcggcggcgatgcgcgtgacggcgacgcacgggcaggaaagacgacgtgcgtgcaagaaagggcggccgctgccggcaacggcgacgcggacgcacgcagcaacacggcggaaatcgacggagctagcgctgcccagattgatcgcgcggcagaggtgcacgggttgatcgatcatgactcgaggacaaacttcgctgacgatgccatgaaagaccaagccactgcacatcatcagttcggttcagatgatgaggatcttgaagattgcatgaatgaagaaaatgattagtgtgtgagtgtggagattatgggtacgccatacccacatggcatggttatccgactagtcataggggatagcttatatctatggaatatgtaacaaatcatgacttaggtattacgtttccttttatattatggagcggcctaacgtcctgatttgataatattgtaaaatagatttaggaaaccgataccgtattggttacggtttctatcttgtaattctgccaaccatcctatataaggtgggcagtgtcacgtcctgataaattcatcccgaaattaaaaatcattcgctaaaaggaataatagaattaattaaaattcggaaagaaattggcaaacactaaaatacgtacaagaaaaattcgaatgtggcccggagaatttttgttaaattctccttggtctaaaaaggagccctcaaattttacttgaattttcagagcaccggaaatatttattaagcaacaaaaacaattatcagagtttattaaaaagaaaaacctaaaaataatctctctccccccctttgggcagagtctggcccaaagtcctccctctctcccctcggcccgcggccgaagtctccctctcctccctctccttctctccctcctcctcttgggcccctcttcccctcccagcccacttcctcctcctccctctttctcccaggccgcctccccctcctctcctcctgggccggccgcccggcccaagccgcgcccaagccaggccgagccgagccggccgtgcacacgcgcgccgcgcgtgcgctgaccgcgcgtccggccgcgtggggcccgcgcgtcaggcgggtcatcgtcctcctcccgcccggccgtcctctctccctctcccgtgaaccctagcgccattcctccctcaaatccgcgcgattcaagcatgggattcccaaattgattagggggaattaaacccctttccctcctctctctttcccccttaattcccccttgaa

SEQ ID NO: 15599 - DNA, 1501 bp, Oryza sativa
aataattctgcaagctgccacttaacttattattttgcagatccagcttctgaagagatgagaggttaaatagcaatagagggatctcccctataaggttgttgaactgcaaaccaatataaacaagattaataagtttgcctagggacgaaggaatggtgcctgtgagcatgttctccgtaagacggagactatgcagaccataaatattgcctaaggaatgggggatgattccagtaagataattccttgcaaagtttaactctgtgagggaagaaaggttccctaatgatggagggatgttccctacaagtttgttccttgctaaaataaaagtactgagataagggagtccaccaagtgatggcgggatggttccaacgagactgttgtttccaagatccaaccaatttagggagaataggttacctaaagatgctggaatggatcctgaaagtttgttctttccaaagtccatgaactgcaaattttgaaggttgccaatttcaggagggatggatccagtgaggccattatcacttatatcaatcaagattaagttttttaaattccctatgtaagaagggatgcttcctgtgagattattattgtaaagattgaggagctcaagacattggagtgaaccaagctcactgggtatctctccctctagataattagcaaagacctcaatggttcggagttatgaacagtggctaagattggatggaattctgccttggaggttattgtaccacaaactaatggtttgaagacgcgagcattgagacagagatgtcggaatttctccctcgagagagttgatactcaagtttgttagatatgtgtatagcgatgtagtcttagacttattttactgttggcccatgaggcccatataccattgtatatgctagtgctctcctggaatacaccgtactgattttagcacaattcacatggtatcagagctaggttgctcttgcgattcccgtcgatgtccgccgccggcgagctcttcaccggtcttggtctccggcgagtgtcctccctcatctcttctcccagtggaagttttctgctgtgtgttctgtttttcgtggtcacttgattttggggatcgaccctcttctcttctggctggagcatctttttctcctgctggatctgctacttgattttggggatcgaccctcttctcttctggctggagcatctttttctcctgctggatctgctacttgattttggggatcgaccctcttctcttctggctggagcatctttttctcctgctggatctgcttgactgctttttctcctgcttctttttctcctgctcgaggttgcattatccaattgtgctagctgcagtggtgtcggctagctgcagtctgcaggacccgcagcctccatcctttgctgtcgcacttgccgccaggactctttccaacaaatctgccatgtgttggatctcctgctgctgattacaatacctaat

SEQ ID NO: 15600 - DNA, 1371 bp, Oryza sativa
tgtgtcatgtatgaatatgaccttttcgtgagctatcacgctacaacggtagaacatctaaattatgaagagctacctccattattgattttgaaaggactggacatatctagatttcaaaatgtctttaaatcattttctataaaacgttcagttaatagctacaaccaaaattgtctaaaaataccctaaaaatatgaaaatattggttatagtttttacacgccgaatatatttgtagtttggctaatgatcacacaaaatctccatttttttcttttaaatctttttcgcgaacgcgcaaaaggattgcatgtcaatatattagaagaaaagagttatagtcactcgacgcaatcagccagaccggcttatgcagagggaaggggaaaaaaagcaaaaaagaagctggagcttaaaaaactgcggcggctaaatacaaactccaagcagcgggaaggggccgagcctctttacactcccaacaagtccccaaaagtggcaacgccagctaaagaccacagatggctctctgagcatgtgtttggtttgggcacaaggtgggatgagttggatccatccctgttttttggaatggcatgatcccattttctgtttggttgaaaggatggaacgaatcctatttttttgtttggtttgaaggatatgatgggttggaatgatcctatgccttatttggatagagggatgaaggtgggatttctggagtgtacacattgtaaaataacatttagacatgaaaattacactatttgaaaattaaataccgttaatatcgctacatttttaatcagtatacatcaattcttgtatcaatccgttcatagaaaataacacatggccatcatctactgtcaagaaatttacctaaaaaaacaacacatttttgaactaattatactgctgttggttcaattgctactgactaattgacttcattcatacttactgataatactatgatagcgatcaagcgcttcggagatgagaattgacaaatatcagtctctctgatcaataccaattattggatagagaaatttacagaaggatagcagagtagcgaccggcaagagaagaggcatcattagctccctgctcgtgcgctcccaccgccgccttgcccctgcttgcgccgttggctcacccttgctcacgcgctcccgccaccgcttcatccctgctcgcgccgctggctcgcccctgctcccgtcgccgcctcgcacgctggccgccgattcgcccctgctcccgccgctaaccctagaacgcagtcgtgaggaggagctgaaaagagcgaagggaaaaaaaagggtgggccgtgagggttaccgcgcctcacacgcgtgc

SEQ ID NO: 15601 - DNA, 1343 bp, Oryza sativa
  unsure (1)..(1343): unsure at all n locations
acatgccagtcaaatgtgttgtatcatgaattctttaaacttgaaacttgattgtatcccacagtagtagcagttaacatttataatcatacaactactgggatatgtatttccagtgttttattatgaattatttgaaccctaggtatgggctagtttcttgttaacttctttcaaacctgagcttatcttattttgcctggatgatgccatgactgatgggaaaataaaaggaaatattccctctgtcccaaattataagggattttgggtggatgggatatatactagtactatgaatctggtagcacatttttcagtcttgctatgcatcttgggctagatatatattttacatgtagggtttgccactcttcataagtgtaaagtgccatttgaggatcagccactctctttctcactgacatgaggcattcgagtgacaaattctcatccaccaatggtggagagtgacagaccccaaaatcaactcttggatgataaaatgaactcgatgctgaaattcttagtgggtagagcatggaattttgaaatacagtgtcatattttgcttaattatatcttgtgctaagtgcttctggagaatcaagttcgacatgcaataaataattgtaaaataaacttgaaatgttgtttcaacaagtgttggtgtaaaataaatacaaatgacaggttgagatcttattatctatttgttctttgcatcttttgtgcagttggaaagtaatattcgtggtgtagcattttctactagctggctgaagctaatagatgactggcctgtggaatctcctagtgcatctgctggtgcatcccgtcctgcagcataccaaaaacgtggaactggtggaaggcggggcagaaaacgttcaatggcatctgaatctgctcctgttactgatgatgacaacagctgaaagaagtgaattggtggagtggaggaaatgtttcaaagcgtatctgacagaggggggctctaccagttttgaccattataaaagctgctcgtcaaggtattgcacatgtctgtctgatatgataatccctttctctgtctcaaggtgagaacaagttaacatgatctgtcgctcactaggtggaaaaaaaaggatgttcagtgtgtcttatcatgaaggctccaattttccaaggcggactcggcaacttgcttgnagggcatgtgttggattaagccagagttcatctcaacttgctctccaggttagcaccttctatcatgatgttttgaagtatttagatcaagctatatgtattcctaatatacatatctatctcacaggttagatatcttgattcccaca

SEQ ID NO: 15602 - DNA, 1501 bp, Oryza sativa
cctacgcacactataatcaaacacttgcgaatgcgcctcataaaacatgctaagatgtaatgtaaatcaacggtagttccctaccacgaaaaaagtttctataaagaacatatccgtatctattatagctctggtttgcaaataaaaagaagagtaaattgcatttagggccaccttttatcaccaaagttccactttggactaccctttaaactattttttcactttggactagattagtttgcctctgtttcactttgaaccaccccaaaaacttttctcgagcacataaatgactttaaccacatcggcacccataaaccgataatctttccgacttatatagactattcttcgtaagattagagggtagatgtagttagaaaagtgacttggggtggtccaaactgcaacaaaggtaatcttacctagtctaaagtgaaaatattagctagagggtggtccaaagtgaaactttggtaataaaaggtggaccaaagtgcaattaactctaaaaataattgaggcttaagctagtagcctaacacagggcctgttcactttgatgccattttcaactttactaaattttggtaaaattgccaaaaaaatggctacatttagtttgctaccaaattttgataactatataagaaattctgccacaaaattttggcaactataccaaaatttagtaaggtttttttggcaacaaagtgaacaagcccacaatattttactatgtgtttcctccagctaaataacaatttctcatttatagtatgttctaactcaagcatgaaaaggctaaagcaaaaattcctttttattttctctagattaaaaataattatcgttttagataaagacattgccactttgagtactacagtatatgtacaactatcaataaatacataatttttattaaagtattttttaagattaatctatagaagttgtccatatgtatgagaaaacgagagagtacacgcagggaaagtatttggaagatcctaccagtagtagtacaaaatgacaaataaaatttgaccggagtgatagtggtgtggcgctacgactggactgacatactcctcggaaccggtggtgcctcgaaacgttcatcaaacgcaacgtgactccacactcttttgttcgttacccattccagcctggcacccgatccgacgcgtccgtccggcgacccggtttgacccaccccagtagcgtgtcgtgtcgtgtccgcgtggcggaccgcaataaaaccagtctcagccagcgtggctagaaaaaaaaccaaaccaaaccggggaagcgcgacgcggccacgacccgaccgacccaacgcggccacgcgtctcgtcgtgtttctccttttccacctccccttttttttccacgcactttaatttgagcaatttaatccgcgccttcctctcacaagtctcctcttcttctacgtactcctctccttcccccgcgcagccgtacacgactc

SEQ ID NO: 15603 - DNA, 289 bp, Oryza sativa
tatacgatgataaattaggtcagttgattcagcaagaagaacagcataaaatatcaagtgatgtccttcttaatagtagttacagttccaaatttctgcatcatgcatgcatgcatgtagtagtatgatacggccaggtctaccaacacctgataacgttagattcttcaagggacaaaagatgtcgaacttgacgaaaggatgattccacgatcagtgtaggcctaccatgcgtccatgcatggcatggcacagaaacaaaatgaactcttgtgtaatgcgaaaaaca

SEQ ID NO: 15604 - DNA, 339 bp, Oryza sativa
gatttgtataaattaccacaaaattgtgtgcaacaatgaaccttatatgacatttttgcatggtatgatggttggagattgaggcatggagaagtcaagcattgcgttacttattcaaaagcatgaagcaaaaaggagttgcatcttgtgatgtaccaatcccacccgtggatttatctaagaccttttgaacaatttacattgtcatttaggtaagattcaatcttatttgttattttctacttgtattgaaccatttacagttatataccgtatcgtttactatttgttattttctacttatttgttattttctacttgtattgaaccatttacagt

SEQ ID NO: 15605 - DNA, 1501 bp, Oryza sativa
aattgactctatttctctttccttgtccgggacttcttccttatctacttaggacttttgtcatatgtatgaggattgattatatataggacttggtatatggtggaccccgccgagcttaaacataagtatagggtgtcctatatctagaacactgacaaaaattcttgtgaaacgttttagctttgagctagttgtgcaaatgataaaaaaaaggaggaaagaaaaggtatcagaagagaagaaaaaaaggagaagaaacaatacataagaagaaaagagaagttgttgttcttgttgtttttgtttgtgttcttttagtgctattttgaatggctacgcttgtgaccaagctcgtgtctctaactaagtttaagctaggagcaacatagtatcattgttgagcatttattcaatctcctatagctcctagttgtaccgtgattttgcttccaacctcctgtagctccacatatttatctactatgacacatgctcgtgcttgttgttggttccggtacaactaaccattgttgatgttcttgttgtttgctaaacaccatctacataacatggtaaaaacatgtaagaacttagttgcacaagatgggagattgagagggagttggatatcaccaagttcaatagttgataggctatatttttcttgttttctactaatcatggtatgagatcgcgactacggtatttggatggtatggggatcgttcgtaccaaggtatatgcaagattgaggtaaaagagatggagacaaggatttttatataggttcgggccccttatttgacaggtaatagccctacatcctgttagccgaggctagtgttgctcttattcatcgtaatcacaccagtacaataattgggataacctatctagctgtcgtcgacttggcggcatggataaccaactcgtagtcgacgacagggtagtcttcctcctcgagtctgcactcggtgagatcagagatagcttagatccctcttgttggcctccgcagacaccatattgggtttgtctaggcttatctcctatgtcgatatccggcggctcgtcttggcgtgtgttggcttgtgtatttgcgcgtctatggtgggtgtgttgttgttgtggctcgtcccttctcctcctagggggcttgtatttatacccataggtgtccccttgtccaagtagaactagggagaccattatggatacaatccgagtagtccttgttgtttctatatagaactctatccgtccttccttatccggaactccttctatatacgaggtatgattccgtataaaatttgatatatggtgggtcctgccgagcttattcgactactattgggtatgtggtatccataaccctgacaggttatgcaaaggaactggagtttatcatgttgaatgccaaccttttcacctgctaaaagacacagcgagtactatacatgacgcttataaggtacccaattataatcatgcaaga

SEQ ID NO: 15606 - DNA, 1501 bp, Oryza sativa
ctgaatttctgattttccaaggcacatgaacccatgtaggttggccgttcaaacttaaacacttattttagaatcacccattcagtggccttttttattcctgtacatgatacatgccaatatcaaatttcctttctttttgttagtttaataggtgcttatcttacctagaagctagtactaattgatttcaatgaccacacaatttgctggcacttcttcaagttttgccaaatgccaacactaacacaattctataaggatccagaacatactgaggaattacgttctttattttatttacaaaactatttgtcctgaaaggacattaacacattttagtgaagtaattttctttttacaaggatttggccttatcaaataaccttggtaaaagtaatttgtggcagtcagccccacttgtctctcatccctatctccttcctgctccctatttcacattgtattggtttggaggagccttcatcaaggagatgtttggtgcttccctctcatatgatgctacctccctgcttcccacgtgtaaaagttctcaaaaatcaaaatttggacatttagggagacaattttgtatccatgtagaattccaaggtcaaacttgattttgtatttgaaagatgtatgaaagacagacataatgaatagtgattttcctgcttggtaccattcattattgctggtacggagtttcctttttctaaaattttcattgctattgaattatccctcccctgtatctccaaatttttagagattgtttttaacttttacatgtaggattaggaagtgcaaggatagttttgttgtgcaagtctactggccactgctactggaacaggcgattgttattttcaagtaaacatcctaccctagaagggatatcctcactttattttttaaaaaaatcgagcagtctcaatttcattacagaatctgtgaatgaatggtgagctgggcacctcaaatggcatgagctgcatgaggcaggccatgcacggtttacaggggaatcaggtccttagccagtctttacttataggctttattatagccaagtagttcaataagtctttccttctattcttgttgagccaggtgttggttgagcaaccaccatcatcagtattcagttcattgtaaaaggagaaagcagctggcattatatcatacgtagaagattttcttcactgatttattgttcttggataatccaatgtgctactggcattttatttttatttttattattttacatattttatattcctaatcagagatttgttcactgcagtacattttgtggctagctttatactaagaggggtcgaattggaggagggctacactacttggtggagattttactgagattctacgttgtgtttcaattacatttacatggcatatcttttctaagacatgccgtcctctacgccaccatcagtgcaacctgcaccaactgtgcaaccattaccgtcat

SEQ ID NO: 15607 - DNA, 417 bp, Oryza sativa
atattggcacacgaaggagcgttgtttttgaccggaatcaaaaagttcaaaaaacgccgaaaacatgatttttggacatattggagtgtattgggtgcgttcgtggcaaaaactcacttcgtgattcactcagtgaactttcgtaaattaatgccaatattggcacacgagggtatgatgtttttgaccggaatcaaaaagttcaaaaaacgccaaaacatgatttttggacatattggagtgtattgggtgcgtacgtggcaaaaactcacttcgtgatttgcgcggcgaacttttgaaaagttcaaaaaatgccaaaacatgatttttggacatattggagtatgttgcgtgcgttcgtggcaaaaactcaattcgtaattcgcgcggcgaacttttgtcaattaatggcaacaa

SEQ ID NO: 15608 - DNA, 1296 bp, Oryza sativa
ctatttgtatctaacaatctattatgtgttttgatttcaggaaagtcagactttaagactttgtcgcagactctacaactactcgattactcgagaacggttgctggagtttgacaaggattacggaataaagcgatggtgtacctgccgagacgaaatttcttgacttcaatccaaattcttgattacggcaagataaagaattaagtcgtatactccgcaccttctcggtcatccgagaatgtcaagcgagcacggcaattgttattccaaggtcttcggtcgagaacatcaactcattcatttgcattgaagtcaggagctactgttagggttatggataccacatatccaatagtaatcgactaagctcggaagggcccaccatatatcaaatcatatatggaatcatacctcgtatataaaagaagttctagataaggaaggacgagtagagttctatatggaaacaataaggactactcgaatcgtatccatacttgtctccctagttctacttggacaaggggacatctatgggtataaatacacaaccccctaggaggagggaagacaaaaaacagagacaccagtcagaataaacaccaacacacggcgccaaacattgatattggagatagcctagatggactcaatatggtgcctgcggaggccgacaagaggaatctagtgctatataggatctcgacgagttcgtactcgaggaggaagactaccctatcgtcgactacgtgttggtgatccatgccgccaagttgacgacagctagataggttatcccaattattgtacttgtgtgattcaaatgaataaagagcaacatcggcttcgaccaactggagtagggtcgttaccttcgtgtgaaagggcccgaacctacataaaaatccttatctctatttcttttacctcgacctcgcatataccctggtaccaacgatccccataccatgcaaataccttagttgtgacccaaaacgtcgacagctactttatataaatctgtgatccgttagatcattggtttctcttctttggaacccacctaatgataactatcatgtgttccctttctatgggcaattaggattgctttatatatatatccgggtgaatcatagacccaaaagtgcacacgggtgaatttattcggcctcagtgcatcggcaaaactagccatattaaaatcacattgcctataataaggtttttggattcatatattgatttaatttatttcataaataaatcatgacattacatatgtaaactagc

SEQ ID NO: 15609 - DNA, 1501 bp, Oryza sativa
gccgtagcacgcgccgcggacggggttccagagccactgcaccatgaaccgccggccgttgacgccgttgacgttgtaggaggcgccgtcggcggcgcgcgacacgttcccgacgagcccgcccgcgccgccgccgtcgccgtacacgccgaggcagaggtcggcgatctccgtcggcgccgtgggcgtgtctccggcgtaccacgcgttcaccagcgggttcgtcgccagctccgccagctcgtgcccgagcacgatcaccatcccgtccaccccgacgtcgccgttcggcggccgcagcacctgctgcccaccggcgccgccgccgtagtccggcgcggcgaacgggtacgcgcacttgcccgggcactgcgtggcgctgttcccgacccacgcgtacggcacggtgacgccgacgacggaggcgaaggtgaagtagtggaagccgcagacggcgcggcagaactcctccacctggacgtccggcgaggtgagcaccaggtagacgccgctgtaggggtcgagcgggagcgggtccgggtaggcgtacacggcggagcggatgacggactgcatgtcgatccgccgcagcgacgcgccgtgcgagtacccggcgtcggagcgctcgccggcgacggcgaacgcgccagtcacgtgggcgcccgtctggtccgcgtacagccgcggcgcgcgcgcccaccagtcggacaccgccggggacggcgccgccggggccgagagcgaggcgaggaagtctcggagcaccgcctgcgccgcggcctcccaccggccgtaccagatgaggtagaggttcgtcggcgaccccgacacgacggggcccatgtggtactgcatgtccaccagctggttgccgtccaccaggtagtcagcccggtacaccggcgcgccgccggcggtggagacggcggcggcggcgaggaggaggaggagtggaagcctccccatttttctcgacgagtggagtggaggagtgagagcgtgggggaagtgaagtggagtttttggtggtttttgagtttgaattccgactctttttaacttcaaagtttggttgtactaccaatgtggtgataaaaattgtgacttccaaaaaagaaatttgatggacttgcattgggagggaggccgacaggtgggccccatgatgtttgtgcgtaaatatccaccatctgatttgaagatttaaacccgggtttataaaaacgtgcaattcgaatgcttcaattcgaaacggacatttttttatatatacttctaaatataaaaattacataaaaagatatattgcaattttttcataatataaatatactagtataattttaaacatttaattatgatatactgagtacatctttattttatcaattatttaagattttaaggtttgactgtatacattatctgtttggaaatgaatggaatacatcagctgatctttaacggtataatccacggaatgaattatatacacactctt

SEQ ID NO: 15610 - DNA, 227 bp, Oryza sativa
ggctccgcgtctccccggccggtcggggagcgcgcgggccgtcggatcgggatcggcaggctcggggttcgcacgcgagcctcgggtggtgcgcctcgcgttcgccccgtccgtcctgctggcttcttggggctgggcgatcgagtgtttttcgccgctgctttttggggggtttgcgggatgcgtggatccgcacattgggacgcgctgcgcgtggaatggatgga

SEQ ID NO: 15611 - DNA, 1501 bp, Oryza sativa
gttgggcctgagcagcatgggtgtgctgttcagtgttgattaaaatttctgattaattactctactgtttcactactcttaaatctttactaaatgctgctttcgcaaatgagactatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcttgtgggagtggagctgaagccatcgctagaccgttattccgctgctgttttcttttcttttgtatgtatgtaacgttattattatgatggatttgtatattaaattatcagtttgtgtacctcggctgattcctagacgaggattttatgcacaaataagtttgaaattactagtgaatttccgggcgtgacaaatatctagacaatcaagccattagaagtttcatagagtggtagatatcctatataatccaagccaacgtcactatttaacctaatcggctgccttctaccgatagatgttagccgattgtaggccagataacgatattgccagagattatgcaggatatatgataactcgatgaattacataaacaagattagagtgtcgtaaagatggaagcactaatcccgagaacgcaagccgtcataacaagttttacctcttgttaaagatcgaaaccgatacagctcaacccgaaagcaagaactcgtcgaaacaaaacgaaagtaaaaagggtggcgatgcgccgagattgtattgaacatgtgtgttcattgattacatggggttcagggtctatttatacccgagaattacaaactatgtccttatcggatacgactcttatctctaacaaactctaagataccataagtctttgcggcagacttttgcccaaatatatctctaaggaaattacataaaatatcctaattgatagatacaattgccttctcaggactctatctgtggagattatggataccccatacctacacggcatgtatatccgactgggtatggggtgccatgtatagatagaatatctttaaagggactcgggttaaattccaaacttttatgtcaaggaaatacccgggatcctagtcggttacgattgtatcttatctgtaactacctattccgttaggagtatgggctgtactttgtaatacggaccccttctcctatataaggaggggtccgggtgtctcttggggcacgatttttctcctagatcactcgacggatcaatccctggacaggagtagggtattacttcttattaagaaggcctgaacctgtataaaattttttgtctttaaacccatccacttttccagcttgatagccacccccttttagtattgccgaaatcttgtttcgacagttggcgcgccaggtagggtagtgtcaagttcttcgccgactagtgcga

SEQ ID NO: 15612 - DNA, 1501 bp, Oryza sativa
tgcaaccgcgttctgctggggggtgcgaaaaaccgccgtcccttcgacgtcttgttgcccaataagttctcgtgctcgtcgcccggcctccaaggcgcgctgtcgccggtcctcagcctccttcgtagcccgttcgtgctcttgttgctcacgctgtagccgttctcgctcttgtgcttgacgctcctcctccagtcggcgacgttcggcttcttgtcgcacatgctgttcttctgcttctcgggcttgacgctgttcttccgtgtcattgtcggccatgaaaacgccgaagaagagaggcgcgtagttatcttcgtggccttcgtcgaagttgtcgaggttgcggtagtcgtagtggtagtcgaagtagtcgtactctacaatctccgttggtcgagaatcgacaccgggggagctgaggaagccatacaattcttccgtcgaaaccgtcccgagacgttggagtatgacgccgacttccctggagctaggctggatcgaagccgaggctggatctggcctaggcctacgggaagaagacgcccttgtggtgaagactgtggccaagtcgtcggggagactcatcaggattgagggataggccccattgtcttgatcaggtcgtgttgaagtagattggatctcgtccgactggtttgaagccgactcggttgagatgatcttggagtagatctcggccgagttcgggataccgaacggggcggagacctggcctccccccgactggttcggatccgagtcgaggagagaaatcttgccgaagtcgttggtgatgaagtcgaggctgccaaaccggaacgcctgcccgggagggaagacgaagtcgtcgatgccggagacgaaacccatcgcactagtcggcgaagaacttgacactaccctacctggcgcgccaactgtcgaaacaagatttcggcaatactaaaagggggtggctatcaagctggaaaagtggatgggtttaaagacaaaaaattttatacaggttcaggccttcttaataagaagtaataccctactcctgtccagggattgatccgtcgagtgatctaggagaaaaatcgtgccccaagagacacccggacccctccttatataggagaaggggtccgtattacaaagtacagcccatactcctaacggaataggtagttacagataagatacaatcgtaaccgactaggatcccgggtatttccttgacataaaagtttggaatttaacccgagtccctttaaagatattctatctatacatggcaccccatacccagtcggatatacatgccgtgtaggtatggggtatccataatctccacagatagagtcctgagaaggcaattgtatctatcaattaggatattttatgtaatttccttagagatatatttgggcaaaagtctgccgcaaagacttatggtatcttagagtttgttagagataagagtcgtatccgataaggacatagtttgtaattctcg

SEQ ID NO: 15613 - DNA, 1501 bp, Oryza sativa
tttcttatacgtattttaatgtttgccaatttcttttcgaattttaattaattctattattccttttagaagatgatttttattttgggatgaatttatcaggacgtgacagggaccgagcgcagcccccagtcccgcagggggtccagccgcactccgtcgtcccgggggcggaccgtgaccttttcttccccgatccccgcgagtatggagccgctcctgcaggtgctcgcccccgccgactccaccgtccgggaggggctcaacgcccaagttcaagccctggcggacgagcgagcagccctggaggcagaatgggcgcagctcacggcggaccgtgcgcgggtggatgagggacgccgcgccgtggatggcctggtggagacggggcgcaaaatgtgccaagcccggctggcggagatccaggcgtgcgaggagacgctggactcggtcatgcgggagacggaggaggagcggtaggcggcgctcatcgcctcgagcgccttagaggaggcgctaggcaacatccgcctgtagtacgaagcctacgccaagcacctggcgaaaagggctgaggatgcccgcggggtcctcgacgctgccgcggcccaagagcggcgggcataggaggttgacacctcgctgcgggcccgggaggtggcgcttgaggccgagcgcacccgctccgcgcaggagttctgtcacgaccggaaataacccaacgggcgttccttacgtgcgtgcattattccttgtcccaggaggcaaggtacaccaaaagttgatacaattcagagtttaacaaacggaagcgtaaatagataatttattacatgggcagcgaaggcccagcacacacaaagacaaacgagaaacagcggaagactagggcgacgaccacaggcacttgacggcaggcacgagctagacaccaaagccttcatcttccagaggctcctcttctgggtttgggaaaaattgagcaagactgagtacaaccaccgtactcaacaagacacacccacaagtgcagaataaatgcaagggagtacaagggagttatactataaagggttagggttgcagtaaacagcatttaaagatatttagttgctcaaagctattttgtaaccacgattctagaactatacattattatttatcaaggccgtgaacccacacgaacctgccttaacccaaggcctacgatgattcagaccgaactggcaacccgaccctgggtcccagctcgtcccaagccaacccaggccaaccattccacattttagttgttaagcatgttttaagaattaaaacactaacttgggtacattgctcggcttgcccataaccgagggcgcggctattcgaatagattttactctgatcagaggtgtacatctttacccacaagacacatcttcctcacgtgtaaccacgtgccacataccaccacggtatacagacggaagacgtgacatagttttcaacccatcctagc

SEQ ID NO: 15614 - DNA, 1501 bp, Oryza sativa
gcgtttcaattttttcttcgtgatacaataatgagtggcacagcaaaaggcaaagccagctagtcacattctgaaaaccttcatacatatacaaatctggttttcacgtgtgaaaaataaagcaggcatcactcatttccatctatgaatattttatatgttttctcaaaaaaagtgtttgttcattgttaatttagtttacgttcatatcggaacaattcacggtcccggaaaaaagtgacagataacagttcacattcagcgtttatagagaggaaaaaaaagagtgataagcatagttcaattgattaggtttcttatattagaattagcccatccgggttcaagttctacagcctgtttaggagagtttaagattttgataagccgctagttggtaaccaaaatttgaaattctaaaaaagttgagttctctatttctagtttattttctaaaattctacgggccaatttggtaaagctccaactcataaatttaactctaagagttgggtttggaatagagttgtgcagtagtctaaacccagctctatctctttattacattttgtgagagtgcttcgaccggctcaattcccgttttaggtggagctgaaactgtttagatggactctagctcctcctaaagctagagccatgccaaaacatacgccacaactacagcttcttaatatctggatgaaaaactgaattgtttatgggagtttctaattttgggagaagatgcagctgacagaagctctcccaaacagacttgacacggatgctcgcatttgtagctcattattcttttagtattaggtaacgtgtaaccattgacagcaagacgtccatggtccatctttcaaatatacttatagaggtaaatgtgccataagcatctgcatttgtaatgtatttcgaaaactgagattgcgtttatacaacgaatcactagactatatgtttcaataattcgatgaataaagtgaaaataacaaggccttagacgcagcggctgtggttaccagtcacacattaccttaagaaaaatgattttaacatgtgggataagcaaagggaatgattttctttttctaaaaactaacaatcccaaaggaggaaggaaagaaacaaaaaaaaaaaaagagcactgactttggcgtaaccaaacggcccaatgcaaatccatccccgaatgctcatcaacaacgagtgtgcaagcatccggaccgaaatacgcacgcattacacggatgcaacccaaacccaacacgggaagtcgcggcccaccgtattctctatctctctacgcgtatatatgcatacgcgcccctcccatcctctacacgtacggttacacaaatccatttcccaaaagaattcaaaatttaaaacgtacataccacgcagcagctagcgcgcgcgctatagcttttccctccaacacacaagtacgtatctcccatggcggcggtgacgccggacgagcacgagcggc

SEQ ID NO: 15615 - DNA, 598 bp, Oryza sativa
actatatgcagtaaagtcgagtcaccgtgggggtgaggacggggaatagttcaccgtcccagcccccgtcatccttgatggtgagaggtttgtaaccatttcattctccatggtgaatacatattaaccattcccgtcacacctaataggtgaattcaccgcgggaaaaggtaaacagggccctattaccatctctatatgtgactcataatagtgtaaaagctcatcaggtcttgggtcatggggtaccatctctactgctgcccccctccacaccatcatcacgcgtcagtgtgtcacgtgactcaccacctcctccacaccaaacccaatcccaaaaagccaaaaaaaaaaaaaccccaaaactcctcccgaatttgaccaaaaaacagccaaaaacgccacacgattcatttgaaaagggcacgcacccctcgtatacacccacccgtggaaaattagagagagaagagagaagacgagggggaaaaaaatcacaagagaggaggagaaaaaaaaatcgcagcagcaaaccctgctcctccgccatccgccgccttccctcctcccccacgatctccggcggcggcggcggcga

SEQ ID NO: 15616 - DNA, 350 bp, Oryza sativa
tccaaaacggcatagcttttgccattttggaggatctaaacagacccttaaaaataggaccaccactaaatatgaaaaaaaaaactaactctttaaaattgtcagggttatggataacacatacctaatagtagttgactaaatttcggcaggatccaccacataccatgtcttatacggaaactgacctcgagggagttccggataaggaaagacaaccagagttatacatggaaacgacaaggactactcggattgtatccatattggtttccttagttctacttggacaaggggatacctatgggtataaatacaagcccccctaggaggagagggtgaggagacca

SEQ ID NO: 15617 - DNA, 582 bp, Oryza sativa
attcctgcagccagtcccatctaaacagggtctaatttggtgagggttttgataacgaggctgaacccaacagtccactcgatcatgtgactttttttttaaaaaaaatgataattttattgccacaacacaaacacttcttccaggaggaatattaactccaaggttcacacaattctcactcacttccctgtggaccccactccactggtcccaagcctccccagccccacgggccataggtgacagccctacaccagaacagtgccatcccatccagcccagtgcctcctcaaaaggccaaaacagcaacggtaaggtccaaaacagaagcatcctttcccagtgctgagaagcagcagcagcaagccagcaacagcctgccactcctcccatcccatcccatcccatcccatcccatcccaatgccagtgaatgctgtcgccacgcgtcttcgcggcacccgatgctactctactgcctcccctcccgaacgttcgaataccccaacggctacctccactccaccaccctatttatatccgcctcccatggccgccacagcatcatctcctcctcctc

SEQ ID NO: 15618 - DNA, 1501 bp, Oryza sativa
ttgctttttgctttttattatatctatcggattttaatacaaagattaaaaatctgtgtgatacgattataaaaatctttcgaaagatgtataggtactcccatttttaataaggttcagacccctgagataggtaattgttggctagtgttgcctatatatcaatctctcatgaatacatgggtacaaattagttacccaaaacgccaccgattgaatcattgacaacccgatagacatgtctttcgtagtcttcaatgataaccatgaaagcgagagacatcgacaaagagatgaaaaaaacagaaaagagcctagctagaaaatgttaactccatagacatgctgaaagacaaaccctaaaaggctaaaatattgttattaagccggccggagtgaattatcttctttcaaaatactgtttttctagccagcctcggtagcacagataacttaaggggactagctgggcgcaggagggaattaatgagcgggcaataatagtgaattatctgccgacctctctcgatcaggtgtcgttcgatcatggctaatccaactacctgagatattcatatggttatagccaaacttttgcaagcagctcatctccaattctacttcacttatacaagacatggaggggagaacgggagaatgatatgcaacatgaacaagaaaaatctcgaaggacctatacatccgatgattcaacgagtgccatagttaatattggttgatgaaacattgagccctaataattgaaatagagaaaatcataaaatcaaaacttaaaatgtgcaatagagtcatattctattgaaaacattcgcttcttgaatatgaaacatcgaatttcaatggatggaaacctagggaatatataattacttgtactgtgtagtttgttttttcaaataaggtctattcttagacgattattaccatcttcttataataagacaaattttgtcaacacacaacaaagatgatccacacttggaatgccatgtggtgttgaccaacttcgacacgcgcaaaaatataggaaaaagtacgaattaccccctcgaactatcgcggtcgaccgaattaccccctaaaccatagaaccggacattcttcacccccaactatgcaaaccatatgaattacccccctcgacctaatccagagtggttttatcctacgtggctgtgtgatgatattttgtacattttttttaataaaaaaagaaatgaggtgtgttaaaatattgatcccagaaacgatggtagtaataaaattgatgattaattatcactaatggtgcaaccttgactacatgggcacatgcacctgtatgcacgtctgaatattatatgacacttgtatagtactggttgcctatgctccagcccagccggtgtacgtgatgtacatcatgtacgcatacccctcacaaatgccatattccaaatataaaagcttgtataaatatatggaagggatcattgattat

SEQ ID NO: 15619 - DNA, 1303 bp, Oryza sativa
gaaacgccgccaccgggcgtagcgccacgacggcaccgcgccgcacgccgccgcggcgccacgccgctgcgccacgcgccggcctgatgccgcgcgcggcgccacgctgccgccgcgccgccccaccaccgctccgctgccgccacaccgccgtccagctgccgccacaccgagaacgtgaacgagcgaacgaacgtgaacgagaacaaggtgaatgaacgtgaacgagaacgagcgaacgaacgtgaacgagccaacgaacgtgaatgagaacgagcgaacgaacgtgaacgagaacaaggtgaatgaacgtgaacgagaacgagcgaacgaacgtgaacgagccaacgaacgtgaacgtggaatgcaattataggctggttaatgaacgtgaacgaacaaatataggtgaatgaaacgtgaccttaacgagaacgcgaacgtgaacgatatcgtgaacgaaacgtgaacgtcaaatgcaatatatgttacttcgcgtttatcctaatacatctttttgtatcttgcagaaaagacgttgtcggagttgtccctcaagccggagtggtagagctagccctcgaaggaattcgcccaggtaagtgacgtaattatatatatatgattgttatatttgtaatgtaattaagattattagatttgtaattagacttaattagcatataagattgtgtagtgttctaatatacgacagttacacttagaatacatgactatttgagttttagtataagattattggagttttaatataagattattatatttgtaattagacttagtatataattattgactagctagggtcctataatatacgtcacctagacttagcatatatcactatttgagttttagtataagattattagatttgtaattagacttagcatgtaagattgtgtagggttctaatatacgacagttacacttagcatacatggctattttagtcttagcatataagattatttgagttttaatataagattattatatttgtaattagacttagtatataattattgactagctagggtcctataatatacgtcacctagacttagcatatatcatcactatttgagttttagtataagattattagatttgtaattagacttagcttctaagattgtgtagggttctaatatacgacagttacacttagcatatatgactgttcgtttagtcttagcatataagattattttagttttaatataagattgttaaaacataaatgtctcatgatttagcagatgtttcctgtatgaacaga

SEQ ID NO: 15620 - DNA, 1501 bp, Oryza sativa
tctttattttttaattccgaattttaactatttttaaattgtatttctatatggactctggtctcctcttctaatatttcttatttttttaattttgaatttcagctatttctaaattgtattttctatatggactctgccttttctttttcttcgattaatgtgaggaagtagatgacatatataaacgggtagacgtacgtccacccgagctattaaatcagtttcccccctttcccccttctctaccggcacacacctctgttctctcccttccgccgccgctctccccttctggtgatggttttatattcctttttctctcttcttttcttttcttttcgagtagatattgcagttcgggcctcccttattagacggaccaggcccatctggacaggcccatgaaatctaaataggcccatctttccacatatgttgaccttatttctctctcttaaaaaaaaaagttgaccttatccttccttcctttccatggcgaaggcgcaggcgcagctcgtctccctctccttcccacctaccgcgccacccttcgcccgcccccgccacgcgccgccgttccttaatgcggcggcgctgcgcaccggcgtgccgccctactccgccggcgtcctcgtctccctgctccgggactgcgccgacctccacggggatgacaccgaccaccgggtcgcgcgccgcctggccccgcagctgcactcgctggcggtcaggaccggcctctcgcgggacccccgggtgacgtgcgcgctcgtcgaccttctcgcgcgcctcggccggggtccctcctgcgcgcgcctgctccacgaggcggcggaggacggcgccaaggacgccgtgctgtggaacaagcacgtcgccatgctggccgaggcggaggagtgggacgaggcgatcgccgtcttcagggagatgcaggcgcgcggggtgcccgccgacgggtacacctgcgcgcgggtgctccacgcgtgcggccgcgcgggggcgctccgcgaggggagggccgtccacgcgtacgccctcaagctcgccctggacgcgcacccgctcgtgcccggattcctcgccggcatgtacgccgagaacgccgacgttgcggcggccactagggtgctcgacgcgatgggggcgggcagcgtcgtgccgtggaacgcggtcgtcgcgtgctgcgcgcggctcggactcgtggacgacgccctggagctcgcggcgcgcatgtccaggtcggggccggagcccaacgtcgcgacgtggaacaccgtgctgtccggctgctcccggcacggccgcgaccgggaagcgctcggcgttgtcgccagcatgctgaagcaagggctgcgaccggacgccaccaccgtgtcgagcctcctcaaatcagtggccaacacggggctgcttcgccatggcatggaaatccactgcttcttcctgaggaaccagctcgagccggacgtctacacggggacggctctcgtcgaca

SEQ ID NO: 15621 - DNA, 1501 bp, Oryza sativa
ccggactgcgcgtagcagtggcggcagggcgcgcactggagccagacgacgtcgctgccggtgtcgagcaccatgagcgcggtggtggcgggcgtgccgaccccgacctgggcgaagtactccccgctcccctgcgggaggccggacagcaggggcgccgcgaagccgccgcggcggcgcgggcgcgtggcattgttgggtgcagcaagcagggcggcggcgcgcgcggcgtcccgggcgaggaggtgcgcgagcagatcggaggcggtggcgttgagcgcgaagtgctcgcggtgggcgaggcggaagtggagcgtggaggcgttggtgcggggcgcggcgaggctgagctgctgctcctgagtgataggatccggggagagcgggttggcgagaagggattgggtgcgcacggccttggagaaggcggcggggagaggcagcaacagcagcgcagcgatgaggaagacatggaacgccattgccgttgaggggagcatctcgatctcgatcggaggtggtggagatgaagcagaggaggagaggataattgggagagagaggtggccggcggttgctagctggggaattaaatgttgtttcttcttcttcttcttcttcttcttcgcggtggctgatcgatcaaagtgaattgaattgaagtgaaagccaacagcggcggctgccacgtcctctactggatcgatagatcgatccgcacttcactgcagcgacttcaattcgaccaaggatgcactgggaaaatcatcacttgctgcctggatcttgcacaagtacacacactcggttaattaccagcagcagtttacagtctacaaggaatctgggcattcgggaatcgggagagcgagatgtgccgtgtgcgtgcgtgtccgttgtttcaggacacacaccatgatggcaatctcccgttgggcctaccagccgaaaagttagctaattggcccatggcatcattttgggcccaaatgcatgtggtcccgacgacagaaggcccacaatgtcgtccgtccagcgcagcgcaaaactgggggacggcaaccaatcgcagcagtccatgttccgcggcgcgggtggatcggcgaggactccatcttccccggcaattccggcgaaagcatctcaaattggtaccaaatggcagccatggcgagcgcgacaaaccgccagaggcacctaattttggcactggtcgtccccagcagagcagatgaacaagagaggtgcctcgcaattcccaaaacgaaacgaaacgaaaggaaacaaagcgatccttcttgcgctccggcgccgccgtctccccctcgcgcggttgcctgagccaagaacaggatcggaggccaggccccatgcatgcatgttaattagtctgtcactgatcacttcatcccattagccattagctgtttctcatccagacggacgcgccatccaacacacatcgatcgatcggaggttgattggccggccatgacgacga

SEQ ID NO: 15622 - DNA, 502 bp, Oryza sativa
gcagtccaaatgggttaaggtcaggttgatatagtttgagttggagggggttagctgatacagccgattagtttaatatagccaatttttattaatatgactgggtgtaagtcatagggttcaagttgatgtgtttcaagataattgtcatgcatggatagagttttgggaaggcaattgtatctattaattagggtattgtatgtaatttttttagagatatgtttgggcaaaagtttgctgtaaagatttatggtatattagagtttgttagagataatagttgtgtgtattatggaggtattttgtaattctggggtatgaatagaatcgagccgtatgtaaaaaagagtgacacatgcaatacaattttggggcatggtcaccctttatgctttgtttttattttggagagttagtgctctatggttgagttgtataggtttttgtgggtgacatgggatcaggagtatctatgattagaggtttgaggcagacacaa

SEQ ID NO: 15623 - DNA, 649 bp, Oryza sativa
ggtaacgagtttaaatattcgttcctttctttttctcattcgcatgtagttgatgacttaagaaacataggagtgaacctaggtgccactagagatttaatgatagaatctgttgataattttaaaaagtctgagtttgttagattcaatagtgcaaatcttgagaagtctgttgtattagaagggggggggggtcgaggagagtgttttttctgaaaacgaggagttagacaaccaggttcttgatcacttatgtggtggcttagtggaagagttgatgaatgaggatgattgtcacctaagttgtgactccgacatgcttatgaggaaacataatgttaagaaatggagaaagaaaaataaatgaaggcgagttaaggtggggagaaagtctaaaaataaaagaggttcaccatgaaaggattattttggaatagcagaggtcttaaagacttggctaaatcaagattcctctcagaaatttctaaggagcaaaagctagattttatcgctctattggaaacgggtaagaacaacttttcagactcgtggcttaaaaaaatatgtcgaggtagggacttcctatggcactggacaagaccaagaggaagagctggaggtattttgttgggaattaatttggactttt

SEQ ID NO: 15624 - DNA, 1501 bp, Oryza sativa
atatttcctgttcatgcttcaggcaggcatcaaatgtagagcaatcggcgcacgatctggcctaccatggcaatccgatccacgcctgactaagtacctgtgttagaccttgtcgaaattgcgagggacaaaaaaaagattgtcattgaataaatgatccatgtttctactttcaaaaaaaaaaaagatccatgcttcagctattgttcaaaagtcgacaggttgggacatggtgatctctttgtaacatagagtcatagactaccaggtcaaggattggacttgtgatttcttcccttggagctatcatttgaagttctagagcattatgtttggtttaacaaaaccaatcagaaacaaaagtcttcagctccctgctgaatttaaggactttcagttgaatgaatgggttgaataaccgttgtcaaagttcagatttttcatagcaaaggttaacaactacaaaaatcgagaaaattggcataataccatcgtcaaaacaggtttcgcccaaataccactatgcagttgggattcgccaaaatatcattctcaattgaggggcttcgccgaaacaccattttcttccaattctctctttcctttcatctttgctgaccaaaatgcccctagttgaattaattcaagtaaagcaaatatgtagattacagacaaagtacatatcgtccaaatatcttgacatgcaatatatttttttctttacaccaaattacagagtataagacactatctccacagcataaataaaaaaataattacgtattttttatgagagtttccgttgatagtgtctttttttttatgttatggatataatacgatgcatactgtgtaagaaaaaaatagcatgtaaaaatattttagcgtatttactttataatctacgtattttgatatacttaaattgattcaactagggccattttggtcaataatgatgagaggaaagagagaattggaagaaaatggcatatgggtgaagcccctcaattgagaatggtattttggtgaatcccaattgcatagtggtatttgggcgaaacccctttttgatgatggtaaaatgtcaattttctcgttttttttaatgtatgacattgttgacttttgacgtaatgtttaaccatttgtcttactaaaaattatatgaatgttatttattttgttagcacatattttatcatcaaataaaatataatcttaacttatacttttatatatttatactaaattttcaaataaaacaaatggccaaatgctatgcgaaaaatcaacggcatcagcatcatacacatttatttatgcccagtgctgcgtcgccacgtcatcagccagctggcagccggtcaacgtggctgaccaagcgccacctgcaggctgcggccgacatgtcctctgccaccgccgccgccggcggccgctgccgacatgtcgaggtgcggtccacgacagcagcaagtcgtcggaaagtatgctacta

SEQ ID NO: 15625 - DNA, 1092 bp, Oryza sativa
aaactccaaattgaatgcttaagatatatatgtacacacagatggagtcacgcacgcgatgaattatatatgtaattatatatgcagtgtaaggctctgtcatcgccatggtcgacgtctgtgggagagctgaagaataagcaggcggatgatgatgttcatcgtcatgaggattattccggcggcggcgtacgcgacgacgatgatcggcgcatgatggaggacgtggagacagatctggtcatcggacgcccgggatcgatatgatgaacgagcagcgctggctaacttcatctatccaatcaagaaaactctgtatatgtagttcggctggcagctaagctacaatactgaataacgtaacaattatagttttttttaaaaaatacagtacaaacgcaggaactcagaatacaacaatcacccatctctataaactcatacatacactttgtatctctataagcatttttgaaagacttgatatcttgagattgaagaatatatatgtatcaacatacatatgtatggatgcagtgaaatcgatcgatcgttcgatatgcgtatctgtattgtgttttaaatcctatcctattgattctttgcatccgtatgtgtgcagatatatgattaactaaactgaatcagctggatgttgggcgcctggaaaagtagctagctagctatagctagctattagtaaagctaaaattaatcaagatgagaggtgagtgatcgatgtacgttgtttgcttgtcgtggatatgcatatcattcatgtacgtatgtatgtatgtacgtatgttgccaaaaactggagcataaacacaagatagatctagggtttagatataaagtagtgaaaaacaaagtgtagtacatagcatttctgtgagaaaattatgaaggtgcaaaacacgcgatagcgagcgcagaggaatccaatcccgggccaagagtggattcggcccaacccaccacggcccacgcgacacgttgtgcgcacgtgctccgttcagatcaggcggactaggggagtactcctacgtgttaattaaggaagaggagaaaagagagagagagagagagaag

SEQ ID NO: 15626 - DNA, 215 bp, Oryza sativa
aagaaggaggggggagagagagagaggacagagagggcgaatggtagggggggactcgggatcgcggtattatgagggggggcgcgtttcggtcaggtcggtttgggtttggggttgcgttgcatcgggttcgcccgggtcaaccgcggtggatcgggtggagggagttgggccgtgtacctacacgcggcggcggcccaattttgtactggaga

SEQ ID NO: 15627 - DNA, 1501 bp, Oryza sativa
  unsure (1)..(1501): unsure at all n locations
ccccacgtacgccgcgcccagcctgctgtgctgcccgtcgatcgatcaaccgaccgattccaccgatctctcgcgcgcgcgcctacgtacgccacgcgcagaacgctcccgctcgcgtcaaccttgtattgcagccgcatgagcctgaaaaacacgtgagtaccccgcgcggggcgcgcgcgatacgtacgagtagtaacctgtagaaggacgaggatcttctaccataataacattatcattacaatcacaatcactaatacgtgggtttcacttttctatcgtttcacacaacagtatatataatggtagtgtcattataatagatagaactcgtgtacatcagcaaacgaccggtttcaccgatctcgcccttgccgcgcgctgctccgcctatcttgccgctgcacgtacacacaaaagaaaacgtgagctcgatcgagtgccccgatcgggcgagtccccgcgaaacacgtttatcgagttcgggttttcacagcgcgcgtcgtggcgcctttgcttgcctaaccttggcaggcgcatggatctgatcgatcgacgagctgcatcatgcatgggcaaatagggcaatgcagtgcggacgtgcggtgggagtgggacgggttcagcgcaggaaccaagaaaccggcagcgaacatgctcatggatatccctattccttctctcttttgatctcgcatgcgggcactttttccccttgattcgatccttgttttccagtggtctcaaggggaatcaatctgcaaaatcctgccttttttctgaagtagcacacgatcgaggccctttgagcctgtccgacagaccggtgatatgtccagctctgggtggtagctgcagaggcttcctggaggctggagatcagcttgctactaaattgcgttgtgtactgctgcattattatggtgatgaaatgacctgtgtgactgaaagtctgaaaccagtggagaaaatcagattgagctagatttctcagcagatatttgatgctacttaactttacatggtctggacagcaagaagctaggctaagaataaacggggaagtagccccatgacctaaaaagattggagatatatgcactacaatgatctctccatttcagactttgttcctgtaagtgggcacaatctagagagcaggcattgtcctacagtatatcctatcagcctccgtgtgcctttgcaggaggagctgcaaaaggccttgtgctnnnnnnnnnnnttgctgcctttcaccatgcaggagcgagtataaatatcactgcacaatgatcagtgaactgtgcgctctacacatgaaactaaatgtggcacacggatagaaataggttgagaccatgagatgtgcagctgcattgctgggcaagttgtcctttggcagatgttgcagttcatcatcgatgcctgggggttaccagactactgccaaaggaaatttgccccggaattcatctgcacaaacacacacaagaaaaga

SEQ ID NO: 15628 - DNA, 1501 bp, Oryza sativa
caaaatcatgtcaaaggcgaagcgattatctcgcggtatggatcataatacattcatgattgctctgtaaaatcagaaggtctcagatgaaaacgaatttatgcccctttctgttctcgttgttcttgctaggctcgggctcagggtcatcaagctccagggctgctgctgccacgactgcttcaggggtaaacaattcacaggctccggttgacacttcagctaatgttccagatggaagcgctatggaggagagtcatgtgttgcctgtgatcaatgaagaagctgcaaacaacgtagaggctgtgaacgatgacgaaactgtgaaccatgaggaggaagatatgagcgaggagtcagctgagggtgaagaagaagcaaatcctcctccagtcagggatgtggcgatggaaaacgagcttgcccatgaaatgacgggggatgccttggatgactatgatattgatgttagcaacgaagggcaggctatatcagagtacctgagcttactggattctgctgcttaggcttgatgtgcaaacatattactcacctggtctagatagtttttatcaaacctcagaaagaaatatagtcagcctcaatccgagagagtttgcttaatagggtcgatttgtacatgagtttacctttctgccacctggaaacttattaccgtgtgcttaagtaatttctcatggatagcaatctcagctttagaagttactccttgtgctatcaactgtatcttaatatgtgtagtacgtatgtagttcctatagttcctatagggtaactagataagctcgcgagtatagcacaaaacattgcaaacaagagttacatctgggaattaaattaaatagttttacaatacatgcatacagtacaattgatgacaatttccggagccactacatgtacaaattaacattgcaaaacaagaaaagcaaatccaataaaaaagaagttcactgaataattgaacatcccagaagcgagtggcttcatcacccgaccgatttgaccaaattaacgaccgaccttaatttgattgaagctaaactgtgtactcgagagagaataatgaatgcgtgcatggcttgggacgtgacgtgcatggtttgggacgtgacgtgcatgaggatggcttaggcgcaggtgtagccaggcgggacgtcgcagccgcagttgacgaggagcttgagcgcgatggggatgtagatgctgatgtcgagcaccttggccttgatggcggtgcagaggcaggcggcggcggacaggccggcgatgtccttcaccagcgggcagcacgtcacgtgggcgtcgccgatgtgcacctcgttgccgaggaggtccacgcacacgccgagcttgagcgcgtcgatggggcacgtgtccgaggacgacggcgtcggggtggacggcgtcggcgtcggcgatggcgggcacgccttcctcccgccgtgtcgcttcggcgggctcgggctcgggctgtagc

SEQ ID NO: 15629 - DNA, 1445 bp, Oryza sativa
ttccacctcagctgctccttcttcctctgctgcacctcagcgttctgagtcttcttctcccataaagaaggctcttagggctatcttttgcatgtgtgccaagacagctaagaaggtaaagaagatagagaggcgtcaaaaggatagattggacttgcagcaggcaagggatgtcttctgacatttctgatgatgaggagtttgttgatccttttgctgcttatgagactgctcgagacattgctagtggtgagggtccctctggcacttctcgtttcttcaatgaggagtcctctcactccgaggagagcagtgatgatgaggagtcaaatgcccctaccgagaatgttcttacagatcccgatgaggcagtggacgccgccgggcaagacatcgactctcctcactccggcgacaccgagatcattccttctgatggcgatgatgatgaggcttgatcctcttcttcccttgtgattttgtctctttttggtgccttgatgccaaagggggagaaaattgcaaacgaaggggggtcaaaattttgtttttgatgcttactgcctgctatctgtataatccggaagttccggatcctcttatctggaagttccggacctgacagctccctctccttattgtcatgtcagcttatccggaagttcctggtattttatccggaagttccggacctggcaatcctttgacccctattcttaagaactcatggacatgttctaattctctatttgtgtgaatgtaatgtctattagatgctcttagccgccctttatttatactgctcttcatttatgctatgagtgtcttatttgttgtttgtgttatgatgttgattttatcctcttgagtgctcaccatgtcgtatcttttgcatataatatctattcttactgctttttgcatcccatgaatgagtagggatgaaggaaactctcctcggttgctcccttatatatatgcatatgagcttctctcatatcttccatatgcatacattaagggggagtttcatttacctttaaccattcaaaacaaaatttaattcaatcttttgtaagctttaaccatgttgtcatcaatcaccaaaacgggggagattgaaagtgcattaatccccctagtgggttttggtgattaatgacaaatgtggttaagggactaatgagttcattgagtgactttcaggtgcattagtccaaggtgtggaagatggatgcttggagacccccaaaaaagtacaaaatcaaagcggaccggaactcgagaagggcataggatagtttatcttttgaaatcgagtttttaggaaaaactgtactattaagaggggttccaggtgatgctctgagatatatcaagtgctcttagtgtgaaccaagtgtcaagtttccctaggagtcatttttgcaaatactccatctgtc

SEQ ID NO: 15630 - DNA, 1011 bp, Oryza sativa
acttgaactgtttttctcaggcaggctggctgacggaacaatcaaaactagagggcatttccggacgtgtgattgcgatgagacgtgttgcaatatccagaccagtggctagacgtgttaattttaacttgatgaaacgtaagaaggctggatccaaactttaattcttttccatcacatcaacctgttatacacacaatttgttatacacacacaatttttcagtccaaaatttacgctgaactaaaaacagccgaagtttgagttggaaaaaaacttttttggatttgttgtgatatgcccattaaacaacttaccaagcgattaaagactgtgctatacgtgtgatccagttgtatgatttatgtataattagagatatacaatcatataattagagacaccgtccatttttgtccatgtgtcataagcataccaattttcggtgattaatcgctaatcgacaaggcgatcacatcaaatatttagacacatgcacggagtattaaatatagaaaaaaaataattatatagattgcgtgtaaattgtgagacaaatcttttaagcctaattgcgccatgatttgataatatgatgctacagtaaacacttgctagtgacggattaattaggcttaatattttatctcgtagtttgcaggcggaatatgtaatttattttgttattagactacgtttaatactttaaatgtgtgtccgtatatctgacggagcacacacaaacttttcacctgaactaaacagtgcctaatttatcggactaatcggccgttttattgcgtccatgaaacaaaaaccgttctgaactgcctcgactcccgtctcctcgccggaaagccgccgccgccgccgcccttctacttccgccgcctcctccttcttctcgagaaggctctgcaccacagacgagagctgagccgcggagcacaatgtcggcggactcggcggcggcggggagggacgctctcctggacgagctgcgcgcgctca

SEQ ID NO: 15631 - DNA, 430 bp, Oryza sativa
aattcctgcagccccaactcaattttagaagttttgagccatttaaatggatttctagaagttaaaccgaatttattgcgcaattaaagctatttatggcgtcagccgaggggattaggtggcgccgacacgcagccccacctgtcggtgagggggagggcgcacggtggaccgagttcacgcgcacaccatctgcgggtgcaccacgtggtggccatggcggacaggtaggcggaggtggcaccgacgtggcgtcacgtgggagctgacacggggcggcaccgaggggccacgtggatggcccagattgccccaaagggggatcaggcagccatggcgagcgggaggcggcgaatgcggcggcggcctcgggttcgcagtggaggtggtgattcggtggcggattggggaaatggagcaaaggccggca

SEQ ID NO: 15632 - DNA, 1501 bp, Oryza sativa
gtgtgttttactataaatgtgggacatcaatgtgcatgtatgcaaaattcttttaccataaaagggcattaaatatattttttagctatcgcagaaaaaaaggcaaagaagagtgcatgcatacttgttggagccatcggagaatatatagaattttatttgttagatctaatggtatagaacaatcagttaattagaaatttcgtcaccataaaagggcattgattatcttttaacaaccgattataacaaccacagcaaaaaaaaaacagaggaaaaagggcacatgcgtacagaggaaaaacagcaaggttgaagacttcagaattttatttggtagatcaagcggtttattagaaattttatcttttaactactgattaaaaaaaatctattaactaccgtagaaaaagaagagaatggaaggaaagcagccacatgcgtacatggctgcacccgtggattttttccttaaatttttaggatttttgctgaattttggagtccaacaacgcaaatacatggattgcacccgtgggtcctttatctcctctggtcgcaccacgtggcagcttgagagtgtttttaggatgccacatgttaacttgagagtgattttaggaagtttaatggacttttagtatataatagatagatagatagatagatactactaagctggtgtaatatgggggactaatgtacattggcaaatggataatgagaggagggagggggtttggaaaagggaaatgtatgaatggttaggattaaatgagggtgaagaatggatggttaggatacaatattactctttggagaatgggattatttccctactctatttgccaaacaaaacctaaaaagtatcaccaatgtatcaccaatcatggcgtacagtttagaaagtgtgtgatttaggcatggggcggaccacgccctttacgacttggtctctcggtttgttagacgagaaatcaactaacaaaagctacgatacataatgtacactatgtcaggatacaaatctttacaaataacaacattaactatccgacagctctattagctgcctaggcttaccgacgtataataaaacgtcgatattccatattgctgatatcggtaaccgtttgccataggtttttttgtccaagctttgaaaaatttatggatccaccattgctttccaaaaatgaaaaacaccgggaaaaaaaaaccatttgatagcaacacaagacaaaatgatgttaatgtctacccgagctcctattccgtaccagcacaaccaaacgaacagtacccgccgggccacgggcatgtttgtaaattttcctcccgtggctgccatctctcgcagcatctgcccttttgaactcgccaagagccaacaacagcgccctcgtgccccctccctcctctgcaataaacaaccacacgcgccgcacccatggccaccctcatcgcaacagcgcaccaccaccaccaccgtctccagcca

SEQ ID NO: 15633 - DNA, 1501 bp, Oryza sativa
catctagggatttaattcagctagttgctctacaaacctaaataatcattaaggaatggaaaacgctgaacaagtgaacaatatgttcgttaaagtcggcatagcaagcatcatcgaaagcgttacgcaattagatatgtataagagctcaattctgcgttacaaaaatattgaaaccacaatagaagaacagaaatgagtggtggattcctataagaacccaacatgcttgccgttaattccacatttgattggaagtattaattctataggagtatttaattgttttcggaactttatagaatttaatttggtcatatgaccaaaaactcactggtggagaaatgctttttagtcccggttcgtaaccccctgtagtcccggttttccaaccgggactacgaatccgggacaaaagatcgctatatttagtcccggttcaaataaccgggactaaaaatcaatttttagtcccggttggtgttaccaaccgggactaaagatggagcatcaccaaccgggactaaagatattttttcttttttttttctgtttttaatattgaatattgatttcacaccatcccctcccatatccaaatcatcacatattacagaacatctccaaattctcaaacaaatcttctccaaatacatcacaaactcttaaaaaaaattacatcacagggttctaaaaaattcatcacagattcacatctcacataaaaatacatcacagattcacatctcaaaaaaaaaaagaaaaaaaaatccggccggcggccactgccgcctcccctcctcccctccgcgccggccagccggcgctgcgccggacgctgccgagcggccgcccaccgcagccgccgcctccgcgcggcccccggcgccgccgcgccggccgcccgccgccgccgccgcgcaggccgcctccgcgccgtcccccgcgtcaccgcctccgcgccggccgcttgcacttggtgaaggaaaaaaggaaggagaggaggggagttagagataaggaaagagataagaagttagagttaaaaaagagatagagggaggagtttgttgtgtggacgggaaaagaggatcggtactatagattatatagtgtgttttgatttttattcccggttagtaacaccaaccgggactaaaaacctaaagatcatagggccctaacacagcctgacatggaatcaaccgggactaaagtttccaaccgggactaaagatgatttttagtcccggttggtaacaacaaccgggactaaagatcttcctcttattaaccgggactaaaaatcatttttagtcccggtttttaatggaaccgagactattgtggatttgggtcgaccgaccaaagatgatttctctaccagtgactgaactatttgattggaagtattaattctataggagtatttaattgtttttggaactttatagaatttaatttggtcatatatatagttcagtttttggtcatgaccaaa

SEQ ID NO: 15634 - DNA, 266 bp, Oryza sativa
ggatcatgagaatatcttttattttacaaagatatataaatgagagattctttcataagccgcaaattttggtcaatgtcgcccaattatcttcttcttttttttttgtgtgtgcggagagaggaggtgcacttgctggagtacgtagaaaagcgagtgtgacatgaaaagaatcgttgcgagagatatcaccctgcagagtgcagtagataataatctagctgctgcctgcacttggtggtggggtggccagtagatacaagcga

SEQ ID NO: 15635 - DNA, 1055 bp, Oryza sativa
ttttcccccttccgttcccctctctcaaccgccgctccgccgtgcctatggccgccgccggcgaccataggggcgcgggcgccgcctcccgccggctgcgccatcgtggccgcctccgggcgcgccgtgtggccgccgcgtggggcccggccgttagccgcccgtgccctcgggtgcggctgacgcgtggggcccacagcgccggccggtgtgagcccgggtgcgcccggtccaccgaggaccatgaggctgccgcgtgggccccactcccgtggacccggtccacgcgccccctcccctcggctgacgcaataaacctttttaaattaaaatttaaatgaagaaattcgcaaatattcacttaaagaacatataaacttcaaatggccataacttggccatttgaacttggaattggaccgttcaaatctttaatttttccttaagaagtcaagaacccatttttgtactttgttcctgcttgttatatggagtttattagagtaaaagcctttttcctttccgttggtcgtgtagacgctgcagcttcggaagatccgctctacgtggaggttgaagccgacatttgggaaagcgagcaaggcaagtcacatcatccttgagcatattaaatccccgtttgtaaaattattttgatttaaattaatgcattatcgctttatttaaattcccgcgttatcactattttatttagtcatgtctatttacctttgttatgaccttattattattgttattgttattattaccttgttcaccctagaataaacaaaaccccgactagtgggtactctaatcatggtaccactagtatgaatttaggtagatgcttcgctgtttaattaggcaacattaggtggttttataactctagactttgggaatattcatatcacttggacattttggaatggttggattattgtggaattggatacacaccttcccctctattcaaaaccctcaaaatggttttaggccgggctcggggtgcatggttttgatagtagcacctcggccacataaggaccggt

SEQ ID NO: 15636 - DNA, 1501 bp, Oryza sativa
aggcaaaatagacttttgcggaggaatttgatttggaaggattggattcggaattggacttgacgatagatcggggattgagatcttgagatggcacggacactagacaacaagcaaagaaacaaatttcgcaattagggtttttaagagatgattttcccgctaggcgccacgacggaacgggcgctacagagggcggcggaagaaggtgcttcctcggggatttgcttgacctgtacccgcgtagtgggaggcgatgatcgacgaacggcagcaagtagccaatggccatggccgactaggggcggcttcgttttctttccatgcgtggtttttccccttcgctttgaccgcatatgggccgaaccatcgcgcttctggactggtcgaaagagggcggaggctagagaaaaccggcgctgccgtcagatgcgaaataaacggcgctcaagccttctacatccttctgacgtagaatcttctacgttagaggatcttgttccctcacctcctagtgctcgtcggtcatggatccaagcttgcagcccatcattttgacatctctaggctagcggcggcagcggcacatgcttgacgcagaggatggttgcacttgcacattccctttccaccgatgttttagttcattacctatcatgtccctgttgattgaataacggtttgatttaatttgatacctggtgataccagtacctgaaggtataacctaatgcaccggaacaaagctctttttagtggattcgagtaaggaaataaactgctcggtagctgaaaatttatataaataaggctgaattcaaggaggagtcgggaagaccacatcaggatggtctcatattttcttagtatctctcttaaataagtaggattagtttttttttctagttatgaaatcttatctcgtgttcgatttagacttgcacaaactccagggtataaatatgtacacccaatgtctttttacatcttttgtcttaggatgggctgcatgagttaagttcgatctctggcgagaaatcaagttcgaggccatgctctcgagttggactacatcggttaagttcgttcactggagaggatgtaagttctatcaactttgtttgtattggcttggttagaacattttcagctaagtccgatattctaactagactgttacatgctttgcctatcagatatatcaactctatctttaatcgcatagctgtttagagttgtatcggcttagttaggattttcttggttaagtctgatattctaactaggttggtgtcagggttatggataccacatacccatagtaatcgactaagctcagtggggcccaccatataccaagtcttatacgaaatcatacctcgcatatagaaggagtttcggataaggaaagaaaaatagagttttatttgaaaactataagaactaatcggattgtatccatacttgactccgtagttctacttgggcaagggaacatcta

SEQ ID NO: 15637 - DNA, 1501 bp, Oryza sativa
tgactcgctgaatgataaggatcaggcctcctaaaaacaaaatccactaaaactagattgtgagtgaaatgccatccagtaaatagaacagatgaaaactggaagatagatatcacataatcaagaaaaattccacccacatatatattgggtaaaacaccgcttatatttatatatattgtgagtgatgcattaagatgccttagacattgaacaggtttgacagagcatcctagaaacaccagtggagctaataataagaatagataccacatttaccttgataaaagcacagatgaaagttaaagaaaaagcatacagaccatgaattacaatcatgtctaaattaatattgcctaaacaggtatgattaatataactacagagtaaatgaaacacaccaatgtgcaaccaaaacagaaacaatatgattatttgagctttgaaaagaagtctgtaaaacaagaaagaataacttttttttctagaaagactagtttcaataattttgtctagatacagatatgcactaatacaagttattgcgcaatatacttactcatcttttccagtttctcaatctgctccagtatagcctctggatcctttttcaaaatcccaacctctcgtactttcttcctttcttttttattctggcaagtaaaaaaggtgatgggaatttagaatgtgaggacagaacaaactaattggtatctaccgtatttatatcagcaaccataaaagaaatagaacttaacaagagtacaagattaaagaaaatctgtaaaaggctagattggtttgctacacttaccgaaatttggtaataccgaaattttggcaaggtagcaaaaaccaaacactccaacaaaaccttcttccacaaaaatgttggcaatgcccatatatgtgcctcataatagcccaattttagcaccaaatcaaacctcttagccattctacactaccgaaatgtggcaataccaagattttggcaaggtacagaaccaaaccaaccctaatatacaagcagtcatacagatagtgggtacacgtgcaacaatcatggttgtcaagtcgtaaagtcaagtcgaggtacccctggaccgacttgtcgactagttgacaacttgtccagttgtccatgacttggtcatgcaaaaacaggggatgcaatatatagtataaactatggactatggagtagcaaagcaagacaataagtcaacaagaaataaaacaaaagtactaaacacaataagccaattagcatggtgaattagtgatttgctacgactaatttacaaccaactttacgactaatctatgactaaccgacttcacgactaatgctattttgtcgagttgtggctctctagtcgactagcttgaccgattttacgactaatcgcgactagtcgggtgacttgataacagtgacaacagttgccacatttctagataaaatggcatgttataacattatatcaatgtgcatatg

SEQ ID NO: 15638 - DNA, 1501 bp, Oryza sativa
tttttgtgcagcgacttactacctccgtccaaaatataagtatttttagaaaatacagatttgcactcgggttcatatgtacctacaatctacaccgttgatgtgttccaagattcatgctgcaaaatgtacctaaccttaaccaaatgaatatagggagaaaaatattaggattaggttggttcacaatatgtataacatgtatgttgcattttttaccaaataatttttttcaataccaatcatatatgacatttatatatatagtgcattgtatttttctaacccttattttgtttataacatgatatttagtcaaaatgagaaaccaatatatctacaatatcaccaaattgtcatcttgcaaaaatgatacttccaaaatgatatatatatcctaccatcaaaaactacaaaaacaaggtaatttatataaacaaggtaaactacataaacaagttttacatacaagaaatacaaaaattacataaacaaggtattttacacttgtaaaaaatatagtataacgtaaacatcatgcatcttacattttgttagcacctaatatacttgccttaagattcgcacaagctacatatagggtgtagattgtgggtacatgtgaactcgcgtgtaaaaaatccaactcctacggaggtagtacctcccaatttatcatactccctccatcccaaaatataagtaacaactactcataacataaagaacaagaaaaaatttaatcaccttattaattaaattacatccatacatgcaagcaatgtaattgggagacttaatggtacatgaaataaaataaaccaaatttaaaggaccaagagatgataattaatgtatacatgtatacacgccttatattataatataagacatagagaaaaactgattgtgacttatatttggatagatggagtatcatccttgctcttcctggaatcgagcttaaaagcctgctacactttaagaacaaaaaaaaaagtaataagggatcaaaaaattttgcctaacaccaccctacatcttgatagaccgtgcagacatatttatgcagaagtacgttgtcgtgtactgcctagtaaataaacacatcttatccactactatgtcagtcccaaaatacttatcattttgagtttttatttgtaatcattcgttttatttaaaaaaattataaaattattatttattttgtttgtgatttgttttgttatcaaaaagtactttaagtataacttatctttttttatatttatactaattttttaaataaaacgaatgctaaaacattgcaaagaaaaaatcacattgacaacaaaactgtgggatggaggatacgtgctgctggcttcctacagacgcacttaaaagtgccatctgctgtcttggtgtcccactgactctcagagaatcggccattgaagaggaatagctcctatctattgccgcctgtactaatatgaatggcgcttgctcccgcagc

SEQ ID NO: 15639 - DNA, 981 bp, Oryza sativa
cctgccaaacgacacaaatgtattatgggtctgtctagtttttcaagcatatgaaaatgggactatctattgagctttcgacagaattgtagtttagaatcttgtaaaattttcaaccaatgcatatagcccgttttaaatgaaataactaatagacaaacatgtcaaaaactgtaaatctagaggaaaaaattgttataaaatcaactttggtgcactgtaactgagtgtatgaaactataagttgaacatacaagaacatgaatcttgatgcaagatcatatggatgaaaaaagtgaaatataggagccttatcgcaagtaaaattacaaaaccgtatgaaaacaccataaatttatggttacatttttagacaactaggattgcgtcgaaattcatatgtaaacagtagagatatcatttccactccccaagcccctctccaccctgacccctacccaaaacctccaaactctaaccttcctaccgccacatagttgccgaagaagagctcgccatctagtcaccaccgcatgaaagtagttgtcatcggtgagtcaccccctcctatttctcccaaatccaaagctaggttaaaggtaactaaaattcaaagcaattttagtgacctaaacaagttaagaatttgcacgtttgttattagaaagatgggtactccctccgtttaatatagtaaattattttagctttatcttaagttaaacttatctaacgtttaccgggtttatggaaaatatacccaacacctataacaatatatatcattaacaaaatatctttgatgggtaatttaataataaaattattctgatcttgtagatgttggtgcatgctgtcataaactcgatcggtcaatgtttaacaaaattgacttagaaaaaatgatttcttttctaaaaataattaagaacacggccctctcctattcaaaccagatgtacacagccatttggacaaaaa

SEQ ID NO: 15640 - DNA, 1189 bp, Oryza sativa
gaatccggcgagtcaaagggatcgagcagttacagttatcaccacgactcgattcggcgattccgcgagggccaccgcgcgcgtcggtctctctatctatcggatatactcacactggcaatcggcaaagcgtcactcgagcgtgcgcgtgccagcctaagcccccgcattgaattgccacgccacgcgcgggtggacgggaagggaggggagcgtcctcagtaaaatcgcccggctgccgcagcgcgcctgccactttgctcgtcgtccgtggtggaggcgcggtggggtggggaaggagtgtgtttcgtgtgctgtgctgggctcgcgcggctctcgtcccgggctcccggcagcctggggtttctctccccgtttctgtttctcggtgaggtgaagttttccgtctcagcacactgccagttcttcttcttgttcttcctactcgtggcgccgcggcgtcctcacggatcgcaaggtcgggaattatctggggttctcggggtttgtggctcctttccggtgaaaggattcttttttagcgggagatcggttgagtcggtttcttctgtagatcttatcgttgagatttcgttgtttatgttaggcgagtcggggtgagacttatccgcgttcctccctgcgatgaaacacgcgattttggattgtcgttacgtttagggattgtggttttaaggctgttcttccgttgtaaatgttggttgcgccatcctataaaagaaagggactcctgtcgagaaacacaccatgcttcttctgtcctgaaggtttggaaaggcacattctgaggagatttttctgtcctacatcgtaggtatcgagattcatctctatcttccctgattttataatcgattgatgccgctcacagttttatatgatgtgatccaaacaagtatagcaatcatgatgtttgaaacagtgaaccatcattcgtattatgaaacttctgttactgaacagaataaatagtttgctgggtttcttaatctatggcacttcttcgttgttgcgattcatagtattattataggtcctacattgacaaatcttctatttaattctgtagcattttaattctgtgtaataatacaggacaatttatgtttcattcctgcgtgaccaatctaatctgaacctacgttgggtgcgcaaaagcccttgaatg

SEQ ID NO: 15641 - DNA, 202 bp, Oryza sativa
cgccacgccacgccacgccaccgccgccacgccacgccgccgccgcatctcccttcatgcatttcgatctctccgatctcgatctctctccgtcgccttcgacgccgcgcaacgccgccgccgcatgccaacgccacgccgccgccgccgtggccacgccgccgccgccttcgccgccgcgcgcgcaatgccgtcaccgcca

SEQ ID NO: 15642 - DNA, 327 bp, Oryza sativa
aaatccatttgcaaagagcatatgcaatgaaaaggattcagagggctcttaggtttagagggctcttaggtttccatttggcttgtcatacggtcaaggtcggctctgataccaacttgtcacgcccagaaattcccgaatagaattccaagcagaatgtgcattaaaatccccgtccaggaccagccggggtacacaaacgacaatgttgacattcagatccacgtcttacaaacatcataaaagtcttacaaaaaatgcagcggaaaacaaaaggaactggagctaagccttgactaaactgcagcgggaacaccactccacagg

SEQ ID NO: 15643 - DNA, 1501 bp, Oryza sativa
ctttcctcttggagaacagccatggctttatctctgccttgcaaaggcaacgattcgaggagtcgtcgactgcgacggacagagcctgccccatggtcatcttgctccaggtgacggtcacgctgcaagatttgccacggaggcgggctaggtaggtgcactgcaccatgttctggccacctggagaagaggaatgggcgacctggacgccgctttgacttaagcaagatgcaaagtctctcatcgtgacgatggcgacggttgcaagttgcacgcccaccttctcctttgcggctttctgacgaacacctcgtgcgcaaccgccctacttatcactcacaccgtcacacgcacactccgagcaggctgttcccctcggttggaatctggattcaaaacatctgcttgctccgactgacggctgaaaagaagtgaggaaaaaacgatgcatcaaatccgcatctttgcgctcgatatcccaagatttccccccaatcaaatccacgcctgttaacctggaatctgaaacaacagcagcaccgcaaacaaatcaagaacccgaagaacggaacatcatttaggaactcccagagatcaaccagagaaggagcagccatacctttccccccgacgaaatcaagaacaccaccggcgaagaacggagcagcgggagcctcagcaatcagcagcggacactacagagcaaagccggtgggcggccgttttcacctggccggctgcgccaagaagaatcaccacccacccaaccgctccacaagcgaacgtgctccttcccctccctccctacccctcaggagcagtaaaccagcgccatcagcaacaacagcaccatcatctctctcgctctcgctctcgcttggtccgttaagcttcgcacttcacagcagtacaggagtaggagtacttctgtttgtagcgtaggaggctcaaccaaaagcagaagagggcgggaggaagaagacaaggggaggggtgcgactgcgagggcgaccgccaccagcagcagcgtggcgttggggaatgtgggcagcagaaaagacgcggaggcagacaggcaggcagcaagcggccgaggcagacagggcaggctcttgggtgtcgggaggtggagggcgcggctgcactgtccagtcgcagcgagaggtcgccttcctcgcggacatgtgagctccacctgttcgcacttcgcaggcacggcctaaaaccccgtattatacgggaaactttggtcttctcgtatggaaaatgtgttgtgtagagagggagatgagaggtgccgatcacaatacagtgtcacgttgtatacagtgtatgccaggaacttcgatcgacataggtagtcctcgttcttttcttagcatatcatgtcggtttggaactttggataggaactctatgccgtaagagcaagtttaatagtatagccaactactagctctaattttactgagcaaggttaacggtgattttactgagcaga

SEQ ID NO: 15644 - DNA, 1501 bp, Oryza sativa
cttccttcgatcccatccatgtccaggttgatggccgccatgctgctcggtggcgcccgcgtcgccggtaacaccaccaccgccgtgatggcgcttcatcatccgaggccgtcgtacttcctccctccccggccgcggctggcggcggcgagctggagccgcctccgcctgcagaccgcgccgagatcatcccaggtgcgtaccgttcgtccgtcgtcgatcgccgtcgccggtgagtgatgggtgttgttgggttggctggctgacatcaatggccgtcgtttttgttcggggtaggcgtacgacaactcgccggcggacgaccgaagggacgtcggggacaggtacagggacgccgcggaggaggcgaaggaggccaccggcgacgccaaggagcgggtgaaagggatggccggggaggccaagggcagggcggcggacattgccggcagggccaaggacgagaccaaggacacggcgtcgcgcgcggccgacgcggcgtcgcgggcgacggaccgggcgaagcacgaggccgccgacaaggcggcggacgtgaaggaccgcgccaaggacgcggcggacatggcgcagggcacggcgagggcggtgagggacaagacggcggagacggcggagggcgccatggacagggccggcgaggccaaggacaggacagtggaagggacgaagcacgccggcgagaaggtggcggagatgaccaaggaaggggcgagcaaggtggtggagacggcgcaggccatcggcgagaaggcgaagcaggcggcgcagggcgcgtggggcgccaccaaggaggcggcgcagggcgtcaaggacacggtcgccggcggcgacgtcgacgccgacgccgcgatgaaggagcaggacaggatcgcgcaggaggagaagaagaggcaggccagggagaagggcgctggcttgccttaggctaaaactgcatacttgttgcatgcttatttgtactaaaagcttttttttttagctgaattttagtcggttcagttcttttggttgaataatgttggcaaacttgagcctcctaatgtctgtaagactgtaactgtaatggaaaggaacttattgaagttattagccatgcaatgtaccaatgtacactagtagactgtaggagttctaatacgcctttcatacaccacatatttacttgtagactagtaattataatgcgcctttaatacgccacatatttaacagtttaaggtgactctaaactgaaaagcagtaaacacatgaagcggataaaatcagtggaaaaacagtgagctgagctgtgaagacaatttttctgacctgaatcaatctaattgataactttctggaaccttaacgacatataaggtactggaagagagacaattccagttgagaaagaaatgaactgaagccctgacaacactggactgctcgagtcagaccagagctaaaaatatttacacagaacgaaatgatcatcttttttttg

SEQ ID NO: 15645 - DNA, 1501 bp, Oryza sativa
ggggtgagagccgccgccaccagatctcccttcatgcatctcgatctctccgatctcgatctctctctgtcgcgccgcccgccacgagacaccgcgccacgacgacgacgcgccacgccgccgccttcgacgccgcgccacgccgccgccgcatgccaacgccacgccgccgccgccgtcgccacgccgccgccgccttcgccgccgcgcgcgcaatgccgccgccgccacgccccgccgccgccgccacgccacgccatgccaccgccgccacgccacgccgccgccgccacggccccacaacgccacgccgccgccgccgtcgccacgccgccgcgccaaccgccgccctgatgccgccacaccgccgttaacgaacgagaacgagaacgatcgaacgaacgagagcgagaacgaacacgtcaacgtacgttgccgcgacaacatgaacgagaacgagaacgatcgaacgaacgagagcgagaacgagaacgatcgaacgaagacaagcgagaacgagggaacgaacgtgaatgagaacaagcgaacgaacgtgaatgagaacgagcgaacgaacgtgaacgagctagggaacgtgaaatgcaatatatatatatatatatatatatatatatatatatttgtatatatatatatgtatatatatatatatgtatatatatatatgtatatatatatatatatatatgttacttcgcatttatcctaatacatttttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtttgacattattgactacagaattggtgcgactcctagcaattgactattgtagtcttaattagatttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagactgagcacgtaaggttgtgtagggttctaatgtacgacatttacacttagcatacatgacttagattgttaaaacataaatgtctcgtgacttagcagatgtt

SEQ ID NO: 15646 - DNA, 713 bp, Oryza sativa
ggaggaggaagaaggactgacatgtgggccccacatgtcggcccacatgtcagtgggcctacatttttttgtgtgaatgactaatgggccccatgcatattttttatttctaccgctacgtaagtgtcacgtcaacaccatgtgtaagaaaaactcggtcaatattgccacgtaggcgccacgtggcgccacgtcagcaaaacagcctcctaaaaccgccaagggagttaaattgcaccggttttaggagtttgggggttgagatatccggttttgtagtttagggtcatggattagatttcgatcacatttgagggtcatgaagtgaacttattcctcaaaattatggatcatgccggatgggattgggccgacattctcaaaggttgggccccttgcatgggccaaatgtgggacttgacagcccaaagagaggtaatgggtcggaaatctggcccatcccgtttatcctttcttgacttcgtgtctccgccttttcttccgtccagccgaggcggcgaggactcaatgcctcactcataggtcatagctggatttaccttctgcctcagctccggcgagggaggctgccggcggcgaggcatttgtaccgtctctcatcctcacccgctctctccccccgttgcatcgtcccttgcgttgtggacgtttcttgctctgcgaacgcgacgcccgccacctgttcgacggaa

SEQ ID NO: 15647 - DNA, 772 bp, Oryza sativa
tcaaattcaatttcaggctgttggaaacaaagttatagagacaaatgaccaaaataaaagttgtagatcttgatgagaggatcaacttttttgttatgcctttctcatttgaaatcatttactatttacaaaagctgttttaatttgtcatattttcaaaatcaattttaagctgttggaaacaaagttatatagacaaatgaccaaaataaaagttgtagctcttgaaaggctctacaattttgttgttgaccatatttcaatttcaaatcatttactatctgaaaatgtattatgactaataaattgaattattatatagcagctatatattttgcactcacaaatataaagaattgatgggaaaaatggaaaatagtcatcggtgacgggccttagtttaagcccgatagagattaatctatctttatcgtgcattgtcgagggcccgtcgaagatgagtcatccgtgacgggcctaaatgtcatctcaatcgggcattagtatggagcccgtcaccgatgagtcatctgtgatgggccctacggcaatgcccgattgagatgactcatcactatactataactagggtttctcagatcggatctaaaatttttctaagtcccgctacagttcccgcctccttagaaccctagcaccgccgtcgtcctccattgccgagcccgccgccgtcgccatcgagcccgcggtcaccgccatcgagcctcctccgccctccattcgaactgccgccgcctcctcaccgacaacc

SEQ ID NO: 15648 - DNA, 1501 bp, Oryza sativa
aaacaagtcatattagtgttgagatattttttctacataaacatggtcagttgtaatcctttaccattagcattctatgaaacaacaaatgaatacattatttccctcacttcactgtctgttgaaaaatattttatttatgacgaaaaactatttacatttgtatttgtatttgtatttgtgtattgttagtgtatccagtcgaggaaacatgtcttatattatatttgtatccagtcttatattgttattgtctaatattgtttccagtcatctgagaagtatttgaatttttttattacaacttttgtagtcttagaattgcaatttttagtgaaaatattcaatttagtatcctacatgcaatgaacatattatctatacttgtgaactagttttatgacatttataactggttactaaacaagaatgttatgtcacttatcgctactaatgtgtcaaagaaacacttatcgctactaatgtgtcaaagaaagtaacaaagttatcttgaagatttgccacacaagaagagaagctaacaaaatatagctataattatggtttggcccaatgctcatctaagttgaaccgtttttttcatatttgttttcaagatctagcctctataccaagtttgagtgggtcgataggtgggagaaaacagctatattttttacttatccctgtaaactatcgacatattatactactctcaagaccaaagttaagatacacaaaaaaattctattagagagtataactttctttaataggacatagactacatcagtagcaacttgaatattctatgatcttgtacccgctcgatgtaactgggcgctaagaccccctatcccgctcggtataaaattgactggggccctagtcccacctggtgtaaaattgatgtttagttactcacaataatggtatttaaattgtttagttggaaattatacattgtataacaaacattaagtctattcagaattacggttgaggtggatcttgttacatatataaaatgttgcaactgatccatcaagtggtgcacgccatcaacaatcagttcaacatgcatgtcctctgcgccctcaggtttccactttttatgtctgatctaagttccttctgaattgcacagggatactttgatagccggccagcatttgatgctaaataaaggggctttccaagcacactttataagacctgataatttagcctatcggagaaactgtcccttcaatcaggagagttggataatgattttagggattccttcggattacataaatgagactcacattcataggattgtaaacgcttttgggaagtttatacattggcatcacaaaatagtgttcttggcagagttctgggaagttaatccattggcatcaaagagatagtattcttggcagagttctggcaaaatgtctttatacagaccctagtgaagtgcctagaagaattgttatggaaaatcctgttaata

SEQ ID NO: 15649 - DNA, 745 bp, Oryza sativa
aagaacatacttcctcgtatggaccgtaccaaaaaaaactaacataggattgagatgtaacgtaacctaacataacgaatcttggcagaagactatctagatttgttgtgctaggattgagatgtaacgtaacctaacataacgaatcttggcaaaagactatctagatcttggcaaaagactatctagatttgttgtgctagattatgtccgtccttatattagattggatttttttaagaccgagagagtagtggccaactggggcagacaaagctactggtgactaatcaggttggtacacgtggcgacttgtgatttctctggggggccgtaggctgcggttagatggcagggtcaacctccttatcggcgatataaatggcgataagatgggccatgcatgtcgttgacaatgatttgccatcgcttagctgctaccgctcccacaaccgacgattccttgagacgttttaaccgtacaaaaaatgaagggtaatttctacagcagcagtagaaattactgcctaaataaacattttcaaaaatttatattatcaaaaatttgataaattgacaacattattaagttttgataggataaattaaatatgatgttgctaaatctctatataacaaagtaaatatcgttatatatttgttaataacaaataatgatacgatttaaattaattgaacatattagtactacgaagaaaaaatactgcggctagatattgacaaa

SEQ ID NO: 15650 - DNA, 1501 bp, Oryza sativa
aagttgttgttggcataggttcaacaaccaaatctggccatatggattagtagatggcttgatcgaaatcctttgagtcatatggactatagaagacgccaagctaccttcgaacaggtcttcgctctcgagtttgaagcttccacccccattaatgagcttgcctctctcactgtgtcgctatcaagctctttgctcttgagttcgttgttttgatcagtatcacttagtcatgcgtatcatctctcatcgatccttaggggtgggcataaaaaactgagatcgaagaccgagactggaaaaaccgaaatcgagaccgaagaaaccgatctatcgatcatcggtctcttgatcggtcatgtgtttcaaaagaccaatccttttgtcaggcttcagtcttattcctcagttacccaatcagaccgatcttggtcttgggccaatactctcagcacatccactcaacgagaggttaagcccaacaagtctaccacaatagtctactatcactcatccccatctagtgctacaggtacaaccctaacctagctgccactcgttatgacgaccgccacagcgccacctatcaccgtatcgcccatcttctgatccccgactgttgcactatcgtgagatcagtgaagatgtggactagatcctgccggcgagcactcttcgtttctttctctccctcccatcctctcattctattgtctgtggagggggcgccgtcggtggcggggcggtgagctctgtcagccacgcaggggaggctaggagggcacgatgcggagagaacggaatcgacagtcgggtcgatgaggtcgccggaggtgggaacgagatcctgcagcgatagttccgatgccgtcgctctcgccactagccctgacgcttccctcgtcaccagtctacgcctcgatgcgccgcctgcctctccgatccttccgtgttcggtcaaatcggtggataccgaagaccggactaaaagttcggttacctgatctatcggtccacgattttttactaagcacttcggttttcctttctcaataaccaattttctaaaagaccgaactacccggaccgaagtttcggtcttaaccgaatgcccacccctgacaatcctctatatgaacttaacttttacgtagtttctctcaccacatagcttttttttaatgcttaatgctaagatgccccaaccagctaatgatgttactaggggaaataaaaatcaatcgtgcttgtgtattagtccaaatgtaatcttggcccacctgtcattgacaatttggcacaatctatttttttttttgagataggcacaatctaattgagtacgtgtcccacctgtcagacaaaccaactgttgtatcgaggattctaggcccacctggcaaagtgagccttaacgggccggatctgcaacctcccccttgttggatgcttcagatcgtctcctcttcgaagctagtccagcctgccgggccactgcctc

SEQ ID NO: 15651 - DNA, 1501 bp, Oryza sativa
attctttaaaaagagggttaaataagcgaagttaataatttagggttaaattgatagttagctttccgtatgtgcaatggttccttctataaaaggcttggatgtcctgtcatgtcctaagtacccccatcatcctaccgggtcatgtgcacaattttcaataaaaagagttggatgtcctgtcacctattcatgtctcacgtatgtctcgcttagagtaaggctaataatacagacgatttgttggctataaggttctctgcagacttctcttagcccacacgtataatagttagctatttacaattaatacagtgtctctctcacataatttcatggttcttgtgtccaagccagctgtaagtttatagcccgcttctcctctctctcttctctcctctcctccaccttagcatttagccgacttacaacctcttattatacttgctcttagggatagcagttttacctacgggtcgggtacccgcagatacccgacccgatgggcatgggtatgggtgtaatattttatccgtgggcatgtccgcccgatacccgaacatatagtgggtagcagccgggttttattttttacccgtggataacccatgcccgacccgatacatatacatattagctatatttggcccatctcttaattcccatggccttcttcttagcccatttagcccattaactgagacatatatatactcactcaatgaaacctaacctaattcctcatttccccaccccatctttcccggatgcctctctcctctccataatccaaagcggcggcgcgtgcaggcagcggcggcggcaagggaacggcggcggtgctgtgcgtgcaggtgggggagcggcggcgcgcaggcggggcggcggcaggggaacggcggcggcggcgcacgtgcaggcaggggctgcggcaggggaacaagaggccgcggtgcgtgtgcaggtgggcgggcggcggcagtggaacaagcggcggctgcgcgcgtgcaggagggtgcggcggcgacggcgcgtgcagtgtggcggtagggggacaagcggcgacagcggcgcctgcaggtggtggcaacaacaagggaacaaacgggagcggcggtcaccatggtaggcaatagcgacttcgtcgtctccattgcgcatgaccacaatcttcgtcaaccgccgccgctcacctgacccagtcttcgtcactgcgcatgacccagtggatatccgtcggcgggcatgggcacgggcacgggcatggggttttgcccgattggctttgcgggcatgggtcgggcgtgggcacgtgggtcttgggtcaggcatggattcactctgctcgtgcccgacccgacccattgccatccctacttgctcttatgcgaccttgatacgggtgcatccgtaagatatgtatacaagtcatttttacgtaatatgcccatgaactaataaatgtcatcaagaaaattataaaaatacgtatcatcttcaa

SEQ ID NO: 15652 - DNA, 1501 bp, Oryza sativa
gttaccaaaatattggtcatgattggagaatttgacaacactatatttagccaatcttattaaaacttgttaatgttatcaattaatcaaaattttggtaatacaaaacgttgaaaatggctgtaaagtgaacaagctcttggtgtttgattagctagcaacctcgtcattaatctgtgttgacttgctccgtgttcgtgtccggtgcgtgaggtgagctggaccggaccaaatccggcggccggccggtgagccgccgtacgacggatggaacgcagctaattaagctagcttagctcaatcatcgcttgattaaacttcaagacagctaaggtttgtggctacctagccgtgttgacattaataatactctgctggtatttttgtaagcaatctaatctggtactccaattgagatcgatctgcgacgctaatgatcttctcgctgttcacaccgttttgggcctggtcgatttgaatataatttgtagaaaaaataataataataacagttgggctaatgattatctgtagttagggcatggattatggatgcatggaaggtgaacctaacgtctggttagctttcagacaacaccgtttcctcttaacctcacagtacagttttgttcgtgtaccactattattgcccattgaggcagacaggcagagcttttgccctcctttcaaaaaagaaaaacaattattgctcatttttcattgcacgaaaaacattcagcataaaagaaaaatcatgtcatccctatctcttgtttccttcctgggtgttgcacaagtgcacaacaaagttgtcagtacaatgcaacaggatagaggcagctgtttttataaatgaaatgaagtaaaataaaaatattctactccatccagtaaaaaatattttaaaaatcgactgaatttttttcccctaaatgtcaaatactccactatctactatagggaattttatgtggaaaaattctctccccccaccccacacacacacaaaaaaaaaagaaaaagaaaaaaaacacaaagagcttcagaacatcctctcagcccaacccatctccaagcccaactcaacacaccctacacgcaccccataatatgggccttacaatctcaattcggcccataccaaaatatccgcaccacgccacgccacgacaccgaaaccgacttccacaccacgcgggccccacatgtcacccccacgccaaataacgcacgcgtcccacgagccaaaccccaacccaaaccaaaaaacagaacacaaccacacgccacgaaacgaacaacaaaaaaaagaaagaaaaagaaaaaaaaaggagaaaaaaaaaacacaaccgcgtcgccctcctccgcctcccaacccccctcctcgccgcggcggccaagtcgccgcccgccgccgccatcagagtccacgcccaagtcgtcgcctccatccacctccacctcctcgcggtttccatcccgcgaagccttggcaacgaag

SEQ ID NO: 15653 - DNA, 1501 bp, Oryza sativa
agctttcgacagaattgtagtttagaatcttgtaaaattttcaaccaatgcatatagcccgttttaaatgaaataactaatagacaaacatgtcaaaaactgtaaatctagaggaaaaaattgttataaaatcaactttggtgcactgtaactgagtgtatgaaactataagttgaacatacaagaacatgaatcttgatgcaagatcatatggatgaaaaaagtgaaatataggagccttatcgcaagtaaaattacaaaaccgtatgaaaacaccataaatttatggttacatttttagacaactaggattgcgtcgaaattcatatgtaaacagtagagatatcatttccactccccaagcccctctccaccctgacccctacccaaaacctccaaactctaaccttcctaccgccacatagttgccgaagaagagctcgccatctagtcaccaccgcatgaaagtagttgtcatcggtgagtcaccccctcctatttctcccaaatccaaagctaggttaaaggtaactaaaattcaaagcaattttagtgacctaaacaagttaagaatttgcacgtttgttattagaaagatgggtactccctccgtttaatatagtaaattattttagctttatcttaagttaaacttatctaacgtttaccgggtttatggaaaatatacccaacacctataacaatatatatcattaacaaaatatctttgatgggtaatttaataataaaattattctgatcttgtagatgttggtgcatgctgtcataaactcgatcggtcaatgtttaacaaaattgacttagaaaaaatgatttcttttctaaaaataattaagaacacggccctctcctattcaaaccagatgtacacagccatttggacaaaaacaaaactaaggccctgtttagttcgtgaaaagaaaatttttgggtgtcacatcgcatggtttaccggatgtcggaagacattttcggacacgaatgaaaaaaaactaatttcatagctcgcctataaaccacgagacgaatttattaagcctaattaatttatcattagcacatgtggggttactgtagtacttatggctaatcatggactaattaggctcaaaagattcgttatgcgatttccatacaaactgtgcaattagtttttctttttatctatgtttagtacttcgcgcatgtgtccaaagattcgatgtgacgtttttgggaaaaaaaatttgggaactaaacaagtcctaaggggtgtttagatctaggggtgtaaagttgtggcgtgtcacatcggatattatatatggtgtcgcatgggatgttcggacactaataaaaaaaaactaattacagaatccgtcagtaaaaccgtgagatgaatttattaagcctaattaatctgtcattggcaaatgtttactgtaacatgacattgtaaacacgacattgttaaatcatggagcatttaggcttaaaagat

SEQ ID NO: 15654 - DNA, 1501 bp, Oryza sativa
tatgcgactgacttatgaaccccacgaaaaagtccaccggagattcatcgtggtccacatcagcgagtggagcgggttgcatccaatttggattagttgttatacccatgacgagtttagagatctgaaagtgcattttaagattatggggacctagatgacaaacatgataagtttagggactatccgttcactttacttaaaaaaaagttgggtgtccgacctcatttctatatgatatgcaatttatttatctagatgtctttttgcatctattgtgtttaaaaaagtgcagatctttattatgcaaactaaactgtatcattacttcttcatttttttaatttttttaaataaataaaatgttgactggattaccatgcgtacgccacgtaggataaaatcactctgtattgggtcgagggggtaatttgttcagtattgaaagttgagggtgaacgatgtctagttttcgggtttaggggggtaattcggtcgaccgtgataattggaggaggggggtaattggtacctttttccctttttttttcctcgtgtgagtgagcagcccttcccggtctcatctatctcattccttttttgaactagcaagaagtgatttttgtcgtggtctacgggcctgatgctagcacttaacagaatgggccaaatgatagcccacaacaaaacgagcaaaatggtagcccataaaacaaaaggagtaaagtccatcaccggtccctaaacttgtaccgctgtgtcatcccggtccctaaacttgcagatcactcgtttaggtcctccaacttattcagatgtgtcaccccggtccctaaacaggatggtctaaaaactttatatcaaaaaataattcataactttttcatgtgaactctaatgaagacaaactttatatcaaaattgtagccttcgacgcgacttacaactttgtatttgaaaagtttttgaattaaaactgtttaggtcccaaaatattgttgcatgtttatatattttgaaattttaattttaaaattacattttgggacaaaaaaatgacttaaaataaaaaaaattcaactacaaagttgtagatcgcgttgagggctacaagtttgatataaagtttattttcattagagttcacatgaaaaagttatgaattatttttaaatataaagtctttagactgtcttatttgacccagatgatattcaaatccaagtttagggaccggggtgacacaattgaacaagttgtaggacctaaacgagtgatctgcaagtttagggaccgggatgacacagtcgaacaagtttgaggaactgaacgatcgatttgcgagtttagggaccgggatgacacaacggtacaagtttagggaccggtgatggactttactctaataacgagtttgggaggttgggagcagatccgatccagttggcatccgagtgtggaatggggatcccgagtgcgggtgcgctcgctttgcttggga

SEQ ID NO: 15655 - DNA, 1501 bp, Oryza sativa
cccgaattacatgagggatgtggatttgtgtaaattgtttgggaggaaaggattatagagaatttattggccttggaatttggtcgctatatgttatgaataagctttcttggcttcttgtttaacgtggtgaagacacacatgacccatagatatagaaaagtaccataagggtttttttaggctatagtaagctcaagattgacgaggtatgtatcatcttttgcatattaatatgttcctctcgtgctttcatcgagtgactagattatctttattgaaagggcggtgagatgtagatgaagctacacaagttatattaaggtggcatgaggacgctcactattgatggcaaagtaacatgattaaaaacaccccctttgttgccttataggggtaattaaacaataagcgaggtaacgccttaatttatgtgactaatagtgattaggatatggataggagaaggaggaaaggtagcctaatatgactcataaaaagctcaaattccattcacaccaatccaaaaattcaaatagataacctaacacaaatattaagagtctctcctctcaaaaaataccttcacattgctgcttctccttgtagaccgcgtcttacctcacttcagtgttttatgttattttctcccattgttctaacttggatggattctgtgtcaccgtgtcagcactccttcaatgactcaatgtatcgatattggttcaccgactcacgatggatctgacgcatgggagagaagagagtaggggctaagagctaacggggaataacatgggatgatatgagcaaaagaataggaaaatgatgtagttgtcgttgtctttaagtctcatttttctctacactatgcccttaaagcgaacggtatattttactcgatacatcttatccagtggtggagccaaaattttccaaacctaaagctcaatcagttgaatttatataattttgcctttatcttctagtttttgaagttctaaaaaaaaatttcaatgaatatttaggaccaggagtagggctaccgccctagttgccctattcctatctctgtccccttactgatgttctaacaactagcatgataataagttcagatatacttaaaactttctattttgtattgccgatttagattggatttgtaaatttcaattacgattatctgttaactattttatcaaggacaattcaaattataaaatctacatcgtccatctaatttccaaaagcaatatactagaactttttccttcacgacacgatctaaaaccgtccaatcttagaaatgcacggattgattttgatcaaccatgtcggttgctgatgaaacgacgaacccacgcagtgagcccgacccaacaccccgaccggccgcgccgccgccccctaaaaccctaaacccgccgccttcccaccatatatacactcccatcaacaaaacccaaccgttcccctctccccgcggctccgccatcca

SEQ ID NO: 15656 - DNA, 1501 bp, Oryza sativa
accgttcgctttaagggcatagtgtagagaaaaatgagacttaaagacaacgacaactacatcattttcctattcttttgctcatatcatcccatgttattccccgttagctcttagcccctactctcttctctcccatgcgtcagatccatcgtgagtcggtgaaccaatatcgatacattgagtcattgaaggagtgctgacacggtgacacagaatccatccaagttagaacaatgggagaaaataacataaaacactgaagtgaggtaagacgcggtctacaaggagaagcagcaatgtgaaggtattttttgagaggagagactcttaatatttgtgttaggttatctatttgaatttttggattggtgtgaatggaatttgagctttttatgagtcatattaggctacctttcctccttctcctatccatatcctaatcactattagtcacataaattaaggcgttacctcgcttattgtttaattacccctataaggcaacaaagggggtgtttttaatcatgttactttgccatcaatagtgagcgtcctcatgccaccttaatataacttgtgtagcttcatctacatctcaccgccctttcaataaagataatctagtcactcgatgaaagcacgagaggaacatattaatatgcaaaagatgatacatacctcgtcaatcttgagcttactatagcctaaaaaaacccttatggtacttttctatatctatgggtcatgtgtgtcttcaccacgttaaacaagaagccaagaaagcttattcataacatatagcgaccaaattccaaggccaataaattctctataatcctttcctcccaaacaatttacacaaatccacatccctcatgtaattcggggtactctcgtcgacaattacaaatcagtacattttctcaccgatccactaaggacaaacctctatgataagtttcaaactaaagtaattccttcctaatgtacctgtcggtgacatgggaccgggagtatcatgactagaggcttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccccgaccccttgtgggttttgcgccgcgtgtatgggttaggtgagcgcagcggggctcacctaaccgcatttattgcggtttgggtgagcacgtcacgccacacgtaatgcagtacagcgcgctcgtttatccggtctgtgactggtcacagaccggtcagattgcgggttaggtggcgacgggcggtctgacgcacgcctcgccccatcccgtcaggatgagagcctccaagcactcgtccctagccggagccggcgtgttagctcctgggggtggcacgttggtcctggtcagatatatgccaggctttatcccaacctttataagcaaga

SEQ ID NO: 15657 - DNA, 1501 bp, Oryza sativa
gtgatgcacacgttgttgtgttgcaaggacatcgatcaagggcgaggagaggacaaacatttgttggtcaggactcggacttttactctggaagatccccatgttctcgcataaaagttttttatgtgacatatataccaacattattttcaagcatcaaatatattaataatttttatatgtttcagtgagtcaaaatatgaaggttaagaaattagtagaacgttatgtatgtgagaacaaggttgagttatgtgacatgacaaatacacaccatcatcagttagtactagaacgtagcaattgatttgttatcggatctaatgttttattctctatcagcctcgtaacttatttttatgggcttagtcaatctggtctactactcgcaatttaccattgcttctcctgaagttccttctcctcctcgttttccttttttcgaggaatgaagtccctccttgctgctcattccacagttttcctatggagtgggatgccatcatcagctttgggtctattttttttaaaagggaacttggagaagttttttcagcaaaattataaacagttattttttaagattataagaagcttagtcgtaaaatccaaaaataaactataaatcagaaactatacaacttctctaattttttcagaatctggtaaccaaccatattacccaaatagccacttcgttcctcaccgtaacgaaattccaccaatccggacgcttctcatcgttagagcaagtttaatagtatagccaactagtagctccaattcatctatagccaatctaatagctcattcatacaatagttacatactacactattaatatctggtccacatatcatacacatactatgtcttggagtccgtgctacagctggctacaaatttttagcccgctgctcttctctctcctcatttatcttcttacaatatgtttgtagctggcttataacctgctattgccctgctaccaagccaggccaaaacgccaaaaccccaggccaaccaccgaccccaccgtccacccacgcgtccgcgtcccgcacgccaatcacacgcacggagaagagagtccattttttttttctaaaaccccgcgtgtcccgcgtgcgggcggtctgattgccgagccgacccggcaaacgaacagcccgacgcccccgacgaccaaaacctcctcgcgcgatctcgcctcgcgtcctccgtccgtcctcgtcaagtcgtcacggtcctcacggctttttcacatctcacatctcgcactcgcatcgcagctcccaactccaactcaagtgggctccttcttcccccacaactccacggaaaaaacctcgcagtacacggccacccaccacctaactcccttccttcctctccctagaaatattcccgcatccgcatcccgcatcccgcctggtttgtgattcgccgaacagctttgccgggagaaagcgaggaaggaaggaaggagaggagggagcca

SEQ ID NO: 15658 - DNA, 361 bp, Oryza sativa
  unsure (1)..(361): unsure at all n locations
cccacaatcaccctngtatggttatggaagacttctcccccacccagaccntccacggtctccctcatccagtnatcgttatacccccccaccccccccccagggtgatgacggctgctggaccncccnnaganngagaannggaaccccccagccgagacggaccccaaaacaagaggaaaacaaacgagcacaagcttattctcccaagaagcctcctaactaagatacatccgctgtcgtccatagccttccttcttgcttaatcctctcgacgatgatcagaactgacgataggacagcgtcgaagacacgcattacacttctaccatagttgccaggatgtcaacgaaacaataga

SEQ ID NO: 15659 - DNA, 1047 bp, Oryza sativa
agacctcacattgaccttgacgatgatccccaagagcatgtggcatatgctcgttcagatcatacggaaggcataaccttgtgaccgatgcatttgtacttatctattgtaatgaatgaagtattttgttttattgttttattgcaaagacttgatatgtgtagtcattaatatggctaattttgttttattacaaatgaccaaaagaaaagttgtagatcctgatgagaggatcaactttgttgttgaccatatttccatttgaaatcatttagtatttacaaatgttgtttatatttgtcatatattcaaattcaatttcaagatgttgggaaaaaagttatatagaaaaatgaccaaaataaaacttgtagatcttgataagtcatcggtgacgggcctttagtttacggccgatagagattaatctatctcaatcgggctttgccgtagggcccgtcacagatgactcataggtaacgggctctatactaacgcccgatttgaaatcattttgtatttacaaatgctgtttagatttgtcatattttcaaaatcaatttcaagctgttgggaacaaagttatatagacaaatgactaaaataaaagttgtagatcttaataagctctacaattttgttgttgaccatatttcgatttgaaatcatttactatccgaaaatatattttgactaataaattgaattattatatagcagctatatattttgcactcacaaatataaagacttgatgggaaaaatagaaaaatagtcatcggtgacgggccttagtttaagcccgatagagattaatctatctctatcgggcattatcttagggcccgtcacaaatgagtcatccgtgacgggcctgaatgtcatctcaatcgggcattagtatggagcccatcacagatgagtcatttgtgacgggccctatggcaaagcccgattgagatgactcatcactctactataactagggtttctcagatcggatcgaaaatttttctaagtcccgctacaatttcctgcctccttaga

SEQ ID NO: 15660 - DNA, 1487 bp, Oryza sativa
atggtcttgtagcaccatgtggtcatgcatatgtttgcaggagcggaggcatgcatgcaggcctaacatagctagtgctaaagtccttacgcttacctgttttagagtttaaacccctttaaatcatcatatgatatttggattaatgatctaaacatcatctctataacaaagcaaatacaaaaggcaggtttttttttatctcatggccgcacggaatcgtggagatgtccattaaactcataaattattaagtgtattggttatttggctacaaaagtgtgtcactacaaattagtcgccggctctctttttacataattgatagaaattcgatctttatatttataagtggatatatacaggtaaaagtttcacggctgcatatactcatatctcatgactgagatacatacaaatacaaacaaatcaaaaataaaatattagaagtctacctacaagattgttctcatcgctttcaactggaaggatagccctctccatgccgtctcactaccattgcagcaatcaaaagcttccccatttcgtcatgagcaaatacgaaggctagaactagtccgcctaattgttggctctcttatctcttcatctattttcattccacgtaagattatactaatatcaactaacttgtagctagtctatttattgactacttcctcgtttcacaatacaagactttcgactttgaataaattcatacatcaatccaaatatatgccttatatacgtgttaaagtttatatagatattagtgtatctaaccgagggatggagaagctataatatcttataacgtgaaacaagcatagtatcggagtatatcttattggccctgctgctaacaattagccgatcattgtcatcttattgccctgcttatttccaatagtcaatttgatccctaaaatgatgatgggtgggattgcctttctcgaatcctgttccaccacaggatcgaagagatctcagatcgccggtgcttccacggagaagacgaacaagcgccattgtccagatccctatggccgaactacccgtggattgtccagatccccatggccgaagcaccccgtggggcccacctgtcggaacccgccaagcgaaacacaccctcttctcttcgtcaagctggatcgcaacgcaagggcccgcgtcctcttccctttccagccaaaccgacgccgatgctgttccactgcagggcgggccccaccacctctttccgagccatgggtccacccgtcagtcacccaagaaaaaaactaattgctattgtgggtggggtccaccccctccacgtccacgtgggccacgcggcatccgggcccactttcagtgagcgaggggctcccttcttcttaacaccggaggagagatccttcccggccgtctcctccttcccctctccgctcgcctccgcgattcccttcccatttcgccgccgatgaagggcggcgggggcg

SEQ ID NO: 15661 - DNA, 654 bp, Oryza sativa
  unsure (1)..(654): unsure at all n locations
gtgggaattccgtaagaacagnaccttccnnccngcntgaggtcgactctagaggatccccggtataaacaaccaagactaaaaatagatctttagtcctggttgtttataccaaccgggaccaaaataaactgccgagcgcgcgctgaatttatctcctcggtatcccctccccttttttctctccttcattaaaaaacgccgagactaagcctcggtatccaccagtccgcctcctccccttcctccctgtcggtgacatgggaccgggagtatcatgactagaggcttgggcagctgcggtcacccacgtggcctgaccccctcggggggtcgggcccgagggagacgtgcccaccccctcctctgtctccccgaggggtcgggccgctcctgtttcggccccgagggctggggcgccccgaccccctgtggtattggcgccacgtgtgtgggttaggtgggcacagcggcgctcaccaaaccacatttattgcggaatggacaagcgcgccacgccgcatttaatgcagcacggcgcacgcatatccggtccgtgaccggtcgcagtgtgtgaccggtcacagaccggtcagatcgcgggttaggtggcagcaggcggcctgtcacacgcctcgccccgtcccgtcgaaa

SEQ ID NO: 15662 - DNA, 1501 bp, Oryza sativa
gggctggagagactaaggcgaggaaatgagctgcacgcctctcaattctgagtcgctttgttgtgaaacttatcagccaccatatgctaaatgctggtttggaaaccagtctaagttttacatgaaacatgtgaatacaaaattgtcacctggttatgaatgtaaagctgactatggtaaactgtgaacaaactgatctattgcacataggggggtgcgctaataaaactaacgcacctgtattggcttggcaacatctggtacttgcccaaagacctctcgtggatcatgacttgcccagaagacctctcaaagtttcttgtactgaatcaaccggggatcatattcaacctaaatgactcaaaaatgtcaatcatcttagctcataaaacaccaacaaagttagtttataaggaggccctgcaaagtattaataccagtttaccactccaaaacctacaccacacacacacacatgcatttgaatgaagcactcaacggacaaacatttccgatggtttatgcacaaaaaatacacacaaaaagcagatctggcaggatgaatcgtccttgttgaacatagaacattccttttgtttttttaaggaaatgatccctatttagcaatgaaaatgaaacttggaacccaaaaaaaacagattacgatggaaatgaaaactcgcgagtattttctttcagtttttaacttacacatacgaaatggtaatggccaatcagattacgatgctaactacggaaatgaattgctacgaccatggaactggacatatcattggttcatggtatcgatcaagaacagctataagcgtgggagtctccgcaccgcaccttgacgcactcggcgtggtcgccgaggttgcggtactcagggcgggccttggacccgccggcgtagccgacggaggtgcggatcacgccggggaggcacccgaacgcggcctccgacctccagaagcttcccagcgcgaacaccgccgtctccgtggccaccgccgccgccgccgctcccccgcgcggctcccgcccccggttacccccgctcccgcccggaagacgcgcccccgacgccacccccacgaggaggagaagcaccacacaactccggcgatcgccgcggcggcggatccgcgtgccatctcgccggtgggggatccgaatcggagtcaggttacgcgtccatttcatctcgagatttttctcctcttctcctcgctgagtccgatcctgaccgtccgatcgtgcaacggacggccaggattatccggataccaacaagtagagcactagcgaggtggggcccacacaccagcgagaccgtccgatcgtacaacggacggccaggattatccggataccaacaactagaagctaggggtactagtactagttatcacatcgaggcacagggagggtggggcccacacggcagcgagagacgcttcgatggacgcctcctcctccgcctccgccggcggcgagg

SEQ ID NO: 15663 - DNA, 803 bp, Oryza sativa
cgccataccttcccaactgttgctgcctcaaaaaggcgccaactgcacttgtgcccctgaccaccaccacctccagcctctctctctcttcatcttctcctctactctcacatcacatatatcacacccacacacatcacatcacacgcatccatccatccatccatctgaattctccatttcactctctctctctactctctacaagtgatcaattctttcttcttcacggagctcacctcgattaattcttcttcagtggcccatacctcacctctctgcatattgcatccatccatgtcgccctccatgcctgttaaattaccgcactgggtagcagcagcagctgctagctgcatctctgcatctgcatctgctgctcacagctcactctcttgcatgctgctgctagctatctactgttccttgcatcagcctcaaacttcgcgctagctactcgatcgaacgatccctctcgcaaagctgcaaacgagctgctgctgcctttgctcacgcggctcgatcattcattcacattcagattcgatcatggcatctatatgcattttcagtaaaaaaaaagtaaccaaacaaattgatcgaattaactgcaactgcatatacatcgatcgatctgaatatatgccaagcgtgcatgcatgcagctagatcgatgcagtgcaggcaccggagaatcatttgctgctgcttctcttcttgttttttttttaacattgctctctggcctgctctgtggctaacaaaccatgcatattcattcaattcttgcatgcatgcgagca

SEQ ID NO: 15664 - DNA, 679 bp, Oryza sativa
acataaaatactattaatgttttattatctaataataatattattattattaatcataaaaaaaatcaaataaggcggatcgtcaaacgttggatatagaaacccacaactacacttagaatgaacggggagtataatttacttatattataatgatataaatatatttagtaatagtgaattatgggccattttgacggtttcaagtcatgaacagtagtagtgacgttaggcaggagagggtgaggtgtgcaagaggccgggagagacagacacctcggcagccacacacgcggatgcgcccgggcccaccactcccaacgcgtgggccacatccgggccatccaatccaccccagcccatccatccgacggcccagatcacgcgcgctcctccgctttccttttccgaaacgaacccaaaagaaataaaaacaaaaaaaaataattcctctcctcttctcatctcatctccctctcctctcctctcgccgtcgccgtcgccgtcgccgccgctcgccgccggcggggatagagttcgccgggatcgcctcgccgggagagttccctcaccatcccgcacctccgctcgcctggcctcttcctcccggtcagtaagcccgccttctccctctcgctttctgttctgctctgctctgctccttttgcttttctggagg

SEQ ID NO: 15665 - DNA, 1501 bp, Oryza sativa
cgaatataaacctacgtattgttcccttaaaaaaaaaccaaacagacgtaggtacgtacgaagataaaaaaaaagaaacaatacggtctttcgaatacgtattgtgtatgcctttctctgttttttatttaacaaagaacagcaagtacatacttatgacttatctatctatccacggtctttaaaataggatttcctatattataaaataaaatttattactccacaaatatgcacggttaaactagattaatataaagtaccaaatcaactgtctttaaatcttcatcgtttaaattatttcgaatatctatctaacttataatcctttgtctttctttaattaaataaaatactaatcacttactacctccatccacaaaagttacacctattacttttgtcaccaagaccaaaggaaaaattaaattatcttggatgttataaaatcaatgagtgaatgcaaaaccaatgagtatttagatgacacattcgattctaatcaaacatttaatttatctccttctttaagtcttgaatgtataaagactacaaataggaacaacttatttggaaaaactcaaatgtgaaatatgtctaacttttgtggatggaggtagtacaatagttatatggaactgctaaattcattacaacacatggtgccgacatataatacgtaatgtcataattatttttaaataatttagctaacatataataaactaatgtcatgatcattttaaaaataattttacctgacaaaaaggatcaacttggtatcaaattcacttgacaaatatataacactaattcaaatctacatgcagaaaaagtaaaacaacattgtggtttacagttagatttgatttaattttagtttatgtgagattaagtttctcttttttttaaaaaatagaactattagattggaatttccaggcaatgtccttgctataatacgaccccttaatccatcacgagaattatggtcatatatggtttttctttgcgaaattggtttgataacaaatgaacaatcatgtgcatcaaactattcatcatatattttttatagtttagaaattctaatatatcagacataattgatgatgtatgtcatacaccccactgaagtaactataaatgcactccaacaaattagttattttaactaattttggaaaatatattcttagaattagtaaaaatattgcatgtaattatgaacaatacatgaatgaaaacaaaccggagctaaactatatatcttagtcaaaatataaagaacgatatagtactcctagatgtcacggacatatgtctgtttagttttttttattaactttgctcatttcaaaagagaatattttatctacacaataaaaaattaagcattaccgattaataccatacacaattttgtctacacaaaactttaaaaaaattcatcaggaaaatattttcatcacctacattgcctttttttttcccataaagg

SEQ ID NO: 15666 - DNA, 561 bp, Oryza sativa
agcaacctagacttcttagcttttcttatctgatgaactatttatattacatagatgttttgatttttttctgttaaagttaaacctataaaaagttgacttaggaaaaagtcaaaactacatatataatattaaaccaagggactaccacatagatcacttttatttgtaaaaatgctgatagcaaaacaataatagtggatatcatcgtgaaacataaaacatatataggtgtgtaaattttactttgcatgcaccagataaagcgcacctagtttcactttacatcaaatttagcatatactttcagtttacaccagattaccttcaaataagttttactttgcaccaggatataaatcatcaaatacgatgaaactttgtgaaaagtggtataaattcaaaaaaaatattgtaagtttcactcgtgattttacaagattttccagttatataacacaaactagtaaaactaaaatttattttactatactctctgatgcaaagtaaaagtatgcactaaacccgtcaaaagtgaaacaagatacattttatccggtg

SEQ ID NO: 15667 - DNA, 1501 bp, Oryza sativa
gcgccgtggccatcctctcgcagccgggcctctttgcccacttggccgcgtcgtcgtcatctcagtcggtgaatgtcatcgaacaacgtgacgcggcagtacacaaaaacactattaagctgttcatgacgagaacgtcattgctgttctcgtcacgccgtccagctgtgcacacagttcgctctccaagaacgcaatctcctcggagcaatccaaccagccaccgacccttacccggtagagcactcacctcatgtcgttggcatccggcgcaacgcggtccttgaattaatccaagattgaccgcacgctccgcgccgcgcgttcgtcggtgccatcggccacatcgttgcgcgccatgctaagtagaggctggatcagacgagggggaagcaaaataatgcaggggccaaactgcaaatatgttgccacgctggaccgccacgtaaggtagttaacccagttagacgtatttggaccacaatgattcacttaaacaagatcacggaccctaatatcgattttccaagatcatggacctaagtgacagcacgctccaactttaaggaccggctgtgtactttactctaatgtatcaaagattgggaaagtgatttcatccctcgatgaaatatcccctcattttgtgcttgccacctaaatagtcactgaaaactttgaaaaaaattggtaagatagattaatatgaaatatatcactccacaaacatgcaagttaaaattcaaatgttacaagttgtcgcaaaaataatatgaaatatatcactccacaaacatgcaagttaaaattcaaatgttacaagttgtcgcaaaaataatatgaaatatatcactccacaggcatgcaagttaaaatttaacttttacaagttgtaacaaaaaataataaatatagctacgaatgtacaataactattttcagtttattttgttctttttgttacaacttatagaagttgaatttggcttgcatgtttgtggagtgatatattttatattaatctatattgttaatttttttcagttttgttataactatttagatgacaatgcaaatgacaatggggcatctcctcaagagatgaaaaccatatccatcaagatttatttgaacataagtggtttcgaaagaaaaaatagtggatggagacgtagagtcatgacacatctctagcacttcaccaacttttcttttattttcagttgtaatacgtattagtataactttaagttttacttttatttttacatatactagcttggtggcccgcgtagatttcgcggctagcatcattatatttttttctcatataataacatatatgttttctcaatttattattaaaatatattaaaatgacagcataattttaaattttgaaccaactttacaaactacaagtgtgtaatattcatattgtattttatacatgtgttagttattaattatttttaatatcaaattttagttatttctaaat

SEQ ID NO: 15668 - DNA, 1501 bp, Oryza sativa
gcaaatccctcccctatctctcagtaaggctctcgacccaaacccatctcatttttatttttttggcacggtgaaaaatccacactgccacatttgcagtcgctgacatgctgccgccctccctgatgatgatgttaggtccaccaatcgtaggccacccatgtcacattgggcttgttccaccacaagttcaaccagagccacaactttaagtcttagacctgcacaacccaaaaaaaactagtcctggacctgctccaccacaggctcaaccggaaccacaactttagatcatgggcctacacaatacaaaagactctgcctctgacaccacttgttaggcctaccaaccataggccacccaagtcacattgggccagactctgggctctgataccacttgttaggcctactaaccaactataggccacccaggtcacattgggcctgctccaccacaggctcagccggaaccacaactttatgatgggtctacacaacccaaaagactctgggctctgatcccacttgttaggcctaccaaccatgggctacccatgtcacattgggcccgctccacctcagatccaaccagaaccacaactttaggtcatgggcctacacaacccaaaagactagtctaataggtgatgtttgcctccaccttttaagttgtgctcctccatcatcaattaccaatgcgggactacttgttaggcctaccaaccatgggtcacccaagtcacattgggcctgctccaccacatgcccaaccggagccacaactttacgtcatgggcctacaaaacccaaaagattagtctgataagtgatgattgcccccagcttttaagtcgtgcacccccatcatcaattaccgatatgggactaaacctaacaattgttccggtttccaaacctgggctctaataccacttgttaggcctaccaaccatgggccacccatgtcacattgggcctgctccaccacaggcccaacaggagcaaccatgggccacccaggtcacattaggtctgctccactacaggtccaaccggagtcacaactttaggtcataggtctacacaaccaaaaatactagtttgataggtgaggattgcccccaccttttaagtcgtgctcccccatcatcagttaccgttatgggactaaacataacaattgttccggtttccaaacttgggctctgatacaacttgttagccccaccaaccgtgggccacccaggtcgcattggtcctacttcaccagaggcctaaccggagccacaactttaggttctagggtacgtgggccacccaggtcacattgggcctgctccaccacatgctcaaccggagccacaactttaggtcataggactacacaacccaaaagactagtctcataggtgaggactgcaccaccttttaagtcgtgcttccctctcatcaattaccgatgtggaactaaatctaacaattgttcaattaccgatgt

SEQ ID NO: 15669 - DNA, 1501 bp, Oryza sativa
  unsure (1)..(1501): unsure at all n locations
gccgtccatgtctggtcggtcgaatcgacggaattgggctcccacgagggcgtccacgcgtttgccggcaaagctgttgctcccaccggattcctgcggctccgcctcgccatggatgtcacgcacgaagacgtacttgtgcaggctcgactccatcagctcatccttcacaacaacctgtcaacctcctacacaacgatgtgtgtgccaccgccggcgaccttgccgtcgccgtacctcccgtttgacaagcacttgccattggccgaccggtccaacttgaagctcttgttttccgacgacaaggagttgaggtccgcgaccattgttgtcgtcgagctccgccatggggttgcaacggtatggctagtgctcggccttccgcgacgagctccggctcagagatggcctcgtgcgccggctgcagccccttctccctggctgcagccacttcctggacgcagttggcatgcgccgcttctccctggtcaggaccgacaccgtcttcccagctgctgctgcggccgcccccgcgcaccgctgtgcacacctgcgcacgcgagagagagatatattaggaagaggtgaagagagagaaagaccggtgggtcccacccttttttttaaaaaaaaaaatgctgactagattgccacgcgtacaccacgtaagacgaaactgctcgggattgagtcgaggggggtaattcgtccggtattgaaagttcagggtgagtttcgttaaaaaaaaaaagttcagagtaagcaatgtttggtttttgggttaaagggggtaattcggtcgaccacgatagttcgggccgaggtggggggagggggtaattcgtactttttcctattcttttatacattggtacaatagcaagtcagattattaacacttcggttgtgtggaattatataatcatatactccatccattctataatataaaggagatttggggtggatgtgccgtctgtccagattctttgtgttagnatgtgtcncatccccccaaaatcccttatatatattatgggacggatagagtatatatatatgtaataatacctatgatatgcttcatatgacatggttttttgtaagttaaaccacaatacccaaattcatatgaaattatattgaatttgaataataccggtacttctattcgtggagaatatatatataaattaaacattctgaaatttatatgggaaacagttgtacggctcactgtcactggtgcgggtgcctgagaaagaccgcaggcatcggcatgggagatcactattggcatagatcatcaatggttggaaaatcaaccattaggatacaaatagtcattatataagtacaattgatcatgattgacaatgattttaatcgtatatagtccgtggtgcttggaagttgtcgacgtttgatgtcgcaattctgatatttgcatagtatggggatcgtcggtgctaggatatacgtgatactgaggtaaaacaga

SEQ ID NO: 15670 - DNA, 1207 bp, Oryza sativa
taggatatttaatgaacttttatatataatagacgatattaaaaaggaagcgggctaatgtaaacgtataaaaaatggatccattaatttaaatgaaaatcaacagtgagattatatagtgccacgtgcacaacatgactatatttgtggagtaataaattttatttttatagtatagaagatcctagtttaaaaggaccgtatattttttttccacggttataacttcgtatattttactttagggctttatagtatttttttttattatgcgttaaccgtacatacgtatgttccttttgtatatttccatccaagcgaacagttgcttttttatcgtacacacacgtacgttctttgtttatttcttaatacagtacctagatatatactccatcatatacgtatgtaagtattttcatatgtatatgtatttaagtatttccatcgtacgtaactattttcatgcgtatacatatgtaaatatttccggtaaatggattctattggacacagaaaacatatgctttttttaaatagatctaatctgacggtgtaaaataatgggtccaccaatttaaatgaaaatcgatggtgggattgtagtataccacatggcagcctatgagcgcttgtagaaacgccacgtggcggtttcggagcgtttgtaggaagtttaatggacttttagtatataatagatagattttaacatatttttgactgaatttgaacaaaatttgaccacgttcacagataaattggagaaatccaaaaacttatggggagatttgtgcttaccggtgcggtccgaaatttcaaaccatgggatcagacgggttgattcgcgtcgtatcgaggcggtggcggggggggggggggatcgtgccggacacctcgatgcagcggcgaacaacctcgtgacaaaccacttgcaagaacattccgcgtggcgcgagaattttgtcaggaaagggagattgggagcagcgcctgtcccctcttatggagaaccaagaatctaggcttgggagttccaactattgggagttttgctagggattctgtcgtcgtcatcttcaatctcctccttgtacaccgcggcggcgccgcttgaacggcggccgccggccaccacattagcaggagggggcgacgcccatgtccccctgctactgcgccgacccaccgccctccagcgagtcga

SEQ ID NO: 15671 - DNA, 1348 bp, Oryza sativa
tcatggccgacctcaagacccacgagaagcactgcggccgcgaccgctggctctgctcctgcggcaccagcttctcccgcaaggacaagctcttcgcccacgtcgccctcttccagggccacgcccccgctctcccccctcccccgccgccgccgacgtcgggtcgccgccgccacaagcaggaggagccggagttcacgtggggcggcggcggcggcaatgagtttcttgacgtcaaagggatcgccggcgtcgggtccggctccggtggtggggatgagttcttctccgcgggaagcttcggcgccatggatttcggattcgggcagttggatgcttcgctcgcgatgctgctgccatccgagcaattcgcgggtgatcatcaggaggagaatggtgacaagtgaaggtgcacatgatgcgtagcgagttgcatatgatcatatatatatatatatatatatatatatgacgtatgtatttcatggtgtaatagcattgtgttatctaaagtggaagaagttgttcttcccatcttgtaccatcttatatgcacttctttattaagatagttatgcagatgatgttgcaaacatttctgcatttgatgattttctgcaaactacggggaaaaatagtataaaaggattttggtagaggaattgggaagggagaggcataaattcgtacaactctctctacatgtgtgtttggaaaatgggttatgacttatgagaggtgggattgagaaataaaaatgaatagagggataggatgaaatggggtgagatgaatggatggctaaaattgaaacttactctttgggagtgggaaatcatatcccaaacccatttccaaacattggctacaagttagaagttgtcaagtgaggtcaaccttgaaatggatggaggtttatgaaaaatctaaaaaataatactcctacattttggcgttgggcctgggccgcctggcctttcaatgcagggcccagcccatctatggtcaaagtcaacaccatcgtaattctcacctggtaaacgaccggcagccgccggcgacaacctcccaccctttccactgtaaaatctcaaacttccaaggacctaatcgcaaaaaacaccgtagctgaaataaacctccgatacgcgaactgacatcttttccaaaagagcccctcgaaaaacttttaattccactccacctaatcctgaatcctcctacctatcgcctccccctcctccgagaccgagatctcgcgctccggcgaggaggcgaagcttccagaagcttccggaggaggaggaggggcgcgccacctcgatgctcttcccgaagcggatcaact

SEQ ID NO: 15672 - DNA, 1501 bp, Oryza sativa
ctgaaagctttttatacaaaaggtggagcactcgagcatcttccacttccttcccttggcgtaaaagaaacagaaatctctcgtctcgtcgtctccgctccttgcgccaagacgagtcgcgggtgaacaggggaggggacgccggacgccgatctccatctggcgagcagagcaacggaggggaggtgcgccgatctccatctggcgagcagagcaggggaggggaggggaggggatcggggtgagcatccacatcctctttctgattcatctctctctcccaccgggagtacttttgcctggaatttgctcgcgttaaccctagcttctattctagatctttcttaatttgtttgctcccccaaaagtttgagcccccatgtcccaagtttgatccgcccctgatttcctttgatcccacgcacagactatgctgctgtacagagtaaggaataattataactttaaccgtttaattaatgtccctattcaatggttcttcctcaagcctcaattattcctctcctaccgctgctaatttgcacaaagtggttgtttactttactccttgtttcttaggtgagatcatgttatcttttttttttcttcaaatgtaaatccgtgtccctttgtaattgcttgcaacttcgaaggaccttgccataagatattggccctttgagcaaaccagagatggatgctatattttattgaattatcttctctacaagtcttcaacttgtcataagattcctgctaatctacttactccacttacaaaatatttctgtcaacttcgttgcttcgtgctgaatcttacatatcatcttgactgctaacctgttgtgatagtgctgttgcttccacgagtcagcttgtaatgttgagtcgttctcactgtagaagtaggcaactgcaggattcacaagcaatttcattattgtactttttagcaacttaagttgacctttgggaattttgttgtcatcataaaataatttgtgcggtgctctgagcaataccatttaacattcactggagatgcggatatgttatttactcaaagagattaaaactaccaagtatttactgttttactgcactttacagttttttgctctgcataacaaggctgtctaatagctgctgaatctgtttataccatacgatcatttttaattttgttagttggaagaagagtaccagtgcttctaaatattgttcattgctagtatttttcatttttccatgattcataatgttaaatagaatgctactgtagtgcgaaagcattctccatgctgcactaatctagttatactcatttcttctgttcaaggcaattatttataaaattgagaagaaattagttattacttatttgcaacatactaacatgacggttattaacactttatactttcttgtagcgaaatttgtgaaatctttcagttgatgaaatcttaaaatcatgggagaaaatactggcgataatccaaac

SEQ ID NO: 15673 - DNA, 1501 bp, Oryza sativa
tattcttcttttttttttcccacgctgtctaacccgaggggtatgcgattggcaacgatggcgtcgccgcggccacacctcacggcgccagggacggtggccaccttgcctactccgccgcgagcggcgcttcctagttcctacctccgtttcgtgtcttcgaccaccacggcgctacgtcatgacgccaccaacaccaccgtgggcggcactcctttccttcgcgacaaccacctcgccgacgctgtatgacgtcgagtagcgtggtgcctccgcggcgggagccagctggtggagaccatcgcccctgttctcgtcgtcatcgcggaggtttgatgagacgatggtggcgtgtcgtaaaaaaaccgctgagagagttaaattacaccggttttaacagctgaggggccataatatttggttttgcggttaaggtcacatatattagattggggtcacatttaagggagtcaaagtggacttattccgatatcccctaaaggcctctatttgggctcacataagcccaagcacacagagcccgcaacatttttgacatggatataccacctaccttttccaagggattctccacatgggtttgcacatggcacatgaacacaaagctccggtcaaaaaggagctgaaagaaattgtctaaaactgcgctttcaattcaaggctggcaaaatcctcaaaccacgcgcttatctctggaatctgggaggatttagagctaatttttccgcatccatgaattcgagacacactttgacttttggcttttggctttgactttggcttcttctcctccatttcatcgctcgttctctccatccaccgctttgattagtcgggatctggacagcatcggcgaatcatccgcctccgcctccgcctccgcctccgccgatcccccatccatcccgcgagcgccgccgtcgttgcttccgccgcatcctggtgagcacatcctccgccaccgccgcctgcgccgatccccatccatcgcgctctctacccacgcacttttttctcgaatttgcgctaaccctagcttctgttctagaaatttgccttaaccttaataccaataacagtttgatggttcccaaaaaggtttggcccatgttagatccgccgccactgctatggaacttatgaatccttcattactctttagttatatgtgtgtgtatgtaacagtacgtatgtgattaagacctgttttgcagagtgagataagggagatttttcctctttttcagttttatctgtcctccatggatgattaaccgtgaacatatactcttactagatttacaaagcaaaagaaaaatggtgtgcggatactgaacaggcagaattacaggaaaaatgtaggattcgagttcctgttttcagccttgggcttctgcagtttagatacaagaactgtcaggaagattaatcagctggctgctgaaagaataaccatattttatcattgccttgcagatgg

SEQ ID NO: 15674 - DNA, 891 bp, Oryza sativa
cctttaggggagggccacgtggcattggagggccgcctcctccgactattctttgggaaggagtggccgccaccccacctcgggcctgactccccttggggagggccacgtggtattggggtcagcctcctccgactagtctttgggaaggagtggccgccaccccacctcgagcctgactcccctaaacatgatatcctcgggcccatatcaccgacaacagttgcgaagacaagcataggacaattaagagtccagccatagacctgttttcttaatcctttaagattccattgtaaatcgtatacatattaagattgttaagcaaattattagttcatccttggctttgatagtttgatggttttccgggtctttccctatctatatgtatacatcttaattgtaataaaaaagaaaaaaacaaagaaaatgtatgagtagcagtgggtagatctgttccggaagatgagtaaccccgttgtacaaacgtacagtataaatgactctctaatataaaggggatgttacctttgttttttccaatatatgacacatcagaatcttctaattcgtttatctatttatttctttagatatttatgcaaataaataaacatactaggcataaccaaagcatttttttttctgatagtatcacaagatactctattcgctattttttctaaaacaaataaaatatttcctccattccaaaatataaaaaaaattggttgtatgggacagatttatagtattaaaaatacgtcctattcaatcaaaactctatatattttaaaacggatggagtaaataataatcgaataaatatttgtggtctaagtttgagaaaaaaaaatcaaccgtatcacatcacacatctcaaagaaa

SEQ ID NO: 15675 - DNA, 1501 bp, Oryza sativa
ttcatcatcctaaagtaaattaggaggaactgtatgtggactatggaaaaatgagcttcatcctcaaagggaataaaacacaacagatccacaaacaaattgctattcacgatgaacagatgcacgtggccatgaaattacaaaatattcctgcttgaacaaaatattctatgcttcaacaatttttgcgtgtatataaaaaatcaacatcgtaaaaaggatgtgttatgtccctcagatcataatgggaaaacactgtcagcgccatataccttgctaagtactccaatgataattattatcttcaaatcttgcttaacttccaatgattacaatatgcccctttatataaagttcccccctaacaaatacagatcaaatttatctaagaataactttccctaccttataactactccattcatttcatattataagatgttttaggtttggactaagtcaaacatcttcaagtctgaccaagtttatagaaaaatgttgccgcatttccaacacaaaacaaacatactaaagaatatatattcaatggtgtatttaatgaaactaatttggtgctgtagatgttgctacatttttctataaacttgatcagacttgaagaagtttgacttaggacaaacccaaaacatattataatatggaatgaagggagtaagatacttgacaactaagggcccgtttggttgggattcttaggagcaattctagcaggaatcggttggagctgagccaaacgggcaatttcccctcagcttccaaagcgaatcaaccgggatcgattcccttttttacgaaggaagggagaatcggcggaaagcgagcttctgctgagaatcaaaccaaccaaatatgaaagtccccatatttttcccaaaaaattacccgcctgccactgggtatacccctctttccagccttccccatccacccgagcagatcgatcgacatcacgtgctagggttgcgggagccaggtgacggcgctccccatccagcgccgccatccccgccggcgctccgcatcgccgccgacctctcccgccgacgacatcgccgaccacagttcccgtgcccgagccttttcccaccatccagccaccttcgacaccactgccggtctccatcctgccactcccctattctccctcagccctgcagatccaggccgacaacgccaccagttgctagtgttgccattctccgtcgagctccctaaacaggacgaccagcactgactgggcaaggtaccatgtcctgaacttctccatttgattagctttgtatgttgtactgttgtgcaaaatagtagaactgaattgctcactgcgatgtggatttgtgtgtaaataatattgatgtggatttgcactctgatctgtgtatgtctaaatagttttgatgtgcatctgtgctctgatttgcatatgtgttatttcataagtactgcagatggcagcaacagtagtagaggaaaatcaagg

SEQ ID NO: 15676 - DNA, 1501 bp, Oryza sativa
tgaaaagataaagcatgttaaacaataagcacaatctgtgtggcgtgaatactccagccaacaaaattgtttagaccaactgctgcgaaatcgacgacggtgcttagcatcattcaaaggatactcttgttcttgcaagattggtcgaaaaggaccctcagatatataaaatcttcgagcttcatcttgttgatcagcaggaagttcaaatatttgagcccgtttccctgggtccctctcaaatgctgtagctacaatttcctgcccctgttcagcttctagtgatggtagtgtagccgcattttcattagcagcttgcaaatcaactgggtcaatatcttgggcaatgattggactaggattttcagtggagttcacccttgaaacaaccgggttataatagcaatcgattgtctttctcttcatcttgcttgagcaaataatgtacgactgaaaatgtgaaaatgttcagatttcagaagtgaacttttttaagataatgttcagaagtgaaatatgagacacagacatactatcaaggaaacaatagtgaaacagtggctgatctgattaattgattgggaaatagagaggaaccaaggaagctccaaagctggagcctggaggagatgtagacatacatacatacatacctcagtcaagagtaggtgtagtgcgttccaggaatttaaagtcatttgggttcgccggtctgcaaacaaggtggtacatagcctagccaaaatgtgcctgacaagtgaggagtgttcaacctggttttcagttccacctttatgtatttcttctctgttagttgaggactgtaaccccttaagcactgattagttgctttaggcttgaagcctgtttctcaaaataaaagaacaatttgtaccataatatataggcaattcttctaggaaacgaagagaaattcatgttactttttaatgtcaatctgtggcatctctagatacctttaacgctaagacagacatatttaagcttcttgcctccaggtaaaagcagcatacatgtcaacaaatgcatatattaatgctgccatgcagtttttttccttttccataaaaacagcactatatattttctcattattctattattttaatatttaaatatttttaccagttggtataaaattttattctcattattctattattttaatatttttaccagttggtataaaattttacctaagtaacaactgttagagtgcgcaacctggcccaccaaccataggccacccaggtcacatagggcctgctctgttacaggcctaaccgaagtcacaactttaggtcttgttagagtgcgcagcccggcccaccaaccatgggccacccaggtcaaggcctgctccaccacaggtccaaccgaagccacgactttagatcctgaacctacacaatccaaaagactagtctgatggtgaggattgcccccacctttttaagtcgtgctcctctatcatcaatta

SEQ ID NO: 15677 - DNA, 962 bp, Oryza sativa
cgtcttttaatatttcttttttttaattccgaattttctataaattgtatttctatatagactctatgctcttcttctaatattatttatttttatttctgaattttcatattatattttatatacgtgttagttattaattatttttaatatcaaatgtttagttatttgtaaattatatatattcctatatgaactctagactcatcttttaatatttttttaatttcgaatgttctgtaaattgtatttctatataaactctatgctcttcttctaatattatttatttttatttctgaaattttattatttctaattgtatttctatgtggactctaaactcatctttcaatattctttaatttttaatttcgaatttcagctacttctaaattgtattcctatattgaccttaaactcttcttcccatgtttttttttatttcgaattttagttatttgtaaattatatttttatacagactctaaactctacttttaattttattatgtttattccaaattttagttagttttaaattcctatatggactctgtcggtgacatgggaccgggagtatcatgactagaggcttgggcagccgcggtcacccacgtggcctgaccccctcgggggggtcgggcccgggggagacgtgccaccccctcctctgtctccccgaggggtcgggccgctcctggtttcggcccgagggctggggcgccccgaccccctgtggtattggcgccacgtgtgtgggttaggtgggcacagcggcttctcaccaaacccaatttattgcggaatggacaagcgcgcccacgcccatttaatgcagcacggcgcacgcatatccggtccgtgaccggtcgcagtgtgtgaccggtcacagaccggtcagatcgcggagtaagtggcaggcggcggcctgtcacacgcctggccccgtcccgtcggaa

SEQ ID NO: 15678 - DNA, 1501 bp, Oryza sativa
tatatttcagccataacaaaaaagacaaaattctgacaaattttcacccttaaaactgtcagatttttcactttttgttacagctaaaatataatgaatttgaatatgagactttgcagatatatgtaatactattaagagtatatgtctatttttttagtttttttgtaacatttgttaattggtgtgcacggagtgtgtacggaaagcttatgtgcatagtagaatttcccgtgacatttttctagtagtacttctacgtacttttgcatgtaagggttgttcggttactaacattgtcataaatcataactcactttagttaagtgtggcttgtcataattttttccctacaaattgtagaactatttttagaaacaacaccatttaaatgagaaattgcaaaagtagagatctgttggctaaaattgtaagtttagcacattgtcgaactttggttgtttgaaaggggttgcagggtaaaaacaacttgaaaactcatggtgcatgtgcatggcctattattgttggccactacatgcatgtgcttttaccttacatgaatgtgtaattagtccagcaacctttattgaacaatggttgttcgataggttatccgacgtgtcatgctcgtagcttcgtattgtggttgtttgatatacaccctactatcaaacaactaaatgattggtgaacaaacgattgagtatatgacaagaggggcaatgtgctaagaaagtgtggcaagtcataattgtagcaatgaaccaaacaaaaggttaaaagatgcagcagcctaaagtttggtatggtaagttgaactgttattagatggtacctaataggttattaggtgttcttataatgctttcaatgccgacatacttatggataatatcttttctagataatatcaataaatttcaaaatccatttcgtcacctaatggctaccatcgtctttttaatctataccgctgtaactgtttggttagatacgggagtaacattacccactgaaaaatccaacttagttcactaagatcaggcaagccatagaagtgaggctcattttctagaatatgaacttaatatggcctcgtcaggtagtgatgaaaataaagattaagtacatgcacgtaaaaatgagaaagccattagcacatggttaattaagttttaattatttcaaacttagaaaatagatttatctaatgctttaaagcagcttttatagagaaagtttagcaatttaaaaaatgtgttaacgaaaaataaggtaaaatatgtatcttactcagaaacgaacgggccttaacgataaatggattcacaatggagcttcaaaaacaaatcatcgtttcctaacccatttgtctataaacactttattttgggcctttccaactaaggcctgtgtggataatttcgcctctctataaatttcggcccacataacgtagttgggcctcaaccccaaatccccccaaaattctgatttc

SEQ ID NO: 15679 - DNA, 1501 bp, Oryza sativa
ggttgccgtcgttgccctagtgtttcttggcgaagtcggagtagcccggtcttgtggtgtgatatcgataacgtcacgtctttgccaatgtgtgggggtcttgttttctttcaaccttttacttgttcatatgaacggcgtttgctgagttttgggcttggctatcctgtgtttcgtcatcatggtagcttaggttagttggagtgccgttgtaattgtagtttttgcctagtctttcgtaattcagaatgccagctcatctccctcccctcttttctctcttcctcctctatctctatctcacttttctcctctctgcagggtggctggaaggtggggaggaggtcgctggggcgaggcgggaaaggagggcggcgtcgcactggtggccgcagccgtcggcggaggcaacgggggcggcgacggaggagaagggaggatgtcggtgtcgctgcttcgacactaggtggctcttccccggctacaactagctgcgtccacgcccgcgatgaagttgcccgggcgcggtggcgcccatagtcctcggtgttgcacacgcgaggccgatgcgcggatgagcacggaggatggcgacgaggaggatgttgtgctgagcacggggccggcgcagccgccgcccagcttcttcccgcgcgctcgcttgccacgacgcccgctcctcctgtcgccgcccccgtcgcgcggtggcggagaggcggtggcagcggcggcaactgagcgcggctgcggatggggagcggccgtctccgtctccgccgtcgccagaggaaggccatggcgacggaggccgcatgcgcgaacaccctcgcggcgccgccacagcggcgccgcagcacgatgaagatcccccgtgcggcgtggagttagcgggagaggtagtgtgcgtaggactagaagaagatgtagccggaggagcgtgtccccggcgggaagcagaggagccagcggaacggcgtggtgcggctccagccgcgccacgaccaccgtgtgtcacgtatctcggtgagcgtagagagcagcatgccagcgaagatgacggaggagacggtggccatcaggagcgcgtgtgccgcgggcatgggccctagtgggagcggcctccggcgacgcgcaggagggtgaggaagagcgcgatgttggaggcgaggaagccgaggaggaaggcccaggtggagaaccacagccccgtgaggctccaccggaaggagacgattgccgggtgctcgcgcgagccagtaggcggtagtggtggaggcgatggaggtggcggcgggcatggtggtcgttggtgtcggcgtgtggttggcgcgccttcctcctttcccgccgcccgcgcgctgctcctccgtcggccgcccgccgctcctcccccgccgcccgcccgcagctccttccccagccgccgcgttgtgggcctcatgggcggcggccggtgggggagcccgcgtgccgctccttcccccgccgccagcacaccgcc

SEQ ID NO: 15680 - DNA, 1501 bp, Oryza sativa
acgtgtgccaatataggccaatagtggcactaattgacaaaagttcgccacgcgagtcacggagtgatttttcgacacggactaacccaacatactccaatatgtccaaaaaatcacgttttcgtgctttttcaagtttttcattccggtgaaaaacatcgcacccacgtgtccaacataggccaatattggtattagttgacaaaacttcgccgcgtgagtcatggagtaatttttcgacacggacacacccaattatctacagtatgtccaaaaacatgtttgtgtgctttctgaactttttcattccggtgaaaaacatcgcacccacgtgtgccaatataggccaatattggcgttatttgacaaaagttcgtcgcgcgagtcacggagcgatttttcgacaccaactcacccaacatactcaaatatgtccaaagatattggcattagttgataaaagttcgccgcgcgagtcacaaattaatttttctacacggacgcacccaatatactccaataagtccaaaaatcatgttttggtgctttttgaagtttttcattccggtgaaaaacattgcacctacgtgtgccaatatatatctatattggcattaattgacaaaagttcgccgcgcgagtcacggagtgatttttcgacacggactcacccagcatattccaatatgtccaaaaatcatgttttggtgctttttgaagttattctttccggtgtaaaactccgcacccacgtgtgccaacataggccaatattggcattaattgacaaaactttgccgcgcgagtcacggagtgatttttcgacacggacgcacccaattctctacagtatgtccaaaaacatgttttggtgctttctgaacttttttattccgctaaaattcatcgcacccatgtatgctaatataggccaatattggcattaagtgacaaaagttcgctgcgcgaatcacagagtgaattttcgacacggacgcacccagtacactccatgtggagaatatggatatcccatatctacatgacagttataatttagtcggatatacggtaccaaatatagatagaatatctttatgaagactcgggtttgttttttacttgtatgtcaaggaaatacccgagatcttagtcggttaggattgtattttatctataatcccatattccgttaggatatggactgtattttgtaaagcggactccttcccctatataaggagggtccgtgtgcctctcggggcgcaattcttttttccaatatatacaatcaataacatactcggcggaatcatccccggacaggagtagggtattacttcttgaataagaaggcctgaacctgtataaaattccttgtctccaaacccatccactttcctagcttgatagccacccccttttattattgccgaaatcttgtttcgacagttggcgcgccaggtaggggcagcgtcaagtttttgccgactaagtgcga

SEQ ID NO: 15681 - DNA, 713 bp, Oryza sativa
attgggtgcgttcttggcaaaaaataacttcgtgtttcgcgtggcgaagttttgtcaattaatgccaatattggccaatattgccacaagtgggtgcgatgtttttcaccggaataaaaaagttcaggaagcaccaaaacaagatttttggaaatattggagtgtactgggtgcgtccgtgtctaaaattcactccgtgattcgcgcaacgaacttttgtcaattaatgccaatattggcctatgttggcacacatgagtgcgatgtttttccccataaagaaaaccttcaaaaagcaccaaaacatgatttttggacatattggagtgtattgggtgtgtccgcgtcgaaaaatcatttcgtgactcgcgcggcgaacttttgtcaattaatgccaatattgatatatattggcacacgtgggtgcaatgtttttcaccggaatgaaaaacttcaaaaagcaccaaaacatgatttttggacatattggagtttgttgggtgattccgtgtcgaaaaatcactccgtgactcgcgcggcgaacttttgtcaagtaatgtcaatattggcccgtgttggcacacgtgggtgcgatatttttcaccggaataaaaaacttcaaaaagcaccaaaacatgatttttggacttattggagtatgttgggtgagtccgtgtcggaaaatcactccgtgactcgcgcggcgaactttt

SEQ ID NO: 15682 - DNA, 1501 bp, Oryza sativa
tgcctgtatgtgtttgaggtaaagctagataagccaaagccttcgtttggtcaagctcctctgtcatttccaacacgtcgtccttttcccgggcaaaggccccacgattgttacgtagactaactttaatcactttggcacatttcaacaatctcgattacctttcctacttgaatctggtgatcataattttggctagcactagctagtccttttcagaatttgtagaagcttttcttcttcagggaaaaggtaagaatttacagatggttttggtgtagctggtgagctccagcttctttgacccggcatctacaaatggtaattaatacatttatttttcaagtctcagtttgatggtctgggagggatcctctatttcgtctgcattaatttcagagaatgacatgtctgcattagtaatagagaatggcatgtgttacttcagaataattagctgaaattgaaagtgacagtttttagattgtagtattagtgtattactagtatactattctgcaagatgcaatgtgtttctggatactaactaatctactagtagttttagtgaaacagctttgcagatgttgaatggtgccctcacattgctcaacggcataggattctcttggtacactaataaagcgaaggctagttgcctcttaataaaaatgctaagcttttcttttgaaaaggtactcagaagcaagaacttgttccagaggcagttcaaatactcaaaaagactatttataatttcatgtaccattatcttttttcctgaccattactgtgtttttttaagttgattttaaatactcttaaatcaccaaaaccaaattggacagcaagtatattccagtcagtttgcatatataaaaaattggcatccatggatataactgagaaattaccaacagaaaagatcattttttttctttggaatagtaacataaagaccattcttttgttgtttgaatggtaacagaaagaccattcttcaaagctgccaaagtttccttaaaactcagcctaaatgcaggttctcatcatcactgttctcaacctgctttcttcagtgttttcagctcccctctctcacaggttttggtcactcacacaagatatacgtttcagtcagtcaaccctggaccccaagaggtgtatgtgtgcgagagaaaaaaaaaatcctcctttccttctctctaaaagactggactcccaacgccgaagcactgggagtctgggaggagcaagaagaggagagaagagagccatggccaagaacaccgagagccccaaaacctagggaaagagaggaaaaaatcgattttcttgggtggtggttgagcctgcagtgaagttcatcagggaggaaagggaggggattaagggaaggagatacaggaatcaatgggaggccaagaacaggtggccatggcggagaggaggccttgttactgtcgcaacaatggcttcttgctgctgctggtacaagttc

SEQ ID NO: 15683 - DNA, 1501 bp, Oryza sativa
cagacttaccccctcagatgattttttcccagaaagaaggggtcgttccgaaatgtggttaaattagtttctggcccaacccaggagtacgtaaagtctgtcagcattcagcaaactgcccagaagcctagaaaatatgggaccttgggctttacggaccatgtaatttctggcccatttcgctacagaagggcagtactctctagcttgttgtaactagattcaggatcagagtattgggagttcacaatgtttaatgtcttggcatctgtcgtgtgatttttgagaaaaaatcacctaatttttttctcccctcagatctgcatccaacggtaaaaaaataacagtacagagaatccattcaaatagcctgtgattgtgcttgttagcagagtagtatttagtaaagattaacacaaatgttgaatttataactaaaattacagtgttttataactaaaattacatttgtaaaaacagtagatatggcatgtaagtgcactgtaattttagtataagtgcactgtaaattttggtaactagaatatttatcgttttagaacaaatacattacttgagaaaccgtgcagatatttgaagttataaatgttgcatttataactaaaattacagtgctttataactaaaattacatttgtaaaaacagtatatatggcatgtaagttgtcagggttatggataccatatacctaatagtagttgactaaatctcggcaggacccactacatactatatcccatacggaagcaatctttggatataggaggagttccagataaggaaagacaaccagaattctacatgaaaacgacaaggactactcggattgtatccatattggtttccctagttctacttggacaaggggacacctatgggtataaatacaagcctcctaggaggacagggggacacccaccatgagacgatcaacacgatcaacacccactatgggacagaggatcaacactcaacacaatcgacatagaagccacaacatagaagcctacatacgctaagacacgccgccggatatcgactttagagataagcacggctagtcccctacggtgtttccggatactgttaggagagacgaaagcgctatctctgatctcgccgggcacgaattcaaggaggaaggctaccctgttgtcgactacgactcagatcgtcagaccgccatgttgacaacagttagataggctaccccaaatattgtactggtatgattatcatgaataagagcaatatcggcttcggccaacaggatgtagggttattacctgacaattcaggggcccgaacctgtataaaaatccctgtctccgtctcttttacctcagtcttgcgtatatcctagcaccaacgatccccatcctgtccaaataccgtagtcgtgacatcaaacgtcgacagtggcgcgccaggtagggggattttggtgcttcaggatttcgacgagataggtttaagaga

SEQ ID NO: 15684 - DNA, 1501 bp, Oryza sativa
cgtagtcgacaacagggtagccttcctcctcaaatccgtgtccggcgagatcagagatagcgctttcgtttctcctgacagtatccgaagacaccgtagggtactagccatgcctatccttgaagtcgatatccgacgtcttgtcttgaagtatgttggattgtatgttgtggcttctgttgttccgtatattgtggtggttgttgattgaggtggtcgtctgttgattgtctatccgtattgatcgtctcatggtgggtgtccccctgtcctcctaggggggcttgtatttatacccataggtgtccccttgtccaagtagaactagggaaaccaatatggatacaatccgagtagtccttgttgtttccatgtagaactctggttgtctttccttatccagaactccctcgaggtcagttttcatataagacatggtatgtggtgggttctgccgagatttagtcaactactattaggtatgtggtatccataacgctgccagtagcccccgacttcaataaaaatgaacgagttcatattctcaaccgcagatcttggaggaactgttatcgagctaacgtgatcgttcttggtgagttcagagataacgttagacttcctttgtcagccttgtgcaggcaccgaaagggtttgtctaagtcaatctctgatgtcgaccgagaaagtacagagcatacaacttagtctcccgccttgctgtaatcgaggatttggattgaagtcaagaaattttatctcggtgggtacaccatctcttcattccgtattccttgtcgagatccagcaaccgttctcgagtgatcgagaaggcgtagagtctatgacggagccttgtcgacatttgtcgtactcgccttagtcgatcttggtgtagaaccatagagacatggagccttcgtcaatgtcgaatagaattttcctgaaatcaatactcagaaaagaatattagatagaaatagccccccgagcgaacgctcaaagggtaacatgttataatataacagactagtgaattgaatgtacagaccagtgttttgtatatgagcgtcttctctcttaccgactccgaacagtcagtttatagagtcatacactctccctagcccccagccttgtcgtcggagaatcgttctcggatgacaaggctcttggacctttgacctgcctcggtcgaacaagcactgatcctagcccccagccatgaagttggaaaactcaatttccgattacacggcttggttaatacgcacggcgagaactcttacacaaccagatcttacatggtctttcgtctctgaaggatccgacaaggccttatcggctctgggagtccccagccgaagttccctcaggttcctcggaggccttgtcaagacggcgtaaagggacagtaggataggtttcaacgctgggtgtcttttgtggtaagggatctctggctaagacacttggcgatcttgtgcacctgatatcaact

SEQ ID NO: 15685 - DNA, 871 bp, Oryza sativa
cgaatcttttgagtctaattacgccataattttgacaatgtgatgctacagtaaacttttgataattatgaattaattaggcttaaaaaattagtctcgcggattagctctcatttatgaaattagtttttttattagtctatgtttaatactctaaattagcgtccaaacatccgatgtgacatggactaaaaaattttagccccatctaaacaccccctaagttgttctggaatctgcacctttgaattaggagcgttgctaaactatatgtgctgttccatggcagcactgctggagttattgataccattttgtttcagtgacccaataacacacttttgtgtttcatatcaccaaactgcagtttctgcagaccctaggacattatttgggggacaaagtagcactgtaactaggatcatgaagtcaattttgtgtttatcatcaatctattgaattcgttcaaaaaaaatataatcaatctattgaaactttgtaactgtatgtaagataacctttctactaatatgatgcattaaatatcttagtataaaacctagctaatttaacatattgtgcaagtatagtattattatatcctctgcaagtatatcctctactgcctggggctttgctttgcatttcccagataacagtaatcaaacactcacttgagctttccaactaaagaaatcaagaaaagatgccatgacaaatactagttcaccacaaaagatacagtagtctccacaacaagagcactagttctgattattactattgtaatagaacaactgatacatgatgatgaattctatcaagagagctccggggatatagacactccattaccatcttcttgtcgaga

SEQ ID NO: 15686 - DNA, 1501 bp, Oryza sativa; identical to SEQ ID NO: 5134

SEQ ID NO: 15687 - DNA, 255 bp, Oryza sativa
tatgtaattataatttattttattgtgacttgatttattattaaatgttctttaaacatgacataagtatttttttatttgcataaaaattttgaataagacgagtggtcaaacgttggttaaaaagtcaacggcgtcatacattaaaatacggagggtatattatacagcacgtatatacgtagaatggagcatgcatatggtacgtacgtataataccggtggatgtgaagtacgtactggtagcgtaaatga

SEQ ID NO: 15688 - DNA, 1501 bp, Oryza sativa
tgaaaacaaggcaatcttccagagaatgtctgtccgtcttgtgtatggggcaccaagatttctttgtgtcgctgccttgtgggtctgggcacttgggggggttcgcgtattctgctgcgaggacttccgcttgagctttccttttcccgtttttgtgatttttcttcttgcttgactcatatgcgtctgtggctgatttcttttctcccccggtcttcggcttgtcgttcttgcgtcttagcgcatcgtccacatgggcgcatcgctcaacgatctcgaatagcctccgagtggttgtgatgggtcttgtcaccaattcctgggtagtgtaacgatctctgacaccggatttgaaggcacggattacagaagcgttagcgatatcagggattgtgtttctgcattcgttgaagcgtcgaacatattccctcaatgattcacctgagttctaggtcgtctcacctgagttctaggtcgtcttcgatcgcgtggcgcttgtacgttccttgaaaattggcgacgaattgttgccacaggtctgcccacgaagagattgaaaagggaggaagatgcatcagccatgaacgtgcagaacccttcaacgcggttggtaaatagttcgctagcgcgttgtcgtctgctccggcagcatagagtactgtggagtagacttgaaggaattcttctgggtcggttgtcatggttatggataccacatacctaatagtagttgactaaatctcggcaggatccaccacataccatgtcctatacggaaactgacttcagatattgagggagttccggataaggaaagacaaccagagttctacatggaaacgacaagtactactcggattgtatccatattggtttccctagttctacttggacaaggggacacctatgggtataaatacaagcccccctaggaagacaggggacagacactcaccaagagacgatcaacacgatcaccacgatcgggacgaccacctcatcaacacctaacacgatcaacatacaagccaatatacgccaagacatgctgccggatatcgacttcagggataggcatgaatattcccctacggtgtctccggataccgtcaggagatacgaaagcgctaactctgatctcgccgggcacagatctgaggaggaagactaccctgttgtcgactacgagttatacctttagaccaacatgtcgacaacagttagataggctgcccacatattgtactggtgtgattatagtgaataaaagcaactccggctccggccaacaggatgtagggttattacctgaccactcgggggcccaaacctgtataaaaatccctgtctccatctcttttacctcagtctcgcatatatcctagcaccgacgatccccatactatgcaaatagcagaatgacgacatcaaacgtcgacagtggcgcgccaggtagggggattttggtgctctaggatttcgacgagattggttcaaaaga

SEQ ID NO: 15689 - DNA, 1501 bp, Oryza sativa
cagtgagcgagcagaattatctctcgaacaccgatggaagctacggtgtgagagattgctgcatactggtgcgagaaccagtgagcgagtagaattatctctcaaacaccgatggaagttgcggtgtgagagattgctgcgtactgatgcggtgaaccaatagtccactgatggaagtgctagagttggtttattgcaagtgtatttcatgtggccagcatgactcatgtactcaacttatagcatatccggatgtctgttcgcaatcatgtcggttgatcaagccgacgacgttcgcgaggaattatccgttaacaaccttttctcgagtagtccagcatggccggtgttatgagataggtcgtcggtctttgttggtaggttgggtgcgatagctccgcatatgtcgagaatgttctcgataatggagtgtactctaccataacctactcgagtgctgttcctgaaaaatattttctagaaggcaagatatatagcagaaaatatcgagtatgtactcaaaaaactgcatggagcttctagtattatcaggagataacgagtagatgtaaatatcaggcattatgtaaatcgtaaagaagcatgatttatacagaagaaaacagagcgagcccccagcgttagaccgtagttggcctatcgtcggaagtactcgcacaacggatattgtataagaaacatgctctaggtaaacataataaattatagatctgataatgctgtataatctggataggtacgataaattgcatagaaaatattgcgtacctttgtagatacatgccggatgtatctacaaaattagtagatcaattaagttaattaacctactaattaccttgatttgcatgcccgatatactatctacagaagatatatatatatatatatatatatatatatatgcgcatgcagtagactttgatgtatcttattggtttggtcgtagagcagtgtaacctgtcacatgcatacacgtgtctaggcatgtgtacgtgacatggttaggcaagcgtgctcggttgaccaactccgggtagaacacgacacgtcagtgacacagcggcacttgttctcggatgaatcatgtgcagcctgcgtcgagcgattttggttgtgggaatcgatgccgtgttggatctgggctgaagtcgcgcgggcggcaataccgatttgccatcctccatggtggccacgtcttgatgaagattgatcgatctcgccagatcgaaaatttgacaatgatggttccgatcttgtcggaagacatgctctgaccgggttagatctccacagccgaagtcgtcgagtagcttgttgtcggagaatccgtcttttgaaccaatctcgtcgaaatcctagagcaccaaaatccccctacctggcgcgccactgtcgacgtttgatgtcgtcattctgctatttgcatagtatggggatcgtcggtgctaggatatatgcgagactgaggtaaaagaga

SEQ ID NO: 15690 - DNA, 239 bp, Oryza sativa
ctgtggtgtagaaaacaactgaacactttcaaccgtttgaaccaggtggttttgtggtgaaccagaattaaaccaagactggctggaccagctggtgtagaagagtcaagttattgcctcaaaggctcgctacaccatttttaacccaaaaatgcctcaaaatcgttggtggaggtttgatcccagactggcaagctacaccattccaagtggtttttgtgttgaaagtggaatataga

SEQ ID NO: 15691 - DNA, 585 bp, Oryza sativa
ccgcgcggcatgccagagaaggcgacgatggcgaggcggtcggatcgcatcctgctccgagctccatccgagagggaggggggaagccgcgcccagctcctcatccccgccgccgccactctgcgtcactcaccgccgccgccgctccgtgtccctcgtcgctgttgacccgggagacggtgagagagaggaagagtgagagagagaagtgagagagagagagtgagagggaaaagagagagtagtgtatgataggtgggtcccacattttcttaataaataaaatgctgactggaccaccacgcgtatgccacgtagaccaaaaccaccacggattaggttgaggggggtaattcgtccggtttgcatagttgggagtgaagaatgtccggttttgtggttcagggaggtaattcggacgaccgcgacaattcgggaggggtgggagggaggggggtaatttgtattttttcctatattgtaagactacgggcatctaagtgaaaaactgacatgttcaagctgccaattctttatgttgaaagcacgagacctaacgatcttgggaatattttgcgaaccctc

SEQ ID NO: 15692 - DNA, 1501 bp, Oryza sativa
tactccaatacgacacacctgttgtctctcatttttattgtaattgagatttttaaaatcaaatatgattatcattatttttttttactttctagaagttccgccaaccgccttaactgattgcttcatgagctgcccgtcgtcctttccttttaatcgacattaggattttctatttggtgttttattaatagtttttagatgtccatcaaccgccaccactctactcctatatagatgtgttacttgattaatctcgtcatgtgttttagatggtcttttctttcaatagtctttattttttatcactaattttagttattcataaattgtattccgagttgaaatattatctttcttttttaatttcagaatttattttatttttcatattgtgtttttttatatttttatttttattttcaatttcagttgtttcaaaattgtatttctacttgaactctcttcttaatttgcctaatttcagattttattttattttttattccaaactttaattaatctactattatgttcttatatatactgttatttcaatattacttatatttaattccgaatttcagttaattctaaattatatttctactagaactcttcttttcttttctttttttctaattttgattttttattttttattctgaattttaattaatctcgtattggattcttgtatgaactcttctttcaatatttcttattttcaattctgaattttatttatttttaaattgtattcctactttaactcttcttcttttttttgctaatttcggattttattttatttttattcggaattttgattaatctcgtattagattcctacgtggactcttctttcaatattgcttatttttaattccgaatttcagctatagttttagattgtatttctacttggactcttcttttctttttctctgattaatgtgtgaatttctagtctccacagcgaacatggtgcctcctttcaaggctgttttaataatataatagaagatagattgagggttcgcaaaatattcccaagatcgttaggtctcgtgctttcaacataaagaattggcagcttgaacatgtcagtttttcacttagatgcccgtagtcttacaatataggaaaaaatacaaattacccccctccctcccacccctcccgaattgtcgcggtcgtccgaattacctccctgaaccacaaaaccggacattcttcactcccaactatgcaaaccggacgaattacccccctcaacctaatccgtggtggttttggtctacgtggcatacgcgtggtggtccagtcagcattttatttattaagaaaatgtgggacccacctatcatacactactctctcttttccctctcactctctctctctcacttctctctctcactcttcctctctctcaccgtctcccgggtcaacagcgacgagggacacggagcggcggcggcggtgagtgacgcagagt

SEQ ID NO: 15693 - DNA, 1501 bp, Oryza sativa
ctagacaatcgataaactaatgggaaaacgagcctaatgctcggaacggctcctgcggtcggtggagtcgaaagcgtcctcctgctcgtcacctggtccctctgaacgactcctggagcctgacagatcagtctcgccgctgccactgggagtagcggacaaccaacctccggtaccactggctggacctctggcggctgatgctggagcgaaggagagagtgaacgcgggagctggagctggagctggaggaactgcgggaactgccggagctgcgggcggaactggaggtgctgcgggagctgctggtggaggtgggttcctgggcgcaagctggatgcgcacgggtgcagtcgtcctcttacggggcgtagtgcggatccggactcctcctggtgctggaagacccttcaactgagcattctccttcttcaggcgcgctatctcgtccttcagagcgacgatcctcatgagcttcccatcattcaaggccttggtcgccttgtgcaggtccgagtgcatccggtccaatcccctcatcacagcacacatgtgaccgaaggtggtgtcgttctcgccagctgtcggacggaaggagctgacgccatcaccatgggctcgacgggggtggtagcggtacgccgtgtcgtggaagatgtagtcgtggcgctcccgtagtctggccatcatcaagtaggctgcctcctgacaggcgtgatctgctgtgcctccagatgcctcgaccgccatgttagcgaggcaagtccccacgtaaccatggacctccaagcggacacggtgaggaagctcgccactgagcggcggaatcgtcgtgtactccggcgcgtcggggtagcccaccaccagggtcatgcgtgccaactctgccacgaaatcaatcatgccttctccgcggtggttgggtgggtgaccggccatctagagaagacaaaggagtaggatcaatgcatgctcaaatccaaatttaaataaagcaataaagactcaaataaaggaatcaaataagagcaaaattttatgcatagatcattttacatgagcgcgaataaataagacagactcacataacgataaaataatgagaaattagatacatattaataataacgaacaaagcataaataccttgcaacccatgataccgagctaggaccgagtgcatttcacccatcaaatcccaactgactgacgaataaatcccaataattttactaaaaccctagactgactcgttttgaaaaactcactttaaacgagcgaccaagatttttcccttgaaccataagaacagatccccattttcccggaacaaaatccaattgcaaagaacatatgcaatgaaaaggattcagagggctcttaggtctttccatttggcttgtcctacggtcaaggtcggctctgataccaacttgtcacgcccagaaattcccgaatagaattccaagcagaatgtgtattaaaacccccgtccaggacc

SEQ ID NO: 15694 - DNA, 1501 bp, Oryza sativa
cgttttattttttgttccaccgaaaaatatttcacctattgtacttataatgtttcactatatatagattaaatgttgcagtgaactgaaacaatctttcgctatttgctgaaacattgtttttatataaggtgaaacaacactcgatttaaacgagtgaaacattttcgatctacttagtgaaataatttcgatataccaggtggaacatcgtgtaacatttaaaaataattcaaaaataagctaaaaaaatttttcgtcggaatatatccatgtgtggtcttgttttgaagatttaattgcaatgaatttaatggtgcaattggatcataatttggataagtaatttaagagaaaaaacagttgaaaggagtttttgcacgtaaatcgggcgctgacgtcaccgaatttctcgaaatgatcgggcgcccgagccatacaggttcccttataagatgttgtaacaccctgaaaattcgaccgataaaaccaaaactctaaaaatacggattttcaaaaactttttaaatcaattgcatcatgctgatcttattcgcctatttttggatttgatctcgaagtttattaatcgtgagtaaagaatagttaattagaaataaaccttaaaaataaattggtaaaataaatataaattaaaataaagattaggtgtggatagaagtaaataaaatattgtcgcgaccatatttggatcaattaaatttaaatacgatggaataataattaaccctaattaaaaaacttcaaataaattatataaataataataataataataataaatgtgtgatattaatctagggtgagttcattagttgagataacacaattattgagtaaaatgcatatatgcaaaaattaggaattgtggaattaaatttatatgggaaatacacaaaaatcggtttaatagaaaaaaccactgttcatcggccgccacacgtgttcgacgatgtcccctagccttcctcccctctccccaccgctgccctagccgcgccgagcccgcgccgtgccgcacgccgtcgcctgtcgccgtgcgccgtcaccctcgccgcctgccgcgccgctgccgcgcctcgcgccgtgcgtcccccctcctcgcgccccgcgccgccgcgccatcgtcacctgtcgccgcgcaccgtcgccatcgctgctgccgcgccgcgccagcgtcgcgtcgccgcctcgcgccccgcgccccgcgcgccgctcgcccgtgcgccgctcgcccatcgcgtccgcacctcgcgccgcgcgacgccgctgccgcctgcccgtcgcgtcgccgctgtcgcgccgcgcgccgtcactgtcggccgtctcgtcaccgtcgcccgttgcgtcgcccgtcgcgtcgccgcccgtcgcgtcccgccccgagccccatgcagtgcgccctcaccccgagccccgcaccgccgtctcgtctcccccttcccctctcttccttcccctccctttcttcctctccacg

SEQ ID NO: 15695 - DNA, 1385 bp, Oryza sativa
ccccccccccccccccccccccccccccccccccccccccccccccccccccccccccccccccccccccccccccccccccccccccccccccccccccccccccccccccccccccccccccccccccccccccccccgccccccccccccccccccccccccccccccccccccccccccccccccccccccccccccgcccccccccccccccccgtgccacggtgaatccggaagcagcaaaggccgtcgcagggcccatccatactccatcatgcccactctagcctgggtacgtcagctagaggaaagctacagatcaagtagttacccattcccgcttgtggtacgcgcagtaagtattccagttcatcccgtgaaccggaccttaattgccatgggcgcgactagcaaaaccatgcacccacaacccaccattaagtcgtgttttatttggataattacgaccaatgaaacatgatcggatgtcttgagcacgcagctcatcaagatacgagatgtctaatgatgtgattatcccattatgtgagctagtggtagttaagcatggctaatcctatagttctagctaggtcaacttaagtaacacaagctagtcgaattattacccaagtttgacaaaggacagacataaagtaatatggcacaaatgaacatataggtaaaaccatgatcccacgtaattagcaagacatgcaattttatttgaaaacgataaaacatttataaactagaatcaacattctcaaggggaatgtgtgacttgccttgcttcttcaatataatcttctaaactctttcctcgcgaccacggacttccgaaacggcggaatctacgtgctggcatgcaaaacgaggaaaaactctaataaaaatcaagttaacaatacatgaaaagtaaacaaacatgcagagctcaattttagatgaattttgcaagttgaacaactcaattttagaagttttgagccatttaaatggatttctagaagttaaaccgaatttattgcgcaattaaagctatttatggcgtcagccgaggggattaggtggcgccgacacgcagccccacctgtcggtgagggggagggcgcacggtggaccgagttcacgcgcacaccatctgcgggtgcaccacgtggtggccatggcggacaggtaggcggaggtggcaccgacgtggcgtcacgtgggagctgacacggggcggcaccgaggggccacgtggatggcccagattgccccaaagggggatcaggcagccatggcgagcgggaggcggcgaatgcggcggcggcctcgggttcgcagtggaggtggtgattcggtggcggattggggaaatggagcaaaggccggca

SEQ ID NO: 15696 - DNA, 1501 bp, Oryza sativa
gaattctaacggtgatagaaaaaaaatttggataaaatttgaaaagaaattgaacaaaagttgttaggaaatcatacagattatatccaaaccattttgtataaaaaattaatatatactttataaatgagataatatcaacatttttatagcacacacaacgcaagcaaatggaagtgaaaaaagagagagagaagaaattcatatctttgcttgaatcgaacacaaaacctattgattaaaacctacaggtcataacgaattaatcaaagcaactttgtagtagttattgacgctatgtccagaaaattcaaaaaaaacccgaaatgtttggccgataggagattttatcgggggtagcgataaacgggaaaatcggacttatcagtgaccttgtgctttgataattgaaaccctacggccaccctaggataacacatatagcacatggtaaatgtgaaaactagatgaaatttgtcgacgtttgatgtcgcgattccggtatttgcatagtatgaggatcgttggtattatgatatatgcgagattgtaataaaagatatagggacgaggatttttatacaggttcgagcccctaaattgtcaagtaataagcctactcctgttggtcgaagccggtcgttgctcttattcatcataatcacactagtacaatatttggggtagcctatctaactattgtcgacatggcggtctgaagtgctgactcatagtcgacaacagggtagccttcctcctagaatccgcatccagcgagatcaaagacatcgctatgtctctcctgacagtattcgtagacgctgtaggggactagccatacttatctctgaagtcgatatccggcgtcttgttttggcgtatgttggcttgtatgttgatcttatgtcttgatctattgtttcgtgtcccctctcctcctatggagccttgtatttatacccataggtgtccccttgtccaagtagaactaggaaaaccaatatggatacaatctgagtagttcttgtcgtttccatgtagaactctattcatccttccttgtgcggaactcctcctatatccgaagattgtttccgtataagacatagtatgtggtgggtcctgccgagatttagtcaactactattaggtatgtggtatccataaccctgataaaattcatattaaaaaaaattgaattcaaaaattcaaactcagggggacaaacattattcttgggaaacccgaaaagtgagaaaaagtttcaaaaattcaggtaaatcatagataattctagaaaaagtagggcaaattcagaagatgtaaaagaataaagcaatcaagcatgcaatttcgtgtgaccatttttgtattttggaaactgaaacatagtagaaatcacgatcggctctctaagataggttttgtgaatagcactcactattagcctagcccatttgcttatttttcttttttttattttcaacttgggttgggtaca

SEQ ID NO: 15697 - DNA, 1501 bp, Oryza sativa
cttaacccctgcttagaatatgattatcacaattaatatataagttattagttgagttctctttacatgatcttcccacgggataaaataaatacgatacccttggaatactcttgggtgaaatgctacaatattatatccgtgcgcttgcggatgaactctgtaaccataatataccagaagtatttctgcgtcattgctgggaattatatttctaataatgtcgttaagaaataccaacacttgtcttgtcgtatgttggcttgcatgttgatcttgtgtcttgatctattgttccgtgtcccctctcctcctaaagggctttgtatttatacccataggtgtccccttgtccaagtagaactagggaaccaatatggatacaatccgagtagtccttgtcgtttccatgtagaactctattcatccttccttatgcggaactcctcctatattcgaaggttgtttccgtataagacatggtatgtggtgggtcctgccgagatttagtcaactactattaggtatgtggtatccataaccctgacagtagcccccgactttaatgcaaattaacgagttcatattctcaatccgaagacctcggaataactgttatcgagctcacatgaccgttcttggtaagttcagagataacgttagacttcccttatcagcctcgtgcgggcaccatatatgtcacgcccagaaattcacgaaccagaatttctaagctgaatgggtattaaacccctgtccaggaccagccagggtacacaaacgacaattgttgacatacagatccacgtcttacaaaaatataaaggattacaaatgcagcggaaaaggtaaaagcgagctaagcctgaagacttgactcctgcagcgggcgattccattccacgggcaacccttgacggcagcgacgaaaccaacctcttcaagacacctccaactgagaagaacttcaactctggtgtgggggaaaagagcaagactgagtactacccactgtactcagcaagtcataccggaagaggaggcatgatgcaggatataaccaaaggaggctacggggttcatttgcataaagcaggcatttaaaaccagtagttgaaagatttaaacagttgtaataattaattagtatcaactatccactgtccaacactaacccacgttgcgacaggcccaaccatccacctaaactatccaaattcaaaagattacactagggtgagactaatcacggtgaatctggttgaccgcccataaccgcgggcacggctattcgaatagttttactctgatcagaggtgtacaactgtactcacaagacacagccccacgacacgtttccgtgcgctgacatgccaccacgacatatcggaaagaggccgtgacaggacccttcgcataaccccctctagccaagcacaccacacctcaggtttcacccccatccccagtgggcaacgggcagtcccctctcgtgcctagg

SEQ ID NO: 15698 - DNA, 1501 bp, Oryza sativa
caggaaagaagggcaggtctccgtcggtgacctcttcttcgacgagccgtcgccgtcgtcctatttccgcctccccggcgactccggtcggtaccagcagcagcagcaggcggcgatgagcgtcctcttctctcaggcgacgacggctgattccgacgcggtggcgccgcgtcggtccccgctgcggtgcacggtgcatcaccgtcggccggcgaccgcaacaccatgaatcatatcatggtgatggaagtgcaaggtggcaactggcaacagaagaaattaagcaactcaaatggaagcaaagcaagtgaagacttgcttaggtggtaggaatggaggttggtagattaattgtggtatgcatgcagattgagcaactgtgaatattatactagcataagttgcagtatatgttactgttttttttctatttcttttctttttagattgtgatttgtgaaaatgtgcagaaatgatgcatgggtgcaagttctcccaaggagatctctgcaccataattagagtggaaagttgagagttgtgtatagtgccatcgaggaatatggcaataaaaaaagtgtgtacatgtacaaagcacgtatatatacatgcatggttgccaaaaaaaagagagaggaaagtgttaaaattgtatcctatagaatcttagttcttcaatctagttcatgctgcaatcttaacattgggcttcaatctacccaagcacaatacgttcattaaaattatcttagaaatgagaattaatgaaacctctggttccataggttcttgaccttttgaataaggtcagacaattacaatttttaaaatatttagtttgaagatactatagcatgatgtataatttagtattaaaaagtatttttaataaaattatatatttattcaactctttacataatataaaacaaaatcgtcatcaaagatatattttagaggccatatcattatctaaaacatcaaggattatgaacctggacggagtagtaaaccaaatccagctgaacagaagaactaggccgggccgtcgtagtaggccttggcgccgtgcttgagggcctgctgcggcggttgcacgctgtcccggagcacacgtagcggtcgcggccgctgcgcttgtgcggggcctcctcgcccagcctctgccctgcccgcagccgcgcggtgaggtcgtcggccaggagggagcgcggcgtcggcgtcgaaccccctgtcaggagcataggagggaaatggaattctggaccaaattcagacaagggaattcagagaagttcagaatgttcagagaacgattcagaagtgaagtaatgaatccaacggcagtggagaaaaaaaagggagatcggatggacgagatcacttggggaccactgtagttgtcatttttcatttttagcaggaatcacgcttcagatgctgttttgatgctacttttcttgtctttatgtttttacagctggatgtaatgcttgaattg

SEQ ID NO: 15699 - DNA, 419 bp, Oryza sativa
ctgctataaatgcggttaggtaagcccgctgtgctcacctaacccacacacgtggcgccaaaaccacagggggtcggggcgccccagccctcggggccgaaacgggagcggcccgacccctcggggagacagagggaggggtggccacgtcaccctcgggcccgacccccccccccaagggggtcaggccacgtgggtgaccgcggctacccaagcctctagttacgatacccccggccccatgtcaccgacagtagcccccggcgttatgccagggcgatcgcccccctcgagggaagcgctcgggcgtgacgccactccttaggcccggtgacaggtggggccggtccctacaggcgggcagaaacccagcggtcgcaaatcgcgcgcatcggcaagggaaaaccgaccgacaataa

SEQ ID NO: 15700 - DNA, 1501 bp, Oryza sativa
tgtgtttttttttaatcaggggcgcacacgataggggtggcgcattgcagctcgttcagctcgaggctgtacgggtacaactccagcacggggcaggacccggcgctgaacgcggcgatggcgtcgcggctgtcgcggagttgcccgcaggggagcgccaacacggtggccatggacgacggcagcgagaacacgttcgacaccagctactaccagaacctcctcgccggccgcggcgtcctcgcctccgaccagacgctcaccgccgacaacgccaccgccgcgctcgtggcgcagaacgcctacaacatgtacctcttcgccaccaagttcggccaggccatggtcaagatgggcgccatccaggtgctcaccggcagcgacggccagatccgcacaaactgcagggttgcaaactgagctaggcctcgcttgctgaacaacaacatttttgaagcctctacttgttcctatcatcagagagtttttgttcttcttttgtctctatgctttaatttgtcaaacggcaaaaattcaatggaattacgcattggttttgaactaaattatccaaccattacgcgtgagatattcattgctctttggaatttggacagtacagtgaggcacgagagattagcagacatgcaagctcacaggttctcgaagctctgctaaaaaaatcctgcgaagccatggcgcgttgcctggaaatacaggggaaaaaagtgttttttatttagctggtgaatgcatggatcggcgccacacgctgcgtacacacttttagtcatgtgccaagcaaaattgaaagccaacctaacaatctaatctagcaatcgcaattttttatgttgaaccggacactgaatattgataaggctgagactttctacgaacaattgttagttattggccgtaaagttgatgctggcgaaaagaggcaacaggcctgcaaatgcaatgcaaccaaagcagagccaactttgatatcaagatggaagaacaaacaaaaggaggacttagtggttcgcccgagtacaagacgagtctaaggaaataatacttctgaatcctgataccggtattaatgaagtatggtagtgatcatgcaagcaattcgattagtactgttactgattaagcaaactgctgaaaaagatatttcttctacagtgctggtactgatttatgcaacctcactttatcatggcttctcaaattgaggtcaaagcgacagcagtccatgctggattgattggtaggctataaattgccaggtttctttgcgcgatttatgcatccagcttctaccaaacacgactacctgcatggctgcatctgcatgcatgtgcaggcagtaccacccctactcatccatctggtaggtagcagttaacagaggggatttatcccttttttttccaggtagataaacacgtttctgaatgctaaagaagcttgaactcgaattattctgacagtgaagttttgtcctgaa

SEQ ID NO: 15701 - DNA, 1501 bp, Oryza sativa
cctgacacacgagtcactcgcgcggtacgacccggtcctcacggctcacgccatcgcatcgcactcgacaccgtcctccccacgcgggggctctcactgagaggtgggcccatcaggtcatacccacacgacaagtaacaaacgccccagtccaggagcagttgggcccgtaccgccgcgccgccgccgcctgcaacccgcccatagaccggagcccatccccgccgtgcgttcgcgcctcgagatcgggcgtaggcccggtccaccgcgttgcgcccgtgtccccacacgccagtgggagagcccccgcactgcccctcaggtgggcgtccattaatcgggaactccacgcgccgctgcgtcccttccccctcctctccttcctcctcctcgtccgccatctcaatcgagagagcgagcacacgagagagagagagagggaagcggaggagggagaagagatcagaggaaagaggaagagagagagagagagaagagagagagagtgaagagaaagagtagcgttgatacaccgtcgaatcgaatcgaatcgtgccggacccccaccatcgcctcccctctccccatatcggaatcggaatggggagcatcgcatcccttccctttcctttccctcttgcgtttgcgtgattcgtacggtttatcaccgcctctttctcttccactctccccgtcgcatcgtcgtcaccgccgcgcgcgccgcaacgcccacgcccaccggaagtagtagcagcagcagcagcagtagtagtaccaacattcgttttcccctcctcatctctcgtcttttgtattctgctgcttctgattaatggaggagtgaagtggtcgggtgttggtgtggtgctgtgtgactgcttgcttgcagctgctgttgacggcgggagcgatggcgggaggaggaggagttggaggaggcgctggcgagcacgcggcggcggcgtactggtacgacgcgtgcgaggacggcgcgtcgctgctgtgcggcatcgacttcgccgcgtccgcggacttcgaccccggcctcatacccgcgatggacaccggcgccgacgacggcttcgtcgccgagatcgacaggatactcgagagcatcaacgcggagagctcccctgcgcccccacccccgccgccgccgccgctacctgagcccgtgcctgtggctccgccggagctaccgattcaggaaaagcaattacaggtggcctctgcgcccgtggccaacaatgccgtggcggtggtgggcgttgtgcagagaagtaaaggcgtggtggcgaggaaggagccgaggagggagtcgcatggctgtgctgcaaatggcggcggcggtggggagtggagggacgggaagcgcccgcgcctcgcctccggtggtgtcgggggaccgcgtcaggagtggcggcggaggccgatgctgccaccaccgccctcgcgtgggtgggatgacaggcgtggaaggcgcgatttcgacagggtccgc

SEQ ID NO: 15702 - DNA, 1501 bp, Oryza sativa
gaagtttatgtcaaacaaccaccaggttttgaaaatcctgattttcccagccatgtttttaaattgtctaaagctttgtatggtttgaaacaagctcctagggcatggtatgataggcttaagaactttttgcttgcgaaaggttttacgatgggaaaggttgacaaaacgctttttgttcttaagcatggtgataatcaacttttcgttcagatttatgtggatgatatcatctttggttgttcgactcacgccttggttgtagattttgctgagactatgcgcagggaatttgagatgagcatgatgggtgagttatcgtactttttgggattgcaaattaagcaaacacctcaaggtacttttgtgcatcaaacgaagtatacgaaggatcttttgagacggttcaagatggagaattgcaagccaatttcaacaccaattggttctatagctgtgttggatcctgatgaagatggtgaagctgttgatcaaaaggagtatagaagtatgattggatctttattgtatctaactgcttctaggccagacatacaatttgctgtgtgtttgagtgcgcgctttcaagcttctcctcgtgcttcacatcgtcaagcggtcaaatgaataatgaggtatttgaatcatacacttgagtttggaatttggtattctacttcatcttcgatatgctgtcgcgaccgagaaagttgccttttcccgaacgctagtgtattaatccccgtcccaggaaaagccggggtacaccaaacaaacatgatataaaagacacatctttattatatcgacaatatttacattattacaaaggcgcttcaagcctgacaatcaaaaataaacagcagcggactagcgagcctacggctccatcttcacaggcgctcaactggggtataagccaagactccacctaagacttcttctctaaagcttctcttactgaaggggggagaaagatagagcaagaatgagtacaaccacagtactcagcaagccacaccggcggatgcacgattaatgcaaggggggtacaggggtaatgatataggggttaagttttgcagaaaacaacatttaaaagtcacttagttgccccaagccattttataaagacgatcctagagtcacacagtgttattaatcaaggccgtgaaccctcacgaacctgccttaacccaaggcctacgatgattcagaccgaactggcaacccgaccttgggtcccagctcgtcccaagccaacccaggccaaccattccacattttagttgttgagcaaattttaagaattaaaacactaacttgggtacattgctcggcttgcccataaccgagggcgcggctattcgaatagattttactctgatcagaggtgtacatctttacccacaagacacatcttcctcacgtgtaaccacgtgccacataccaccacggtatacagacggaagacgtgacatagttcccaacccatcctagc

SEQ ID NO: 15703 - DNA, 1501 bp, Oryza sativa
gtgcgcgtctactagctcactcaattacggctactagctactgtagctatactaacgaagtgactggccagcgtgaagacagaaatgacagctaactagccacggccaaggccagtatagcatgtactcatcaccagtttttgtcaacgtctacagtctactactacactggcattcatgggccaagtttagccatcttgttatgttacatcgggccagatacctgcatgggctttgctagccatggagcccaatatggcaaaggcccataaggaggataacggaagcccactacaggctctcggcccacaaggcgcgctctctggatcttttccccgcatcccccgcgtcgtgccggcggtggcgcgacggctgcgcggccggctacgtgttcgcgcgcgagccacaacacgtctcacctcacccacacccactctcttcttctgcttcctcccacgccgcgagagcgcgcgcgcacacgcccccgccatggctctccccaccacctcccccctcgccgcggccgcagcgaggccctgcgcgttcccgacgccgtggagatgtcgctcgccccctcttcgccgcctcccgcacgtctcctgccaggcgaaccgagggggttctcgggacggcaattcgttgagcacctcggcggcggcggcggcggcggcgtcgccgccgccgaggtggcgtgccgcggtgtccgcggcgctcgcggcggcgattgtgtccgcggcgccggcctacgcggatcttaacaagttcgaggcggagcagcgtggggagttcggcattggctccgctgcgcagtttgggtcggccgacctcaagtacgttacgcgggctcctttcccctttcggatcctttcgttttgcctcgtgtcgctgatattcttcgccccgtgcttgtatcattgcaggaaggccgtccatgttaatgagaacttcaggttggatgcctaatttcacaaatcccaaattagtattctttcgtgctgcggtgctaaatgtttgctgcttaccataggttttatgtaataattgaaccaaatgaatcctgtgtttccaatttcagctataaacagaaattccatttggtctatgcctgtttgggttataaagtaattttggttctctgcaagtgttgatacaaacttttctctagctcatgcttatgctgttatatcatcatcttagtattctggatagatagacacaatctctggagtccagtgggttatgcattttttttcaagcattgattccattgcaggctatagataagacataaaagctcttgcagtttaaagtttgcttagttaagcagttttactatagtactatcatattggcatttattgcttaacatattggcatttatgtggagggtggaagattaaaatagtaatatcgcaaaatagtaatcagccacataaaaaacaatctgtagatgagcagccaattttgaatctttaccatcactgcttcagcttggcatggt

SEQ ID NO: 15704 - DNA, 1501 bp, Oryza sativa
gtgatggtaaagattcaaaattggctgctcatctacagattgttttttatgtggctgattactattttgcgatattactattttaatcttccaccctccacataaatgccaatatgttaagcaataaatgccaatatgatagtactatagtaaaactgcttaactaagcaaactttaaactgcaagagcttttatgtcttatctatagcctgcaatggaatcaatgcttgaaaaaaaatgcataacccactggactccagagattgtgtctatctatccagaatactaagatgatgatataacagcataagcatgagctagagaaaagtttgtatcaacacttgcagagaaccaaaattactttataacccaaacaggcatagaccaaatggaatttctgtttatagctgaaattggaaacacaggattcatttggttcaattattacataaaacctatggtaagcagcaaacatttagcaccgcagcacgaaagaatactaatttgggatttgtgaaattaggcatccaacctgaagttctcattaacatggacggccttcctgcaatgatacaagcacggggcgaagaatatcagcgacacgaggcaaaacgaaaggatccgaaaggggaaaggagcccgcgtaacgtacttgaggtcggccgacccaaactgcgcagcggagccaatgccgaactccccacgctgctccgcctcgaacttgttaagatccgcgtaggccggcgccgcggacacaatcgccgccgcgagcgccgcggacaccgcggcacgccacctcggcggcggcgacgccgccgccgccgccgccgccgaggtgctcaacgaattgccgtcccgagaaccccctcggttcgcctggcaggagacgtgcgggaggcggcgaagagggggcgagcgacatctccacggcgtcgggaacgcgcagggcctcgctgcggccgcggcgaggggggaggtggtggggagagccatggcgggggcgtgtgcgcgcgcgctctcgcggcgtgggaggaagcagaagaagagagtgggtgtgggtgaggtgagacgtgttgtggctcgcgcgcgaacacgtagccggccgcgcagccgtcgcgccaccgccggcacgacgcgggggatgcggggaaaagatccagagagcgcgccttgtgggccgagagcctgtagtgggcttccgttatcctccttatgggcctttgccatattgggctccatggctagcaaagcccatgcaggtatctggcccgatgtaacataacaagatggctaaacttggcccatgaatgccagtgtagtagtagactgtagacgttgacaaaaactggtgatgagtacatgctatactggccttggccgtggctagttagctgtcatttctgtcttcacgctggccagtcacttcgttagtatagctacagtagctagtagccgtaattgagtgagctagtagacgcgcacatgcatgtattatacgctc

SEQ ID NO: 15705 - DNA, 1501 bp, Oryza sativa
ccttaaaaacccatcaaccttttccttaaacattacatctaatctttctttaaaattagccatagatgaatctattatagatgcaatttgtttgttgatagattgcgatacctcgtcattacttaccacgtcgggagcgagcttgggacgtggcccgggcttgatgatcacgccttgacgagtcctagtagtcaatctcatcaacgcctcccgtgtgagctcgttgatgtactcctcaacagttttacgatcctctccttcaaagtcatccaatgtgaccggtatcacatgagatggctacacctccgtcttggatgatggcttcgtcatggcgaagtcgaagtcgagttgacgatgaacggatctcttccccagcggagtcgccaaaaatcatgttggcaactttcttgacaagttaacaagcacgatcgtagcaccttaagccttgcggtgatcctagagtcgccaaccacctcgatctagcaaagagctaaatctagatgggttttgataaataaaccggctagcggagccgatttctagataactacccgtctcgtgggcaaacggaaggttttcaggacaaacctacaaagagatgtcgcactctcgcagcggcggcggacggtttacggcgcaaaccgacaaagatggacaaactaagaggaaactaaaagcaatatgaaaagaacgattcgattgattgattgtagattgatttttacaatgaaccggccttgtcccttatataggggttggtcttgccctctacaggccctcctccacatccaactcggggtaaaaaccaaaggaaacccgaaacatgccttcccgagcaaggaaacctcgaaacctgacgaaacagggtcgaactcggacctgccggtcagaccgttcacacaccgccggtctgaccggccctcaaccggcggtctgaccgcccaacacatggcggtcagaccggcacactcggaggaaaccggtagatttctaaattttggcaatctttcctattttaatcctaggtgccaaatttaggtgtaaacacaatgtggattagaaaaaattaaattgatagttagttcttaaagtacggtcagatttgcaattgctcctattttaatctcataaacgaattaacgcaaaaaaatattggattgaattcgatcggactgcgcatgaccgcatcggagtaataatttcttcacgcaataaaaacagaccacctcgccctgatccaagcacgaaacgcgaaagatcccagaaacccagttagactcggatttacttcaacagattaaaacagactccgtctcggagtttgtcaatctctggcttcatccatatatacagaccgccaaaactaacaatttccaaaccatccagttgccgagaaacgcaaacaggtttttgatcaacaagctagggcgcactcatctgatcgatcagaagttcacgcctttgttcaacaagcgcgccaccgagatggcatcggcagcag

SEQ ID NO: 15706 - DNA, 1501 bp, Oryza sativa
acctcctcttttctttggctgacaaaccgtctctcaaagtaccaaagaatttttagtagagtttatatgagagcctctccataagcaatgccttctagctcccatgaaattccatgtatgtacataaaattttatgggttgactgtgatatatttcttatatagaaaagtataggcatacgaatcttaatttgtttgtttagttataaatagagcaatagttatattagaaatcaaatgtgtagcatgtagcttaatcatttcaaaattataattattaattatttctcttttcgctggatagctaaataatatgaatggggagaggaatgaagagcgccagttcaagctagtgggaggagcagacagtgatacgcatgtgaggggacggggagggggagatgaagaatccttattttctttgagatatatgtattgggttcataggtggaggcgaaagtagatggaattgtttgcaaatgaatgtggtgttcaataattgttaatactatttggtgagaaaaggcataatacggtttaagtgtgataaattgttaattaaaatattgttaatatgtgatgtaataattttttcttttattatagataagatagatgtgctatgttttaaataaccatattgatcgtttgtttttctcgatgataggtgcctatgtacgtacgtgccctctttttttttatctactgtgtgtttgcttttttcttttttgcattttcttctcctgggatatgtacgtacataagtttttcttccttttttctggtgaatgtgtacatatttaattatactagcataatacacgtgcgttgcaacggattctaaataatattcattgacataaattaaaatccaaaaccatatattatagttgggcataaatgatgaaggaaatataaacgtataaataacaacatcaaactacaaataactttgttgggaatgataattcaatattaggaaaattatatgacttaatcctattttcaaatttagctataaataatttaatatagagaaaactataagttacaataatttttagtggatcaaatagtgctaaatctaataatgtaaatgaaaaaacaacttaaattagttagaaattgaaaaaaacttcttttagcccacgtatgaaaatctgattcattaattctgaacgggtgcttgtttcattgatataaattagaatttttcatgttctattcatactccatttgtcttaatattatgtgagtagtctaggatcatggttggatagactaagaaagaataatgcccaacataagctgttcattgttttccctagctcaaggcgagaaacaaaagaggagggaagatgggtgtcggtgctccggcgaccaaacgatggtaaggaaagtggtaggatgtatcccacgatgtgactcgttcataaacggtggaggttggcaatgaagaaaccagaacaagagggatgcaggggggcaaagagggagaaacg

SEQ ID NO: 15707 - DNA, 1501 bp, Oryza sativa
cctccggcgagtgtcgcggccggtgcacgaacggctccaggctgaaccactgcgactgcgtgtgcgtggccgcggccgcgccgcgccggtcgaggcgcctctcgaagagggtgagcggcagcacggcgcggctgacgatctcgtccttgcccgggtgcgccgcccgggcctcgatgacgagcaccgccggctcgtcgaacggctccgccacgacgaacaccagctcctcgttccacgatgggctcgtcgggcggcagcacggcttggtccggagcgtcacgccgccgacttgcaccttgacgacgacgaaggcctcgccgtgccgtcccttgtcgccgcctgcgccggcgacggcgcccgggacgacgtcctgcgcctcgagcacgcttatccggaggtaccacagcttcggcgtcacgtacaccttggaccgcgtgctctgcacggccgccacgccgtcgccgcctccgcgcaccgacgccgcgccggcgtgccacgcgtccgcgaacgcctcgtcggcctgcgtgccgacccacaccgcgagcatgacctctccctgcaccgccctgccgcctccgccgccgacgtcctcgaggcggtaccactgcggcgcgagcgggctgtccggcggcacgcgcacgggcgcctcgccgacatcgaacgcgacccttccaacgtagccgtctcgcgccaccgccgccacggcgtccttgtccctgacgaacacctcgagcaccgaggcctggacgcgctcccgcgagaaggcgaacacctggttccactccggcgccgccttccgctcgtggtgccgcgttgtgccccggtagttcccgagccgcacctccacgtacgggttgcacccgccgccgccggcgaccgtgctcgccgccgccgtgagcccgcgcgccctgacgacgcgcacgtacaggtagtgcatctgctccacgaggtcgtacgcgctcgccaccctctcgccggagccaacgcccatccaaccaccgccgccgccgccgccacccgccggccacgtctccctgacctgcggccgtgtcggtgtcgccattgcctccttggccatcgccggcggcgcctgtgcacggaacacgtacggacacgccatgacccggctcaccgtcgtctccggctcgccgtcagggcggttcaccggtcggcttttcccgtcaccggcaagggaagccatgcaaaggtggcgccatcagctagtacgacgagccaccacgcaatggttttttgtctttgctgtttctaagcaaaatctttgcagaagcttgaagctatcagtgagcccacaagagtacggcttactaaggtcaagtgtaaaatggaaaaggttggtgagtgagatcgagtgatcgcgccagtttcgatggattcggaattatgggggaataaagatgagatggtggggttacttttttttttgtgtgtgtttttgggtttgaataagaacaggagtcttggtgaagattcctgggatttt

SEQ ID NO: 15708 - DNA, 1501 bp, Oryza sativa
gtcggcggcggtcttcatcggggggaggccctgcgcgccgaggacgccgacctcgagcacgccgatgggcgggcgccacagctgcctcgccgtggggcgcgtgtcgctggcgtacatggcgggctcgtccatgacgtggtaggcgccgtcgaggcacgcccggaggtgcacgcggccggcgaaggcgggctcctccggcgagtgtcgcggccggtgcacgaacggctccaggctgaaccactgcgactgcgtgtgcgtggccgcggccgcgccgcgccggtcgaggcgcctctcgaagagggtgagcggcagcacggcgcggctgacgatctcgtccttgcccgggtgcgccgcccgggcctcgatgacgagcaccgccggctcgtcgaacggctccgccacgacgaacaccagctcctcgttccacgatgggctcgtcgggcggcagcacggcttggtccggagcgtcacgccgccgacttgcaccttgacgacgacgaaggcctcgccgtgccgtcccttgtcgccgcctgcgccggcgacggcgcccgggacgacgtcctgcgcctcgagcacgcttatccggaggtaccacagcttcggcgtcacgtacaccttggaccgcgtgctctgcacggccgccacgccgtcgccgcctccgcgcaccgacgccgcgccggcgtgccacgcgtccgcgaacgcctcgtcggcctgcgtgccgacccacaccgcgagcatgacctctccctgcaccgccctgccgcctccgccgccgacgtcctcgaggcggtaccactgcggcgcgagcgggctgtccggcggcacgcgcacgggcgcctcgccgacatcgaacgcgacccttccaacgtagccgtctcgcgccaccgccgccacggcgtccttgtccctgacgaacacctcgagcaccgaggcctggacgcgctcccgcgagaaggcgaacacctggttccactccggcgccgccttccgctcgtggtgccgcgttgtgccccggtagttcccgagccgcacctccacgtacgggttgcacccgccgccgccggcgaccgtgctcgccgccgccgtgagcccgcgcgccctgacgacgcgcacgtacaggtagtgcatctgctccacgaggtcgtacgcgctcgccaccctctcgccggagccaacgcccatccaaccaccgccgccgccgccgccacccgccggccacgtctccctgacctgcggccgtgtcggtgtcgccattgcctccttggccatcgccggcggcgcctgtgcacggaacacgtacggacacgccatgacccggctcaccgtcgtctccggctcgccgtcagggcggttcaccggtcggcttttcccgtcaccggcaagggaagccatgcaaaggtggcgccatcagctagtacgacgagccaccacgcaatggttttttgtctttgctgtttctaagcaaaatctttgcagaagcttgaagctatcagtgagccca

SEQ ID NO: 15709 - DNA, 1501 bp, Oryza sativa
aggcgggctcctccggcgagtgtcgcggccggtgcacgaacggctccaggctgaaccactgcgactgcgtgtgcgtggccgcggccgcgccgcgccggtcgaggcgcctctcgaagagggtgagcggcagcacggcgcggctgacgatctcgtccttgcccgggtgcgccgcccgggcctcgatgacgagcaccgccggctcgtcgaacggctccgccacgacgaacaccagctcctcgttccacgatgggctcgtcgggcggcagcacggcttggtccggagcgtcacgccgccgacttgcaccttgacgacgacgaaggcctcgccgtgccgtcccttgtcgccgcctgcgccggcgacggcgcccgggacgacgtcctgcgcctcgagcacgcttatccggaggtaccacagcttcggcgtcacgtacaccttggaccgcgtgctctgcacggccgccacgccgtcgccgcctccgcgcaccgacgccgcgccggcgtgccacgcgtccgcgaacgcctcgtcggcctgcgtgccgacccacaccgcgagcatgacctctccctgcaccgccctgccgcctccgccgccgacgtcctcgaggcggtaccactgcggcgcgagcgggctgtccggcggcacgcgcacgggcgcctcgccgacatcgaacgcgacccttccaacgtagccgtctcgcgccaccgccgccacggcgtccttgtccctgacgaacacctcgagcaccgaggcctggacgcgctcccgcgagaaggcgaacacctggttccactccggcgccgccttccgctcgtggtgccgcgttgtgccccggtagttcccgagccgcacctccacgtacgggttgcacccgccgccgccggcgaccgtgctcgccgccgccgtgagcccgcgcgccctgacgacgcgcacgtacaggtagtgcatctgctccacgaggtcgtacgcgctcgccaccctctcgccggagccaacgcccatccaaccaccgccgccgccgccgccacccgccggccacgtctccctgacctgcggccgtgtcggtgtcgccattgcctccttggccatcgccggcggcgcctgtgcacggaacacgtacggacacgccatgacccggctcaccgtcgtctccggctcgccgtcagggcggttcaccggtcggcttttcccgtcaccggcaagggaagccatgcaaaggtggcgccatcagctagtacgacgagccaccacgcaatggttttttgtctttgctgtttctaagcaaaatctttgcagaagcttgaagctatcagtgagcccacaagagtacggcttactaaggtcaagtgtaaaatggaaaaggttggtgagtgagatcgagtgatcgcgccagtttcgatggattcggaattatgggggaataaagatgagatggtggggttacttttttttttgtgtgtgtttttgggtttgaataagaacaggagtcttggtgaagattcc

SEQ ID NO: 15710 - DNA, 1501 bp, Oryza sativa
ctcctccatggttagcccgctccagtgcggtgaagcttgcaaatcaaggatgtctggtatctcggcgaggtcgcagcttcgggtagatgcatcaccagcggcttgaattagcagcgtcgagtctagggacaagtagcactacgtcggcttgaacagacgccggcatcgatgaggcttctgtgacgcgtagatgaatcggccaccgcaagttccccggcgacgacgatacgcgcagatggatccctatgcatggatttgtgcgtgctgtagatgaaagaaaacgaaacaatcttgctagcttttacctggactagccatcaagctcctctcctgcgcttgctgatgatcggatcaccgcgcgtgccctctcctgccggacgccgggactccggccgaagtcgctcgccgccgccggtgcgtgtcgtcgatggatggatcgccgatgagagttgatggatggatgtgttgatgctggatgggtagatgcgttgatgatgggtggcttgtggatgctagatgcgttggtgaatgaatgtgtggatgagttcgtgaatgcccctagctgccgaggggtcgacgccttatataggggtctgaggtctgtgctcgccacgtccgcacgccgtttcctccgcgtcaagttcgttgtagataaggcttgatcgatcaatttgttatttgttcatatccttctttgattttatctcttagcttctcctagcgtcaaatatctgatttgtaattcgctttgtttctctactgctgggccacagtccggtgataagcgcctcgccagcgctcgcgcgaagtaactaactagatcaagtttgttatagagataaaatcaattggtttgttggttatctcttaattcatctggttttatctcttccgcatattaacttctgaaatcttggcgcgtaggcagctaccgtcttcggccatgggccgagcccatgattaatcactcggatatgcataggttgcttaatcacccaggcatgcacacacatacgaccgtctactgtagtacatgcatgcatgcacgtgattgcctcaccagccaatcttcacacggctagttattggttaattatacatgcacatatactaatccaagtatatatattcccagctgcctgtgcatgcatttatttgcgtgtatatacatggccgagcattgtgtagaaatgataagctagccaacttacaaactgcttgtttgctttgtccatcatgagtaagtcttgtgtacacatataatcgccaaaataccatcaaacacatgccccccaccaagtaaattttgatcgtggagcgagcgaaattaacttggtgtcgtgtcggctcatgcgatacatgtccggtagagtttagtcatgcgacgaaaggactcccatgttgaagcttatctccggccgtgcgttgaaagaaaaacaaagctagaccgtcatcggccaggactccaaatccttggcagttacgagtaatttggatgaag

SEQ ID NO: 15711 - DNA, 1501 bp, Oryza sativa
atttagcaaaggatcggacgttgttcacccacatactactatttgactgcatgcaaaaaaaaaaaagaaagaaagaaaaaccatcatagttaagctgctatgctccaagcctataccctactctcgtgcatgtctctctattcatcttctctaccaataaacctttaaactatttttccttctaaattacttatccgatgtaccatccgatttcaccattgtgttcattacaattaaatctttacaataaggtctcacttagctatatttctgataaaatttataaatatgattatattactaattgaaacatttatatattatacgagaaacaacgagttataattattcaaagatcagaaaatattcattgcaacatcccaagcaacacgtgcaacatttataaatgagttagtgaaatattagaaaatacttactagaacatccaataataccacgtgcaacattcacaaataaacttgtgaaatgtcagaaaaatatttattgaaacatcggaataacgccatgcaactatatgtgttttagaaaaatcaacctttgttttatcacttgtacggataactcaacctactttagaaaatgtttcagatatatgtaacttataaaaattactaaatgcaacaataaccaccgtcacatgaaacactaggtcccaactactgaaacataaaaaaaatatgatgcaacgtatttgcaaatattgatttgttaaaattttatatcattcttaaaacattaacatgcaatttttgaaatataaaaaaaattatttgttgaaacatataaatagatcacgtgcaacaataactatataaaaattattggctgcaacaataaccatcattacatgaaacattaggtcctacctaggaaaacataaaaatatatatgatgcaacatatttgcaaatactttattttgttaaaattttatatcactcttgaaacgtcaagttgtattttttgaaacacaaaatatatttactgaagcatataaaaagaccacatgcaacattatacctgaatcaataaaacatgagtaaacacttattgaaacattggaataacattatgtcataaaaactatcggaatattgtcatatgagattttgttataaagagttaattataacaaatccaatggtataattagttcataattcagataaatagtttaagagaaaataccatttaaattttgaatctatgtgacttgcataaacactccatttgctacatgcacttgtcacgccactactactcctttgggttggggtgtcccatttttccttcttcgatgataagcattttcagggagaaatgcttgcaacttctgttggctcaggtacgcacacatgtccacgtgcccggctctcccggcaccggatcaacttccgccattttctctcgctcgcctcgccatttctctcttctcaaatgccttagcgatccgcagcgcacgcacgcacggacggacgcca

SEQ ID NO: 15712 - DNA, 1501 bp, Oryza sativa
ttgatcattgcgacactgacacatgatcttccttatggcttgatgatattattgaggcatagctccctgcgtctgctggtggtccggtggggatcccgtgtactcgtcgtgtccggtgggattcctagtactcatcgtgcctgacggaggtggcgccgctggctgtggacgaggaggggaacatggacttgatattgtcggagactcgatctgcacccagcgaatgtggaaggaaggagccagcagcggacgcggcgctggtcatggcgccgccggtgttgccgaacctgtaggacgtcgaggtcgcctgctaagtggcctcgggctgctccgtcgatgccgcggtggggcctctagatctttctaatctttctacttcctccgtttcacaataagtcattctagtattcctcacattcacttacattgtgaaacggagggagtaccaaacaatgggaaaacagatacacctgaagaagaagtgattggaatataaaagttactagggacttttctgtaaaatgagatggtcaatgctaatgtggcactttcgctaaggtggaacaatggcgtggcaacttttgcaccatgagcgcacccacctagccaagttattgtaccgttacgcttggttttcaagtttttcacctaatcacacccatctgccaagttcttttaccgtcaacgcaatttactctaaataaagaaattaaataatatatagttatatttcgggataaaatctaaacgcataaaaagtaaagtaactatattatgggatggtgagtcggtgagagtatcaatcaggttttctttagatcagggtgaaaagttttaccgtgtcacatcggatatatggatatatacatttgaagcattaaacatagactaataacaaaacaaattacagattccggctgtaaactgtgagatgaatttattaagcataattaatccgtcattagcaaatgtttactgtagcactacgttgtcagatcatggagcaattagccttaaaagattcgtctcgcaatttacacgtaatatatgcaattagtttttttccctatatttaatactccatgcatgtgtcaaacattcgatgtgacagggtaaaaaattttgcctggggtttaaacgggccttcaatgtgaaattttccttttggcaaacagtagtacagttgcagagagctagcagtagcactcatgctagtacaaatcgggaaaagtacacgcaaggtccctcaacttgttagccagatacaaaatcgtcccttaaccacaaaaccggacatccggcgtcccctaacttacaaaaccggtcacaataggaccctcgggggttttcaccctagttttgtcccacgtggcggctgactcagcgtgggacccacgtggaccccacgtgtcagtaagccacgtcagcaccctatctctctttctctatttctctccttcctctcgctccctgctctcgcacaggcggcggcgcgcgcggc

SEQ ID NO: 15713 - DNA, 1501 bp, Oryza sativa
cgcgtacaccggcgccgtccaccgcgtgatcaccgtgccggagtccaccaccgtgccggcgccggtggcggcgtcgaacgcgaacgatcccgcggggaccttcacccacgcgtgccccacgctgagccccgtcacgttcacgtagtagagagacgacctgtgcgggttcctcagcatcggcgtgtaccggacgctcctcggctgcccgccgccggcgcccagccggagcgagccggagaagtagtatgacctgtagctcgggaggcagtaggagaagacgccattgtacaagctcccggcctgggagagcagcgccatggggccacgcccgaggccgagcagcccttgccttggcatgttcgtcgtcggccccgtcaccgagctcacgcacccgaacgtgtagttcgggatggcgtccttgcccagcctcagcgtgtcgctggcgagcgccgcctggaacgacgcgtcggcgaacggcttggagaaggcgcacgtcggcagcgtcgccggcggcggcgccgcgtcgccgccgccctgcggcgccgggcacgcctggccctggaacagcgggcaccacgacgaggagcacgggagggaggcgtaggaggaggagttggccggggcgaagaggctgctgctcgggcacgtgccgcacggcgagcagtgcgcccacgtcgcgtcggcgctggtgtcgagcgccagcagcagctgctgcgacggcgagccgaggccggcccggacgacgtaggacgggggggcctggccgaaggcgacgggggcggaggagacgccggcggtggctgccttggaggagaggaagagaaggcgggcgtcgtcgtcgcgggcgagcgcgatgatggactcgagcggggacggcgacgaggggtgcacgttgtggtacacggagagctcggcggcggcggcggcgacggtggcggccaggaggaggaggaggagagggatggtggtggtggccgccatggcaatggagctctcctggctaagctagcttgcttgctaagagagtgtcactgaggggagtgaggattgtgactgagcgagctgggtttatatagggtttctggctgttgatcctgtagtctttggcgccgatcgattgaatggtttgagcttaattacggcggcacggacaacatgacgggctaatagcgcacattcaaatcattaagtactactctagtactctgtccaaaagaaaaataaaatctctaacataagtagtatctaggttcgtagttagaattggacttgtttttgtttttagagacgaatgggtattttaaaaattttgaaatatatttattttttgacaatgaactttcgtaaatagtttctgtaaaaacagattatttattggcttgaaaaaacgtgctcacgaaaaagagagataccataagctaataagttcatcattattaaggtctcctttgattcaaaaaaaattcataaaaattttagaggatttcatccctgtagaaat

SEQ ID NO: 15714 - DNA, 1501 bp, Oryza sativa
tataactatttttctttataattgcttgcccaatgacgggttctaaagctggatttgtttgtctatctcagagctaaaacaataaaaatgctaaatgggggacaaaagctagataaagtgacaccatgaagcatcaagcaactcaccttatatttggtccatcactttcagcaatgaatttattttttcatcaatccctgtattttgccttatgcgccggatcgaaagagtaaataccaacgctttttttccataaccttggatatactattgctaaaattgcttgtttttttgatgatcaacactgggaatggggaacatccctgcctggatttttcattaatgaaagctagtttgtttttttcctgcttgtttttccatgttcaccccttagatgaacaagtagaagttagtacacgttttagctttgaaatgatatttgtgttgtggtttcaattccaccgttctgcatttctggtcttgtacatcgatatcttcttattttctttcctctttttgctgttttacaggggagctgggttggctaccaaacattagttgactaatccagtaataatattatcactacattaggatttaggcgtactgcttgcattgaagttactatggtataagcccaatggaaattttttaaatggtaaatgaatccacatattgattgaatcatctgtattgaaagctctttgttctagcctgcagggattgttgcaagaactgtgttagattcagacaattgattatttattgctgctttatttcatttgtacaaacaaatatgtcatttgaggcttcgtcactttgttcacttataaaaggacacactactatgcaagttaacgctctttatcattacttataatatcactgtttgtttcacttcaggctgtgttacagcaagtataatagtaggctataagccggctaaatgctgaggtggaggagagaagagaggagagagaagagaagcagactgtaaacttatagccggcttagacacaggagccaagaaaccctgtgtgagagataagtgggccctgtattaattgtaaagagctaactattatatgggcaggctgaaagaaggctacaaagaatcttatagccagcaggtcggctgtattattagccgtgctcttatgtggggaatttcatatcgacgccgggaacgggaggaaggccccggcgcatgcaccatgagctagtggattaagtttgttaagattagtgattagatcaagtttgttagtggattaagtttgttgccggtttgttagttccttttaagtagcagattagtttcattgtaaggctatatatgccatttgatcagattaatgaatcaagcaagaaagttatcacaattcctgttcgttccaccacggctccggggcggcgaggtgtgcaacactgcaacctcgccctcctaacatcttggtatcagacttccacgatcctgctcgacctcgccgccgccgcgcca

SEQ ID NO: 15715 - DNA, 1470 bp, Oryza sativa
agcgtggaacccacgtgggccccacacgtcagcctgttcttcccctcccatctctacctctcttcctctcacctctcttctccacgagcggcggcgggtgagcagctgcatgggtggtggccggtgggggagcagctgggcgcggcagagcagcgcgtgggcaggcgcaggcggcggggggagcagctgggcgcgaccggcgggcggcggatcagcgcgcgggaaggtggtggccatcccttcctctcttccccatcgtctcctccgcctagttgacccaccaaacacatcgcctatagtttggttggagggagtttttaggagggattgggagtttagagggatgaggctattaagtgttttgtttggttgggagacatgggaattttggtgggatggggatggggatggggaattgaggaaggaactccctccttttcaatacgtgggtaggagcaggtaattgggagggaattcctcctttacttaatctaagcaaatctcagtcatccatttttattaatgatctaatctccaactaaactccctatcaatttccataacctctaccaaacaagatattgggattaaaaatcaaattcccatcttaatctcattatcaattctctcgtgtaaactctcaatccccttccctcgagttaccaaacaagctttgaagggccttcaattccaccccgctcgccgccacaatccccgtccgctggaggagagtgagcagtgtccacaccacaccctccgccgagtccacccattgagaccgctgccgtgcccgtcgagggctggtggctggaggagcttgccgaggaagtcatgggcttgaagggaacgagaggaagagagagagagaggagcccctgccgccatcgcttgaggagacccgcgctcgacctcctcccaggttctacccttctagtcatcgtcgtttgtggcctcatggggaccgccatagccaaggaggccatggcgcggccatccccatcgatcgacgtcctccgcctgatgagcacccgctaccccgtggcccaactcctctcccgtcggccgttgctcgcgcccgccgcactggcctgccgcgcgcccgcgcctagctcctcttcgccgggcgctgcccgtggagagggaaggagagaggaagagaggtggagaggggaggggaagaagaggctgacacgtgggtcccacgctgattcagctaccacatcggataaaaccgaagttaaactgccaagggacctattttacactggttttataagttgggggatacgtcatatccggttttgcagttcaaggacgattttgtaacttgatgacaagttgagggaccttcgctgtactttttccaaaagatgcagatgcaagtatcgagcgggccgggcccgttaggcccaacagcaaccgcagcgtgtgctttcccccacgaccaaatcgccgtcggccgtcgcgcgc

SEQ ID NO: 15716 - DNA, 1501 bp, Oryza sativa
atcgctttgtttaaattcccgcgttatcactgttttatttagccatgcctatttacctttgttatgaccttattattgctattgttattattattaccttgttcaccctagattaaacaaaacctcaactagtgggtactctattcatggttccactagtatgaatttaggtagatgcttcgcggtttgaattagacaacattaggtggttttacaactttagacttgggaaattctcatatcatttggacactatggaatggttggcttatgttggaattggacacacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggtgtcgatggacattctccagggcaaatgaaggctacacgagctgcggcccggtagtcgagatgtcatacggcagagggttggtgccctgctgctaggggctcagttctgcctgcctgtcccgggtatcccggccgtaggtgggattgggtcggtactcttgtctaaggctaggatgggttgggaactatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggaggagctgggacccaggtcgggttgccagttcggtccgaatcatcgcaggccttgggttaaggcaggttcgtgagggttcacggccttgtttaataatactgtgtagctctaggatcgtctttacaaaatggctttgggtaactaagtggcttttaaatgctgtttactgcaaaacttaatccctatattattattcccttgtacctcccttgcattaattatgcatccccggtgtggcttgctgagtactgtggttgtactcattcttgctcaatctttccccccttcagtaagagaagctttggagaagatgtcttaggtggagtcctggcttataccccagttgagcgcctgtgaagatggagccgtaggccgctagtccgctgctgtttatttttgcttgtcaggcctgaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccaggttgactgtaggataag

SEQ ID NO: 15717 - DNA, 838 bp, Oryza sativa
cgaccggtggctgagctacagagggcgtgagagcaggcagaggggatgcggcggatgcatcaactgtgggcggcggtggcggtggcggcggcacccatgccctccattgcatcggggcatcaccaagggagtcccctcgcgatgcggcggcagcggcgaccatggaagtggaatagcaacggtggcaacacgatgacctgcagcaaagccgacgacggatggggatgcagcgattgggtggcgtcacggtggggtcaacgcgtccgcgggcgctacgcatagccagtcctgggcgttttgagccgttggatgatagcgatggacggtagggattgatccggatgatttggcctgtaggattggaggggtacaactcctcctttttatatgtgtgtatctatatatatgaaaatggttctatactcctagggagtatgtactccctctcccatccaccggtgattaatccatcccaatctcatgtgtgctaccgggtttagcaggcaaacccgttttagtttttggtgttaaaaaaattgcgattaaaaactgatcacggtatattcgggctagtcaaactcgttaatctgggatttaacaccgggtatatgcattcatccaggtgatgagccggcggtggcagtggcgttccccggacgacaatgtcgatccatcatcgatggtggctagcgcaacccgtctttctaagcgatgcgcaggcagatccaaccccatccattgaaatagcagagcaggcgccgccgccagcccgactcttcgtccaggtttcacggcatgcgtgccctttcgtaatcaccggcgtactcctgtgcagtgg

SEQ ID NO: 15718 - DNA, 869 bp, Oryza sativa
ttctttccgtacaaatttcccagagcaccgtcaggaaagcagagcgtagtccttttttctgaattttctctgcattgcttgtttggctatgccaccagtcaagcagtgtactgtcctctgatgagtcttggaagcgccgtggcctgatctgacgcccaacctcagtccaaatctgctgcacaaagggacattctttgaagaggtgttgggcggtctcaaggtttctgaagcagagctgacaaggtgcggaaaaaatgtgagatcatcgaaatctatacactatacaaggtgcggaatgaactcgcgcagacacttagctttgtttgttacttatacgcacattccgaagtgttttgagtgctttgggtttaattcgttcaaaaaggtggttgaatataggcagttgtaggtgtgaatatagcgtggtaaatgaaacaccgtcaaataggagaacaatttgttagtgttctttcacataaatccattactgcgagtctggaacaaagctcacgtgattcagctaacaaaatcttttaagtcgtcaaaatggttgtctttctcattttggctctccaatcaacaaatcccctagtcggggtttaatcgcagaacacatcgccacttcaccccaatcttgagaggtatcgcttctttttaatttctctattaagatgaatccactttctgtaccaaacttgagtagtcttagtgtttttttgttttgtactaacatttgagagaggtaagtttctgtgcatctgaatcatctactgctaacagtttacaaaattattcactcttacgatcttatctacttttgatcagcagataaccctgatcagagacttgagcactatatctcaagcttg

SEQ ID NO: 15719 - DNA, 677 bp, Oryza sativa
agagattcctacgagacgatgaaagacggatcacgtccaaagttcattgcatgctggcagtgagatctgggagaatgtaaaggatatcaacattgtattcgataagtgaatggaagcgtacgtgcatctacatcaagcggtgagacatctctttcgaaaaggaattgaaatccgtctttcgggacttaccgtactagaaaaacttagatatacgtcatgcaatcgacgtcatccgcgtgacatagagaaaaatgtgtgcgaaagcttgatcggagcattgttgaacacggtatgcgtacacggtacacgtgaagaaatatgtgcgcgaaagctctaatctctctagcacggccggatgaatcaaccacgtacgcggtactcctcgtcctcgcgatccgagtccgacgacgacgaagccgccacgtccgcccgcccgcccgcgcgcggggccaaggcaaaagaaagcacgccgcaatggcgcccatgcaagcaaagcatgtgcgcgcgcgcgcgacccacacgcacgcttttcacgtacatatcgatcgcaaatatcttgtgcaccttaaacaatattcaaatcgatcagcctctcgttcagtcgttcgatcgctcgccttcttctctattaatagcggcccagtttgctcgtacaactcacacacactcatattcac

SEQ ID NO: 15720 - DNA, 1501 bp, Oryza sativa
ggttctgtctcccccatcttgcggagccgcttcttcttgcgctccccctcgggctgcgatgtcggcgcggccccctccgggcgcctgctactgacacgcgccgccccgccccctcggggaggagatggggaagaggttccttcctgcttcctcttcccccgggcgtcggcagggcggctgctccccgggcccccgtcgcggggcccagaagcacgaccccctctcggggtagattgttcccccctacggctcccgcccgcgccatcgtggcctcgaggggcccgctcctccgacgccccgaccgcctgcatgatggtcaggatggaggcgcggtctggatcgctgcagagggggaggactccttggggaatgagggatgcctccacggagctgagattcagcacccgttggaccactatcttgaagtcctcaggagcccaatcccatctgaccccctggtgggtcctcatgtagtcctcggacccggtgtactcccaggcgccccgggcgcgccgctggagcggcgcgatccggcgacgaaggtagtcgccgtacaccatggcccctgtgagcccctgggatcacaggcccgccaggtggtcgaggacagcgtcatagccatctcccagatctaccggcgcccgccagctggaggcctgcgccgggggctggctcggaagtcggaggcgcgcttcgtcggcgaggggggtgtagaaccagtcgctcttccagtcatcccacttcttgcggaggacgcaggggatgtagcggttcaacaccggcctccgcggctggaagtagcagccaccgaccaccgacggcggcgacaccgactgcacggtgaagaaccaccagaacagccgaagggatgggcgcaccccgatgaacatctcgcacagatgcgcgaagatggccaatgtcatcaccgcgttgggggtgaggtgcgccatctggagatcgtagaactccagaacatccatgaagaaagaagaaaatggcggaaccagccctgccattgcaaaggggagaaagaagacggaccgccccgggtagactggcgccgggcgtccctcgcccagcgtgactatctcccggccggtggcagattccggcatgaagcggcgtggcagcccagcctgcctctcgctcacgatgcgggaaggcggcagcacgctaccatcgagcagagcggagccccgtgccatggcgccggaggaagagaagattgagagcgagcgcgtgtggcgaaggtaggacacaggaaagaaggagttagggtgcaagcggcgaagacaaggggaatgatggcgaaaggaaggaagcagatcctttcctcagtgcctttatactcttgccaacgctgtgcccggctcctcgcttctcgtgcccactatttcgccccctcgtatctcgcgccctcgcttccactaatcccattcgcccgcttgcggcgcatgaggtggatatgcggttgtggcagtcgagataaatcatatcgtgc

SEQ ID NO: 15721 - DNA, 1501 bp, Oryza sativa
gaaataaatttgtaaataacatgacttcggaaaatataagaaatattagaagataagtttatagtctatataggaatagaatttagaattaactaaagttagaattttaaataattaataaatatcacgtatacaaaatacaatatgaatattacacatcagtttggtcaagtcagtacaaaattaaaaattatgttatcattttaatatattttaataacaaagtataaaaatatatatgctattatttaaaaagatataacgatactagccgcgcaatctatgtgggccaccatgctagttgtaacgaagacactagtatcatgtgcatgaagaaattggatggggagacttcgtgataagggagcaagtggctaacccataaatccatttgtaaattaaaatatgctataattttacttatgttgatttataatgggttcacgtgttaaccacttatacccctacttcccgattttcattcagtttagctgttgaggtaaggctgtttatgcctcgctttcgcgtgattgccagggatgaagtagtccacttcactggtgtccactaattttagtaccttgcgtatgataaaatttgcatttatgggttatttaatcttattcaacattactatatattcataaaataattattttattatcgaaacaaacatggaggtaaaaactattattttattattgtagagatgttcgacggaggagtcgtgaccaccacgggctaaattcacgtgtttgtagttacgtacacatggatattggaagctcattgatttatcaccaaatatacgtaataactttaagctttgcgtgcattaagagggccgtacttgtgggtatgtatatacagtgtgcatcttccaagtatataatgaagaaaaagaataggatcgagcatatcgatgcaagtatcttccacagagaccacgtaccattcacgtagagtaaactagctaggtggacggcacttatataaaattatctatttttacacatatttttttttaaaaaaaatattaaatagacatatcgttgtcttatattttaaaaacaaaccttatcagcatcgggttttttatttttataatttttaaaagtcacactggtcaccacccatccctttatttgcttgtccagtcagtctatcacggcttcttttcatcttcattaaaatctataaaattcgtcggacattaaaatatatttttgtctcgaccggcgaattttatagataaaatcaaaccttatatttttgggttaattggatctatgccattgcaaatttgcctcgttagaaaataccattacaattcgtctattcgtagccatgccgctagaattttatagaattataaccacgccatcaccatcacatttttcatcgttttctccatctatacatggggcctacctgtcagaatcatcttcatcctccatcctcccctattttcttttttcctcatctctctccattgcgcagc

SEQ ID NO: 15722 - DNA, 1090 bp, Oryza sativa
tgtaatcggaaattgggttttccaacttcacggctggggtctaggatcagtgcttgttcaaccgaggcaggtcaaaggtccaagagccttatctcccgagaacgattctccgatgacaaggctgggggctagggagagtgtataattcaacaaactgactgatcgaagtcggtaaaagagtagacgctcatatacaaaacattggtctgtaaatttaattcattttcagttttccatacatattataacatgtcaccctttgagcgttcgcttgggggctatttctatctaatattattttctgagtattgatttcaggaaaattctattcgacattaacgaagactccatgtctctatggttctacacaccaagatcgactaaggcgagtacgacaaatattgacaaggcttcgtcgcaggctcacggtcgatggatctcgacaaggaatacggaatgaagagatggtgtacccgctgagataaaatttcttgacttcaatccaaattctcgatttcaatccaaattctcgattacaacaagatgggagacttagtcgtatgctctgtactttcttagttgacgtcggagattgactcagacaaaccctttaggtgcccgcacgaggctgataaaggaagcctaacgttatctctgaactcaccgagaatagtcacatgagctcgataacagttactccaaagtctgtgcgcggctgagaatatgaattcgttcatttgcattgaagtcggagactactgttagggttatggataccacatacctaatagtagtcgactaaatctcggcaggacccaccacataccatgtcctatacggaaacaacctgcggatataggaggagttccggataaggaaaaataaccagagttctacatggaaacgacaagaactactcggattgtatccatattggtttccctagttctacttggacaaggggacacctatgggtataaatacaagaccccctaggaggagaggggagacacccactacaatcaacatacacggaacaatagatcaagacataagatcaacatacaagaaaacatacgtcaagacaaga

SEQ ID NO: 15723 - DNA, 1501 bp, Oryza sativa
cgccgacggagcacccgccggcggcgccgccgccggtggcgaggaggaagaagacgaagaatgcagctgcgatcttgctgctctgaaactccatggatgatgaactgttcgacaactagaggtttttttttttttttgaggggggtcaagaagtccaggaatgaattaagagcaaattaatctaatttttgtgtagagaattttctgggatggatgtaaatgggatgggggcagcgttcatatatatataggaattaatttgcatctgcaatgaattaatgtgcatagcttgattccaaccgaatttatgtgtagagagagatacacttgcatttatgtgcaaatccatgctgttgcatttattttttttaaaaaaaatggagtaaatgaaatgatatccttgttttgtggtagtataattaatctagaccagttatttatttattttttaatctagtgaatcatatgtactccctccgtcgtagtatagttgtcattctaaattgtttagggtagattaaggtttaaagaaaaagactatagtgctccttattaaatagggtatggttatagatgtgcaaggatagttgagggtagaataaaaaaaactaaaatgaagatgattgatgagacatgtaatactcaaaagtgacaatcttagcatgtaatactcaaaagtgacaatcttagagagaactatttttgcacggatgtaatacgtacaaatggcagaacataactcataagccaattatgggaatcatttttattggtgataatactggcaatagtcaatagaatattatcactaaagagcaccgtaaagatgaatttccttggtgtaagaaggaatgatagtatatgcatgtataccaccaacgtaactgaaagcctgatgagaaaaattttcagtgaaaatcagcccattttcgtggcgttgccggcgtgggctgagcagccggagccgggcacggcctgaggcaggtgcagccggtgtcgccgccgaagtgtggagattatgggtatcccatatctacacggcaacggtatttggattgggtaccggatacttaatgtagatagaatatcttatctgtatcttgggtttgtttcttaacttgtgtatcaaggaaacaccctgagacttagtcggttacgactgtattttacctgtatcttcatgttccgttaggaatatagattatcttttgtaatccggactccttcccatatataaggggggtccgggcgcctctaggggcatatgctgattttttcccaaatcatacaatcaataatacactcggcggattcatcccccggacaggaatagggtattacttcttttataagaaggcctgaacctgtataaattccttgtctccaaacccatacactttccgagcttgatagccacccccttttattattgccgaaatctagtttcgacagttggcgcgccaggtaggggtagcgtcaagcttttcgccgatcagtgcaa

SEQ ID NO: 15724 - DNA, 1501 bp, Oryza sativa
tctggtatcgttggagaagatgcgatctcggccgagtggtttgaagccgactcggttgagatggtcttgaagtagctttcagccgcgttcgggaatccaagcgggaccgaaagccggttctctcccgactggtctgattccgagtcgaggagagaaatcttgccgaagttgttggtgatgaagtcgaggctgccgaaccgaaacgcctgcccgggtgggaagacgaggtcgtcgatgccggagacggaacccattgcactgatcggcgaaaagcttgacgctacccctacctggcgcgccaactgtcgaaactagatttcggcaataataaaagggggtggctatcaagctcggaaagtgtatgggtttggagacaaggaatttatacaggttcaggccttcttataaaagaagtaataccctattcctgtccgggggatgaatccgccgagtgtattattgattgtatgatttgggaaaaaatcagcatatgcccctagaggcgcccggaccccccttatatatgggaaggagtccggattacaaaagataatctatattcctaacggaacatgaagatacaggtaaaatacagtcgtaaccgactaagtctcagggtgtttccttgatacacaagttaagaaacaaacccaagatacagataagatattctatctacattaagtatccggtacccaatccaaataccgttgccgtgtagatatgggatacccataatctccacacttcggcggcgacaccggctgcacctgcctcaggccgtgcccggctccggctgctcagcccacgccggcaacgccacgaaaatgggctgattttcactgaaaatttttctcatcaggctttcagttacgttggtggtatacatgcatatactatcattccttcttacaccaaggaaattcatctttacggtgctctttagtgataatattctattgactattgccagtattatcaccaataaaaatgattcccataattggcttatgagttatgttctgccatttgtacgtattacatccgtgcaaaaatagttctctctaagattgtcacttttgagtattacatgctaagattgtcacttttgagtattacatgtctcatcaatcatcttcattttagttttttttattctaccctcaactatccttgcacatctataaccataccctatttaataaggagcactatagtctttttctttaaaccttaatctaccctaaacaatttagaatgacaactatactacgacggagggagtacatatgattcactagattaaaaaataaataaataactggtctagattaattatactaccacaaaacaaggatatcatttcatttactccattttttttaaaaaaaataaatgcaacagcatggatttgcacataaatgcaagtgtatctctctctacacataaattcggttggaatcaagctatgcacattaattcattgcagatgcaaattaat

SEQ ID NO: 15725 - DNA, 1501 bp, Oryza sativa
gcctagggacaaataagatgaagactttgcggccttgctccagatgttagctagtaggtgagcccattccatccgaccggcctacttggagggacagcgacaagaccaagcaaaccaacccttgtgtattgggtccctctttcatatgcatgcatgggcattgtggataggcctgctaataggttgggtgggaattggtataatggattggttttcattttgggtagaaatggtctaacgaagctgttgggttggggcagtttggactttgctgaaagtggattggatcgatctggttttcggtcatatacctttgggtccaaaatgggttcaacccatggattttcattgaatcgtccccaaatcctctatgctagcttgatggacacactcatcttcctcgtgagcacaaggatgcccaaggcatgcccgtcggcatgcgtcgtcgtcgattcgggcttggacgccatgcgcgttaacttcaagcacctttcaaccatgaggtagttcgaggacctcgcggcgaaaatcttagggagaaaggagatggtgcgttcgtaggagatcttcgttggcgacaagtacaagcagcaatagtccgccgccacactcgctttcctcatggatgcaactaggtcgactatgacgaacatccgagaaaggagagcatcgactatgacgacatccgagaagtagcctcgagcggccagaaatcatctatttgctgggaatcaggcgccggcaaggacaactcctcgaagatctaccacttggtgcgtcatccacaagacgaccaatcactcttttacggactgcaaggtggtgcaacacgtgagagctgaactcgaagcctgcaaggaacggggtattcagcgtgcttcaccaaccaagaccacctggtgtctgatccataagtcaagactcaagaggacatgagctcttaggctgcaaagtcttccttgacgccaccaaacctccacgccctcagatccaagaacgacgagttcaaactcgaagcgttgcataggaacagagcccagggagctcctgaccgtttcgggattcattggtatggacccccacgaggcctcggttttacatagcttggaggatctagagtcctcggcacctaatactctacgaaaggtgaacgtaatcgagggagtagtccgagtaatcaaaatccaactgctcgggcgaccacagatcccatctgtactcccgccaagcatttgaacacaatcaactcaatattaagatagagcccttttgatccggtcatgttccctgatggcgggtcgaacgactacgatccacaatggtgaatctcaatagtgcttttgcggcggcgactggacctccggctcaagatcctcctcaactcccagctcgaggagaagaggtgcacgtcgacggcagtgtcgaagaagaccccaacgaacattcgagctgagatcctggtcgtaacctcccaatacctcacctcgaggacctcgtcagg

SEQ ID NO: 15726 - DNA, 1501 bp, Oryza sativa
gcgaagcaaatcaagtgattaacccaagagacatttgtttggactaagagtttcagatgtgtctttttcggatcaaaggcaatgacagtccgtatagcttttggcgaaacacttcaaggtttcactgaaaggtagcaaaccaaaggacctcatcgccaccagaagcatccacaactctcggagtgaagagtacttagcgacaaaggtcaaaagatgactgatagaagatatcgaaaaagatgtttattaccaggcaaagaagtaggtcgaaaggtgattgataagagaaatcgggaaagaacacatcaaggtcaaaggtgtaaaggaatacgctgaatgctaactgaggacaacatgaagtgaatagtggtaagttagaagtaaataacaagcatggtatcctagtaatgacaagctgatatcgacgcataacatgaagtggtaacttgtatgaggttgaccccaaagatatgagctatgcgaagttctggaactgaagccccatcttcaagtgccgcaacccagtcgaagtcagctaaaggttcaaccagggacaagtcaggtgaagagaagattccatctgcaacaggagatcgagccaagcagtccagagtggagaagttgtgctaggcaagtttgttatagaagacggagcggaagaagtcagacaagaagagaagaccgcccaacctatcttcttgctagcctcctcgaatctcggggacgagattcctgtaaggggggtggatttgtcacgtcctgataaattcatcccgagaataaaaatcattcgctaaaaggaataatagaattaattaaaaattcgaaaagaaattggcaaacactaaaatacgtgccagaaaaattcaaatgtggcccggggaatttttgttaaattctccttggtctaaaaagagccctcaaattttacatgaattttcagagcaccggaaataattattaagcaacaaaaacaattatcaaagtttattaaaaagaaaaacctaaaaataatcctcttcctcctttgggccaagcccagcccaaagtctccctttcctccctctctttctctccctctccttctctccctctttctcttgggcctcctcccctctcggcccagctcccttcccccccctctctctcccgggctctttcccccccccctccttcctcccggcctgcctcggcccagccgcccggcccaagccgcctcccccttccccccccctgggccggccgcccggcccaactcgagcggcgccctcccgcccgagcgcgcacgtgcgcgcgctgaccgcgcgccccgcgcggggcccacgcgtcagcccgccgtcgccttcttcctcctcccagccggcctcctctctctctccccgaaaacctagcttcgttcctccctcgaatccacgcgatttaagccttggattccaaaattgattggggggaattaatccccattgattcctctttgatttcccccgtttttccccttgaa

SEQ ID NO: 15727 - DNA, 1501 bp, Oryza sativa
tgggaatacacaactcaaaagattagtctgatgggtaagtattgccccccccttttaagtcgtgctcccccatcatcaattaacgatgtgggactaaatccaacaatggtcatgccccgtgcaaccatgggagagggaggaaagagagctcgtctcggcagccagggagaaagcccctagctctatgccgcaccactgccagactcgtggtcgagtagtttctgtcgagctcacgacccctcaatcgtcaccgggtctgaagctcgagaccgctgatgaggaggggagctcgagatcgtcagcacgaaccgtgaggacgtcgacccctcattcttcttcttcacctcgtcgtcctctctacttcctcgtcatcatgagagggagagatggctttgatttgtgcatgtcggagctcgccggtcgcgccacccccaggtttgcgtgtgtggatggggaaaggcaattggctgttgaggaagagaaggagctgcaaagggaaggatgcacgacactggccacgaccatcgatgaggtagacgagtcgtgtttctcatcggttgggtgactatgcggcatagttgtagtgggagaagagaagatcagttggctcggtggagtggtggagatggggaaagtacgaatgagttgttgataggtggggatgggggtgcgattattaattgttctcagcattggggcagaaatgaataaaagcatgagttgaatcataaaatttattgtcagtaaaaaaactctatttaaagccaaatacactgtggagggtgtttcctacaacttttggtaggcctaattgccgacttaagcttatcaagtgtggtacttacactgcttgctccaatggcttcatcaaacaccggtcagtaaatattaccaaattcgacacataaacttaattaggtcacatgtatataacctaagttcgtgactaagaaaattagggaaaatcctccccatcgggcgcccgatgggggggtggggagaaaaaatcggactcccgcggctcccacgcctcacgcgccacccccaccacgcacgctttgcagcaaatcacctgcatattacggaaacgccctattaggagaatccgttttattttttttccaccaacaatgtttcagctagtgtactcatgatgtttcattatgtatgtaccaaaaattgctgtagatttttgatactgtcttaataattttatcttgattgacacgtggtttgttgatgcagatggtttaagagttgcaatggcttaaaatcattttgcatatgttaaaccaaattgtttcatctagcgatctaattgtatttcacttttttttttaagaattgaaacattatttctctatttgctaaaatattatttttatatatggtgaaacaacgcccgattttgtggaaaccgttgtttcatatgttgtagcaaaatgttttatgaggtgattttgttgtgtttcagctttttaaaagattgaaacattttcga

SEQ ID NO: 15728 - DNA, 1501 bp, Oryza sativa
attctacaaccgaatcggaagtttcggaaccttaccgaggattggaggaggcgagcgatccgcttgcagttgcatcactttcgtctcacccctcggcgcactaccaaatgaggtaccacctgcgggcaccgctgctcctccaaccgtcgccccttgaagccgccgcatgtacatccgcccgcattgcaaagcgcgattagggcatcgcctcaaggatccacaagggcgattcgccgcaagctagcgatggaaatcggatgcacctacctagcaaacgcccgcggatgatgaggacgctccgctccgctccgccgtccatcgcctcctctctccctctctccgcgattcgatctcaccggcgccgtagcgcgcggggcggtggagagcgtgggatttctccgcgggtaatcccattggataaacatggcgcgtttgggtggttcggtcgccgcaccacgcaacgcgacgcagtgcgcgtgagcgtgcctaaccgtgtgcgactcggctcgacaaaaaaccaaaccaaaccgatcagatcgcattagaaaatctctccaccgcttgcaattgcaagctagctgcagtggtttagggccaaacatgctgcaagtgtgagtcgttgaccaaagaggacatcacattcggagtcagagatgggagaccgccagtgcaatgctagtcataaccacgatatcaaatgccaaggagttaaagaaatgatagtttgtgaacttgtgagttgtgatggaccgggacgatgagcatgggtgagctaggcattgtctctgcgcaagcactggtgtactgccgctgccagggtagatccaccgtccattgcagtggtccattgcctcaccctcacgccgacacttgtttcacagcgcgcaagtaattaacttgatccattcgagagagatgaggagagaaaacgaacaaggtttggttgatctggcactggggcaccgccaatccgatgttcgttccaccgactgtactacagtactagtatccggcagtctggctacgcggtatactactatacgtgtcattgtctactcaaccaagaaaaattcgctgacgatcgagaattgtgtcagtaacgccgccaagcagaagaacacccaaaatccatctatccaccaccactgggactggattcatcatcatcaattggaagaaatctcaaccaccgttgggccccagacgcacagacacacacaaacacatccgatcccgcggcggcagcagcaagcgcaattcccatcaaccgcaagtgcgtgccggccgaagatttggcgcacgcacactcaaaccccccactccactgcccccaaaacccaacccccaaccagccagaattaccacacacacgcaccgcacccgaaatcccaagaaacgcgcgtataaatcccaccggcttgaggagtcgactcgccgatccatccacccgcgcttcgtccattccatctttctctctctctcgcggaggtcggaggagcca

SEQ ID NO: 15729 - DNA, 1501 bp, Oryza sativa
gcaaatcaatcagagagagttgctagcgatcgatgaaccgagagagaacgtgcatgggctagttgtatattcttcttcctccctgctgctagctgcaactactcagtggttgcctccatgcttgcagtgagatgcttctctatatgccattggatttggaatctagcagcgtgaagctcaaactgagagaaattatagcttaataagtagtcgatcgacgaggtagctagctgccggtggcctgagtgagggccatccatggatgcacagtctctgtcgaagtgtcgatctagctatatatcattcattttttggggttcgaatacgaatgtatactcctgtcactttggtaatctcactttcaaagattgaacacctagattgtgctgtacatacgagggatgatgacatttgtaccttttgagttgtgactaggagatatcgatcggtgaggaatagtctggccttacgtgttagtatctgtacctgaagaaagtataataatttatgaatgcaacactcgacactgtacttttcgcgttcgcgaaaaaaaagacactgtacttttcgattgttcatcgcatggaattggtaacagcaagcttaacagagaaaggtagtcgattgtctggactctctgaatgataacttataattggatctcactggtgactgaaccaaggacgtggatgcatgcagccgtcctttttgttgtctggatcagttaacggttggtaattagctacgtggatcaacgacgatactgccaaagcttagcttagctgctgctccgaaagataaggagaagattgagaagaagaagatgctagagctagtcgatctcaaggcgacatatatgtctgctcgtcctgatctgctctgctccctctgtactttagcagggagcagtttgtttgtgaatagagtaagtttattttgcctccatttattgaatcatcttcctcgaccgcaaaaccacctgaaccacaaaccaggtttaacatcttccctatgtttgaaaaccgaggcaaatcaactgcttctatggttttaaaaacggttttttgctaacgtgacaggtccaccacatcagcacgtggaacccaacatctcaatgactttctctcgtctcatcttcttcctcaactctcttctcatatctcctgcaaaaataggcaaaacagtggcttaatttggacccagcaatttcagcaagccgactgtagtatgggccgttccggcccaactataatgggtcgcacgaagctcgcattcccgttccggcccaatagtgtgggccacacggagctccctctcccttgacggcccaactgttggatggttaagattcgtgcagcctcactcggacttgtcatctgatcgctcgggaccttatcgccgtctcggcctcactccggctgccggcgccatgcactcgccgtcgccggcgccggcggggtgcccaccggccacctcgtcaccacctccccgcgccagcagc

SEQ ID NO: 15730 - DNA, 1501 bp, Oryza sativa
tatcacttatatgtaactcatcttgattggggatgaattctaagtacatggcaggtgaatctggcgatcgggaagttgatgaaggatgtgcgaaccctcaagcatagaagacattcggctaagagaactcgaaggaaaaacctattcgagttaagatccagtcgaatggaagattctgtgggggccacttctcaaccacccttgccagctggagccaaaagactataatgaccccgagaatgtactgtagtacccctagggttgctgacatggcaagggcattataggaagttcactaaagcccatgagggtagaaacgtaacatcacatgtaagaccgtaggctataaaagccggtcaaatccctgtagcacaacaagacatttttaatacaaaagtaatcctcaaaggttgtgtttgctgtttgagctcatttctaaggataggcgggaaaacacttctttccggcctatacccgatcttgttcgtgacctaaggtcacaacacagagcatagcttgaagaaaactattcatgccgttaacaacaaatacattggtgacatttcttgactcatgagtcaaaataccataaccgaggttattcatgctggttacaccaacaaatacatcggtgacaatttcttgactcatgaggcaaaatacctcaaccaaagttgcacaagaatttcttgttgccattttgcatattaaatgcagaatctgcagctactggcaaacaatttcaaaagttacccctggtcacagattgatatccagtaccagcctttcctacaacttgtatacactcggaagccctgaaccctgattgttagtactactagggaactctcagcgatcaaagaaccaagcaactcaccattcctcagatttctccatagcccggacttggtcatggaagaggacttgggacacaacacaggctatcttgctccctgattcgagcgcctgatcccggccactagcatccacaaccacaaaattccctgcaaattcacataacccacaaccaaaccgtcataaaccggcggcaaaagacagctcggttcactacgggagcagtgaccagctatgctaaagtccggcgaccactcaccattcttgatccaaaagctcttctggaacttggccgggaacaaggccagagacttcactcccttggcgtccatcacctaacacccagcaagccacggcgataaggaacacatacgaatggagtgcaagggaattcacgatcaggggagacctggaggtgggagagagagagagagagagagagagcttgtcctacctcgatgacgttggagccgcgcagcgcgaggacctgcatgatgctctcgccctcccccagcgtgacggcgccctcgctgcacgcccgccgtaggttcttcctcccagctttcatccagctcccgcttccaaggaacacaacagttctcccctctcgccggatccaaccacgcggaggcggtccgggaagcta

SEQ ID NO: 15731 - DNA, 1501 bp, Oryza sativa
tggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccagggtcgggttgccagttcggtctgaatcatcgtaggccttgggttaaggcaggttcgtgagggttcacggccttgtttaataatactgtgtagttctatgatcgtctttacaaaatggctttgggcaactaagtgacttttaaatgctgtttactgcaaaccttaatccctatattattattcccttgtacctcccttgcattaattatgcatctgccggtgtggcttgctgagtactgtggttgtactcattcttgctcaatctttcccccccttcagtaagagaagctttggagaagatgtcttaggtggagtcctggcttataccccagttgagcgcctgtgaagatggagccgtaggccgctagtccgctgctgtttatttttgcttgtcaggcctgaagtgcctttgtaataatgtaaatattatcgatataataaagatgtgtcttctatatcatgtttgtgtggtgtaccccggcttttcctgggacggggattaatacactggcgttcgggaaaaggcaattttcccggtcgcgacaagctggtatcagagccatctcgactgtaggataagccaagtggataaaacccaaggacatattttataaataaaaattatttgcgaaagttcctttttctccttcccctaatgctatttgcaaaaggtttactccgttcttccttcttcggattttcaactagtactagatggtcagctttgcgaggaagaagatgtcgtcagttgtttgccgaagctccggaagactgcaggatccgctagcgaagcgaaggaagcaatgaagccagctgtgaaggagtgaagatcttgggaacccgtcgcagaacctaagccaccctatagggtagtgttgttagtcgtgtgttccttgcttgtgtgtgtagcgcgtggtttgcatcggtgggtggtgatgtaaccatgctaggttgtttgcttaatcaacttgcagaataagtgaaacaaacaacacatcaacaaaaagagttagttcctttaaggtcttgtccctagttctggtctattctttccttgtatgcttcccctct

SEQ ID NO: 15732 - DNA, 1210 bp, Oryza sativa
aaatacttggacattaaaaatatttaatacaattttatctatatcaacttaatgttcaaaattttcatagattttattcacacacttactttaattattaagtaatttctaaaaattcctttttcacaacgatttataatttagcgattttcagggtgtgacatgtgatatctcgcagcacctatcataaacagttgagcaaatcggtcgatctgcattatcctttagtttgtgccacagccaacagggaaagcggtggtaaaccatttgcatgacaagtggaactgtggaccagtctatttttttcttacccaaaatttttacttcaaaaataaaaagtttgacccaagcccgtacacttgtgaaaaatggacatgtgaagtgacagatcgcttcgcttatcctaacactactggagaaaccctcaaaccgggagagaatccgagactaaatatgtgtgtgtatgtatgtacgtacatacgtacgtacgtatgcatgcatgtatgtgtgtgtttaaatacatattatatggatgtatctacacagctagtggtagctggtttgtctaaaacagctaccactctatctataatagggaccatccacctatacttcaaatacaattttctcttaaactactcatccgattttcgatccgattacaccgttgtgttcacaacaattaaatctttacaacaagatctcacatgattatattttgatgaaaaatcacaaattacttttatgatatgtctaaattacttttagatttcactaagttacttcttaaatataaaaaagtaatttacatatattatagaagtaacttagaacaaaacgaaggtaactttagcatgtcatttgaagtaaatccgttttagagataaaaacatgactctatctagaaattaaattaatcagcacaaattatggaattaactaaaaaaataataaaagtaatcacctcagagcattatgaatgtataggaagtattttaataaaatctgaaagtaaattatatatatatatatatatatatatatatatattgaatctattctacaccctctcccatgggtcaaacccaccaccccaccctcccttgggcccaaaacccctctcccacctcggtcaaagcgtcctcccgccggtcaaacccgctcaccactccttcccccacccaccactttgctgctctcgtcttgcagg

SEQ ID NO: 15733 - DNA, 1501 bp, Oryza sativa
atcttttgtatagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattatcacaactcctttccgaggtaccgtggtggtattgaggcacatggtgacatgatgtggggttgtgtcttgtgggtacagtggtacacctctgatcagagtttaaactattcgaatagccgtacccgcggttatgggtgagttgagcaatgtttttcgtgattagtctcacactactcattaatggttataatgtggtaattaatttgactcctggtttggaatggataattcctggtttggaggtttaatttgttcaactggggttggttgttcaaatgtggttgggcctatgcaacatgggtgtgttgtatggtgtttatttaatactgattaattattcaactgtttttatcattctcttaaatatttattaaatgctgtttctgcaaatgagctatattatgccatccttcgttatcctgtgcacttgcatatttgctgtgtgacttgttgagtatgtcatatgctcattcttgcaatattcattcatcagaagaggagtatctcagtgaaggtgatgatctggaggattgagcttgttcttggttaagatgcctgtggagtggagtcgccatagctgttccgtagtttgttatagttttttttccgctgcgtagaatgttattttttgagaggaactatctacctctgtaatcttttgttatttgcgagtattaaatagttatttatttgtactctattatcaaattgtcattgtgtgcctcggttgattcctggacgagggtttaacacacatgtaagcgtttggaattttggatagaaattccgggcgtgacaagttggtatcagagccaccttgaccttaggataagccaaatggtaaaccttaagtagccttcaaaatatttttgaaaaaaaaatagaactgctcttctctattctcttacaaattaaataagttggcagcacatgcaaggttatgcacaaaattcatttaattcaatttcttttcttttaaaaagcaaaaagttgttcttctcaaaatgtttctttttctctttactaaatcttatggattggtcggcactgtacatctattatggtatcgatttaatcatgttggcactagtactactcatcccttttaatggtgacattgtaccgtgcttatagtaggtcttaagtattttggttttattttattcacttgttcaaactgatttgtctctgttcaaaagttaaattcaaaaagaaaaatatataaagtagctttgtatgtgtcttttcttttattttcttcctttttggtctaaatcagttaagtctagttggtgcagctaacttaaaaatatgcattaattcttcccttctatgtttctttaga

SEQ ID NO: 15734 - DNA, 1501 bp, Oryza sativa
gaaggtcatcactatcactagccaacgtcacacgaacacgacacttctcctcgtcggggtcatgggaaatttggcgatactcgggagcaacttcatagcctacctcaaaagccatcaacctcagctccctgacgaaccctaacaccttgatcaaatttctcggtgaatggggtggcatctaaagaaacatagaagggaagaattaatgcatatttttaagttagctgcaccaactagacttaactgatttagaccaaaaaggaagaaaataaaagaaaagacacatacaaagctactttatatatttttctttttgaatttaacttttgaacagagacaaatcagtttgaacaagtgaataaaataaaaccaaaatacttaagacctactataagcacggtacaatgtcaccattaaaagggatgagtagtactagtgccaacatgattaaatcgataccataatagatgtacagtgccgaccaatccataagatttagtaaagagaaaaagaaacattttgagaagaacaactttttgctttttaaaagaaaagaaattgaattaaatgaattttgtgcataaccttgcatgtgctgccaacttatttaatttgtaagagaatagagaagagcagttctatttttttttcaaaaatattttgaaggctacttaaggtttaccatttggcttatcctaaggtcaaggtggctctgataccaacttgtcacgcccggaatttctatccaaaattccaaacgcttacatgtgtgttaaaccctcgtccaggaatcaaccgaggcacacaatgacaatttgataatagagtacaaataaataactatttaatactcgcaaataacaaaagattacagaggtagatagttcctctcaaaaaataacattctacgcagcggaaaaaaaactataacaaactacggaacagctatggcgactccactccacaggcatcttaaccaagaacaagctcaatcctccagatcatcaccttcactgagatactcctcttctgatgaatgaatattgcaagaatgagcatatgacatactcaacaagtcacacagcaaatatgcaagtgcacaggataacgaaggatggcataatatagctcatttgcagaaacagcatttaataaatatttaagagaatgataaaaacagttgaataattaatcagtattaaataaacaccatacaacacacccatgttgcataggcccaaccacatttgaacaaccaaccccagttgaacaaattaaacctccaaaccaggaattatccattccaaaccaggagtcaaattaattaccacattataaccattaatgagtagtgtgagactaatcacgaaaaacattgctcaactcacccataaccgcgggtacggctattcgaatagtttaaactctgatcagaggtgtaccactgtacccacaagacacaaccccacatcatgtcaccatgtgcctcaataccaccacg

SEQ ID NO: 15735 - DNA, 1501 bp, Oryza sativa
tctattcgtagctgtgccactcaaattttacaaaattggagccatgctatcactgtcatgttttacatcatcttcctcatctacatgtgggacccactagtcagattcatcttcttcctccatcctcccctcttctctcttttttttccatccctctctaccacttcaatctcagcctcatcagcaacaggttgcaccacttcctccatcctcccgcaggccgttggcgccagcaccatgccggagcaagccgtgacggaggtcggaggcatggacttccccggcggcgaggtcggaggcgtggcgcgtgcggccgcgagtgggggaggtgtggcgtctgtggccgcaagggcggaggcgagatcgtccgtgtcggtgagggcagaggtgtggactctcgtgacggcgagggaggacgcgtggactcccatggcgacgagggtggacgagtactccacagcggcaacatcggagacgtggacgcctgcggtcacgagggcggaggcgaagtcatccgtggcgatgaggggtggaggtgtggattcctgtgacggcgctgtcgacgggggatacctgtagaccggatataaagggtattggggtacgctggtatgaggatctacgtagtacgacatcaagcaaacaggaaacagggattatactggttcaggccccttggtaggtaatagccataatccagttgatatgggattatatgatagaaaccacagattacaaagggaatagcggaactcgacgataccgtcgggatcgtagtcgagttgatccgactagatctcccggcgacttggctccaacaagctccagcttcgtaggctgtggtggatgtgttggctctgagattcgatgccttaggtcctcccggggggtcccttttataccacaggtcaactggtctccaagtaggactcggagacatcaaacccgacacgatacaatgacgacccagttctatctgagtaggactctttccatctatagaccccgtgatggacttccttaacttatgctgagaacgtccgtatacgcgcaagcataccatatcgatatgtgacgtatatcgaggggtagagggtataccttacccgtaaccctgacagtagctcccgacttctgcttaaatgaacttgtgagaccgatcgcggcttctgatgttgtcgttgttctcggtgtgaagaccgagagacaaggagtgatcgacaacgtcgggtgaagctcaacggtcatgagtgaatttaaactgaagtccgaaaaactgtcgcatgtaacggaccccgaaatttccggcggccatctctctcctttccttggaattcgcaccgtcggaagtgcgtctatttaagggagttttggggatcccatttgaagtacgcctgttgaaaacactctccagcttccaagcgtccctcgtcttcttcgctcccgcaaaaaaccctagctagctcatctcgatcctttcttcggcgatccccagcagtga

SEQ ID NO: 15736 - DNA, 1501 bp, Oryza sativa
cttaattagctgccaccgataaatgagcagttgatgatggtgatgatgatctgaatgatcagctcatgtttttttggttagactggttaatttgatcttccttttggtatggagcttaatgcttccaagtgtatatacactctatgctatgctatgctatgttttcccatgtgcatgcatgcaaatgtggctttgaaacctaattatacatgcatgagaatacttaattaatatttctgattttcccatgcatttttggatttaagtgttgcttcttaattaggatgcttcataattgctggctgatgaatgagaaccgatattaatttaccatgtgctttgcttgctagagttcattaatcaagaactgtcattatatattgcacatatatggattattgctcatgttgtgtttaaacctttatgcaatattatgttgggttaaacattgaggtaagctcttgataataattgatagaaccaaggaactgcatggattatattatttatcttgctctggattatgcttttatttttatggaggtaggtgtcactttccctctttgttcgtgcatgaatggtttggacgtttggtgtctattcctctactgaaatgaatgaatatgttccccttcagattaaggataaaccatgtcaaattcgtgttgaattattgtcacatctacttcttcattgttggttgttagacctgattgaagaagaaatcgttagaccttataagagaaaaaccaaaagacttaatttctttttttctcttagatgtgcactactcttccacaaggtatcttaaactcagaatcatatcactaatatgcatggtttaaatttcatattgactctatacatatcaaccatttcatcaatcaaggaggagctagtttagttatttaatgaaataagacgatatatagggagaggactacagtcgggtgtctgacgttttgtacgtcggacagtgttgcatgacattgattccaagtgtttcacatgtttcatcttttgatgggaaaatattcaacaaaatatggagaaaaaatgtttcatcgtatgaaaacaatgtttcaactgttgaaaaaacatgtttcgacataaaaaaaatatgtttcaacaattttaaattatgaaacacaatcaaaacaatactgaaacattttcttacaacacatgaaacatcaattttgaaacatccaaatgcttcgggaaaacaatgaaacacacaaaaaaaaaccactgcaacattttagtctaaactaatgaaacatccaaatattaagctaaaacataaaaagagaaaaaagcggtctagatctatttcttcctcttctccagtgataggtaggccaccatgttaatgttgggatacctatactccatgaagactctctattaccttctcctattgctgacgaagataaggcagagcttggcgccgcgccgctgtcaagcaagctaacactgagttgctcccctcattgatagt

SEQ ID NO: 15737 - DNA, 876 bp, Oryza sativa
tcaaggcttccacatgtcttgcaaggaggctaggacgagcaggagaagggtgtccactgtacaggttgatcgatcgatcgatcagagatcaacatgttgatcgatcaccctgccctcgcgggagcccgggtcatagcggttccagaggcgcttggttcacgcacagctcgctggtttgttttaatctcaaccaaatcaacggcttggaatataggactcaccgagttaaaggaaaattaagggatagattttattaacgccacgtgtcagcttaagagcgttttgaggattgccacatggcagcgttggagtgttttaaggaagtttaatggacttttagtatataatagatagatagatagatagatagaagatagatagatagataatagaagataatagatgcctgcgggcttatgatgtaataattagcactagactctcgtgtatgtgcatttggtatttcaggtatgaactcgtgtataccagactacttgatcttgggaaatggtattgtttacacgaatgattcctgttatcaaaacgggggtccatatattggaagagcgtgtgtagctaaataatcatccatagctatctttattaaaaattgaaaattactctactagtgaatagttgcatttatcttatccaatgataaccattttccattttttttttctggcggcttccaccagggttgtgtgggggagagggcggcaacgtgtgcggtgaagcggagcgaggctatagagatgatgtggtggcgtgcaggcgtggagacgacgtgacacgcagctgtggatgagccgaccaacatggccggcggtggcaggacgacggcgcggtgacagccgggcggcaataggacgacaa

SEQ ID NO: 15738 - DNA, 1131 bp, Oryza sativa
aaaaagtcaacggtgtcaaatattttaaaacggagggagtataaaaataggatgttcccatcccatcccatgatatctcccaaccaaacccaccctagcagtcccgatgcacttttgcgctggaacttgcagaggttcaaggctcctactgtacgaagtcgaacactagtgcggttgatgggctgaaagcccaccgaaagatcacaaaaacacattcaaggccacagagatcggttaaaagcccatacgtatccaactacaactaggcccaagtacaaaaaatatttatcgatctttacaagttggttaaggcagcacatggcttttagaggcgcggatgttggatgcgcgtgccgtaaatttttcatacggacgaaaatcgattgacaaatagtataattttaatcgagtgttgtttatacacttttttcccgataagaaccagatctcctggttacgagaatagttgtatatgtggcgtgtagagaagagaaaaaataaataaatgaggaatgttagctactccattatgtaatagctagctctacacatgttctaatagaaagaaagaaaaaattgtaaatgcaaccttatagctaatctttatatatattagtgagagcgtattctatacacacaagatttcacgtgttaactttcaataattcagtgaagaaattgaaaacgtcaagggcttgtttggcagagttttaactctagctcagtttcagctctatccaaaataaaagtaagctaattgaaatactcttacaaaataaattagagagatgaaattagatttaaactgccgtacaactttattttatatagatctagtttttacttaaatttaagagtttgaactgttaccaaacaagtcctaaaataatttaattaatggggtacgtggcaaacgtaacctcaattcctcaaataacacgagaggctgcggcaaaaagccgacgacggagcaaaacgataaagcgagagagacctgccgagaccaaactcactgccgtgcgccaaacgtgcgctgcatataaaattcgccggaattccatctacccgcacaaaatattcgcgagatatttttgtttatcccatccgaactgctcattgatccgaccaagg

SEQ ID NO: 15739 - DNA, 614 bp, Oryza sativa
ctgaatttcggcagaatctgaccctagtatgacggactcagattcggtgacattgtgtaagcatgtcacaatgtgacattcggtggatctcagccatccaatccccatccaacgactgtcttgattgggcccgcttgcagatcaagaaaatccccaatccatccaccacggcgggagacggcgccccaatccatccatcccgcgcgcttcgctgccttcgttcgcccgccgccacgagctgggaggcgcgccgccgccgtgactcgccgggctcgccgctaagtggatgtaaggctaatggacctatatgctaatgatcctgtcataatacaggtagcacttttctacctagttaaaaaatgaactccaaatcatctatgacaaatgttctgaaagttcaattctcaggcattgagttcgagttctgaaaactaaccatagacaaggatgaaaaacatgctaattaggggatagctagagctctagcaataaactaaagccttttgtccttccaaaactagtaaaataaccctcagtgcctatctctgaaacacaactcagacatccccagcaaccacacggacatcaaacatcataaaaaaaatcagataagt

SEQ ID NO: 15740 - DNA, 1501 bp, Oryza sativa
  unsure (1)..(1501): unsure at all n locations
tcctactaatgaaaatcaaagaggaggcgagcctttgggctttagcaggagctaagcggttgcgtgagttaatcccgcactctgtatagtgtacagctatagtggttctccgttttcctcttacccctaaggatttgtattttctcctgctctattcaatgaaaaggcaatctagtgctgttttccgttaaaaaaaaaaaagatgcgttcgtgatttcttctgcaaaggagtctgcaacaacatactcaaacgttggaaggccaacatggtgagagagatgcatcgcttgtacagggtgctcgcacacgtggcgtccaggtcagcgggcatcgcgcgcacgagctgccacgtcacccacgcgatggggcgtgcgcctctcgtgctgattggccgcgccgttcccattattggtggggcgatcccaattattgccatcaactatggaattctcgtcgcgtgctggatgctgcacatgtttgatgttgtccaggtttgttgctctcacacattatgaatgaacgcgaatctctcggtgttaatggaagactttggagtcgaattttggattactgcatgcatgattgcatatcatatctacctgtttccttttctctgttgaaatgatcaatgaacgtatcgatttgatttatgttcatgaagacaaactgaaaaaagtgtacaatttggcagagtaaattgatttgccgtgccatggcactccacttctcctggcgtagcacgtcgccgttcttggatactgtctgctcttccgtatacgatctctacaactccagtgcgattcacagggctagttgcggtgaacagctcgtcgtcaacggcacgaactgcgacctcggcgactactggcagcattctccgacgccggatttcctcgacagcgaccggatttacgccgtcctggtgctggggtgcgtttgcagcagcggcggttgtggacgtggggaggcccatgcgaagcaggggcatgacgtctccggggaaaagcggccgagtcggcgggacggcctcggccgctcgttctggtggatcatggtggcgaggaagtacgagtggtgcgtaacgtacgccgtggtggtggcgacgctgcagctgttcctgcgcctgaccggggccaacgtcaccacgcttttcctgcccatgctgtcccaggcgacaggctgcggcaaggcggcgctggccggacacgccgtgctggtgctggcgaacgccggcggcgtcctcgggtcggcgctcgccgcgaggacgtacggccgcgaggtcatgtgcgtcatcggcggcgtgctcatcgtgttctgccaggtgaactagctactggagtatctgtgtacgtgtccttatattacgacgtgttcgactaaggcgttatatgcacgttgctgtaccgccaccaggtggtgatcccggtggccatggagatgcacgggggaggcggcgcgtacncngcggcggcggcgacgttcttcgtggcgtgcgcggcgt

SEQ ID NO: 15741 - DNA, 1375 bp, Oryza sativa
ccccaacgaatcgaacccccgttgccccagtgaagtttccctgtttgctcgccgccgacgatcgccgtcgaaatccgccgtcgtcggctcctctcgcgtcgattcctctcgccgccacgctcccggggatccccttgacctccccctggctgccccaaggccgccggccttctcctttgtctccgcgccgtgtcgccgcttccgccgccgcctaacgccgccgtgcgtgcgccgccggtgaccatcgggtcccgcgtccccgcgtgcgcatcgcggtcgcgtaccggttcggctaagcccgagcccgcgcgcccttcgctcttctcgcgcgcggccacgtcggcgtgccggcgagattggtcgccgccgccagccgccgtcgtttttcccccggctaatccgctccgttgaatcgattccccttggcctcctctctcttccggtgctacccccccaatccacctcgccgccgttcgccggttcacgtcgctcgtcgccggccatcggatcagcctgcccggcctcctctcccttccccatccgacgtggcatccacgtggatgccacctcagccgcccggccccgcggagaccggtcaaaggtctcccggtccaccgatccaacgcgccgccttgcgtgcaccccgctcgcgtgagccgtgtcgccgccttgtgggtcccaccttgcgcccggcacggtggaccgcgtccaccggcttgcgtcgcgtgggccgcgcctcgttcggccttgggccgcctccctcccgcgcgccgacccgctcgcctcggccgcgcccgcgcatctcttcgggccgcgccccttcgctcggcccaagtccaattaacatccctccatccttttctttttcagggatttaataaatcctttttcctttgtcccataaatcaattccttattctaaaatcccataaaccatttcctttggtcccgcgtgacagtgactgtcaataatattcttgagaatattataaattccataaaccatttctcctattccagaaactccaattaaacttctaaaattcatatcacccaattcgcaactccgattgactccgttccacttccagtatttccataaaattgagatctatttaatggcactactaattagtctaaataggatctttcttttggtctcttgtttaggttttcgattgttgcgtatagttgcggttatcggatttttcgtcgatcgcgggttttcccgaagattcgtgaagcttcgtgaagaccttgagcaaggcaagtcaccctttgatcaattgcccctataattgaaaagtcattattattttgtttgcaacttgcattattagaatcacacacttaacttgcttggcctcggtttgcg

SEQ ID NO: 15742 - DNA, 1501 bp, Oryza sativa
ggctcgtctcccctcgtcctgcgcaacatcccggtgtgctcgccttcgcctgtatcgccatggtttgctccgccgctcgccgctgtcgaccgccgtccgttccggccggcgtcgtcgtctacctcccgccggcccgcgtggcagccacgtaggcgccacgtcggcgccacctcggccgcgaccaggtcaagtagaccccggtccgccgcttccctccgcccctcgcgcgcgcggtccaccgcgagccgtgaggctgcgcgtgggcccgccgcaccgcgtcctccgcgaaccgcgcgcatgcgccgcgcctccctccccaaaccctagcacgccccgcgtgcacctcgctcacggtgagccgagtcgccgacaagcgggtcccacccgggaccacgagggatggacccggcccaccggctctctctctcccctccccgctcgcgcgcgcgccttgggccgccttcataggccagccagcccattaaggtcggccgagccgccccattctctcgggccgtgccctagccgcccgagggaagtctaatttccctccctccttcttttcttttcttttctttttcaaaaaggatttaaataaatccttttcctttagaccaaaaatccaataatcttagaaattcaatatctccccaaccgtaagtccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggatcgcacttaatctgtcgtcccgtctgcaaggcagattggcggacccacctaatttgttgcattgatcctcccttgttaattgttatatcatgtccccctgtaaccatctagttgcgtctcgacattcgcgcaccctgtgcgagcatcgacggacgccttcaaacttaaaatctgaaaaacaacttgggtaaaacttgggtttacaaaagacttggaaaactcgacacctgggtcggtgcttgcgaactaaatggattttccaaaaccgcggaccggggaacgtaccaggtgtacggtttcccgctctcgcacttaaggaccgattccttggaatttcatccaaacgtaagacaagtacgaccacatgggtggaatgagacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttagaaatgccttgtcatgaa

SEQ ID NO: 15743 - DNA, 1501 bp, Oryza sativa; identical to SEQ ID NO: 14942

SEQ ID NO: 15744 - DNA, 1501 bp, Oryza sativa
tacgtcgattaactcttctattttttttaatattttttttaattttgtttctaagtatagttttttacttatttgctaacttacacctgtaccttattaattaggaggggtcatctcgttgatcaaccatttatatagatagttccctacaacacgagtacttaaaaaatactccctccgtcccaaaataagtgtagttttacactatttatgtttaacgtttgaccgttcatcttatttgaaatttttttacgattaatatttttattgttactagatgataaaacatgaatagtactttatgtgtgactaacttttttttaattttctcataaatttttcaaataagacggacggtcaaactttggacacagattcccacgactgcacttattttgggacagaggtagtacaagataattaaaaaagtagaaattttggtttggaatctactagaaaaactactccacaacacaaggtttataatttacaataaaaaaatattgtttagaatataatattcatttttaaaaatatttcttttaatgtaagatatgacgatatatcctattactgttctaagataggcaaatacattaaattatatgtgcctatttcttgaaataaaaacagattgtggatcacttcgtcagctttgtcgccttcagctaaattgtacaatattaaactatacggataaaatatatacttttgcctacgtcattttaaagtcaaacatactttgattgaactgtatggataaataatgaactatcaccaacataatccagcatgtcaccatggttactctacacataatttggtttacatcaggcaataataattcatgagaattatcatttacttctatcatcaaccagaggtacatagaaacaacaatgagagtgtatttggataatgggttaggagaggtggaattggtaaatggaaatgaatggagggatacgatgaaatggagcgagaagaatgaatggttaggattgaaacttatcctttgagagataagaaatcatatcccaaacctattacatggtctgaagtaaataagatacttgagccacagccacaaaaaaagtcatggtgaaaaaccacagagtgtgctgttactctgcagtgcaaaagaagggagtagaaaataacctgaaaatgaatcgagcggtgggtcacacaaaaagcacctgcccactgccttccccttcctcgttggcagcttcccccggcgccacctatgcctcgccgcttcaccctccactctttcccgttttgcccctcctcctgcctcttcttcctcttcctccagccaccgaactcaccaacaacgagacgactcaggggagatcaacctgctctccactactgtggactgcagtggagtccgtggtgagtgaggcacacacacgcgtccttctccggcgaacgatggggtggggtgagccgccggcgccgcagcagaggaaggcggcagggggcggcgggctga

SEQ ID NO: 15745 - DNA, 803 bp, Oryza sativa
tctaagacagtcagaggagccgtcgacttcatagagaagatggtctccaacatggactggagcaaagaacgactccagacccgtaagtgaggaatgcacaccataaaggagaccaagatgctcgctgcaaaactggacctcctcatgaaacatttggacgaccacgagaagaagccccagggcactgttaaggcattggactcacatgtaacgtgcgaggtctgcggcagcatgggtcattgtggaaatgactatccggaaacacgtgaagaagcgatgtacatggataacaacacaacgggttccgtccacagggaggtcaggggtgaaaccaaccccacccatatttccaaggagccaacaataacggtaacctttctaaccaaccttccttgaaggatctcgtctttgcacaagccaaaacaacttacgcacttagcaaaaagctagctgctaatgacaagatactagagaatataaacgtcaagctagatggctttggttctgcatttcagaacaagcttagttttaaaagatgattgaaacccagctggcgtagcttgctgcattaattcccgctaatgaataagggagggttccggagcaaccggaaccttatgttgaaaatgctaaggcgattacaacgaggggaggtaagtccactcgcaatctgccatatcctaaccctgcagggaccggcaacaacagcaacagggaagcaccatctagtgacacaactgaagaagaggttcagtcaaagaagaccgtgctgcaggagtattgtgacacgagaccgctgccac

SEQ ID NO: 15746 - DNA, 1208 bp, Oryza sativa
ttttccttcctttttctcttgagtcttgatgggccgtcagcctatctctctctctctcgcgccacctccctcttgctgggccggcccaagccgcctccctcctcttcccgggtcactgacaggtggggcccacctgttggccccgtcttcctcctccagccggcggcaaccgccgctgccgccccacctcttccgctcctcccgcgcccacgccgcgccgctcccatgtcctccccacgtcgccgccctctccccgcgtctcccgccccgcgcgcgcgcacgaaatgggcgggatttgatttcgaatcccaccccactctctctatctctccaccccacgtcgccggcggcttcggccaccctcccggccacgtcctcccctccctcgcccataaaaaccctccctcgagctccctctcttgtttccccattcgccgttgtcagggttatggataccacatacctaatagtagttgactaaatctcggcaggatccaccacataccatatcttatacggaaactgacctcgagggagttccggttaaggaaagacaaaccatagttctacatggaaacgacaatgactactcagattgtatccatattggtttccctagttctacttagacaaggggacacctatgggtataaatacaagaccccctaggaggagacgggagatgaccacctcaatcaacatacacggaacaacagaagccacaacatacaagccaacatacgccaagacaagacgccggatatcaacttcagggataggcacggttagtcccctacggtgtctccagatactgtcaagagagacgaaagcactatctctaatctcgccgggcacggattcgaggaggaagactaccctgttgtcgactacgagtcagaccttcagactgccatgtcgacaacagttagataggctaccccaaatattgtactggtgtgattatggtgaataagagcaacgaccggcttcggccaacatgatgtagggttattacctgacaattcaggggcccgaacctgtataaaaatcctcgtctccgtctcttttacctcagtctcgtgtatatcctagtaccaatgatccccataccatgcaaataccagaattgcgacatcaaacgtcgacagtggcgcgccaggtagggggattttggtgcttcaggatttagacgagatgggtttaagaga

SEQ ID NO: 15747 - DNA, 1501 bp, Oryza sativa; identical to SEQ ID NO: 15672

SEQ ID NO: 15748 - DNA, 1501 bp, Oryza sativa
gctggcagaccatcgcagtggttgtgtcagctcggggggcagctgggctcgacggcagcggcgcgacgaggaggaccaccggcagcacgacggctacagaggggcgaggcgacgagggcaggaggaccaccggcggcggcgaccgcggcgacacgcggtgggagcagcggcggaggcgataaaccacggtgggagcgcgacggcagtgcgtagtgggaacagaggcggcctcggcgatggtggggagcgggagagacggcgtgagcggcgaaggggttgacccgcggtgggagcggcggcgacggcgtcggcgtgcggtttgagcagggacggccgtggcgacggcgggagctttggaggcgccgacccgcgatgggagcggcggtgacagcgccggcgcacggtgggagcatgggcggtcgtgtcggcgcacggcagtgaccgcgtggagcatggtgtgggagctcgttggcgcgcggaggccaaatggttgccgacagcggtacatgcgagggcgggcggcggcgcgggagcttgtcggcccgaggaggctgggcggcggcacgagagctcgccagcgtgtggagggcagagcttggcggctcgggagcacgccggcgcgtgaaaaaaaaaatgttgaataaacaattttagaaactagggtcaaatgagcaagggtataaacgtctatttttccctgaagttaacactgttagcttgcccttcacataatacggttagatccgaccttcattttttaaaataagggtcaaatgagcaaacttgaaaaattagggttaaattggtagttacactccaaatcaggggcaaatacgcagcaaatacgcaattaccctaactaactttttatttttcatgtttgagtgcacttgatgtatatcggtgtagtagcacgcgcgtgagattctcaccgtcagacatgacgcacctcgactttggggctgttcaaattgatgacagtttcaaccataccattatttggtaaaattgataattatgtggttatatttagtttgttactaattattggcaatacatatagaattttggcaacactattgaactaatcctaccaaaattttgacaatgttattaatttgccaaaattttggcattactaaattttggtagcgttcattttggcacaaactgaacaaaccctttattttaagagcaagggttttgtcgaatgtttatttaaatcaagattgttcttaaggggtgtttagatcccaccccaaaattgtacgctatgtcacatcgaacgtttgaacacctgcatgaaatattaaatataggctaaaaaataactaattgcacaaattgtgactaatttgcgagacgaatcttttaagcctaatagctccatgatttgataatatggtgctacagtaaatatttgctaatgatggattaattatgcttaataaattcgtctcgcgatttactggcagattctgtaatcagtttttttattagt

SEQ ID NO: 15749 - DNA, 1501 bp, Oryza sativa
cattttgaaacggagggagtagttactacttagtgggccattgctttgtttttttgcatacgtgggctagtagaaaacaaaaacctaacgcaataaaaaaaagttgcacaaaggcccagaagcctgaccaaagaatacctctaacaccactcgtgttgaaaacatgagcccaaaagcaactacgcattcgctggtagctgaaagaacgaaaggggtgtccctttcttttttcttttttttttcatctgggccaaaaagggcattcagagcaatcaccgatgagccatttcatccacagagtgttattgaaacctaatgatatatagcctccatttttttcactataacacaactagtgggccctttgtgtggtagtcaaatcccaaaatcccagtccagcaagcagaggatctaatcaccaaacctaactaaccagcgtggcgaagatctataaaaatagagtgatgcccactgtcaggatgtatgccaagactgtaggggtgtgtgcacatacgattgggaagatacgtaaaacgaggtggcctattaagttgtgtttgggagtgagggttcccagcacgtaaaacgaagcagcctttagcgtgtgattaattaagttttagcaattttttttaaaaaaattgatcaatatgaattttttaagcaactttcgtatataaactttttaaaaaaaacgcaccatttagcagtttgaaaagcgtgtgagcggaaaacgatgagaaggggttgggaacctagacaaacgaaatgagccttagtgcatgattaattgagtattaattattttaaattttaaaaatagattaatatgatttttaaagcaattttctgatagaaattttttgcaacaaacacacaacgagagaaatattctctatcacctgctgccgaatgcagttagactcatacgattcagcatgtaccagacaatatcattatttctgaaaaaaatcctgcctttggaatcgtgatgattctgttccgacaaggtcgccatgtctatgaactgcactgctgtcgaggaaagacatctatatcttgtttgaattgcctgaatctcaggtgataattaagctagctgattccgtacttcgcggctacatgggtccattccttgaaggggtgattagccgtttccaggattctgtattacagcaggcaaagtagttatttgctcatcatctaatctacaagtgatccgccatccaaaccctgttctaaaacagtactattattatgacaaaagtaccatgcaatatcatctgtcatgtaacttcgtcgtgtcctcatttagttttgtcaaaactattgttatcgcatcctatatgaagtgtgcacattcttgagctagctacccattagtccatatcgaggtcaagaataatcatatacccattgggcgggtgctattggcgagatgaagaacgcgatggtggcacacaaagacgggggtggtcgcaccgaggagaggatctcgaca

SEQ ID NO: 15750 - DNA, 828 bp, Oryza sativa
attttcaaattcaatttcaaactattcaaaaaatgttatatagaaaaataaccaaactaaatgttgtaaatcttgataagttatacaactttgttgttgacattttttccatttgaaatcatttactacccgtaaaattattttgactcataaaatgaattattatattgcacttaattatttagctatagttcaacttacaaatataaatatttcatatgaaaaatggaaaaatactcatcgttgacgggctttagttattgcccgatagagattaagtcatctcaatcgggcattagtatatagcccgtcactgatgagtcatctgtgacgggcctagttgttatctcaaacgggcctcaagttggtacacgtcacggatgatggtcatctatgacgggccccaacttgaggcccgtttgagatatgaaatgttatctcaatcgggcctaaagttggtgcccgccacagatgatggtcatttgtgacgggccgtaaatttaggcccgtttgagatatggaatgttatctcaatcgggcctaaactatggccagtcactgataggtgtcatccgtgacgggcttaagtattatacccatctaacatgtctgtgtgaccatatctcaatcgggcacttttcggcccgattgaaatgacttccttgtgatggcccgctatttgtaggcatattagaggccccacagatagaaggatctgtactagtgtagcattttttcaccagatgtcaagttttgccaagtcggctttgtccatatgctgcctcctctgagcctagttggtgactcatgtcccctgtctatgctaga

SEQ ID NO: 15751 - DNA, 1501 bp, Oryza sativa
aggcagcagcaagaaacgcggcggcggcgggtattcgtccggctccggcggctcgagctcctccggcagcttcaggtcggacggcgagccgggcggtgggctgcggcggtcggcgtcgtcgtctttctccttcgctcgcggcggcggcaaccggatcaggctcgccgccggagcgaggcagcaggaggaggtggaggcggccagtggcagctggttcttctgatcatcatgtcgccattgttgatttgatcaagttaaagttgtgaaggatttattagctaggagaaattaaaggaattagcagctttaatttttgcgttttgttgcgtggtgaggatgagagagcccagttcgatcgattacatcagactggtggctgtttgtgtgtgtcatgtgtaaagaagatagacatgaacagtttacatactccattgcatttcattttagtggagagtccactctatatgttgctgttaaactagtgcattaaccgtcaagattacacattgagatcctccgatgtaaagttaagagaaaacatggtcattgacatgtagaacccatcacactcataggctcatatatcagtgaccacgtcataactaattccgaatattgcacatgtgcgcgtttagataggcatgcatggtgccagttcagagaaagccttcttttttaattacttaccaaagtgaaatttggcaactagttggaaaattatatatttaaatttgctaataatcatcccataaacaaccatgaaaatatgcattacttaaatttgttaattagattcaccacttcaaaaagaagaagaaatccggacgtgccaccagcccaccacaaagttggcattagttcactacggtacggggtatatttcagggtacagggtatatttcagagtagggggaaatttctccacacatcctcagtgagttagttcactcatcaccatcaacaatattaccaccaaatttttattatcaacagaaaaaatcagcaataatatatctgcttcaacatcaacattgaaaaatatagcaagaggaagaactaactatatatatatatatactataaaaaatacccgtgcgttgcacgggtaaagacattttttcactaatatattaagagttaagcaataaattaaaatattggaatcgctatatacattataattgaaaaagttgatgggaatcctaacattgggattgtcagtgttatagataccacatacctaatagtagtcgactaaatctcggcaggatccaccacataccatgtcttatacgaaaacaaccttcggatataggaggagttctgcataaggaaggatgaatagagttctacatagaaatgacaaagactacttggattgtatccatattaatttccctagttctacttggacaaggggacacctatggatataaatacaaggccccataggaggaggagaggggacacgaaacaatagatcaagacataagatcaacat

SEQ ID NO: 15752 - DNA, 1186 bp, Oryza sativa
cctggaaattttatcgtactagatgcatatgctagtttgtccaccattttcctgatgcttcttattcataccactcttggatacacagtggaactcaatctattgttcacgccttctgtaatcgtattcagctccatcctttttctgttgcatggcttgcaattttgtgatggatactaagtgagcagtgacattgtctttcaatggtaaagttacactcatcgatcaaaagatgggatgatggatatacataaggatattatccatttcacaaccatgtctttttccacattccgagatcaacccaaaacaacaaaataagacatgcgtgttacagtaacaacttcgacttcaaaacgttactttataccttgcacatcaaaaccacttagtgtaaaagaagagacttgaatattttttttaaaaaaaagtaaaaaacatacaaaaaaacagttagaaatatatatatactgtctggagttagaatatcttttgagttgagggtaaaaattatttacgcatcatcccatcttcgtactagatttttgaagttgtagctagctgttgatctctatgcttcacaaactatactatcttgtactatgttgtaactgcatagttttattcttttatttcaacttgtggtgttaaatgtaggtaaatcgtgaattttgcagcttaaaagaaacatattttttttgcatttaacgaaaattagtacatgaagtattccacagtttgggtgagttcctttcactcaaacagagccaagagtagagattcagatcagctgcaagactaacattgctgaaagttagcacacatgtactgttcactacttaaaaaataatttttcccgacacttggattttattttttcaagtggactaaaaatattctcgcttgtgaaaatatcagaagttctataggtctagccccaactgaaaaaaataatcaatttatacaagtgggatctaaagaagtttgcctgtgaaaatacccttcattttcgcaggtagacctccttagcctccacgtgcaaaaatcaatggcagtcgggacctaaagaggcccgccagcaaagcgtggaggcacttttttatccagcatcgccagccaccgacaagcaatccttctccctcacctacgccctccctcactcaatctccctcacacctctactagg

SEQ ID NO: 15753 - DNA, 1501 bp, Oryza sativa
gtcccgtacgccgtagctttccgcgcgacggaggcctctacacgttcgccttcgcacgcgtgcgcgcggggccgtcgatggatggagcgagctaagaatcgaagaatcgatgacacgggcgccggtgtacgctccggccctccttcgatcggtttcttcctgccgaccttccacttccaaccaaggcgtcgccatcggcagtttgggtagatattgacgtgggattgtagtggtgcagtgcaaggggtgtcctttgctggcgttactgcgttttgctcgttcgagtgcgtacattctgatttctgcatcctctggctctgtcccgggatttggacgtacggcctacggcgcgtgtacgattggatggaccgggtgacggggtgagtgaggcagcttaaccaaatcgaactccacaagtcactgatgaataatgctgaggagctgcacggtcgtgggaaagtcttccagcgaattaaggacgtcttggttgagaggcggtatccaaatcaaccactacactaataactagctgccttcgtttgcattttgcacgagtttgagagagagcagcggggccagatccgcatctcgcgctttattcgtttctatttgaccggcgaaatgttactttggacttgtggaggattaatatatagaggtgttacctaaaagtttcagtttgcaatttgccagtagtgtgcatgtttaagaaaattatctacgggggagctttccaaattttatctcagggttgcatggtaaaaaaggttatccatgggggaactttcatactgtttgctcccaaatgctttgatgacatggatccatcagtacttttacggttactagtagtacatttctttaaggaaagattatcgcctctttcccccttgctcgctttgtcgacgcacttgcctacatcaacagcaccgctttttgacagatatgactgcgaaatatgatcttctaccgatttgctagtaatgtactcctacgtagtacgtaacattggatgcaaaaccattggtacaagattatcaaacggagggaattaaacggacgaactgtgtgtatcacatggaagagctcgtgaacagaacacgttgtagcactgtacggtacccgtcagagaaaccgtaaccgagtaaccgaccacgctcgggaggtcgccagtggccacatgaccgcaggtccgcagccgtcacacgaaccaatcatgcatagatagaaggccaaatggacaagcagacaccaaaaccaggctagaaacgagagcgagcctcgcgcacatgaaacccctccgttttctcggcctcgcacggggaaacgacccgtacgcgcgccacgccgtgtctgctgctcgtctcctataaaacaacccgttgtcacgctcgccttgccattacaacgtcgctagcttcttccgctcgtttagaaaacgccaccaccaccaaagtcaggcacccccgccgagagagttagctagctgcgcgcatgcagg

SEQ ID NO: 15754 - DNA, 1501 bp, Oryza sativa
tgtgttcaaacgggcggatttgcccccgcaaatctcggcagcgccattgatggcggccgacctcccgcgccggtttccttcccctccggccgctctctcccccttccaaccctatttaaaccctccccgcacctcctctgtccgtttccgcctctcgccgcccttcctcctcgccggaatcgagctcgcgccgtcgctctctctctcctctattgccaacgaccttcggccggccttctccgctcgccgggaccgtctcccgccccggcgtcgcctcctccggtttcgccgcaccgccgtcgaccccgtccacccccttgccgagttcgccgaccgccggaacgtcgtcgaccccgtcgacccgagccgcgccgccgccttcctccgctccggccgcctttttcgtcgtcgccgtcgacctagggtgagccgtggaccgccgcctcttttcccccttcccttcccctctctcggccgccgctccgccgtgcctatggccgccgtcggtgacaataggggcgcgggcaccgcctcccgccggccgcgccgagtggccgccttcgggcgggccgagtggctgccgcgtggggcccggtcatcagccgcccgcgccctcgggtgcggctgatgcgtgttacccacgacgccggccggtgtgagcccgggtgcacctggtccaccgtggaccgtgaggctgccgcatgggccccactcctgtggacccggtccgcgtgccccttcccctcggctgacgcaataaacccctttttaaattaaattttaaatgaagaaattcgcaaatattcatttaaagagcatataaactttaaatggccataacttggccatttgaactcggaattggaccgttcaagtctctaatttttccttaagaagtcaagaacccatttttgtgctttgttcctacttgttatatggagtttattagagtaaaaacccttttcatttctgttggtcgtatagacgctgcagcttcggaagatccgctcttcgtggaggttgaagccgacgtttgggaaagcgagcaaggcaagtcacatcatccttgaacatattgaatcccagtttataaaattattttgatttaaattattgcattatcgctttatttaaattcccgcgttatcactgttttatttagccatgcctatttacctttgttatgaccttattattattgttattgttattattaccttgttcaccctagaataaacaaaaccccaactagtggacactctactcatggtaccactagtatgaatttaggtagatgcttcgctggttaattaggcaacattaggtggttttacaactctagactttgggaatattctcatcacctggacactatggaatggatggattattgggaattggattcacacctccccctctattcaaaaccctcaaaatggttttaggctgggctcggggtgcatggttttgatagtagcacctcggccataaaaggaccagt

SEQ ID NO: 15755 - DNA, 1501 bp, Oryza sativa
agatcttttgttttcctgatagaactatttctttcttcaaatttgcaaggtctgtcacatagaacacatgtgccacgcgattggcgagtacccaagggtcatccttatgacccacattcgcaaggtcaacaatagtaataccaaacttatcaatactgaccctgttcgggtattttacccactggcacttaaatatgaggaattgcattgtgagtccatagtcgatttcccagatttcttcaataaacccaaagtatgattgtttttccccctgaatcaattgccttcatacaaacaccgttgttttgagttacggtcttactatctcaggctcttgtactaaatgtgtatctattaatgtcatatccctcccaagaattgactgtagttgatggaccacaagccaaccgcttcatagttatttgctcggttgtttctccatcaggtaagtctaggtctcgcaaccaatctatgaagacacgcttgtgttctttcattatccattcggttgtgcgtcccttattgttagctcttagtaattcgatatgttgatcgatgtaaggctcaatgatagcaaactgatgaagaatgctgaagtgagcttctcaaaatgatttgtaatcatgggtgacaaatctcttctttcctattgtccccctgccagtcaatctacccacgtgttgaggtacaggtgtcagggttatggataccacatacctaatagtagttgactaaatctcggcagggctcaccacataccatgtcctatacggaagcaaccttcggatataggaggagttccgataaggaaatgaaaccagagttctacacggaaacgacaaggactattcggattgtatccatattagtttccctagttctacttggacaaggggacacctatgggtataaatacaaggccccctatgaggagggggacgactgaccaggagacgatcaacacgatcaacatggtcaccacgatcgagatccacctcaatcaacaaccaccacaatattcggaacaactgaagccacagcatacaagccaacatacgccaagacacgccgccagatatcgacttcagggataggcatggctattcccctacggtgtctccggataccgtcaggagagactaaagcgctatctttgaggagcaaggctaccctgtagtcgactacgagtcagaccttcagaccgccatgtcgacaacagttagataggctattccacatattgtactggtgcgattatggtgaataaaagcaactccggctccggccaacaagatgtagggttattacctgaccgctcaggggcccgaacctacataaaaatccctgtctccgtctcttttacctcagtctcgcgtatatcctagcaccgacgatccccatactgtccaaataccgtagtcgagacatcaaacgtcgacagtggcgcgctaggtagggggattttggtgctctaggatttccacgagatgggttcaagaga

SEQ ID NO: 15756 - DNA, 1501 bp, Oryza sativa
tggtggaagactagaagcctgagcagcagacccatgggtggaggtagaggctgtagtcataagacgacgaaggagccttacaagctcttgctcggtcgatgtgatctgctgagagcttgactgagaagagccctgtcgagagccctgagaggtgcgacgactctgatctctcttcttcttgtagcacatagaggcggtgtgccctgtcttgctacagtacccgcaaacaatgcctgaaggagtactaggagcactagccgcaacaggtaaaggtgatggcaccacaacaggctgggcagagacatggacctgagaaggcaagccctgtgcaaccaagacagaggtggactgctgtgcaatgcctataccagcctcacgacaacgagtctcttcagcccgtagctcaggcaaggtctccaacaatgaaggtcgagggcgtcgtgccaacagctgagctcgaacaggctcaaactcaggcctcaaacgagacaagaactcatagaggcgagtggtctcagtctggaccctctggcgctgacaacaggtacaagtgtgacaaacatcagcgccctgtaggtccatttgacgccacaccgcagacatcttgcgaaagaactcatccacagtggcatcaagctgacgaagagattgtgcctcattcacaatggcaagaaacatggcatcgttgcgaggctcgtactgctggcgaagacgggtccacatcaactcagagctagcaaggcccgcaatgtcgagtgatatgtcaacctccatgctcccaaccaaaatagccttggcataggcctcctgctctaaccaagtctcatatagagagagatctatctgatacgcctccatagcagcagcaagatcatcaaggagaccacgcttagtgttctcatcagcatatgccgggatggcaggctcagcaggcaaggttggacaaggcgggcaaggccgatcgctgatgaggtagccccacaaccgctggctgcacatgtgtatctgcatatgcaatgcatactcccggaagttgagtccgttgaagatgaccggaggcttcggaagagaaatggcacccggttttcccgagggcggcgccatcacagtagaggcagtagctttagacggtggaagatgagggagaagcaggcggcggcagcagaggcagcgcccgcccgtggccacccgcccgcgagtaggaacggcggcgcccgcgagcaggggcaggcaacgcccgcgagcagaggaaggcggcgcccgcaagaggggcggtgactccagttggcgtggcggcgaccccaggcggcgcggcggcgaccccaagaggcagaggcgcggcggcgacactggcggcgcggcggcgaccacaggcgaggtcacagggcagaggtggcgacgctcgcgcgagagagaagagggatccagtcgcgtgagaggagagagagagcttcacgacgacggcggatgtggaaccctaaaccatatgctctgataccat

SEQ ID NO: 15757 - DNA, 1501 bp, Oryza sativa
gttgttgggattgatttatgacatcacatctggcgttgatgtcgtgcctgctggtgctgctcctctccctcgacaagttcctcctccactacctcaagaagcgctggctctccccgaggatctcgacttccccgtccaaatcgcggcgatccatggcggcggcggcggcgggcggcggtggcgccaagtggagcgagacggccatgctcgtcatcgacatgcaggtatgtgtgtgtgtgtggggaaatttcttggtttcttttggagatgttgggttggtgatggttgatgtgggatttgcagaaggatttcgttgacccggcgatgcggagcccgatgctggtggatggcggccaggcggtggtccccaccgtcgccgaggcggtcgccgtcgcgagggagcgcggcatctacgtcgtctgggtacacttcttgcttccttcccctctctctctctcctctcgcggggtggctcggttcttgttgattagtgaagctccatttcgtcctcgtgtaataatttgtttagtctcggttgcttggtttggttgaatgcgacgaggactgcgaatttcgtggtcggattcaggaggaatcttgtgtagcctgtggtgctctaagcaagtgccacagatttcttggttcagtgcaatgtatgtgcagcagtgtgggatcaaaattcgtgggtggatttcctttggtttttgaccatcctgctcgtcgtttcggtttgcaggtgcagcatctgccagcatttcaacgtttaatggcgtggaattgcaatggttgctcacatttcctcactctgtagactgattgacgaatagaagttatcttttgatttcttgttctgtcaggtcatttagaaccatattctaggcaacaaaccagatattatgcattattttctgcatgagtgtatgcaaagaacagagtttatgtggtatagtagacacacatttgtttttatctgatgaaaaccaattttcatattggagggtcgctgctttgctggattaggtgactgactccctctatttcatctctaaatagcagaaggtaggtgtgttgtttaatgtttggcgctgcacgacattattctaaaatctacaaagcgaataatttgctaggtgcggtttccactatgaaactaaaatttggttcttttgaattggcttctgcaacttatacatgttcatggttcattaaatgtaattttgaattttactaaacatgctattatgataatcattggacgtgttgcaaaactagcagctaacctgtattaatgtgatctacatttcccccttcctatgcaaagcattttgcttcaccaggtagggattttaatgccaatagatttacatgtggtcatagttttgagttctgagaccttggttgatgatgactgcatgtaggtggtcagagagcatgacccttctggagcagatgttgaaatttttcggagacgctattattctggtgggaagggcccaacagt

SEQ ID NO: 15758 - DNA, 1501 bp, Oryza sativa; identical to SEQ ID NO: 15611

SEQ ID NO: 15759 - DNA, 312 bp, Oryza sativa
attattgctattgatattaataccttgttcaccctagaataaacaaaaccctaactagtggacattatattcatggttccactagtataaatttaggtagatgcttcgctgattaattaggcaacattaggtggttttataactttagactttgggaattctcatatcatttggacaccatggaatggttggcttatgttggaattggacacacacctccccctcttttcaaaacccccaaaatggtttaggctgggctcgaggtgcgtggttgggttttgttagtcgtacctcgggtactataaggattaa

SEQ ID NO: 15760 - DNA, 1501 bp, Oryza sativa
tcaacacacgttcaatacaatttcggcgcatcgccacccttttttagttttgtttcgacgagttcttgcttttgggttgagctgcatcggtttcaatcttcaacaagaggtaaaacttgttatggcggcttgcgttctcgggattagtgcttccatatttatgatactctgatctcgttttttgtaattcgtcgagttatcatatatcttacataatctctggcaatatcgctatctaatctacaatcggctaacatctgttggtagagggcagccgattaggttagatatcgatgttgacttagattttataaggtatccaccactctatgaaacttccaacggcttgattgtctagatattgtccttcttttcatacttatagttgcatcagttgagtttgatcttatgagtcatgattagaatctcaatctctagcctgctacttggttgccgattagggtagtatcggagtttcagtcgatcttatctgatttaactatatttactttatatgctttattgacatgttaaatctgcccttcatgttgagatcttgttgcatttaagtatattaggcttttatttggtatattctacttgctttaatatcttaatatagagtggtatcggagtattagccgatacatgctagatctatctgatcgactatgctatcaacatatatagtctcattattaatatatatttcgatccaagtgatttatattgactcggcatggcgatcgatctatctcaatcacttgatttaagtatatatctatataaggagtatatattggtaatatctacagccgatcgagtagatttagttccttcatatttatttatgaccgccgatcaacacatatatgacatcggcgcaaagataaatgatatgtcatcggcacctaactgatcggctatcgtttatggatttaaccacggtttctttgtctttatttcttgctgattgcatgatcaaatcaaccggcacgctagcatactcgaaggcgagttttagacctgcactggagttaagcagatctcccaggcctcgtgtttttcatcaacactttcttggttgacatcggagattgactcagacaaacccgcatgaggctgataaggaaagtctaacgttatctctgaactcaccgagaacggtcacgtgagctcgataacagttactccaaggtccgcggttgagaatgtgaagcattgaagtcgggggctaccgtcaaggtccgcggttgagaatgtgaatttcttcatttgcattgaagtcgggggctactgtcagggttatggataccacatacctaatagtagttgactaaatctcgacaggacccaccacataccatgtcttatacgggaactgacttcggatatggagagagtttcggataaggaaagacaaccagagttctacatggaaacgacaaggactactcggattatatccatattagtctccctagttctacttggacaaggg

SEQ ID NO: 15761 - DNA, 1501 bp, Oryza sativa
gttacaaaatatataaatggattggaggatctacaagaaaatactgtcaaccaaaatatataaatggatgggaggatctaaaaatgaattaaagagttcaattgacaagagcaatgtcataggataagatttatctttgcagaggactttgattgctttggtgttgtatgggtcaggtattaagatgctgaaattggtgcagagagttttctaaagagtgatgtacaagcttcggtatggcgtcatgcttatggctatacttgtaaagtgaccaccaccctcctcgccatgcttatggctatactttgtaaagtgaccaccaccctcctcttcttttgtagttaaccatctactatcgaagaagaagaagagaatatttatattaactagagaaaatgcctgtgcgttgcgacaggtggatgctattttaatcttattattgttatacaatttaattaaggtgaaatttactgtggaaattcgcttaaatcatgagctgtaattagagtctgatcgtctcaagctagtatgtgagttttttaaaagagatttcctatatgactcttctgcatttccaaaagcaaatgaacttaataaacgactcaaatacggatatatatttccaaaagtgaatgaacttgaaaaccaactcatacacatatgacataccaaagcactggtaaaaacatcttcaaagaaaaaatgccagtgcgttgcgatgggtggatgctattttaatcttattattgttacacgtttaattaaggtttaatttactgtggaaatttgcttaaaatcatgagctgtaattagagtccgatcgtctcaagttagcatgtgagtttttgaaaagagatttcttatatgattcttctctacttccgaaagcaaattaacttaataaacgactcaaatacggatatgtattttgaaaagtgaacaaacttgaaaaccgactcatacacatatgacgtaccaaagcaccggaaaaaaatatttttaatttttataatagtagagattaattaagaagggaaagatagatcttttttagacaattttctgatctgaatatttaggcagcacatttgtaattaagaatgtaaatatcaatattcaagcaaaggatctgtaattaaccatgtaaatatcaatccgtgtcacacaattgaacattcgagtaagcagaagatagatatatatgtccgacaatttcatagtttctaaatattcagtcatagcattcctaattaaaaatggaatgattgatccatgttagaaaaatcttctgatttctgaatattcaattagagcaattttaattaagctggtagaggtgtatccatgtgtgataattttccgaattctgaaaagccaaacaatgcatttgtagttaagcatgtaaaggtctatccaatcataacaatcttctgagttctgaacatcgacattcaatcaagcaaagcatttctcattgaacacagaaagatcgatccataga

SEQ ID NO: 15762 - DNA, 1501 bp, Oryza sativa
agtctggagtgcctcagcatctctccataagggcagtcctctttggccatgaagaaaagatcatatgccgaggcagccgagaattgccctatctccagtcagtttcaatctgattgcatctgcattaggctgtagagccacatcatgaacctcgtcccaaagctgaaagaagtcacccaaggcttcattgaacaaggaaccctgcaaatctcgcacccatctatgattaaccatggcctgggcgaccgacaacctggagtgtcctacataggagtacaggataggccacctccaggcgaagcaaccatttcccgtccaatttgtcgtccagtatctgttatcagctccatcaccgatgatatattcagccactgatctgaaaatgccatctacatcatctcccatccgatatgccaccatggtccagggcctctccttctgtgctcaaccgattaacagtatgattcctttgaaactgattaactgcaatctaaagcgagcagcaaaatactacactgccacaattttctaaaaactcagttgggttattgtctacaagccaactccagcaagatgtgtcacctccacttacgcaaacgggtcatatatgtcctagagtttcgacgagcctagccagcagttgttttacattgtactggggtactctccagtccagccttgtttctctactctctactatcttgccagcagcacttgtgccgagtgacttacaccaagtttgatatgaacatcttctgcaaactgaagtactatctacagaatacaattaaagaaacattaaagcagattgatggtaacaatgtaaattaaaaaaaaatattagtctctgaacaaactgagcatcttaggcagaagaagccataccctcaaaattcaattcactgataaaaatgaggttaaccttcatgggatggccatgtaattcatcttgctcacttgtggatcatggaggatgagactacaatccatttagccaaaaagtgtaaattcttcattcatacatggaaaattggttgctcatgatttggccttgatggatagattcaactggcacaatctgtccaaaaaagaaatggcattatacactgggaggggggcaatccaaggagatagaagactaatccatggatacctataattatgtcctgataaaatgtatctaagaaaatgaatcataactagttctagcaattttattactgttagttgtggcatccatttcatccaaattgtaactgagaacctctatgagtgcttctttctattcttcttaattgaataagcagaaattcttgactgtaaattttatctttggagaagattacagccatggtttccaaaatgataagttgttcagtactaacaggcatcagcagagttaattaatattgaagtaatttgaacatcaccaaattcaagtattcaacagagagaagaggatcatgtatgagataatactgaagtcaacatgagtagtgca

SEQ ID NO: 15763 - DNA, 1501 bp, Oryza sativa
ttcgattgaaaaacctcaaaatcaactataaatttaagatcgaaaatttaaattttgattgataagcataacatagaaaaaatgagatccgcaattatcacactgatgaagatgcccctgctggctacccatatgctggcgcagaaattcgttggtcgttttgtttgtcgatgctccgtataaaactgatcctaacaggccgtcacccatatgctcgcgccgaaatctgccagcggcgcccacaagtcactgaagcccacaaaccagaggagatgcagcatgaaaccgggcgtggtgtcccaaacggcctagaaacgtacgttcctcgcgatcacggcccaacacaccgcacgtacatctcatcctgttccaccatacatatgggctgcacgcctgcacgttcgtggcaattccgctcccgccccattcaagatctcacgagacatagcaaaatctcaaggaagaaactataaaccgagcctccaattatgtcttgaaaaatttagacggtcaaatatttcagctaaccatcggtgaaatattaagttatatttggtgaaatgaggaaatcatgcactgaaatatttatttttttagtgaaacacagtagagacacgttgaaacatgtcactatcacatatgaaacattgagtgttataaattgaaacatatttgtttttttcatcagaatataatcacgcatatcgtagattagataaatagtttagaagaacataattttgaagatcgctaaatggatgcatgtatacatggatggtgaggagagatagtagttgtagttagttgcatgaattttgtgaaacatgataaaggcacatgctgaaacatatctttatcatatataaaacattgagttttaacgatttgaaacacacatttttctcttgttaaaatataatcatacgatattttgttgtaaatatttaattaaacgaatacaatggtatgaccggatcataaatcggataattaatttaggaaaaagatatttaaacaaaggaagagaaaatgataataaactagttaagtgtaacttcctgcgcgagcccaatttttattgctgcatcgatctaccaattgtattataagtggtgataaaaaatttgccactagacccatatcatgaatatatgaggactcatatagatagcgagtgataaatttttaattatcatatcttaaaagtggcaaatagttaaatgcccccaaatctcacaagagaccaagaaggcgagaagggagcaaattccaacgttttttttctctaaagaaatacttaatctccgagacggatgcggaatcgggtatactgtacgacatagaatttgaataggacacggacgtccttatacgtgtacccctttaaatagagagctctagccggacttcctccgatcttccgttcttcaccttcgcatcgaatcgatagcgagtgtacgtatgtaagtataatctcatctcttcctgtggaaagctagct

SEQ ID NO: 15764 - DNA, 1501 bp, Oryza sativa
aaatccctacatggatatgaccatccaacttaactatgtttggttgataggaaggacgaatcatgaatgagaccgttataagagagaatatttcatgcagatgctggatgagctatttcggaaatattggccggatgagaccatccaccttttctaatcttgacaataatgataattaatatattttgttgttaaatagtaattaattgtcaaggtttgtgttgattagagataatgagtcattttgttgttaatttgtgtataatatggagaagttaatgataactaccgctaatatagaatatattatgttattaataaaaactttcatatttccagttattcatccacatcaatctaaccaagtaagaaactaaatcattcccatccacctaacaaattaaacaaaaaactggatcatatccctaaaaaattagatcatcatagctactcaaacttgacaatcaaccattaatctggatcataattcctggtcatggcttatcccttttgaaaattttgttaatagctagtccctagttacttctgttaagattgttctcagatacgttacaatgagcattcacatcgatctactcaaacaagtaccaccataatacctggggttgattgtcttataccaaaaactcttatggttttgtgcaacttgaaccataataccctgtattttatataatttaatatgtttttttatgcaggtgttaagtaattggtgctaaaatctagcactctattttggaagaaaagaaatgagaggaatgcatataaccagtaggaatcactatgaggtgctatagcctataggctgcagtattttttaattacttagctatcttaagcatggcctatggttccatcttggtgtttatatctagctactactatgcaaatatattacccttttatagagagagaattaccagatggttgtgtcaagaggttgagtatggctgatggtattggagaattgggatgaactgtcttccagtatgccatcacgtcagccgtgcggtctggcaccatcatcgtcatcttctttgcgctcaacaacttcctcccctcgccaactccgaccaccatcacctgtcaaccaaccaaccaaccatcatacatcactactgatgtagccaagatgtgttatttcaacaaaagctttcatagatgattttttcaatttatacacttaaaaaaaaaactaaaacacaactaaaccacccactacaatatcacttgtaggctacacgggccaatttcacaccacactgcaggttgcaaacaggcatgggtattacgaatctcccccaaagattctaccataggataacccaattcccgccacctaccagcttggcaaggaacaatcaaggcatcgttcaacacacatgtgaactatgaaagtatatatagcctgtgataatttgtgacatatacacaaacatcatatcgtgtagagtgtgattcaaaaaagtaaattattcct

SEQ ID NO: 15765 - DNA, 922 bp, Oryza sativa
gcacgcgcggcacggggcgtcggcgcgggctcggggcggctcggtaacgtcggcgcgcgggcaggtggcgatgctgacgggcgggcggcgagacgacggcggcacgcgcggtgatggcgacggcgacggcagagggaaggcggaccggcgcgcggcgagcggggcgcgagggcaacgcggcagagtaggggctagggctagggaacgcgaccgaacacctagggggcaatgaatagtggcttttcctatttatcccgattttagtgtatttcccatataaatttgattccacaattcctaatttttggatatatgcattttactcaatatttgtgttatctcaactaatgaattcaccctagattaatattactcatattttatttttatataatttatttgaatttttaattagggttaattcttattccatcatatttaaatttaattgatccaaatatggtcgcgataatactttatttattcctatccacaactaatctttactcacgattaataaacttcgagatcaaattcaaataaaataggcgaataagatcggcatgatgcaattaatttaaaaagtttttgaaaatccgtatttttagagtttagatttttgtcgtcgaattttcagggtgttacaagtactgtataggcccaggcacattagcactcctgataccctagcgaaataaacgccgaagtcagagcgtcgtttcgtcttccccgccgaaactctcgcaactttccccattctctgctacagtgcaaaaccacaacggcgaaagctagggttaacaaatccactccgatccatcctcttgagctccacaaaaaccttccgtgcaaccaccgcatcgatcccccatccattcccagccatatctcggaccaaatcacatcatccagttcgtattca

SEQ ID NO: 15766 - DNA, 930 bp, Oryza sativa
ctagaggatcccccatcgtttagaacatcaacacgtgcatggttccattatagttgtttcatcattacctttttttttaataaataacgcagttgacttttagacatgcttaattattcatcttattcaaaaattaagtaattataattcattttgatatgattttttatcattaaaaaatcggtggcgctaatacgcatagaatgcagtttgagcgccgcacaacgctccctccatccagttttctctttttttaccaccccacctttactcagtatcccaccattcctctagattttttctgttatctcattttagtaaaatatttaccatatggtttttctttccgagttttctgcttttcgagtgtctctcgacgtttcaaaagtaacaaatttactctactaagttttccatttgctcccaacatcccacctttgcaccttcaaaaataacaaatttactcgcatgaatgtcccatcaaaagtaacaaatttacttgcatgaatgcccctacaccattcctagatggccgtaataaaattactaccagcttacaacgctagtaattcttttaccagtaataaatattgtttagacttcgtagtatgtgagtagggttgtaaacggatggagaagagagagaagaagtaccacgatagataaacaggtactatagatagctttatatgttatctaccactcaggtaatagacgaatatcctattattgtccgtacagttacaaccattctattcttgtttatggactacaactttcttcgtacacacatgcacctccacaaatctctcttggcctaaaattatgcagcaccccttcacaccccattcctcatagccatctcctctcctcttgaccccatttcggtgcttaaccaaactcaccataatatcagttcatccacaacaa

SEQ ID NO: 15767 - DNA, 1491 bp, Oryza sativa
tttttccctctctctctcgcgtttaaacgggcggatttgcccccgcaaatctcgccggcgccactgatggcagccggacctcccgcgccggtttccccccttccccggccaccctctctcgacccggctctatttaaaccctccccgcacctcctccatctgtttccgcctctcgccgcccttcctcctcgccggaatcgagctcgcgccgtcgctctctctctgccgtcgccgtcgagctccggtccaccttccacctcggcgccgcctccttcggcttcgccgcatcctcgccgacctcgtccacccctccgtttcgctcaccgaccgccggaacgccgtcgaccccgtcgacccgagccgcgccgccgcctttctccgctccggccggctttttcgtcgtcgccgtcgacctagggtgagccgtggaccgccgctttttttcccccttcccttcccctctctcggccgccgctccgccgtgcctatggccaccgccggcgaccataggggcgcgggcgccgcctcccgccggctgcgccggcttggccgccctcgggcgcgccgagtggctgccgcgtggggcccggccgtcagccgcccgcgcccttaggtgcggctgacgcatgggacccacggcgccggccggtgtgagcccgggtgcacccggtccaccgtggaccgtgaggctgccgcgtgggccccactcccgtggacccggtccgcgcgccccctccgctcggctgacgcaataaacccttttaaaattaaaatttaaatgaagaaattcgcaaatattcatttaaagagcatataaacttcaaatgaccataacttggccatttgaactcagaattggaccgttcaagtctctaattttttcttaagaagtcaagaacccatttttgtgctttgttccagcttgtaatatggagtttattagagtaaaagccttttcttttccgttggtcgtgtagacgttgtagcttcgaaagatccgctcttcgtggaagttgaagccgacgtttgggaaagcgagcaaggcaagtcacatcatccttgaacatattgaatcccagtttataaaattattttgatttaaattattgcattatcgctttatttaaattcccgcgttatcattgttttatctagccatgcctatgtacctttgttatgaccttattattgttattgttattatttccttgttcaccctagaataaacaaaaccccaactagtggacactctactcatggtaccactagtatgattttagttagatgcttcgctggttaattaggtaacattaggtggtttacaactctagactttgggaatactcttatcacctggacactatggaattgttggattattgtggaattggattcacacctccccctctattcaaaatcctcaaaaaggttttaggctgggctcggggtgcatggttttgatagtagcacctcggccatataaggaccggt

SEQ ID NO: 15768 - DNA, 1501 bp, Oryza sativa
cgcaagcggcggcaccgatgcggcgtgggcactcccgcactgggtaggccataggaaagcagcagcaaggcagcaactagcagagcagcaagcgctagcgatccagccgatccaaatccaagtgccgagcgcgccagcgcggtgagtcaatcactgtcattccatcttttatttcttttgatttaagcagcatcagcagctagatgatgggattttaaagaattgagcctcactatttgatagtttgatttattgatagattagcgatggagaagaaaacaacattgttaaactttcaactgatgagagtaaaaatcaaccaaaaaggcctcaaatattcaaaaaaattgatgatgatgcaatcatgaatagatttcaagcattgaaaacccgcagaatatcattgcctcgtaattcaattgcaggtatttgtagactagtggttggccaaatcttttagttaatttttttactttcctattgtcactaattttgctattattatatgcataggtggctgctcactttagatggttgatgctttgatgcaaatatgcaatcactcatttcccgttggcaaggtacttctatttcatcatttttttaatcatgtatgtgttgaaaaactagtgtaacggtagttttcatgaacttagtactttgaggttgagcctatcctcaatttctatcctagattcgccgccactggtaattgatatctccgcctatggagcgttttgggtttgtgcaacagggtaaggttttacggtgggcccgtgcaaccaggttagattatgtagtgctggtttaattttccttaattattcaactatttttgtattatcaattgattatcaaatgctatttgttcaaattagccctagtatactctcgtttgttatatgatatacacttgcatatttggatatttgttatatttgttatgtggcttgttgagtatacaatatgctcctcttataataagctaccatatgctgttcctggttaagctgtccatatagtggagtcgtcgcttatgctagttttttccttccactgcttagaactcttacgattgagaggttatccacatctatcataattaaacacttatacctgttgttaatattgtttattacttatctcgactaattcctgaacgagagttaaatatacatataagtgtttgaaattatacataaaaatttcgggagtgaaaagttgatatgagaggctccttggctttagcctaagccaaatgaaaatatatagaagcctttccaaaaagatttgaaaaattaggaccgcttttctccattcctctttaatagtatatatacatcatttctttgatttcttctttttctgagaaaatattctaaagaaataaaattttgcatttttcttttataaatctggtgccgcgcatactctttccttctaaatagtaatgtacttcttactgtcctgtttatgctttcttaaaaaattaattagaaat

SEQ ID NO: 15769 - DNA, 1501 bp, Oryza sativa
caccaattcatgtatgtttgttttacttatttcacttctcaaatttaattaatcagcacgagatcaaacagtagtgtagtcattttccatgcaaatcaatatcctatagtgtatttttcatgttgtggactcttttttccttgccatgtgtcaaaggggagacgctagaagaaaccggagggaagtgcctcttttattcatgtgtcaaaggggagacgctagaagacgctaaaagtattttcttttgctgcatggatatctatgatcggatggtcatcttttatccaaacattcatccgatggccattgtttttcagattacgtggccctttcattactttctatatatatatatatatatatatatatatatatatatatatatatatatatatatatatatctatatatgtatatgcggatgtacggttaatggggaccccaaacaattgtcaatatactattttcccgttctttactttcctgttattttctatttcgttttcatggctgagttctagcaatcctagaatttagttaatctttgccttttgcgctgaaaaataatcgtgcttctccacgaaaccgagaagattatgctttggtagtttgctcggaaactactcgttcgtcgtcacgtaagtacgatatttatcttctttgctaatttgcttgtaaattagtcgtgtaattccacgaaagtgaattaatcttgaaatcggctttgctagcaggttttgatctatcgaatttggcgactctgttgtttacaccacaaattgttagtgatcttatgttggccacgaaaaagcgtccacactttccactcttatgataaaaatctatctagaattgtttgttataattatagcatcttggtagcgatattatccagaaggactaatatagacggtccttcattgtttcagtatagatctactcatgacattgcacgcatagttttttctgttgaagtcaatagcatgcattgaaatcactgtcctgaaattggagcgtaattatataacactgaaatgaaaatataattaaaaatagtgatcaaataaattaaactttatttgaatgttataattgtaaaaaatagataaatgttttgtataatcattggcccgtgcggtatacagggttgataactagtttgaaaattaattgagcgcatgccggtgccaaataatataatttctcttaaatcaaattgcatactcgaatattgatacatctttgtattttaaaatgtaacatcaagcaaaaccacaccaaataaagggctcctttggaacacatgaattaaaaaacatagaaacatgaaaacgtaggaattgagagttggcatgtttaattgataactaggaatttcaaaatgcaggaattttgtgaaacttatttgtttgtacgcttcattggaaaagtataagatttaaggagaaagatagacctaagaaaagttttccatgtggtctaacctcgtgttagaaatcct

SEQ ID NO: 15770 - DNA, 1501 bp, Oryza sativa
atttatggattattataattatgttttgcaattataaaacatgtgtaagagctaacctggaaaagacaggaaggctgcgctgttgacatgcggaccccacatgtcaacctaagggacacgacagaccgggtacacagagacggtccacgggtcgacggaagcgggccccgtgtgtcaacagaggcgagtggccgacaaacagactccactagacaccacgcgggccgcacacgtggaaaccacgtggctaccgagcgggcacacaaacacggtcaccacacgcacacacgaacgactaccgacaccggtacacaggtaccgggttcgacaccgcacaacgggcacggggcgacaccgaaaggacgaggacggggcagcgagaggagagagatccttaccaccacgcgacgaggcgtgggaacgactacggcgaacaggcggcagagatgaacgggaatgacggagacgacggcgaggggacgacttcggcggcgatcgttggatgaaggcgagacgaggctggcacaaggcttgacgacgcggagccgaggatgaagacgacgacggggctgcggcatacttgacgaaacgcgggcgacgaacggacgcggcttgacgaagggagggccgacgacgagcgcaaccaggaacgaggaggaggcgacaatggcagccagcagcagctgcacagagacgagaacggtgtggaacacgccactacgatgccgatgatagtggcggcgcagcgagacgatgggccggcgaggatggacggccgactggagaagtcgtcgatgaggacgaacggtgacgacgatgaagaccggtagggttcggatggaggggaggcgaggccgaggacgaccttgtcgctgtgatgccgaaggtcgtggtggtgtggtgcggccgatagtcgcacgggcgaggaggaagggacggtcgaagggacaccggcaaggatggcgtggaggcgacgtgcggtggcttcccgaccaaggagaggcttggccaagggagaggacgacgctgcgacgccgaaggaggagacggcgatgtcggtcggtgtcacatcccaaaaatcttaaaaatataaattgttgtttaattggaatttttagaaattaaattaaaagcctacaagttaaaccctaattttctaggaaaattttcaatataaaaatgagctagataaaattttattaaatactatgcttgctcctctattttctagaattttctgggaattatttgagcaagggaagtatttttaataattgaaacaacatttcataaaatgttttattcaaaaaagttcaaaagttcccccttcttggtccttgggccgatttcggcccgtctctctctttcctctctctcctccgcgcgcggcccaagccggcccagccaagccgcccgcgctcgcgcccctctctcccggaggctgacaggtggggcccacctgtcagggccgtcttcaacctccggacggccgccgccgagc

SEQ ID NO: 15771 - DNA, 1501 bp, Oryza sativa
ggaacgtgcacggctgtgcgcggaacgatagagtaaaagtcaggagaaggtagtatcaaactcagcctaaactggcttacatggaggatggagcacccctcaacttttatcctagattcgccagtttgatatgtataattttatacatgtatgtatataaatatacgtataaacatataaatataaagtttatatgtatactccctccgtccaaaaaaaaacccaatccacatgtgtccaggtttaaatctaggattgggttttttttgggacggagggagtacgtataaaccttttacatatgtatagtacaaactttgattaaatgggtcaaacccacatgatgaaagtggataaaatacgtcaagcctatattttataaaaaaaaatgtaaacgggcttaagcccacatgacagaaatgggctaagtctacatttaataaagaaaagataaacgggctgaaaaaaaatcacctcgattaaaaatggcatataacgggctgcgccacgcgctactgatcgctaattagtgacccgcttgagaaccgctgatttgaaaactgcccgacccgattcttttctgggcaaactgcaaaagacacagatcaaacacatatagcctcgatttcatctcagccatccgattcatgatggccaaccaaagggatcgtaatgacgccaaccccaacgattacatgacgcatgcgatctaattgacagcaacaccaaagtctgaaacataatcatgaaggaggacacccttcatctgttggcatcgttgagaaggcacccaaggctagggcccagggacctaatctcatcctaactccagagtccaaacaaaacactactgtcgttcttggtgaggtgagcatatagctcaactactcgtagatttcttagggtgaaatcagctaattacggatgctcgtatttatggttaattatttttttagtggtaataggcagcatacccatcgatagtgaggtgtccgtaataattttgttaattttaagatatgtgagtttagtttttcggacgagattataggggtagggtgtgtatgtttacgtttataggagtaactattactgtgtttttttgaatgtactatattccttggtaatacttgctctgatcatcattaactgtattatattactgcaaattagggaacagataagacttagaattatgccaagagaagccggggaccggacaaatcgcaactttgcaagcagattgtatatcgttgccttttgggaaaggcatgcatacgaaactcgtgtctgatgcctgaccatggcatgatcaggcagtggaagctaattattactactacttcgtgcgatgatgactagattatctcactgagtacgtctcattctgccttaatataattggaaaagaactggactttggtattgttgtcaatatatcaagtcctgatggctactctcttcaatttcttgtccaattcgttaatagagtgcatattta

SEQ ID NO: 15772 - DNA, 1501 bp, Oryza sativa
gccggccaatcgcggcgccggcgagctcattttgatctcagccgtcgaggccgaagtgcttcctcatgccgcatgcgaactggtacacgaactcgggatccggcagcgacgccgccacgcacgcgttctcccggacgcaccgtgccgcccacgccgccagctccgggcactccgccgccacgctgaacccgccgaaccgctcgtacgtcgcgaaccacgccgtgaacggcgccagcgccacgtccacgtagcccagcgcctcgccgccgccgccgaagtacctcctcccgccgagctccgcctcaagcgtccgcatcgccgccaccagctcgcccctcgccgcctccaccgccgccgcgcccgcggcgcccgccggcgaccgccacaccctcccggcgcacggcgccagcttggcgtcgatgtaggacgcccagaacctggcctgggcgcgctcgtagggccccgcgggcagcagcggctcgccgacgccggcgaactcctcgtcgatgaactcgaggatgacgagggactcgcacaccggcttgccgccgacgaggaggacggggacctggccgtggacggggttggaggagaggagcagggcgctcttggcggcgaggttctccggcttctcctcgtacgccacgcccttcctcgccagcgcgatgcggacgcggttgccgtacatgctcaccgcgcagttgatcagcaccacgctcttcttctctccctccatatcgcctcacttcactttgaaactaattagcccctaattactcttagttagctagctagatgtgatcgggttaattagctgattagcttgggcgtcttcctctggcgcctgcacagcccatatttatacacacacggatgagtacattttctaatgcatgtatatgcaacaattatatatatatatatatatatatatatatatatatatatatatatatatatatatatatatactcctcgtaagagagatgcaatttttttcttgtggatttgaagtttaaatttatttctgctatgtattattagcatatgccaattggtctcatcgatgtgaagccattgtttgcaccgttgacaaactgtatttttaacttgttagtctagaggggctttggtttgtacgacgctgctcgatgtggccttggctgtgtttgggaagctttgtataacagcttatatgctggattgatttgtttggttccgcacggtgggctacaggacggcggtgccgcacgcgttggggaagctaaggtcccgcttagtcaccgcctacgtcacagggtacggccttgaggagttctggacgtccatctggctgttgacggcccagatcgacgtccgcttgtccgtcaacaaacgtctgaactctgaacacctgaacggagatttcctacatgaccatcgaaacccccatttttcctaaacgggagatgcacagtacatataggactgaaaacagggaaaaaaaatcctaattagttct

SEQ ID NO: 15773 - DNA, 1501 bp, Oryza sativa
gttaccaacagatactaaagatgcctccagggttagttcaaaaagaaagcatctctttccaagtcatatgtgtgtagtacgtgggatggtaacgcgcgtaagggctgaggtgagagattttgagtttgaatctcgatttactggtctcggttgctacaaccggtaataaaaggggttgttaaccggtagtaaaaatgagttctcttgtagtgagttgaacgaccatgacaagatttattggtactaccgatgagtctagtaggcccaatcctaaaatcaaaggatcatgaacttcctaaaaagtgttaagtgaatcagaaaatgaggcatgccactattgtaagttatgtgagaaagaagaacatatgaaagttaagttgccatcgccaagtgcaactgcacatcaagaactaatgcaaatgtagaaagttcaatgcaacacgagttaaggaagaaaaaggtgcacctagaattccatgtatgacttgatgcttgggttaggcattttgacataaaaaagtgcatggtgcttagactaccagtagttgtgggttgtggcaaccaccatagatctcattcgttggtagaagggaagagggttctccaccatacatggagaacatcaacaatggcaacaggggcgtggatcctaagattctggtggagaggtggggagatgcggcgtgggcaagggaaggggaaccaggaaggagggatcgatgtggggtgcggaaagggggaagggtaagggagagggtttggagcattcgtttaggtgcatgcaaaggggagagggttccatgcgaaggttgagggaggtacgtgggttgatttgagccgttcgattcaatgatttttggatcgttggatttgatgaatacggtttgtagtagtacagttggtgaactatatataaataaataggaaggaaggatagaagaatagataaattagtcacaatatactcccttcatcccacaaaactggtcgttttactccttcgcgattgtcccataaagctggtcgttttatcatttggagtagaaaagtgggcacatctaatatgaggctatcatgtactactattagttgtttttgcttcacaagactttatgcccgagaagttgtaggatggtggtgtagtgcaggagaagggggacagtgaaatagttttagtacctgcaaccggtaataatttagggtatgttgataattttcctccaaagctaatttagctgcacatttctaggacttccagaattttgggacgaagggaatatcatttaggatgaaaggatagaagaatagatagattagtcacaatatgtcattttgaacttagtttacacacattagataagtttgtgcaccataataaataatttacaaatttgtacactataaactacacccatctaatccatagctgaaagcctctgtttggatttctactgtgaaattcaaaacaaaaaagtgttagaaaaatactcctactgggctc

SEQ ID NO: 15774 - DNA, 1501 bp, Oryza sativa
gtggcgatgcgccgaaattgtattgaacatgtgtgtaaattgattgcatggggttcggggtctatttatacccgaaaattacaatctatgtccatatcggacacgactcttatctctaataaactctaagataccataagtctttacgacagacttttgccctaaacatatctctaaggaaattacataaaatatcctaattaatagatacaattgccttctcaggactctatccatgcgcggcaatcatcttgaagcatatcaactcaacccgatgtcgtacaccaagtcgtattgtcggaatcagctgtatcggcttacccagtctgattcagacccagccgatcctgatcgtagccgatttggactccagccgattcttactctgttcccgaatcgatcttcgtcttcgattccacctcgatctaatcctcatctccaatgctgatattgctaaatttggtcgttaacagtaggatgtgagggggagcattttagttactacgcaccatgggtctagtatagtatggctatatacatatatatatatatatgtacatatatatacatgtatatgtacgaacatgtgtgtgtctatatatatatatatatatatatatatataagcgttttcctatatgtatatatatatgtgcatatatatctataactaatataaatattcgtatttttccggtcgtcacatctaattttcgtgcgtttttcgtccatacacaatccgattcggttagcaatagccatggaaaaaattacaaaaaaaacggcggccgccgacgcccgcctccacgccgtcgggccgccgctcctcccgttccgccaggaccagcgccgccgcacctcccctacccctgatctagcggaggggagggcgtcgccggccctcccgccgccgccacacagagagaaagggggagaagtggagagagtcggggggcatcgtgctgtggggagggcggcgcccccgcccccgccgccgttgctcggtgtgtgggaggcgccgccgccgctgctcaccgtgggggaggcgccgccgccgccgccgctcgccatgggggaaggcgccgctgccgccacaccccgccgcacccggctgtcgccgctccgtgccggcgagaagggagggacggccccggtggcgggggagtcgcccgcctgcgagaaaaggtagggggagaggcacaataaaagtggagagggggaggaggaggcatcgttgggggcggggaaagaggaggcggcttgtttgatcgagatgttgactagagcgggggtgaataggctatttaaaactaaatgacacctaatcaaatctaacctaagtggcttggcttggtgagggtcaactttatctaagcaactaagttatgttttgcaaacctagggtgatagtggctcaattatatctctaggaaagtaaatcacactcctatgtcaatgtttagcaatcctagggtgatatgatctcaagtatgtctctaga

SEQ ID NO: 15775 - DNA, 1501 bp, Oryza sativa
ggtctgactggcgtgccctggccggtctgaccggcctcacaacggcggtctgaccggcccataaggccggtctgaccggtggcacatgcccggtcagaccagccgcctagaggccgggatggtgctgctcggggtggctgatacagagccgacggagccgtagttggtcagaccgagccaatggcagtctgatcgagccgaggccggtctgaccgcccactcaacgccggtctgaccggccaggtcaatggggccctctaacagcactacaacggctagttttctagccgttgcagagtagcacggtctgaccggccaaatacatccggtcagaccggcagagcacaaagttgggggatttcgcccccaacagctagttttggttggtgggagtataaatactccccctccagcagcaaagggactctcttggcacccaattcaattgcatacaccccttgcacctctctcacacccacttgagctttgtgttcatccattttcggagtggtttggagttcaccaccttcggagtgaaggaagaactaccctagtgatcgaggcttgggtagtcctctccgtgggccggctcccgccttgcccaccccttgacgaagggggcgtgcggtggcttcgtggttgagcggtggagttgggctcgcctcaacggggagtaggaaaccggtgagtttccgaacctcagtgaaaaatctcttgtctccttgtctcatttgattgtcgcatttacatttgtgcattttacatttctagagacatacttgagatcatatcaccctaggattgctaaacattgacataggagtgtgatttactttcctagagatataattgagccactatcaccctaggtttgcaaaacataacttagttgcttagataaagttgaccctcaccaagccaagccacttaggttagatttgattaggtgtcatttagttttaaatagcctattcacccccgctctagtcaacatctcgatcaaacaagccgcctcctctttccccgcccccaacgatgcctcctcctccccctctccacttttattgtgcctctccccctaccttttctcgcaggcgggcgactcccccgccaccggggccgtccctcccttctcgccggcacggagcggcgacagccgggtgcggcggggtgtggcggcagcggcgccttcccccatggcgagcggcggcggcggcggcgcctcccccacggtgagcagcggcggcggcgcctcccacacaccgagcaacggcggcgggggcgggggcgccgccctccccacagcacgatgccccccgactctctccacttctccccctttctctctgtgtggcggcggcgggagggccggcgacgccctcccctccgctagatcaggggtaggggaggtgcggcggcgctggtcctggcggaacgggaggagcggcggcccgacggcgtggaggcgggcgtcggcggccgccgttttttttgtaatttt

SEQ ID NO: 15776 - DNA, 1501 bp, Oryza sativa
agtttatgttgtttagctatcttatacattattttttacctattgttatcctactgaactcccgcagcaacgtgcgaggtttcacctagtttcaattgattgtgccaacattttaatagcttagacagtttgttatccataacaccaaactaaaataaagaaaaaacagagccatgttcacatgacatcaataatttagatagttggtcgatttgactttttcatttactgtggcaccatagttctcttcttttaacatgtaggagtacctcactgcaccaaggaaaaaaaatattgagctcatgtatgtattggagaaataaagagataatcaataatgatacaataacggaccgtaaaaacacaatgaaacgagatgatgtaaaaagaaggaataaatggcattttgtacgttactatattttttgaaatgatacaatctcgtacacaatgaaacggacagtaaaaaaatacaataacgagattgatacaacaatgataccatattgtttctttttttccagtaaaaagaaacaatatggtatctcatgagcgtgaatttcaaaatgaagaaggaataaatggctatcatacttgctgttctttataagaaaacaatatttatttttatattaccacaaaattatgtaccatcactactcggggaaaaggatttacatgaaaataatgtcatatgccccaaatccaaccgtcccaaaaaaagccaacctcatactaggatgtgacacatccagattcgttgtactaggatgtgtcatatcctagtacgaggttggcttttttttggatggagggagtaatttgtggaaggacatttctcaataatcccaaatgcagtagctttctcgaaggaaattgacactgtaacacctttcggctgtgtttggataataggtttgggatatgatttcccacccctcaaaggacaagcttcaatcttagccatccattcttctcacccccatttcatcctatccgtctattcattttcattttccaatctcacctctcctaacccattttacaaacacacccttctagtttctaaaatatttgctaaattttaacaaagtggtgctaatttacaagccgcctcctcgcagctgcatgcctctcctcccctccaggaccccgacccctcgccgcctcctcccgttcgctaccgccgcggcgccacctcgccccttcctcgtctccacccctccgcccatgccccgcgcccgcctaggccgccgcgctgctgtaggatcgagatgtcgactagaggggggtgaataggcgatttaaaattaaatgacacctaatcaaaactaacctaagttgctaggcttagtgagggtcaactctaactaagcaactaagttatgttttgcaaacctagggtgatagtggctcaattatatctctagggaagtaaatcacactcctatgtcaatgtttagcaatcctagggtgatatgatctcaagtatgtctctaga

SEQ ID NO: 15777 - DNA, 1304 bp, Oryza sativa
atgcaattattgggtagatctgtcgatttgtcacacgaaccgaggccagtcaaaagttaacatgcacactagcaatgcaatttcccaacaaaacattttgaaaagtagaagccatatgatcaaatggtaacttacatctgtcctcatcttcaaaatctttaaaaatcctcatccaaaataaattccgtcagcgtcaactattcgcaaaagagaaaaaaccaagcaaactcctaaaaagaaaatattattattattaactactagtgccatttggtagatctcaatatagaaaaaaaaataaagacatgaacggagtagatcagagttacgcataggaaattatgaattttttaagttaaacataatttttagatttaaaaagggatttatttaaaactggaaaggaacatgtgtcctcaccttagagagggtttttggcttcaatgaagataggttttgggcgcaacgtcttgctcatgctgattgtgcagattggatcttgcgaaggttgtggtatagttactattaatctatgtcaagtttccatgttcaaaaatgaatagtgattggcgtcaatcatttggaaacgattatggagcgctcctttttttacaagacatttctgaatgaacatttaaatggaagaacaaaaatgagccccacatgtgtagatggattctaatcactcaggtggatgtccacccgtttattgcatgtcaactaaatgattgaaaaaaattaaaaatattgacaaggtagatttatatgaaatatatcactccacaagcatgcaaattgaaatccgacttctacaacttgtaacaaaaataataaattcaactgtgagtatatgtatactaattagagttaaaaatttgttatttttgttataacttgtagaagttgaatttaatatcgcttgtttggggagtgacatattacatatcaatctatcttgtaattttttttgaaatttttgaaaagagggtattttaaggggaactatttaatttgctgatctgcaagaaggaatttgatgtagctagtagctactgaacttgtgttaaagatatgcattggtctttgctcttttgttcttcgcttgagcctggagctaacgaataaagtgacagctaggaaatgtactcttgccacacacacctaggtgtggatgtcgagctggcttggctcggctcgttatcctaacgagctagaaacccagctcggctcggctcgtttgaaagctcgagccagctcgttaggctcgtgagctttgggggcagccggcgaccacggaggcacgg

SEQ ID NO: 15778 - DNA, 564 bp, Oryza sativa
actttctctgctaatactttgtttcttggtaggattcaaagcctcatctcattgttgccccaaatgctggtatagctgcatatcctagttggattccaactattgtaagtataaatgttcttgattagcaacctcctcccattttggatatgagcatgattggctatgaatttccttgtgatactaccactcttaacttcacaaagttgacattgttccagctagtttcatgctaaagcatacatctggaacttaaagtgtattcttcacaaatcgcaaatcatccctttatctcagttgatgatattcaagtaaaaatcgatgcgtttaattggtcatcttttcttctctaacccagacaattttcaacagacatgttatctatggaagaaagtgttagcattatattgtcctcatgtgaacttaaattaaaaatacaccacactatgacagctttaactgatgattgccagtataacacagtatactctatgtcttagcttgtaacagacttccattttttgtgctcattctattcaattttcattgaaggaaataattagg

SEQ ID NO: 15779 - DNA, 771 bp, Oryza sativa
attttgtaaccttgttctaatgtaaaattatggtcaaaactgaacggttaagaaggcgaagaaaatgtcaaatgtcttctttttttcccaaagggagtacatatgctgataagtacaatatttttaaaagtgagctcttatcagagttacaattgctgccgctctgctcaacggcccagatgtttcgctcggttcagttacaagatccgacggataagaagcttcagtgagatgtaacgtaaatcgagttatccttagtttagctatttgttacactgtttagtttatttaagacgcactgagcaagctggtgcagttaggaaggatagctaataaatgtgcatccagcagtagtattgatttgtttaaatgtgaatgacggttaataaaaacagtaacttaacgtgcatgacagatgataaatcatggtaaataaatatgtgagtctagcattgctcacatatatgtatagattcattaatatctatataaatgtggataatactaaaaagttttataaactgatcacatatatgtatagattcattaatatctatataaatatggataatactaaaaagttttataaactgatacggaggaagtatattttttaataatataaagaggtcccttgcaaaaaaaagttctatcacagggaccaacatccctctttgggccacatttgggcctaagcagcgcaaaaaccgcggcccaccagagggaagcggggccctctcctctactctcccgcggccaccttctccgaga

SEQ ID NO: 15780 - DNA, 1345 bp, Oryza sativa
gtgataagtatggaaaccactagatggtttttaggttgggatggcccttatcaaacaattttactcgcactttggaacttatagtatatttggctgtccccttctccttccctgccaccaccgccacgccgccgactccccccatgtctctgatggcatcaattccttttgaccccaaagtcctcattgcgctcacgcgcgcccgagcgagagagagagagatagggtatgctctaagctgggctcgttgtggtggtggtggcttggatttgggaatttgggattggattttgcggcggggaatcagggggagtgatgtgaagcaggtgggccctatgcgggaggacaggtgtgggcccaacctgacagtgactattgccctcgtcctcctaagcccgacgatcaactcattcggtggggctacaagaagtaggggtgaaaacagattggattcagacgaatagtggtcaaaccatttttttaagcggatgcggttagtgtgtggatactgatatcgagcagattgttttggatgttgaaaatggtgcggacctgatttaaaaacagattaaaattatcggtcgttacgtgtatatgcaaatcaatgccacatcagcttagcaatataatagacaacaacccaataatcaatgatgatcaatcataataactatatactgaagtgttaaatagcatgaatacattatgccaattatataaaagagagaatccactcagtgccactgagttttgcccacttcaacaatatacccctgactttgtcaagttgaacagtatgtcatcaggttttctttaacttccactgcgtgccatcgccgtccacgagccgttagttggcctccgtttaccgcattgaattgtctctaaatgactaaaataccctttgactaaaatatcattgtacttgttgactgaaaaccgtaacacaccatccacccccaaatcgatctattgttgtttctctagtgagcggcgccgactccccatcgatggaacgccagccgcctgactcctcgacgcaccgccggccggccggctccccgacgacgcgcggtcggccgtcttgctccccgacgatgcgaggccggccgcctggctcccccacgacgcgcgtcctggagctcggctccccctcgacgcgcggtggctcgccggcctccccatcgacgcgcggccggtcgccgaggtcccatcgacgcgccgccagccgcccggcaagcagcgtctccatctcaatggactaccaccgaatccacccggtgggcgtcggcgcaagggccgcgggcggcggtgctgccggtgcgtgtgctggacgctgctcgct

SEQ ID NO: 15781 - DNA, 814 bp, Oryza sativa
  unsure (1)..(814): unsure at all n locations
agtgtgnnttganatttcgactcgccacctggatgccgaggtgttcttcagtgctgccactgtggaagtatttatttggattttattggatgcagttgctgaatgtttgcttatgccatggccagctagatttcttgtgaagtttctggaaccaggtgtattgtatagtacgagatctccagcaaaagaagcagtatatgccatgtgggttccatcgtggcacgtcgtgtgacagacaagtcttgcatgctatgcgtggtaaaggacttgacttgggagtcttgcattttcggatggtcgtacggacaacgggggtcttcgactcttacaccccattagaccattcccaacccaaaacactagatagtttctataaactccacatcatcaagaaattagtactagacactactcttttaatacaagcattactattccatacttaaatttaatgctccttatcacacatgatgtcttggatattgggtagacatgatttccttctctttcctcatttattcacttgccacatcatttttcatcctaggtggcaccttatttaatgctatggacatcattctaattattgggttgggaatagccttagagcatcaggagatcctctatcggataccctgtccgagatacagtgcacgggagtgaaaaacggggccccagtggatacgccatctagcccttcaaaaatagatgatgcgccaaaacggagagaggaagcccaaatatagcgtttctctctcctcacgctatatcacagtggccgcagctcccacccctatcaggagttttggatcga

SEQ ID NO: 15782 - DNA, 1501 bp, Oryza sativa
cccaactataaaagtgtgataaaaacaaggaactcatatatgtattgtacgccagagtttggagaaaatggtcatgcaaatcttcactaacattggatgaagattcaccaataggaagcctcctaataatgtttctccttcttgtcatctttttcattagtatgcatatttactgttgattcagttgaaaacttcataggaagtgggggtagcttgttcttaagtcaaagccggattatccattatctgctaagaaagaacatgtcgtagttatttgatactaatgttctaaaagagaaacatttgataatttaaacaacgtaactagaaaaataatgtgccctaatcgaatcataacaattcaatctacatctagtgtacatctagctagaatcgttaattttgaatttgagttattaaataaaaaaactaaacgaggactccaagatgaactttgaatttcactaaaatttatgcggttttaaaccaatgcaagtataacatacaattattgattggtaatattgaaattgcctaattaatcaagtcagaactaaactttacactgcacgccaaagtggaaggcgacatatataaggcacttaattataagacaattaggagcatataaatgtaaatgtaaactagttgaatgcacatgctttgctacgggtaatttgacattatatgtggctatctatttagatttggttgatttttaatactaagaagttcaaggggtaatgtgttttaggtttattttcatgtgaagctatgcgtaggtattttatctcttacttacacgggaaatcaattaggacggaattaatttttaatagacgtaatctagtggttcaaaataacggatccactaatttgagtggaactaaatggatagatttttttctcagaatatatatgattttctctaatttattagagcgtcacatgatggtctgaaagcgtttgtagaagtgtcacgtggagcgtttataggatgtttaatggactttaatgtgtttgaaaggagatgaaaagagaagattgagatatacaaaatgaggtgagccattaacatatgatcaattgagtattaactattttaaaatttaaaaatagattgatatgatttgttaaagcaactcttattgaaaatttttgaagaaaattaaacacaccgtttaattactcggaaagtgaagagataagtcttctcttaatcggcagctgccgaacgcagccttaagatatatcttatagatagatagatatatagataatagatagatacacaaaacagcacacgtagatgttttgaaaaatctggcaactgacaaacaagcagtgggtcatatatccagcgcactgctatataaacaccataagtgtgtgaggtggtctgcaaaacaaaagtgcgagacgtgccaagcaaggcgggcggagatcgatcgagatcgaagaattagttgcagtgatttaattgtttgcatggcaccgacga

SEQ ID NO: 15783 - DNA, 999 bp, Oryza sativa
ctgcgccggtgaactccacctggtacccggcgccgcgcgcccctgccttcaccgtcgccctccccgccgccattgccgtcgccctccccaccgccagtcgccatctcgacagcgtccgtgcgcagctaggggagccagcgccggcaacgacccgtcgccagctacgccaggtcgccgccgccccggacccgtcgccaaaccctgccgccgagcactccaggtcgtcgccgcccccgacccaccttccaaccccgccgccgagcagatcccgccatggaggaccggattcggcctccacggcgccggatctggccgccgccgggcgcttctcctcgtcgccggcaccaagcctgagctcctgtcttgccggcgtcccgtacggtttgaccacgagcgagggagagggagccccgccgccgccgtccttgcagccgcctggcttcgccgacggtggctcgggcgacggcgatgctggggagaggaggagaagggcgggggccccgcgtcgcccccgggacagcgccctcgtcaaaccttaaaattttaactattaataatttctcaaaccgtttggttttgaaaatctctatccgtagatttccttttttagaaaagtactatcataagatcgtaaactcgttagaatttatgaacatgtctgatgtaaaattgtgggacaaagttataaaaattattaaaaccaatcttatcctttaaacgtcgaacatttggccgatttctcccgtggtcgtccaactgtccaactgtacagcctgcttttacgcaacagaaaacggccgccaccgtccggtgaggcggtgagtagagacagacagctgggccccaccgagcagtgagaggacgagtagtacagatcccaccaaagtcgacgagacgaccaagctcttcttcctccctgcgaacaaaaaaaaaaatctcctccccgcgtcgaattcgaaggggagagagcgccgcgagcgagcgagtttggcggcgaga

SEQ ID NO: 15784 - DNA, 1501 bp, Oryza sativa
attaggccgacaagatgaaactaaggtgctatgcaggaaaccaacaaacacgtcctaagagcatgtccacacaaatgtaaaaaagaatcacccatagagatgtcgtgtgtactcaatgtggtaaacgctatcgcactggtagtttcatactttcatggcatgtttgaaaaagaaatggcccacataagtacccgtatattagatcaaacgaggtcagacattgtgaagcaccgggtgctaggtagtatactagctagtgcagaacaactgaacaagcacaagtgctactgctactactaccagctttacaaattaaactgggtgacattgcgcaacgattagaacagagcaatccccgcaaagtaagagaatagatagcctcataacaacaaaaagtaaaacacacatacaagggttccgcaaaatctatggaaccaaacagtaattagacccaaagctctgcaaagcggaatgcacgccctaccccaaaaacccctcttttctttctcacgcgacaaaatcggaccaaaatacccaaaagggggcgaactaggcgattgctactaacgcttatcgagagcaaagcagcacatacgcaaaacgcacacgcaaccaactattccaccccgcaaaacatcgcctgtagaaaaccttaataaagcaaccgcgatcgccagaaatgttgggggtaaaaaaaaaaactaaaaaagcagagtccgcccgatgatcaccttcatccgcgcaaccctccgtggcgcgtcgcggaggtcagcggcggcggcagcatccgccgccgcgaacggcggcggcggccgagcgggcccggggctagggtttcgcgcgcgcccacccaatggccgcgccgcgtgcgccattggatccctcggcgatcgccgcagagagaattgatgaaagtgggttttgtgcttcttgttcggtgcgtctctttgatatgaagagagagagggaaaaaggaaggagaagccgagaagggccttctcctccgggcccacctcgcagcttctgtttcgggaaatacacagtccacgcgacggggtcttccgacttccgagcctactggcgggtgggtcccaccgcgtgtgggaccgggatgtcattgtgtcgttgccccggcgcgtaaacgatgggcgcgtgtggttgtgtggaaggtaaggggccccacgttcccagttcgagcggtgggccccacatcaggcgtggtctggccggaccagttttggcaggggggaggagcgcatcggcccgtttatgatggacgatccgacggctggagattaatcttgggtggagacgcatcagaaggttacagaagcccgaaggcatcacctctgttgctcacggatttgaccgctgggctccacgcgaggaggtgcgttttgtctatatcgcacggtgaggatttttcatgcgttaggcccctttttctctcagagaagttggatgaaaatctggatatccgttgcatgttttttaaactgtt

SEQ ID NO: 15785 - DNA, 350 bp, Oryza sativa
tatattattctgcttcatatatactcaatgcgtggctctaaaatacgcgaaagagaacatactctgtcgatagctcgattagttatatcaaccacgtctgactctgaaatacgcgcacgacgaaaagaaaaaatagtatatataataatgttttaattttttttaaaaaaattgcatcttcactggcgggccacgtgtcagaactaggacagtccatatcttcgctgtcgggccacgtgtccatccacagaagccttacttcatttttcctagcgtgccacgtggcctaaaatactgagccgccagcaaagaattatcttcgctggcggccgacctaaggctaacgcaaa

SEQ ID NO: 15786 - DNA, 729 bp, Oryza sativa
  unsure (1)..(729): unsure at all n locations
ggtgtcntttgatagcgatcttgtacccgatgagaacaaccgagagtaaatttactcccggttgttctcatcaaccgggactaaagatattttcccgctatttccaaattctttttaaacccggttagggttaagaactgggactattgataagcgcactgaatattaatttccattacatatgtgtttctaaaatagaaaataatgcattaaaattatttaaagtcgaaaaattaatgacaattacttcgaaaaattattgttgtctgtagtaaattaagtggacaaaacgtaataaccaaatatatgatttaaaattaatataaattctaataatcatatatacttagcatatgaatgatattaaattgttaaaaattgtaattaacatatgtatatacatacgacatgcatgatttaaaattaataaaaattctaataatcatatataattagcatatgaatgatattaaattaattgttaaaaactctaattaacatatgtaaatgccacatgcatgatttaaaattaataaaaatttgaataatcatatataattagcatatgaatgatattaaattaattgttaaaaactctaattaacatatgtaaatgccacatgcataatttaaacttttaaaaattctaattatcgcatataactagcaattacatgatttaaaattgttaaaacctctaataaccgtacgtaattaacatatgccata

SEQ ID NO: 15787 - DNA, 184 bp, Oryza sativa
ttcgccgccgcgcgcgcaacgccgccgccgccacgccacgccgccgccgtcacgccacgccacgccgccaccgccatggccccggaacgccacgccgccgccgccgtcggcacgctgccgcgccaaccgccgccccgatgccgccacaccgccgttaacgaacgagaacgagaacgatcgaacg

SEQ ID NO: 15788 - DNA, 1501 bp, Oryza sativa
acgagctgcggctcggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaggtcagtgttataattcttaaaatttgctcaacaactaaaatatggaatggttggcctgggttggcttgggacgagttgggacccaggtcgggttgccagttcggtccaattcatcgtaggccttgggttaaggcaggttcgtgagggttcacggccttgtttaataacactgtgtagctctaggatcgtctttataaaatagctttgggcaactaagtgacttttaaatgctgtttactgcaaaactgaacccctatattattatctccttgtactcccttgcattaatcatgcattctccggtgtggcttgctgagtactgtggttgtactcattcttgctcaatcttttcccccttcagtaagagaagctttggaggagatgtcttaggtggagtcctggcttatactccagttgagcgcctgtgaagatggagccgtaggcccgctagtccgctgctgtttatctttgtttgtcaggccttaagtgcctttgtaataatgtaaatattatcgatataataaagatgtgtcttttatatcatgtttgtatggtgtaccccggcttttcctgggacggggattaatacacaagcgttcggaaaaaggcaattttcccggtcgcgacaagctggtatcagagccatctcgactgtaggataagccaaatggataaaacctaaggacatattttataaataaaattatttgcgaaagttcctctttttctccttctcctaatgctatttgcaaaaggtttactcttttctttcttcggatttcaactaagtactagatggtcagctttgcgaagaagaagatgtcgtcagttgtttgccgaagctccggaagactgcaggatccgctagcgaagcgaaggaagcagtgaagccagctgtgaagcaggagtgaagatcttggagaacccgtcgcagaacctaagccaccctctagtgtttcgtttgtcgtgtgtttccttgcttgtgtgtgtagcgcgtggtttgcatcggtgggtggtgatgtaaccatgctaggttgtttgcttaatcaacttgcagaataagcaaaacacacaacacatcaacaaaaagagttagttcctttaaggtcctgtccctagctctggtctattctttccttgtatgcttcctctctcaacccctaccttgtgacagatggataacactggtaacaaaggctatgggaa

SEQ ID NO: 15789 - DNA, 1501 bp, Oryza sativa
ttatccatctgtcacaaggtaggggttgagagaggaagcatacaaggaaagaatagaccagagctagggacaggaccttaaaggaactaactctttttgttgatgtgttgtgtgttttgcttattctgcaagttgattaagcaaacaacctagcatggttacatcaccacccaccgatgcaaaccacgcgctacacacacaagcaaggaaacacacgacaaacgaaacactagagggtggcttaggttctgcgacgggttctccaagatcttcactcctgcttcacagctggcttcactgcttccttcgcttcgctagcggatcctgcagtcttccggagcttcggcaaacaactgacgacatcttcttcttcgcaaagctgaccatctagtacttagttgaaatccgaagaaagaaaagagtaaaccttttgcaaatagcattaggagaaggagaaaaagaggaactttcgcaaataattttatttataaaatatgtccttaggttttatccatttggcttatcctacagtcgagatggctctgataccagcttgtcgcgaccgggaaaattgcctttttccgaacgcttgtgtattaatccccgtcccaggaaaagccggggtacaccatacaaacatgatataaaagacacatctttattatatcgataatatttacattattacaaaggcacttaaggcctgacaaacaaagataaacagcagcggactagcgggcctacggctccatcttcacaggcgctcaactggagtataagccaggactccacctaagacatctcctccaaagcttctcttactgaagggggaaaagattgagcaagaatgagtacaaccacagtactcagcaagccacaccggagaatgcatgattaatgcaagggagtacaaggagataataatataggggttcagttttgcagtaaacagcatttaaaagtcacttagttgcccaaagctattttataaagacgatcctagagctacacagtgttattaaacaaggccgtgaaccctcacgaacctgccttaacccaaggcctacgatgaattggaccgaactggcaacccgacctgggtcccaactcgtcccaagccaacccaggccaaccattccatattttagttgttgagcaaattttaagaattataacactgacctgggtacattgctaggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtatgacatctcgactaccgagccgcagctcgtgtagccttcatttgccctggagaa

SEQ ID NO: 15790 - DNA, 759 bp, Oryza sativa
tacggctccatcttcacaggcgctcaactggagtataagccaggactccacctaagacatctcctccaaagcttctcttactgaagggggaaaagattgagcaagaatgagtacaaccacagtactcagcaagccacaccggagaatgcatgattaatgcaagggagtacaaggagataataatataggggttcagttttgcagtaaacagcatttaaaagtcacttagttgcccaaagctattttataaagacgatcctagagctacacagtgttattaaacaaggccgtgaaccctcacgaacctgccttaacccaaggcctacgatgaattggaccgaactggcaacccgacctgggtcccaactcgtcccaagccaacccaggccaaccattccatattttagttgttgagcaaattttaagaattataacactgacctgggtacattgctaggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtatgacatctcgactaccgagccgcagctcgtgtagccttcatttgccctggaga

SEQ ID NO: 15791 - DNA, 1501 bp, Oryza sativa
gctcccccgtcgacagtggcaatggtggccccaggttcttggaaacctaggtcatcatcaccgtcatcgatgtcaacggcgggggccttctgtttggcctcacttcgccgtttaccggagggaactgccgcggacttgccctcacggcgttcctgcctcctgtcctcctcacacttcctcgttcgctcagccaagtttttgactgcgcgacaatccgcgagatcgtggagggaggtgttgtggacggagcaccacttgctggctgggcgctccctgctgggagtaccagcctctttctttttgtcgctcgcaggcctcccctttcgggtggcccgcggaacgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcagacttggcagaaacgctgaatgtacgagcgaagggattcatcatcccctcgctgtactgcgtgcaagtccgcttcttcacctgggcgtggataagtgccttgaaagttcatggtgaactgctggcacaaatcctcccaggagtggaccgacgcgggtggcaggttcattagccaaccccgcgcctgtcccttcagggccatgggaaagaaattcgccatgactctgtcgtcacccccagcggcctcaatcccggtcgtatagacctggagaaactcggtggggttgacactcccgtcatacttctcggtgatggtgggccggaaccttgggggccaacggacattccgaagactcgccacaaaggctctacagccgacaccaccagccgggggcatggagggctggtcctcacgtccctgtcgaggtgacactctggacgaagaggcgccctccgttgcgcggggagtacgccggctattacgccgacgctcgatgtcgaggcgggcattcggctctccatgccgatcctcccgagtcggaggtgccgacgagggagtggcagccgaatggcgtgcaacagccgccgctcgccgcgccctccgtcttgacgacgcggaaccggtagtggcggcgccggaggtcttggtggtggcggaccgtccaccagcacccaggcgctgctgtgccgtcatgaccaagttggccacgtcgtccagccatcgctgggctggagactccgggtcagggacgacaggcgggtgacgtaggagcgcgccaacagcctgaagcgcgccctgaggcgtgctgccgtcaccgtagacgaggaggcgacgctccccatctcgccgttctcctgcac

SEQ ID NO: 15792 - DNA, 1501 bp, Oryza sativa
cccgccggatccaccgcccgcgcactcgccggggaggggaggggaggggaggagccacgggctgcccgtgccgcctgcgccgccgccgccgccgccgagctcaccgccgtccatcctgtggagaagtaggcacaagaagaaggtgagagagagaggaaaatgagtggaggagaaggaatgtgagaagataagggagagagagaggagagaaggggccggggggaagagaaggaagttaaattattttgaataggatgggagggacgctatttttccgtgcgggtggattaggaggcccgcatgcgaaaatagggttattttcgtgtgcgggcctgttaagtgacccgcacacgaaaattgattttcgtgtgcgggcgagaacctggcttcgctcgccccacttttccgtgcggtctaacttacggaccgcatggaaacaaaatgggggtggcgtccaagaaaatcaatcctgtagtagtgtgagaggagcgtcgaagaagaccgagagagaacggagaataagaatagggcaaaactgtcattttatgttatttctcaatcatcaattgggtgaatattatattttaatacatctagtgtcttacagcaaattaccatacttttggagtgtccacaggcaaagtcgcgtctttacgatgtctcatagctaattacatatttctcggatgtcctgtagcaaattttgcctttaaatatatgatagagttgacacttttaatttattgaactactcatcttttctctacaaatatttgtgcagatagacaaacatatattaggcattcttaaagtacttttctttccatgatagatctaatgatactcttttcactctattacttaactgggtaactgaagaaataatggttatcaaaatttgagggaaacaaaaagaaaaaaatgatgctgtatatctacgacatattggatatcaacacagtcttcaattaatagacatttttcatcgtcacattttcaagctatatattcataaaagagtatttaaacgtaagaataaaagtgttttttatggcaaatccactcatatcattttcacatataccccaatatgtatgttaacacttttacattaattattaataatttaagatttggaagttttactacagttatattaagatgcattttccccgtaaaaaaaatattaagatgcatttcatctattcgagaataaagtatatcaagatatgatatgctctaagaaaatgagtagctaggatgagtaggggattgagaaggtactgagaggtggcataatatttttttttattatgtgtattaatctgtgtacctcttgtcaacacactatggaggtacggcaaaacaccaaaagttactataagaaattccagttatctacacaatcgatcagaaccatgaaaaacataaaaaatacttctaattaagcattactattctatatgtgtactgttattaactaaatttgatctattctaga

SEQ ID NO: 15793 - DNA, 1501 bp, Oryza sativa
gtgctcaaacattcgatgtgacatggtgaaatgtttttgcgtgggaactaaacagtgccttatcagcaaaattttgatttttaaacttacatttagagtttatttttggtttatgaattgtgctctggttttcagccttggtttttaaatccctcataactcagatgcaaaagttttttttattgctttgttcatttttctattagcagtaactgaactgatgaaaaccattaagatcgtttgaagaccaacctataggaggccttaagaatagtatgtgtattgtgcaattgtgcatctcattgggacacctaaactgttcatggttgagtgccttccaactcccaagaatcttgataccaaaaaaaaaaaaaagggaactcccaagaatccatggtccaagagtccaagcccacggtgtcagccacctagggaaaaaacgagtattaaaacactggaccgaaaaaaaaatgcaacgaacataaaacaaaaaaaaggtaagaattgaagtagcacgctctttcaattctacggaaattaaaaggcagagctaacagaaagatgagccttttgattacacctcagggaaaataaatcaaaggaaagtcttccaagagatctaaccttttggttattttttctatgcaattggtcataggattataattctatagaaaattctctatcttcttattctgaatcaaggggctcaaaataaaagtccttagaaagttgaatcctccaaaaaaaaaaaaaaccttttcctactctatttcaacgggagccttgcaccaattgaaccctctgccaaaaggattgtacagtagcatcattacaatgtactagtagttcatactccctccgttcctattttaacattttgtttgcgttgtttaaccattcgtcttattaaaaaaatttaaaattattatttattttatttgtggctactttattatccaaaatacttaagcacaatttttattttttatatttatataaattttttgaatgagacaaacagtcaaaaaaaaatgcaaacaaaatattaaaaattaaaatgccttgtataaagggacgggggagtatcagcgtatctcctctccaccctcgcagtccaaaccgagcaagatctcccctgtttctctctctctctcaactgtgaactctgaactcaatccaggagatctctccatcatgtgttaatctgcatctttgtctccatccatctctgccgcactcaatcacactgcaactgcaactgcatcaagaatccatccatcctttctccctgccaataatttctcaagaaaaaaaagaagaaaaaaactgtcgtctctctccgttgatagcgaccttgccttgcgttgtctccggcttcttcgcctataaatcatcgtcttcctcctcctcttcgcttccaaaatcctcgagattttcttgttgcattgcattgtggaggggagaggaggaggagagatgagggagtactggacgtcgc

SEQ ID NO: 15794 - DNA, 1501 bp, Oryza sativa
cacatttaaaatattaaacgtatactaataacaaattacaaattccgactgtaaactacgagacgaatcttttgagcctaattaatccgtcattagcacatgtgggttactgtagcactatggctaatcatgacgtaattaggctcaaaagattcatctcgcgatttacagtcggactgtgcaattagttttttttatccacatttgatgctccatagatatgtcaaaacatttaatgtgatagaaaaattgaaagtttaaaaaataagttggaatctaaaaacacagccatattcaccatcgatcgatggagcggagtagggggctaggggccccgcgggggaataattctgcccatgattaagctgcctgccggcacgaagcgagattgtgcgcccggaaatgattcgcctgcatttgcatgcatgcccccctccccgggctgagcagagcagtgagctgagcgggaggaggaggagcagagcagcactagccaatggagcggggaaaaaggcagccgagatccaaggctttttgtggttttgagaccggggataatcgggagagagaacggcttgcccgggcagccagggtgggtcagccctggggcatcttgctgagcgcatgagcctttaccatggtgtgagtgtgatcggatccgaggatgaacgccggcgtcgctgggtttgccggaccgctgtcgatgccgcggctgatcgagagagctcgagattgggtcagtttgcaagagtttcagcaccaattttatttctgttgaagctgaagtctagctaaactttaaaagaaaaaaaaatagagcgggggctacgacactcatgaaatgaaataaagagggagagtttggtttaaattgatccataaggccattcctaacccaatgactaggatggtgtccatagtattaaataagctgtcacatatgatgaaaaatgatgtggcaagtgaataaataaggaaagagaaagaaaccatgtcttgcatgagacatggtttctacacaacatccaagtcatcatatgagataagtggcattaaatttatgtttggaatagtggtgtttgcattagaaaaatagtgtctagtactagtttcttaatgatgtgaagtttataaaaactatgtctagtcttgggttggaaatggcctaactctacttagagttaaaataaatttaggagctggggtgctactaatcaggcctgacacgtagcgtgaatcgtgatcgggtccgtgacgtacgcccgccgtgtttctgggccagatcatgttgggttgggtagaaagggttagcttggtttgggccggacattttagctgggctaggttgtttagctaaggaaaaagtacactgaaggtccctcaacttgtcatcgaattacaaaatcatcttgaaccgtaaaaccagatataaagcatccctcaacttataaaaccagtacaaatctctggcggttttaactccggttttgtctgatgtgac

SEQ ID NO: 15795 - DNA, 1501 bp, Oryza sativa
aaccggcagtaaagatatctttactcccggtgcgtgagacgagccgggagtaagcatcttttctttagtcccggttgttctcaacaaccgggagtaaagatatctaatctttactcccgcttgttctcatcaaccgggactaaagatctagggctatatatattcccgatgcgcgccctcgtcatctccaccaacacttagaagtttttgcccgatcgatctctctcggcttctccttcgccgccactgcctagggcatccccacgccgacgccgccgccgtatctcgccgtcgtctcgcgctcgtcgtcgtcgccgccgcctccgcctccttcgccgctgccgcatctctggggtgagagccgccgcgcgccgcctccctctcgatctctctctccgatctcgatctctctctctctccctctcgagtttcagacgccgacgccgacctcgtcacgacacgacgccgcgccacgccgatgccgcgcgcggcgccacgccgccgtgccacgcgccggcccgatgccgcgcgcggcgccacgccgccgccgagccgccccgccgccgtttcgttgccgtcacaccgagaacgtgaacgagcgaacgaacgtgaacgagaacaaggtgaatgaacgtgaatgagaacgagcgaacgaacgtgaacgagccaacgaacgtgaatgagaacgagcgaacgaacgtgaacgagaacaaggtgaatgaacgtgaacgagaatgagcgaacgaacgtgaacgagccaacgaacgtgaatgagaacgagagaatgaacgtgaacgagaacaaggtgaatgaacgtgaatgagaatgttgtcggacgaacgtgaacgagccaacgaacatgaacgtgaaatgcaattataggcaggttaatgaacgtgaacgaacaaatgtaggtgaatgaaacgtgaccttaacgagaacgcaaacgtgaacgatatcgtgaacgaaacgtgaacgtcaaatgcaatatatgttacttcgcgtttatcctaatacatctttttgtatcttgcagaaaagacattgtcggagtcgtccctcaagccggagtggtagagctagcccccgaaggaattctcccaggcaagtgacgtaattatatatatatgattgttatatttgtaatgcaattaagattattagatttgtaattagacttaattagcatataagattgtgtagtgttctaatatacgacagttacacttagaatacatgactatttgagttttagtataagattattggagttttaatataagattattatatttgtaattagacttagtatataattattgactagctagggtcctataatatacgtcacctagtcttagcatatatcatcactatttgagttttagtataagattattagatttgtaattagacttagcttctaagattgtgtagggttctaatatacgacagttacacttagcatacatgactgttcatttagtcttagcatataaga

SEQ ID NO: 15796 - DNA, 1501 bp, Oryza sativa
acgcttgtcacaaaacatgcagagtgatccaacctatagttcccaaatgaatcaaaactcaacaacagcttacccctgagcaaaaatgcgaccagcaccaagagcattgtgacccacttcgctgttgcccatgtcatcttcgctaggaagaccaacagctgttccatgagccttcactaatctccacctctcgggagcacccttttaatgtacaaaaaaaatagagttaactgctgaaactagagtgcaggcaaaggcgtaaattcatagcacaagggcaacccaacacaacatggaatcatggatgcaacttcattaaatatatgtccaggctaaacctacgacttaatcatcttagccaaactgtctgttgtcaatgggataaccaaacagttacaagcaggatgcctaatctacagaaaataaaacaagaaaagcaatttgcaatcactaacaacattaaaggcagaaaaaattgcatgaccccaaatcataatcatgtggcaaggaagcatacattcttgagcgaatccatgacgggcgtctgggcgacatggatgcagttgtacttgtcggcgttggcctcgccccatccgtcaagcacgacgagggctaccgtcttccccttggggagcttggggtggtcgggcagcgtccatgagaaaccggagctcgccatcgcctactagatgctatacctaccaaatcacaccaacgcaaagctcagatacaacagttaggtgcagcaaatcctcagatccgtacagaaactacacataattaagtcaactaatatcagggttagcaatccgaaccaactcgtggcctaatcgagcataattaacactaagcaacgctgtaaatctcgccaattttatcagatttcgagcctcagatcagattcgcacaggcggatctaccgatcgatcggcgaacaaccgaaccacaaacaagctaccgcgctcaaaaccaacgacgcatccatcgatgaggaagatcagagaggcccttaccttcgctttgccctcgcgcttttgcccaccgagacgaaagcctttcttttctttttcgagagcggagtacgcgaggaggatgacgaagtgggcggcgcgatattaataagcagcgcgacggcgacgtgtagggtccacgcgaataccttgtttaggatggtcgcgttaccatcggacggtcctctcgacgccacgtggagagaaatggagagatctgacggcgcggataggtggctccgtcttgatttggtggatcccaaagcccaaacgggggacgggatccaccaattttgttttttttattactacggccgctgctggtattggacggccgcgatggcggcggcggcggtcacgtgggagcgacgagactccatcgtgaccgtccagtccggtcccagtccaattccgtcgctgggtttggatattccatcgagatattcccagcggcgacgggatttttcgccgggtttctccagattttccaa

SEQ ID NO: 15797 - DNA, 1501 bp, Oryza sativa
gctaaaaaaagtaggtccaacatgccatcctcattctctcctcctcctcctcaacctctttctttccctcctttcctcatcgagtgcaccggccgctgagcctgagtgtttgcagcccccaaacacccaccgccacttctgccttcgagcagacgagcactcgtcgccgtcgtcgtttgcacctcggagcaactgccatccccgctcgtcatcgtcgtagtagcctgcacctcgttttttaaccaaagggcgcataagatttgtagtattgtgggttagggatgtcgattatactcgacgtaaagcataaggacaacaagtaaacttatttccatcccagccaaccagacatgggccgcatggccgacattgctccctaccaggcccaggatgtaccggccggcccaaagtagtagcaaggtaggctggccagagcccaagcgccaaatctgaccgactgccaccgtgccgcccgtgatgaacactggagtacccgtctcatggagagcgagaagaaagtacacagatgtcgatgtgcgagaagaaagcgagagcgccttcgggcgtatcgcacattccaactctaatggtttagcccccaggacgccggggcccgtggcggcgcggccaacacaacaccggagaggagcattcgttcggcgaggagggcttttcccattggaaaatctggagaaacccggcgaaaaatcccgtcgccgctgggaatatctcgatggaatatccaaacccagcgacggaattggactgggaccggactggacggtcacgatggagtctcgtcgctcccacgtgaccgccgccgccgccatcgcggccgtccaataccagcagcggccgtagtaataaaaaaaacaaaattggtggatcccgtcccccgtttgggctttgggatccaccaaatcaagacggagccacctatccgcgccgtcagatctctccatttctctccacgtggcgtcgagaggaccgtccgatggtaacgcgaccatcctaaacaaggtattcgcgtggaccctacacgtcgccgtcgcgctgcttattaatatcgcgccgcccacttcgtcatcctcctcgcgtactccgctctcgaaaaagaaaagaaaggctttcgtctcggtgggcaaaagcgcgagggcaaagcgaaggtaagggcctctctgatcttcctcatcgatggatgcgtcgttggttttgagcgcggtagcttgtttgtggttcggttgttcgccgatcgatcggtagatccgcctgtgcgaatctgatctgaggctcgaaatctgataaaattggcgagatttacagcgttgcttagtgttaattatgctcgattaggccacgagttggttcggattgctaaccctgatattagttgacttaattatgtgtagtttctgtacggatctgaggatttgctgcacctaactgttgtatctgagctttgcgttggtgtgatttggtaggtatagcatctagtaggcga

SEQ ID NO: 15798 - DNA, 1501 bp, Oryza sativa
cacttgtgttcaatctacttctttaccagagacgaagttgtatgtggctaaaagaaaatagagttaggatgtgtttagttccacgccaaaattgaaagtttgaagaaattgaaatgatgtgacggaaaagttggaagtttgtgtgtttaggaaagttcgatgtgacggaaaagttagaagtttggaaaaaaaagttagactctaaacagggccttaaaatggtgcaaagtgaaaatgttaccttaaaaggaggtccaaagtgaatcttcaaccataaaaatggcccaaactatatttcactcaattagttaataaaccatataagagctaagtgtaagtacaaacctatcttgactgtttttttaaaaaaaaatcattatattttattattataacttgattgcttgacaaagtattaaaacaaacagaaataaatttggaaaactaaaaatccaaaaacggtgtcgaatgctagctgggaagtattaaaattgagcccacgagcccacagcctgttatattcttatgttgggtccctcgtttcctctggcccagaacgagaagcccacaaatccaccatgtacgcaagccatggcctcaacccaactggagtagaacggaatatggcacacgcattttcgtattcattctgcgatcgattctagcacatgcaaaaaaaaatgagggtaaagagagctttattaatgcttaaataagggattacactcctgatttaataagtctagaattcttgcgggagcacacaacctccactccgcgtaggacctacaactcattgtcatttgtgctaaaacatgtgctaccctatttgcttctctctttatcttgtgtacttgcactttgcatcactcatttaatctcttcaatcatcgtcgcccaggccgatttcagctgttcctgtcttactaaatctctaacaatttctgcattgtccatctccaacacaatgggcatatgaatcaagtcttgcactttgcatcactcctttaatctcttcaatcgtcgtcgcccaggccgatttcagctgttcctctcttattaaatctctaacaatttctgcattgtccatctccaacacaatgggcatgtgaatcaagtcagtcgccgctctgagtccctcaagacagccatttgtgctaaaacatgtgctaccctatttgcttctctctttatcttgtgcacttgcactttgcatcactcctttaatatcttcaattgtcgtcgcccaggccgatttcagctgttcctttcttattaaatccctaacaatttatgcattgtccatctccaacacaatgggcatgtgaatcaagtcagtcgccgctctgagtccctcaagatatatgctagcgccaatgcctagacagctgagccacattgatgcagggttctttgggccgccaatagcaccaaacccctgcaatctctaaatataaacccgacactagcatccccggtttcttccctataacctgcgtca

SEQ ID NO: 15799 - DNA, 833 bp, Oryza sativa
taatttaatagctaattaatcaatagttatctataatattatataataaaattaatacctgattccacctatcatatacacacaaggtatcttggaatcaatactgcagctgtctataagtcaatagtccgctgcttttctctttattttttgtcttctcgaaatgtgtttatagctagcttataatatacaattgtacctactcctgatcactgtagctcatatagctcatagaatggcacacattaatctacaattaacaataatgccgttctccatacaaacccaaagagagaggatattaagttaatttgcatcgatctagaaccacatgaatttcacgtgaggtggtactttaatcgccggatgaatatacgtcaagacaaattcgatatgtatgttgcaaacaactgggagcgattatttgttcttccccatacaactactagtgcatgattgtggggcttcttgtcctgttccctgcttctggccccaacaacgtttctttcttctagaagggagtcttgtactgttgctccctttgtcacgtcattctcgaaaggtggcttatcataaagttcacgacatacttaaatacacgtgttttgctatggataaaaatgaattatacatatgcacattgtttagagcaagttggttgtaaagtttttggaacaacatatatcatccctgatttttttggatgtttttgcatggtaaacttaaattcttagagagaggataagatattaacaatacgtagaaatattgttttataaagaaaaaaatacgaattacctttcccaaacaatccggggtgatacgtaattagt

SEQ ID NO: 15800 - DNA, 1375 bp, Oryza sativa
caccaccaccacagccttggctcccgaacacccagccacctcgcccccgactccttccccgccgccgacgtcgccaccgcctccagaatcacagccgccgtcgccgctgccaccgacgccaaccaccgcctctgcaaatcgctgttgcgccgtcgccctccaccaccgtacagctagtagcccgacgccatgtcttccgccgccgttgccagatgacacggcagccaccacagccgccaccgccgtcgccaactgccgctggcccagtgccgccgccaccgccgtcaccacaccgtcgccgtcgtcgccaactgccgccggcgtccagatccggccgagaccgccgtcaccaactgccaccgccgccgtcgccgactgctcccatcctccagatccggccgagaggcgcggatctgggggcaccgctgccgtcgccgccaagcatcgagccgccggccacagcagccgcgcctccgagcctgccgcggccgcccgcgcctgctccaccgtcgcgcctgacgccgccgttgcgcctgccaccgcctgtcgcggccgccagcgcccacgcctcgccgacgccgtgcccacgcctccgcgaccggatccagctgcgagcgcgccagatctggtggtggcgatgccggatccgccgccatgagccttgacgccggcgccgctccggtcggccaccgcctttgcgtccacccgcgccaggagctcgggagatggccgccgcgagccccgccgccgccgtcctcgcgagccgccggctttgccggccgctcgctcaggcggcggcaaggcagaggaaggggtggggaagggcggcggcggcggctagggttccgccgcccgagtcgcccgacgcggggggcgacgcgggggcaaactatctgatttttttcaacatggcaaacatattgatgctgatagtactataaccctccaaataatttggcaatagcaagtgaattttctcatgttttgtagacagttgatagcacaattataataagaaaaacactgtaagctgataattgtggcttcatatttgacgtttcaataattaaaaaaaatatttaaaatactttactcttctagttgaacgtattaacttctcaatattgaagggagttggaatttcaatacagtatatataatagaagcatggaacaattgagatccccctgctgtaattttatttgatattttagcattagaggacctcaacctgtgattataactgttctatcactactgtaggtaactttcaagacaaggatttactactgcaatgttgactccactggtaacttgagtatgggcattttaagggaaggctggagtcctgcttttactatttcaaaggtgctac

SEQ ID NO: 15801 - DNA, 1501 bp, Oryza sativa
ttaaattttttgccacatgtttaaccatttatcatatttagaaaaatacgtaattataatttatttttgtcgttgcgagttgttttatcacttcaagtattttaagcatgaattacatattatatatttatataaaattttgaaataagataaatgattaaatatgtgttcaaaaggcgatgacgtacataatttattaagaaaacgtataatcctcatcatcatgtcgtgtataattactttccaagcaggcctaactagctacatgtagacttagtagctgattaaaatgaagcaagctggagctaaaatagtcgtgtgacgttgttgtcaccagcgatattatatcccatcgtaactttcacattggagttttctaaccatataatcgtgtactgtggtttgttaagaaggtataggtgactaatggtctgtttggtaggttaaaattctgagaagtagttggttggtagacattttctaagaatctagaaaagttaggtttctcagcttctgacttctagtgtattttttgaaatctacaattgcagtttcttaaactctgaaccaaaaactggattatttggaaaagcttctgattctgagagaatctgcagcagttagaatctcctctaaacaggccatactaattgcccactggactggacacacaatcatgacagtaatttgattaagggtgataagacacgcactcatgcattactggccagagatgatcgagtactcgaaaatgaggtgtgatgcaaactgcaaactggaaaattaaaaagaaagaaaagctgaatgaacgaactgggttggattggaaaaaaataaaatgaataaaatcggtagtgcgtgtaacaagctaggccactaaataaaccattcgtacgtgcatggtactctattaattaaagaaggaacattttatagagcgaaaagaaaggagtggtgaatcattcaggcatagtgctcgatcgctgcttgatagtgagaagcttacgggcggctgtgttcggtggtgggtatttacacggaaaacagagtaatccattagcgcatgattaattaatattagttaattttgttttaaaaatagatcaatatgattttttaagcaactttcgtatagaaatattttgtaaaaaatacaccgtttagcagtttggaaaacgtgagtactgaacacagccgtattaatgtatcaaaatatagaaaaatatcgctgtaacctcaaaacttagttgtctgtttagattcgtacttcatgatatgtccaattcaatcctaacttatttatatcttgaaacaaatgagcatatttttttttctaaaatctccagctgtaactgtctaaattgttaaaatttgtaaatataaaattaaaaaataaagtaaacattagacgctgagaaacttagatttcctatattcttgctagctatagctggtaaatttagtggcctagcttctcaaactgggccactaaattaccaga

SEQ ID NO: 15802 - DNA, 1501 bp, Oryza sativa
aaaagctaaggtttcttctgctttctttattttcaatagtttgtttctaaaatggttactgatctttctccctctttcaaaattgtagatggcagtgaacgccagcttcagttcccacggttttagtgagggtcaccacgtcgctcagcttcgtgacctcgcctgtttccttggcttctcgtgtcccgagtacacggggtactccgtggaccgtgttccccctcactgtgagctctccgtgtacctctaccctcgtgaaggtatacacggagctggccttcgcccccaccacttcaccgtggccaggcccactctccagatcgcgtaccaggacctttcctggactgcgcttcgtcgcctggcccacgactacagccaccgtctcggaggctccgccttccggcagcttccacgccttccttctggccactcagacgccaggtacccttgtccgtacagcgagtctcagccagtgctgactcgcatggttgagctttcggaggctcaggccactcagcacgacctactccttgaggcttaccgctccctggcccgctgctacaccgctttggaggcccgtctggccgaggagggtgtcacctcagttgacactatctcctgggactcaggccgcctctgccacgccagccacctgtcctcccacagctcccgcggctctgcctgcactcccagtggcccgcgctcccccagctcgcgtgcgccgtactcaccagtgtactccccctacccacacccagttagcccttcctacacccccggacacaccccagttgcttcctcccgccgtggtccacgctttatccgcactgcgcggaagcgtgttgttggttcttccaccgtgttccgtttccaccacccagctcccccaccgccagcggcccgcgctgctgccggccctcgacaggttccgccggtcccttcgcgtcagccgatcgacgtttcttcgacggaggagccgactacaggaggcagcccggccgacgaggagtagaggaggcagtcttcagcagccgttcgtgtgttaggcccttttgttccgccgccaactcttttggagtcgtggcgaggtagtgcgtgcgtgtgtttgttgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgcgtgctatatgagttgctatttactttgctccttgccccccctaagtgcttatctgactcttaccccgccctcttctgggagtttagatggctagccgcccccgccgtgcagctcgtgcgccagcccgcttcggttttgaagaaggtagagccgaaccagaagcaaatcatgaatcagctaatgagcagtctcaccgcagcaaccgttcgcaccgtactgtttcccgcaacgcagaagttgagcaaccccgccgtagca

SEQ ID NO: 15803 - DNA, 1501 bp, Oryza sativa
actctgcagctgggacctgcagaaacctagcttgggaattaactaagcatggtgtcccatggcaacgccgatcaattcattaatctgtacaactcagagatcctattgagattcgatgaatgcaatgtgaatcgtcagagaagttaattagctgtgaataaaatctaaagaaactgatcctcttacagggtgttagctccacgtacgaaaaaatagagtaaattgggtgcagtgcatgtatgtgtgtgtttgtctgtcttagccggccgctggtcgctgaacctgaacctgaactagctgtctgaatatttctgtcgcctgaatctgtctgaatgatcatctgatgatctgatccgacggtccagagctcgagccaggccaaatgtgtgcaacagattcaatggctggagcccccatcaagattcaagaggtagggacggctgcattcactggcgttgtcatgtcactcagaaaaatatccatcttgacccgggtaatttctcttcggttttcagggttacaaatctcttttggttttgttgaaatataagcacttctaaaatttttcagagagattatttgagaagataagtgaaactaaatgagaaatgatcagtgacggagccagcacagttgtaaaactcaaacgactagtggtgtttttgggtgactggccgatttttatagatgactaatgataatagagacggcagcggcggagcctgggtggcagcccgacctatccgggagttgccttcactgctggaaatgattgcaattggttaaaacaagagagtagtcggaggaattactatatatagtttgaaataaaatttgaacactaaaatttgctatagtttgggatgaagtatttttcatttctccctttaatttcctataggaattgtgtcttcaggttgaaattaagcacatgcagtgcattttagtgagattagagatttgcggctgaaccctgactcttttgagcgttcgtgtgcaatcacgttttctgtgtaatcgtaaaaaaagtataatgcaaaaattttacagcaactttgtaggattttccaacgaacttatcaaattacttctgcaatagccaagaaaaaaccctgcgttcttgaagctgtatatggtacatgatcatcatagccaactttcttgatctggataatttgtatccaaggttaagcagagtgtgacaactaccaggggcatatcttagataccacaattttgcaaagatttctggaagaatatatacaaatacagtgataggccaacaacatgatggtcctgatgaggaaacagtctgattagctacatacaaatcgccatgtgtgttctcctcctgtcctgagacagtgagacaccagagattcagaaggagacggctaatgacagttttgatggattattacatgcaagccacacacctgtgctgaatgtatgcatcattatatcctgcttagacaattctaatacccctgcaggagttact

SEQ ID NO: 15804 - DNA, 1501 bp, Oryza sativa
cggcgccgcctccgtcatcgtcatcgcagcggcgtgttccacgtcgtcctcgtctccgtgcagccgctgccggctgtcctcgtcgcctcctcgccggccccggtcatcgtcgtcgtcgtcctctcgtcgttcccggtcgtcgtggcgttcgtccctccgtcgagccgttctcgtccgtcgtccgcgttcgtcaagcgagccgctgcagccccgtcctcgtctccgtcctcggctccgcgtcgtcaagcctcgtgccggccgcgtctcgcctttgtccaaggatcgccgccgaagtcgttccctcgccgttcgcctccgtcgtccccgagctgtcctcgccggtcccgttcgtcgttgtctttcccacgcctcgtcgcgtggtggtaaggatccgtcctctcgcttccccgccctcgtcctttcggtgtcgccccgtacccgttgtgcggtcgtcgaccccggtacccgtgtaccggtgtcggtagtcgttcacgtgtgcgggtggtgaccgtgtagtgtccgtgttagtgtgcccgctcggtagccgcgtggtttccacgtgtgcaacccgtgtggtgtctagtggagtccgtttgtcggccactcgcctcggttgacacacggggtccgcttccgtcgacccgtggaccgtctctgtgtactcggtctaccgcggtcccttttgttgacacgtggggtccgcatgtcaacggcgcagccttcctgtcttttccaggctagcgcttacacatgttttataattgcaaagcttaaatataataatccgcaaatctccatataacagcattaaacttcggatgatcatatcttggtcatacgaactccgaatcgacccgttcaagtctcttaatgtttgttataacctaaagaaccctgtgctttctttttatgtattgttattgcttctttataggtttgtagctttgcttgtgtgcttcgcgtagtcttcgtcgttccggaggttcccgaagcgtggttcgtggtcgtcgccgaaggttcggaaggccgttctctctgagcaaggcaagtcacatcatccttgagcatattgaatcccagtttataaaattattttaatttaaattaatgcattatcgttttatttaaattcccgcgttatcactgttttatttagccatgcctatttacctttgttatgaccatactattattgttattgttattattaccttgttcaccctagaataaacaaaaccccaactagtggacactctatttatggttccactagtatgaatttaggtagatgcttcgctgattaataggacaacattaggtggttttacaattttagactttgggtatattcatatcatttggtcactatggaattgttggtttatggtggaattggacatacacctctcttcccctttcaaaacccctaaaacctgttttcggtggggtttgggtgcatgccagttgtgggaagtagcaccccggccactataaggattaa

SEQ ID NO: 15805 - DNA, 1501 bp, Oryza sativa
ccccgcctcgccgtcggccgcggcgagcacggccgccgccccgccgggctccgtcgtgcggtactgcgagggcacgccgcgcggcgacggggcgccgccggactgggcgcacgagacgctgctcgagcacgacgccgcgcgccgcttcttccgctacgagatgaacgacaacaacatgggcttcggcgtcttcgtcgccacgttccgcgtcgtccccgacgctggcggcggcgacgcggacgcgccggggtgcgagctccggtgggagttcgagggcgaccccgtgcgcggcacgcccaaggaggccctcgtcgcgcgcctgcaggccggcctcgacggcatggcggcgcgcgtgcaggagcacctcatgtccgcccgcgccgccgacgccgccgtcatcgccgccggcggcgtcgaggccgccgacgagctcaaccgggacaaatactctatcgcggtctgagtgttcgtccggtccgtcgatcgatcggtacagtacaccagtatatgcgcggttgctggtcaactttatacgtgaactaatttggctgcaaaaacgtatattgttcgatgaaaatacacgaactctgtcgccgtcttccgtatatatgtacgtacctacgtatacctacctacgtatacggtatactgtgtttgtacgtgcttggggtatgggaataaacgttactaagtactgaaaaaaaaaccagtctctagcttgtctctcctcgtgtactgttcgatcgtggcattatttggttttgtaatttaatttgtaaattttattatatggaagtcaatgcaaggattaattttaatgttgactaattcacatgtactttcctgcatgtgcttgccatgtgctgtgcttactattggccgctgccattttgcctcccctgagccccctccgtggaatcaagttaatatgcagctgagtgctgacgtatgcaattgagaactgtattttttttttggtctattttgtaaggagtgttatgtattcacgatgtaaagattatttatctatgagtttcattgactttatgaaacatttttttttacaatatcgtttcccttttgtttactaggcctagagttgtgtgtgactttgcacaagccagcgcaacatgattccgcaaaattgtatagggtgtaaattagctactgctcgaagctaccccttcgtttatttttttccagtcaaatttaaaaaaactttgaccaagtttatatacgtgaatcaaacatattataaaagagaaattcaatgttgtatttaatgaaactaatttggtgttataaatgttgctattttttataaacatagttaaatataaagaagttttattaaaaaatcaaaacgacttataatatgaaacgaaaagaaggatttgcttttgagatgacatccacggtgaaaatcaacttgcatgtcctcctttgctggttagcttatatcagtcgtggtgaaactaaaatttaaaattttgatataaga

SEQ ID NO: 15806 - DNA, 933 bp, Oryza sativa
  unsure (1)..(933): unsure at all n locations
ccatcatcctatttaactttcccgcgagtagccttgtagaactccagcagcccagtgtactgtaattgatcgatcgtatatggccgtgttntagttcgtgtgccaaatttttatttaagcatacggatacacatttacagtattaaacatagattaatagaaaacaaattatagattccacctgtaaactgtgaaacaaatttattaaacctaattaatctatcattagtaaatatttactgtcacccgaccaccaactcggccaccgtcaccggcggccgccggctcaacattttcgagggccctaggcgaacttcacactatatgcccttaagaagttaagagtattttttttaacttgtaatatatactctataaaccacaaatactatagtaacataaataaacatttctaacgtggtaaataataaatcaagcagtttacaagttgcaatatagtaatttgtttcgataaaataatatcgatagtatgattgacaacttaaaaaaacatagtagaaacaaagtactatgacctaaaatcagtgagggaaaaatctatataatcaagggcctaggcctaatgaaaactaatccaccatataccttaatttaattagcttatggacttatggtgcactgaatggttgtatacttatattgatcccttgaacggttgaaccagaatggtagaaccctaagtccctaatctaggtaatttaatggggaacaaaaaataaattaaaagaacagttcaattcgaatcagtgaagagaatcgatggattggatcatcacctgatctagtgagaaggatcaatggattggatcatcaattctaatcagtgagaaggatcaattctaagctattgggctaaatacctatatagggtatatacctggatcggagcctccattttggctgggccctagg

SEQ ID NO: 15807 - DNA, 442 bp, Oryza sativa
ataagaaaatggaaagagacgataaccaaaagctaaaaaagctagagcttgtcctatcccactaccaaccacttacctgggtctgacgtgtcatggcctggatatgcacaccttttgtgttattctaagccaaatcacccatccatgctaccatttggcctccccagatttgcaaaactattctatggtgatcttatcaaacacccccctccctctcctccttttgaacacccaacatacacagccttttgttattctaacccatcaccaatccctccttttactggacaatcagcttttgttaataataccaccaaaatcccacttttcctccacttgataatggtggtgcccaaatgcaacggctttgtgttttaatcaaggttatcagggagcactaggcatatttaagatgtaaattggcaaggaaaagcatcaggca

SEQ ID NO: 15808 - DNA, 889 bp, Oryza sativa
cagacaaaccctataggtgcccgcacgaggctgataagagaagtctaaacgttatctctaaactcaccgagaacggtcacatgagctcgataacagttactccaaggtctccgcgcggttgagaatatgaattcgttcatttgcattgaagtcgggggctactgtcagggttatggataccacatacctaatagtagttgactaaatctcggcaggactcaccacataccatgtcctatacggaaacaacctacggatataggaggagttccggacaaggaaagacaaccagagttctacatggaaacgacaaaggactaatcggattgtatccatattggtttccctagttctacttggacaaggggacacctatgggtataaatacaaggcccctaggaggagaggggacacaatcgacacccaccatagaagacacggacaatacacacccaccacaatatatgggcaacatagacgccacaaagccacaagccaatataagccaacatacgccaagacaagacgccggatatcgacttcagagataggcacggctagtcccctacggtgtctcaggatactgtcagaagagacgaaagcgctatctctgatctcgccgggcacgggttcgaggaggaaggctaccctgttgtcgactacgagtcagatcgtcagaccgccatgtcgacaacagttagataggctaccccaaatattatactggtgtgattatcatgaataagagcaataccggcttcggccaacagaatgtagggttattacctgacaattcaggggcccgaacctgtataaaaatccttgtctccatctcttttaccttagtctcgcgtatatcctagtaccaacgatccccatgccatgcaaa

SEQ ID NO: 15809 - DNA, 1501 bp, Oryza sativa
agtttggggaataagttccccaaagatccctcaactaacaacgagattttttttaggtcccttaactataaaaccagaaatgtgtacccctaaacttacagaaaccgtacacttaaggtcctatggcagtatatataggtggtttcgctgatgtggcatcctagtcagaaaaaaaataaaaaaaaataagtgaggcccacatgtcagccgccctatcctcttttcctctccttatattctcttttctctcttctctattctcttctttggtgaggggaggccggtggcgggcggcaagcgagcgcgcaggcgggcggcgcggagcaggcagacagatgcaggcgcggcagcgtgcatggaagaagcgggagagggggagagaggcggccgggacgacgggagcggcgggtagggtggcgggcggcgcggagagcggcgagcgagagtggcaggcggagtggcgagcgagagcggcagcggagtgacgggcgagcgaagctggacatgggcggtgggcgagagtggcggcgctcgtcatgctccagttcttcaccgccggcggcgtcatcgtgctgctcgacctcctccacgagcgcggtagcgcggagcatcagtgggcatacggcggcgagcgagtgctgcggagcgaggggcctggtcggcgagggtgatcagcccagtgtcgcgctcgcctgtcttctctgtcgtcggccgttgctctccccctttcctcgtcgtcgttcacgcatgccgtccaccggtggcacacctccaccagcacaccaatttacggcggggcgagctcgcgctcaggccgggtgagctcgaacgggctcgccagccgcctccctctccctcccaaaccgctccgcccagcacccgccgaccgctgccgctctcgcatgccgccgtcgctccgctcccggcgcctgtcgccgggcttgcccaccgtcgctccgctcgccacccgccacctgctgcctgccgccggcctcccctcaccgaagaagataagagagaagagattaaagagaagagaagcagaggaaaagagcagagggcggctgacatgtgggccccacgttttttttaaatttttttgctgactaggaccatgaatgcattgtttctataagtttagggtacacatttctggtttttgtagtttagagacctaaacaaaatctcgctgttaagttgagggacttccagtgaacttattcctattggtaatccccaaacgagtcatgaggagcccaactcagcccacgtacaccacctccagcccaaaccaaaccatccgcggaccctagacccacgcgctcaggccatatcagccgtccatctaccatccgacgccccgcaaccaaacccgccgctgtataaatccgctcccatccgctcctccccaaaaccctagccccccaagcagccgcaccctcactccctcctctctcctctcctcccccccacggcggcggcggcggcggcggcggcagga

SEQ ID NO: 15810 - DNA, 1501 bp, Oryza sativa
gttgacagaatctttctctatgcgtcaaatatttataactaaaaagagtattagcgctttctaaccagactttgcttaatggttaaaccttttccagttggttaatttgaatttatatatacggatctatatttcaaagtgatttcaaataaaggattggctactattaaaaaaaagaggagactttggagggataagacatccctccaaagtccaaacattttttaagaagaaattgtgagcgtccacccttgaccctaccttgaaccctaaaccttaaattgttgagtcgctgtcggttgccttagttcattagaggcactgaagctagaggagaacgagctctcgcacgaattgtgaagcattccctaatgtaagaaaactacaagattatagctagcctccacctttttttttttgttaaatgtgatgtagcaattccgtctaaatgatgttggtggctgttaagttgcaactaagaatacaaatcacaagaaatcaacggtcaggattaatagtgatttttttaaaagaaaaaaaaacgtcctacagaagaatttaaggacggtcaacctaaagctttgacctttcttgttttgagaggagggttaaatttgggcttgtaacaggcctttcctaactagtcaggttaccaaattgggcttgggcctggccacgcactggtgatttacattagggcccgttcaataggtctttacctggcccattaaaggcccatgacagacgtgtcttcctatctgaaaagaagattgtttgtttttagaactgaaaagaagattgtcacttagcccaaaagttattgcttatcacccaacgttctaatacttaaataaaaaaatatatttaagatatccatgtcaataatgaaaatatccatgtgaatattaacatggcatcccctcggtctcttcattttctctttagataatggataaaccccgacatttgctctaacagaatctatagccattcttgctctccatcatataatgtataaaattaaagtttcagaaagaaaacacaacatacaatttcacctatgcctcaaattatatgtatactcaaattatcttttggtgtatccgaataatgtgttctctagccaaattataatacttggtcaaaactaatgaacatcttttttttcatctaggccataacacagttggtactagtttgtgtacttgtgagattgcaaatatagataggagtatatatgaatatataatcttggttgtctttgaatacacaaagcctagttaattagacacgtggcataaattgattggttatgtatgacaatacgagtccctgaacgactacaaatacctatgcgaaatctccaaaccgcgtcacattccaaccccaaccacgcctcggatcaaaataagaccagaaaaaaaaaaaccctcaaaaatccctgtagaaaaaagagtcgatgactcaaaaagagagtagagaagaagaagccgagagatca

SEQ ID NO: 15811 - DNA, 1501 bp, Oryza sativa
acacaatgtagtgatatggttatagatgatcgatcggtctagcatcgagtaatggagatatgattctagagcatcatgatcggcggtttctagtctgcgtccatctcctcgagcgctgcctgggcggctgccttcgcctgctccacgaggtcgtctggaacctgtattgacagcccggtaacagagttcatatttcacatgataagggaggttctatttatcaagggagaaggcatgtttatcccttgtatataccttctcatgctggcgctttgattcatcgcatacccagctcagctccagttcaaagtctttgtctttagcttcgtcatgcactccatagattctgcattggtacaaagaaaggtcacaggcgagaaaaagaatgcagatcttcattagcttggtcaacatttccttgtagaagttatttacgtttttctgatttgttcacatggtagatggtctattatgagtcatgcatgactcatgagtcatgagtaccaacagtcccactgacaagacaaatctatagcacaacaatttatgctcagaaaaaaatctcaaagctacatattattgtcaatctgtagtgcaatgcaaccaaaactggtgctcatagatcatggtacagtgattattcatgtgaacaaagtaccttctgtacttaaatcatccaatagatttttatttgttctagaggggaaaattgcattagctgctggtagtcgacaaataagtgcatagcaaattttaaggcatccatgacagtatgaaacaaactttcacttgtgagctctaagagggaatttgcagattatagtaaaaggttcaggacatacatctttgcaacctcaacaatgccttctctgcatgtaagctcagaaagattcagtttctctatctccctgtacaacatttaatagatgtatcagaattacaaaccattgttcatgagtcatgacaaatagacagccaacatattcaaaagctgaatcatcttttcttgaaccatcataaacacatctgatgattgccaacccattccttgataagcattaaaactacgaaaaagctaatatatggttcatcaaattataatctagagtttgggtcagttttcccttggcagtcattcaacaaccaacaccaattctagaatatctgtgatatattaatgaggctattgtctagttaatatatcaaaaaggtgacagaagtgcaagaagtgccaatgccaaaataagcatataagaaacaaagattagatcaacatcttccaccattgaagatggaatactacttaaggactactatatatgcaagatgtgaagagataacttgatgtatatagtaaaaatacaaaagaatatgctaagttctaaagataattatggatcatcaaatttaacaagtgatgaataagccaccactatttgcgtcctagtaatatgcaacaaaaaagaagttgggcactaatgcagaaatcatacaataaata

SEQ ID NO: 15812 - DNA, 1501 bp, Oryza sativa
gccgccgtgggcacgcgagggcggcggcggcgggggccagcaggagcccggcgccgtcgagctccccttcttcgcctaccttctcgcctccgccatcaccgccatcgccgccgtacgcctctccaccccttcaactcctctcctcctcctcctcctctcgaatcccaaaccctaaccatggcgcgcagatcgggtccatcttcgagtacgcgaaccagcggccggtgttcggcgtggtgagccccgacagcgccctgtacgcgccgctcctagggttcttcgtcttcaccgggatacccacctccgtacgcatcctctcattgccaatctccattgcgaggacatgaatccaaattttccatggattttgattgcttgttttaaaatttttttgcagggattcttgtggttcaaggccgtgcagacggcgaacaaggaggcggaggagcaggatcgccgggacggcttctcgtgactgattcagcatatgaacatacgcatttgcagagtaattaaagtttgtgaattactgcttgtgattcgtggtgttaattaagttggtgacgctgaagaggggagacggatctgcgtattgacgcaatgaggagatgaattagcaaggaagaaatggcgatgttcaattgtacatcaccgaagggagctagctgttgaagtgaaagtgtaaactctgccttgtagttgagaaatattgagtgtttcgagcgagtataattacagcgaattatctgaacactgaattatcgccacggattatttggtccatatgcatctgagagaaactgttttcttagacccgctattctaatctactttctctatttcacaatgtaagtcattctagcatttcccacattcgtattgatgttaatgaatctagacatatacatctatctagattcattaacatcaatatgaacgtgaaaaatgctagaataacttatattgcgaaatgaaggaagtatctgttagtactaagtttgtaatttatactcccaccgtctcaaaataaatgcagttttgcactgctcatgtataacgttcgaccgttcgtcttatttaattttttttgtgattagtatttttattgttattagataataaaatatgaataatactttatgtgtggctaattctttttaacttgttcataaatttttcaaataagacagacggccaaacattggctacggatacccacgaatacacttattttgcaacggaggtagtatacaaggcaactggttcaaaaaaaaaatgtttgtacaggcaacactctattccaaatccagcccaggaacaaaaagcccagcctcacctctccggcccaactgaacgccagcccacggcccggcccaccttcctgcctccgtcgcgtgatcgcgtcgagtcgagtcccggttcgagtcagacgcgggccgcctccctcctcccaacttaaaccgcaccacgactcgtctcctcctctctcttctcccccaag

SEQ ID NO: 15813 - DNA, 1501 bp, Oryza sativa
cgatcaatcgatcgctttgatgtttactcttgtttttttaaaaaacaatctttcaggtttacgccatgcccctagctaccgcaagcttgttgtatagccccggcaggatgtacatttatcatgtcaatcacttatcctatcactgtccttttcaacagttcatgtccatgcacgctgaacatagacaccaatgattttgtacattgccaggtactcctcagcatgtattttcccgtcacaggacacgggacttctctttcctccttggtaggagtacagtactgtactactcttactccgtacagtacaaacagtactgccgtattttctcgtcacacggttttctttcttcgggtgtgtttagttcacgctaaaattaaaagtttgattgaaattaaaataatgtgacggaaaagttggaagtttatgtgtataagaaagttttgatgtgatagaaaaattagaagtttgaagaaaaagttggaaactaaaccaagccttgcttgagatctttacggtgaagtccagtagccggtaatgtgatgcactagtactacttggagtactacgtggagtactccctagctcaaaaaacgttgcaactctcagcacctcccaaaggacttcaaaactcttccatcttcccggacatcaagcccgaaccgtggttatagttaaagaaagaaccaaagagatgataaaattccagtgcagatgagaaatagtccggttaacacatactcctactttgttcatgcatccctatagacaagccatactgtcagttagtacaaacagttcagacatcaacgctggagtacatgatcacctgaccactgcatctggttcccttacttaaggcaatgaggggcataacactcattggattatacagcggcaagcaatgaaaagcagggcagagctcaggctgcagagtgcctgaaaactgcttgcaaattgcaggcgcagccggatttatggccagatcggccacgcacaaatcacagccagttaccataaggctgtgtttagttcagcgcaaagtttaaattttagttgaaattagagatgatatgactgaaaagttatatatgtatgacaggttgatgtgataaaaaaggactaaagtttggatctaaacttgaatctaaacacagcctaactcccctgggacccggacgctaactttgaccgatcacaaatccgggccccaacccaacaaccggcgcgacgatttgaaaccaacgtgccaatccaatccaatccacacccaagtactgtagaagtgtagaagtaccccaacactaccaaactcttttcccttgcctcggaattctcgcaattaacgtgacaagttatactaccactaacatagcagagttacatacagatcaaaccaccacgcgcgcgcgtgccgcgagctcagagcagaaggcagcagctgcagcacagcgccacggcgaccggccggatgagcagcagcgctgaccagcggccgccg

SEQ ID NO: 15814 - DNA, 1501 bp, Oryza sativa
cgtgcgccgcctctcggtcgcgtgccgccatcggccttccatccctttccatcctcaaatcgccgccgataccgtttccgcacgccgatgagctccttgcccaaattcttgccatttgcatcatcttggataagccccgagccgttcggttgctcgctcgtccccctaaacatgccgccccgccgttgctctacttcgccgccgccgccgcgcccgcctgtgcaccgccgtgggccccctcgccaatccctcgcgccaccaccgtccttgagctccctaggacctccccaaaccattccctagcgtcgtcgccgcccggcacggcctcgccgccattgccgcacgctcccggagaccgcctctcgtcgccggacctccacggcgcctccccatcccatccgacgccacaaacgagttccctgagtcctagagatgctcccacccctttgagtcaaaccctcatcgtctcatcgtgttgtccccttttgctcgccgccggtggccgccgtcgaaatccgccaccgacgggctcctcccggtgaatccgagctgacgaatcgctccctctcgcccctaccatcggtccggtgtgctccccttgagctgtagtcgctgcgccatgtcccggtgaagccgccgccgccagccgttcgtcctccggccggccttcttcctcctctcgccgcccacgtggccgccacataggcgccacgtcggcttgacccggtcaagccggtcagccatcccctcctccccgtgcgcgtggtccactgtgagccgagcggctgcacgtgggcccgccgctctcccgtccacccggtgcccccccgcatgagccgcatccaccgatccgctccgccgctctcgcgtgcacctcgctcacggtgagccgagccgccgacaagcgggtcccactcaggaccgcgcgaggtgagcccggtccacccggctccccttccccccctctctccccgcgcccctctcttgggccgcctccccgtagcccatgccagcccaataagctcggccgagccgcgcagatcctctcgggccacgccaagccgctcgggaaagtctgatttctctccctcgtccattttctttccaaaaagggtttaataaattattaaatcctttctcctttgattagaaaatccttagaccttagaaaatccatatcttcccaaccgctcatccgattgacgccgttctacttccagtaattccctaaaattgagatctatttaatggcactattaattgtgtaaataggatctttcttttggtcttttgtttaggtttttgattatttgcgtatagttgcggtaaccgagatattagtcaatcgtggttttctcgaagattcgtgaagctccgtgaagaccttgagcaaggcaagtcaccctttgatcaattgcccctataactggaaaatcattattattttgtttgcaacttgcattagtagaatcacacttaacttgcttggcctcggtttgca

SEQ ID NO: 15815 - DNA, 1129 bp, Oryza sativa
ccgggccacccccgggggagatgggccgagagggaattggcccatcgaccccgggggaggcaaaatagacttttgcggaggaaaaagatttggaagaatttggattcggaattgaactcaacgatagatcggggattgagatcttgagatggcacggacactagacgacaagcgaagaaacaaatttcgcaattagggtttttaagagataattttcccgctaggcgccacgacggaacgggcgctacatgatgctattaccttattgatctattatccagtggatctattaccttatctttttggctgtgtatccacggacaaaggccggagatataatttatttccattatcttaaaaaaaattgtccagtggatgggccgggcattggtcgatggagctaaaaacggggataaagacgaacaggcgtttttggcaacagctcctcgatccccaacagccggtgcagtgagactagtcgcgggagtacgtgcgcggccgtctaaacacacgatcgagacgtacgcgcatgcagtacgtcggcgcctggctgctcggctcgccaatgtgtctgctgcgccggtgggtcggtgggatcgacacagtacgtctcgatcaatcgtgcaacgcgcgtccatgctccatatatcggcacgaggtgcccgcgcgcgcgtagaccacgacgtccgatgcgagagcgctgcaagtggccggcgagctccttccttgccgatgggcagccacagcccacacggcgcgatccgcgtggagggagttcccactcaacctcccttctgcgtagggaatgagatcctctgcagtcactgcactttacctttgttactgacatatgggcccagactcatatgggcccacatgtcagtgacaaaaggtagaaagcagccaatgcgtgtccatgatccatacattgggtgatgagaaaaggctggaaggctggccttgtttggatgggcccaattcaggcctatccacgtgtgggacagcactaattctctttacttttgtttgctataaaatgagggggaaaagaaaaatatgagattacttggactgtaaaatatagcgttccggagtccgaagcagaggttcaccaacattcccgagcgaa

SEQ ID NO: 15816 - DNA, 1501 bp, Oryza sativa
agctcctcggggagccgctcgagggccccggccatctctgagaggcgctgggcgaggcccccctggttggcggcgtacttcgcgtaccgcccgccccagaggcccgcctgccgcccggcgcggtctagacgggagacggcgtcccgaagcatgccaggccctacctcgctcgccaagcggagggcctcgacctccccggcggacgagtccagcgcgccctgcagctcggcgatggtgtgttcggcggctgcgaggcgggcggctaggtcgccgtggcccgcggccgccccgccactgtgcgctctcgcgtccagctccttcgcccgcgcctcgagctcagtggcccgctgatccagtgcggccctctcggcgcgggcgccttccagattgcggcgtgcctgctcctcccgcgctgcctcgcggaggaacaggctgtccgccagccgctgcgtcgcggcctcggcctcctcgagagctcgcccccgctcggtgagcgcgtcctcgcggaggcggagtgcggactcctcttcggcgcaggcggcctcgtgcgtcgccagtgttgcctcccgggtggcgacggcggcctcgcggtccgccaggtctctctccttcgcgtccagggcgtgggggcgctcctccagcgccgtggcgcgagcctcaagggcctcttcgcgctgccgggacgccgcctcgttctccgccgcccgccgttcccgggcagcggcggcgtcaaggacttcccgggcggcgtcgagcttctcctctagctccgccgcccggctcccgtattggaggcggaggtcgtcccgcgcctcgtcgagcacggcggtggcgatgagggcagtctcccgctcctcctccacctccctggcgaaacgaaccggctcgtcccgattcgcgcgctgctcgagtaatgtagcggtcttgaagaggccgctcattattgtcggccggttttcccttgccgatgcgcgcgatttgcgaccgctgggtttctgcccgcctgtagggaccggccccacctgtcaccgggcctaaggagtggcgtcacgcccgagcgcttccctcaaggggggcgatcgccctggcgtaacgccaggggctactgtcggtgacatggggccgagggtatcgtgactagaggcttgggtagccgcggtcacccacgtggcctgaccccctcaggggggtcgggcccgagggtgacgtggccacccctccctctgtctccccgaagggtcgggccgctcccgtttcggccccgagggctggggcgccccgaccccctgtggttttggcgccacgtgtgtgggttaggtgagcccaccgggctcacctaaccgcatttatagcaggttggacgagcgcgccacgccgcatttaatgcggcgcagcgcacgcttatccggtccgtgaccggtcgcggtgtgtgaccggtcagagatcgcgggttaggtggcaacaggcggcctgtcacatgcctcgccccgtcccgtcggaa

SEQ ID NO: 15817 - DNA, 1501 bp, Oryza sativa
tggaacaaacaaagaaaccatattccgagaccaagctatctccaatttgactcattagtagcaaacaatagtattacatacgtatagtatccatctagaagtcataatcatgaaataaactcggatatccaaataaacaacccgaaaccgaaaccgacacagtgtcggccggtcagaccgcgggctgcgccggtctgaccgcgcgatacacaccggtctgaccggctaccagagcccggtctgaccagtccacataaaatgatagatcctgcgatcacctgtaaatccgatcatctccaaaaccacttcgtgaataaaatctaaataacaaaaccaataatctccaatgcccaattatttatcatagaataataatcaaaaacacctgtcggtgacatggggctgggggtatcgtgactagaggcttgggtagccgcggtcacccacgtggcctgaccccctcgggggggtcgggcccgagggtgacgtggccacccctccctctgtctccccgaagggtcgggccgctcccgtttcggccccgagggctggggcgccccgaccccctgtggttttggcgccacgtgtgtgggttaggtgagcacagcgggctcacctaaccgcatttatagcaggttggacgagcgcgccacgccgcatttaatgcggcgcagcgcatgcttatccggtccgtgaccggtcgcggtgtgtgaccggtcacagaccggtcagattgcgggttaggtggcaacaggcggcctgtcacatgcctcgccccgtcccgtcggaatgatgagagcttcctggctctcgtccctagccggagccggcgtgctaactcctggagttggtatgtcagtcccggtcagatccattccaggcttcagcgcaagtatggcaaggaagtctttggccattaaatgaaggttgaaatgggcgtccaccggaaaagcgggcgagcggggcaggaggcgtgtgctctgcttgtcagaggtcacttccggctgtagactagccctcattgtaaaaagcatgtttcctttcttaggcagcaggaggcccatgtggtgaccccggaacagataaaaaggaggcccaggcctagaaaaagagaaaaagagaaaagaggaagaggaagcagaggggttgggactctggcgaatgggttctagagcctgaactctctctcgctctccggctctctgtattccttcacacacagatccaccagaacacaggagtagggtgttacgcttctcagcggcccgaacctgtatacgtcgcccgtatcttgtgcatttcctctctcgctgacgttcctcagatcgagggcgaagaacctcacttagcgcccccggccgaaccggcaaaggggggcctgcgcggtctcccggtgaggagccccacgctccgtcatctggcgcgccaggtagagggcgcgcgtgtctttcgaagccctcgtcctctttcgtgtgcgccaagcttctcccgctcagcccaa

SEQ ID NO: 15818 - DNA, 1501 bp, Oryza sativa
gaccatgcatgcacgcacgcccgaggagcattcagcaccaactgcgacacacggccagcgtagcgtaaatgtgtaatggcacaggatgtacacagcggcatgcatgcatctccattgcactgcactgcactgcgatactccatcgggtcagtgtttcagccggccctcgtgcatgcggcagcactgccactgcccccactgcaatatccgtacacgttccagttttacagcaagtccgggtaggagtttcagctcggtttgttgttggtctcagattttatcctctcgctttgcttcgatccgcagagattttcactttgattccgttgtgctttgatgccatcatttttcccctttgctttgctcagaggccggtggtgacattggaaattcaggcttgggagttcagactgaaccatgatctactctgctctgcagtgctgtaatctgaagaaaagagagagacacactggtacaaacagaggcatccaaactccaaaccgaacgtatatgctgccagtattagctggttcgaagttttgaactgatcgaggactccacatcgatggccccccgcacacgaatctccaagccgacccaaaccaatagtaacctggctcgtgcaggggcaaccacctcgtgatacgtacacatatccctcttggggcccctgcctccctgctcctgctacgagctgatgctgttgctgtttgttatccattggaagactcagttaaggttcaagtatactagtatcaagggcatatgaaaacacacatcgtgacgagtatatgcaactatgcaagcaaacaagtggggagcctatcctatatacaaggtcctcacgcgtacacaccatgtacaccaactaaaaattatcacaaaaaattctagaaaaattcatacaagcatgcaatgtcgtacgttcaaattcattctacatagaaagtaaaaaaagagacaaaattctaatagaattataaccttaaaactgttatattttttaatttttttattacggctaaaatataatgaatttagggttaatattttatccctaggtataatactgttgaaaatacatatatgaatttttctagatttttttgtgacatttggtagttggtgtgtacgtgtgtacacgtgagagctggtgtacatataatatgttgccaaacaagtgtaaatggaagcggttgggtaatataaggttgtttgtttgttttagattattaaaggaactattagtgtggattatctaaaaccaaatatttgaaaaaaaaaagttaaacaaatactgtagtttaaaacaagtgatcccaatactatagtgaaaaagaattatgttgaaaaaacgtattctttttgagtcgtgaagtattttaataactcagtgaataggctgaaaaataataagacaacttgtggtttactactgttgagttgccagcttaaagcttgatcggagtaaacttttttcggtccattttaatacgctata

SEQ ID NO: 15819 - DNA, 394 bp, Oryza sativa
ctgtcggtgacatggggctgggggtatcgtgactagaggcttgggtagccgcggtcacccacgtggcctgaccccctcgggggggtcgggcccgagggtgacgtggccacccctccctctgtctccccgaagggtcgggccgctcccgtttcggccccgagggctggggcgccccgaccccctgtggttttggcgccacgtgtgtgggttaggtgagcacagcgggctcacctaaccgcatttatagcaggttggacgagcgcgccacgccgcatttaatgcggcgcagcgcacgcttatccggtccgtgaccggtcgcggtgtgtgaccggtcagatcgcgggttaggtggcaacaggcggcctgtcacacgcctcgccccgtcccgtcggaa

SEQ ID NO: 15820 - DNA, 1501 bp, Oryza sativa
ggaactcgccgatcaccttcctcttcagccagtggtgcgtcacgcggaggccgcggcggcacgtcttgcagacgcagtcccacctgccgctccggcgaggggtcgcccaccggcggatgacagggattctggcgaggaagccgccgaccggctcgtccggcatcgggatgcacgtgatgacgccgaggtagtcgtcgccggacatgtgctcgaagaagaagagcgtccgcgtggcggggaggacgaaggcgaggcagcggcgccattgccgccggcggcggcgagccacgaagttgccgtgcgtccaggcgccggtgctgcagtgcgagcgggacagcgtcacgtcgccgccgggtgcgaggtcgtgctcgtcgcccgggtgcagggcgttgtagtggtccaggcactcccgggcgagccgctcgttggatcgcttctccctgagggcggcggcgacgcggtcgtacgcgcggcggatggggtgctccactggcgtgtttcgtcgcgaccatagcgctgcctcctcgtcgtcgtcgatcatggctctgctcctgccgccgatcagggcctcgccgagggatcgcgcgacgcgatcgaccggtgaatccgggagcccttcatcattgtgggcttcggtttcggccttgatagttttggtgggctggatatttcggggcccaaaactgctagttttttttcctttttgggctagaaggggagccgcgcgcgcacggcacacacccccgtgcgctgccggcggtcttcccgccgatcagctcccgctccggtcgacaccaccattgccccgatccggatgttcggttctggttagacacttgtctacggcgcattgcacactagtgaccgatccgtggactctgcgcgtcatgagaaatttggatacatgccatcatcaaaagtaggcttcgccgaaatgccgttgtaaaaattccaatttgatttcgtggaatgctatttccaacttaggggccgatgccagaatgacatttcgaaatttcttccaaattaaaatggtaacccaattttcctcacatatgcccataccgaaatgcctctagctaatttatcctctcgctccccactttgtctggcgaccggtggtgatcgacgccgttcatcactgcaggtagcctgtcctctccatactagctccactcttccaatgctggactctctactatcttagatctctttcctttgctagaaagttttttttttttgaacgactcgcacgagacggtgcgaagttctattgatagagcaggaaaaaattacaagattacaaccaaatataccaccacccacacggcgacatcgccaacaacaagcccaggagaaggctaacaccggaccggccgctgctaagcgtgaccgaccgccactagaccaacaaagggacacatgcgagattgcccctataggatgccaaaacaacgtcttcaagaagagaagcgacggaaaaactgctgccgtcgtctgt

SEQ ID NO: 15821 - DNA, 1501 bp, Oryza sativa
aactggtgagtatagcttgatacattgagcactgttggtttgtgccagtgaagcacatgtggctagttgctgtgtgtgtgacagtgcaaggaggcaggccacccacttggcatccctctttgattcctcctgttcatttgaggctcaggtggggcacagtgagaaagagagagagagagagagagagagagagagaggccatcttgtgtgtgttggattattgtgagtcttgtctttcttatctatagttgcttttcttcattgtcttttggtttaaggtcctcattttccaccagcgcttgccagggaaagtaattctggaggaagacacagattcttgagggaaaagaggtgagattcttgatttcagatacaagaggagtagagtggttctttgtcccctagccctaggtaggtgaaaaaaagcttcctttgctaattgctataggtttctttgtataggtgccccacagaaaagaaagaaagaagctacttgacttgacttggtataggttcttttcctgcccctctgatttgatttgcatatgctgctgccaccattgcagtgctgctaacatggaagaaataatgcagcagccttgaggtcaggtagtagtagttcttggtggtgtggaactgtgaaagatctgagcttgtaaaatctttcatggtggtgagaagtgaaagtgtgaaactgtgataagatttgagattgtgaaattttgggggtggttctcttgtcatgatgtatagtagggtccagcactggactggttgatgttgttggcttcaaaggttagggatagagaaagcctgaagaggagaggtgtagtaggatataagatctgagaaagccagagatgagagtgaggagaaggcagtggtgtggccaagcttgaatgctccagtgaggctgcttctctggctgccaagtctgatggacggcgccgccatcgccagatcggctcgccgcgatcagtggagctcccatgcttctccagggtgatgctgattgagagagagagagagagagagagagagagagagagagaaacagtttttttttttcaggaggaattcatcaggaatctgctgtgctccttttctctgggagagaagcaaagagcaggtacttcactaccccctccccccactgttgaggtagttgtgctttgcctttcttgcatctgaaatgatgatgttgctgttcttgccatgattgatgattcccctgataaagctaagctagagtctgcatatatgggcattcattgatactcttggtagcacatcttgtggtggttgtacttctctctcaaacttcaatgatgcacagttgagtcaagtgtcagctatgccataaatctgtcctgatttctgcaacttctaattgagttatattttctttttgagtatctgtccttctcatatttcattttgttgatttaaaggttggagcagcagcagctgggatctgtaactggcatgggttcttttggga

SEQ ID NO: 15822 - DNA, 1481 bp, Oryza sativa
acaaaggaacacgagcatccatgctcaacaaggctggagcagctgggaactcgacctcgacatcagtatcccactcgaacttgctatcaatgtcactaccataagatagtggcaacagtagcaagttccagtgggatacggatgtcgaggtcgagatcccatattctccggccttgaggaacatggatgttacatatctgctgacgaggaggacacagatagaacacacaggcaaccaaaacccttcctatccttagattgcatccaagatccctaacgttatcgtcagcaaactcctagattgcgtccaagatcatttcgttagggaaccctttcccatagatacaacaaccagctttggatactgaatttatgggaatggggttccctaaagaaatgaccttgaaagcaatctaggatattggtaatgataacagatttctagacatgtcttatttgaacgaaatgttctgtttaccaatttgtcttggtcggtaccgtgcaggcagtaacccgaccaaactagatttggcaaccggaacacttcgtattctcctaaatgccataatttcactaacttcatttaataacaggcctatgcatatccatcccatttccctcaaaatcacccaaaacagcccatagtacacaagtcatgacatgtaataagtttggcctcagttttgctcattttctttcctaaaaaaaacaacaagtgtagatggtctgttcttgttgaaaaaacccaaaaagaacaagtgtagatggtatgttgttatgcgttaaaaccccacatttaaacctaaacaagaaccagagtgaggctggcccaaaaatgcatccatttttgcaaaacatcccttactgccactcctcccaaaaaaatgaacaagagtagatggtctgttcttattgacaaaacccaaaactcacaagtgtatagggtctgttcttatgcattaaaaacccacatttaaacctaaacaagaacaagagtgaggccagcccaaaaatgcatcaatttttgtaaaacatccaatactaccactcctcccaaaaaaaatgaacaagtgtagatggtctgttcttattgacaaaacccaaaaatcacaagtgtatacggtctgttcttatgcattaaaaacccacatttaaacataaacaagaacaagagtgaggccggcccaaaaatgcatccattttgcaaaacatcccatactaccactcccccccctaaaaaaatgaacaagtgtctgttcttattgaaaaaacccaaaaatcaggagtgtatagggtctgttcttgagcaatcatcattggccattcatcacaaatacatccatcacagcccccacagcatcccaacatggcatttcccccaaaaatcacaaattaattccatcacagcccactgcatcccaacatggcattttccccaaaaatcacaaattaattccatcacagcccactgcatcccaaca

SEQ ID NO: 15823 - DNA, 1501 bp, Oryza sativa
tatatcacatttcaataaatattgttatataaacaagaagtcaaagttgtattttagagaccgtttcgctgtccaaaatggcctcctttacgagtaaggagggagtattagagttaacatgtatttttcttctcctatgcatttaatgtattcattttgaagtatgtgaatatgcgtaagctattggttagctctactattaaacttgctcttaaagcaggtataatagcagactataagccatctataaacacatttcgaggagataaaagaggagagagaagagtaacgggctacagatttgtagccagctgtaacacgaactacaatacgcaatgtgtgtatgatatgtgggtccatacatcaatagtgtaatatatgtttataggtaactattgtatgtattggctattaaattgactatacatgatctgaaacccatagttgactatactgttaaacttgctcttatagaacctatttaggctgcgctcgtttgtaggggttcccaactttatcctttcgtttttcgcgcgcatgctttttaaattgttaaacggatcctagtaggaaggtttagcgcattttttgaaaaaaaaaatctataggaaagttgtttaaaaaaatcatattaatctatttttcaagttagttttagataatattttaattaatcatgtgctaatgtgtttctccgttgttcgtgctggaagggaaggttcccaaccaacacaaatgaacagtcttaggctgttcgtttaggatggttgagaactaatatattcaaatgaacacagttttagctaatatttaattaatcatgtgctaatgagctactccgtttagcacaataaaacggcgtggctcattagcacataattaattaagtattagctattttttgaaaaatgaattaatataatttttaaaagtaacttttgtatatttattttttaaaaacgtatctttagcagtttgaaaagtgtgcgcgtgaaaaaaaagagaggtgaattagaaaaggagagggaaaacacagccagtggtcattgcgagttgcgaccggtttgctactagcctagtcctagtaatccctccgtcccaaaatatagcaatcttgtactggatgagatacatcctagtacaagattgctatattttgggacggacggagtactcattagtaccactagctaattggtcgcggtcaatttatataattaattgctaattaatcacggtcaatttataacataccgcaggtccgcaagtgacgaggtctctccggagattccctcgcccttttacccccctcttcgttgtagtattatttacggctaacaaccacatggtggatctatcgggtgaacctacactcacactgacatgtgtggggcctccatatgactggccccacctgtcagtggggctcgctcgctggctggcttgcaagcaacgttagcgcggcggctactccaccgtggcttctgacctctcccttatc

SEQ ID NO: 15824 - DNA, 1501 bp, Oryza sativa
caacaaactgtttcagatgttgtagttcgaactactgcagattataatatcatatcttcattaaaaacaagaaaactaccaacacctattgctaaacctatatctatagttgacgaaaatgtacataaccattgtttctgcgtagaggcttgcaagttgcatgtagtccttgtctttatcaaaaaccaggaacaaaatctccgaaatcagcggctaattgttatgctgatcgaatttcgtgcacatcaccaccaacaaccaacatcgaaccgaagcaaaagataaccaccgccacaaccattggagctgacccgacaaggatattgacaatggttatgaaggttgccactagacagatgacactcccatcgtctcaatcactggatcttgcagacgggacctcgaccacgacctgagctagccaatcattgtcatcgtatattagctcagccttgacatgcccgcgaagtcacggacatgagcttacaacatcggagccgatgccaatgatggtgatggggaacacgaggtgcgtgaaggaaactcaaagccaaagtaatagatgagcaagttgaaatctccatggtgccggggaatacgtactatctccattctacgtgcaatcaattctttaattttgaatcatgataatagattaaaaaattaaaatggccatagtatatggatgggatgcaggtctcgagggttggtggaatgataggacccactaagaatatatcataaaaagtaatagggtaaaagtcacattttacgtatcctatacagttctaccaaaataaaatggcaacatcaaattggggcaaaatagaagatcacactggttaacgtcagtacgtcagcatacttgtactttcggttgtatcctttgtaataatatcaaaattattaaacacagtgtggcacatgccctataccacatagctagctagctagctgctacacatccatcttgtgaaagatcgtcgcggcttcacttctccgcagcgacaaacaagggcaaaaggcacaaaattaaagcacatattgattgattgtatgtacgtacgtacgtacgtactgtgcacttgccttttctcaaacgtgcttgttaacatcatatattgggcagcagtacaatattccttctaaattttgccaccaaactgtccgtttccaaacctcttgttttgcattgcaagcagtcttgcggctctcctcccacacggagaggttgaccattaccagcatgcgtgttgttatccatcgcaaattaaagctgatttaaatcatatcaaacaacacgtcttccgtgcactataagtataatctctcactctctcctctttgatcatcatcagctcatcgatcactagcatagctagctggctgcaaatctgcaaaatgaatatgatgagtaactaatgcgtacataggagagtgtgtttcttgcctatattagtgattagttgcgagcttagctagccatggatcatattggaat

SEQ ID NO: 15825 - DNA, 1501 bp, Oryza sativa
ttgtcaaagtaattccctcgagaataaaaagattgtcaaagccaagccgagtgcctcccattgttctagataccaagacccgactttccaacggggaaacaaaaaattatgctgcttttcctcctccttgcgtgccagctatcaccgttgaactgatacattgtcatgctgacatggttcttcaaaacaaaaaccagaaaaaaaaagaaaaaaggaagaaaaaaaaagagtatatggccggtggttgttggcagattatgtattgttgctgtgaattttaatgctatctcgtgtgatgaagcggtgtttacgttggtgcgtgatgacggtgcagaacatccactgcggggagagcgtgacgatcgaagggcaggcgtacacggtgtctgcggtgacgcaccggtaccagctgcgcaaggggcgctacgagcccagcgagaagcgcctcgacgtcctctccacccggcagatacctcctcaacctctacctcgacggcctcctcgacaagtcctgatctgattagattatgcatctaatctactactactccagtatttacatgagcataccagtacaattaattaaacatcgatcaacttcttttttttgtcatgagagatgtgtatatatgtatctgtaagtaagcactggcactgtaatcgccaacacctgtgtgatggaccaaggatggcgtgctctggatggattcagaggcggagcaacagaaagagactaaattagtttgttcactgctctgctgttctgcaacgaggagtgaatcgatcgatcgattgcacgcatggtgccagagttgtgacgatgttaatggcacgcgtgcttcgcctcattcatatccctgtacttccgatgacacgtcgacgctcttgtgtgttgtgttgatcatgacgaggtaggtaaggtagctagctatagcttgccaagccgtatgggtcgagataaacacttaacaaagcgtgaaggattagtatcttactaataggcaaccttaagcagattccatgtgaatgactgatcagccagcacagtagttagcatatgacaagtgacaacatgcaagactgtgagatttatgaccagtgaaacctggggcggttttgctcacggacaaaatcagcagaaagcggctttgcccaccaacggacggcccggatgcgtccgtcgcggtgacggacgcctttacgctacgtgcgccccatctgggaggggtgccacgtgggccgaacacgacgacgtggccgcgtcagccccctcacgcccgtccatccccgttgctctctccacctggattacgtgaaccgcgtccatacgccgccccacctcgcgcgggccgtccgttccacgcgcccatccactcaccggtccatgcacccggtctactcaaaaccaactccccgaccgaccccccgctcgctacacggcaccgacgtaccaccactgacaggtgggcccgcgagggacaagaggtgtctctaatcccgc

SEQ ID NO: 15826 - DNA, 438 bp, Oryza sativa
gtaggataagaaagaaacgttactagagataaaagggaaacataaagttcttatgggacactaaacacacttttcaaaagataaaaaagactttccaaaagataaaaggaaacaaatagactcttcttaattaatatataacttgccatgccgcatcctccttgaactcagtctcttctggataaactttcttgaataaattaatttccttaaccaaatcctctaagaacccaactggtagcgacttgataactcccattggccgattccagaactctgaaaccgatattgtttttagaccgatgacgtcttcgaggcttactaaatttcactgttaacacccttatgaagaggtgtctcttcataaccaggcacaattaatatgtgctaattgttcactaagccatgcctaatcttcggttgccaatcttttccagc

SEQ ID NO: 15827 - DNA, 1501 bp, Oryza sativa
tttagtctataactttttggttaatgaaatcgcaacaattttgaggaaacataactttaaattttataatagaatatctaaggaaaaagtatgaattacccccctaaactatcgcggtcgaccgaattaccccctaaatctgaaaaccagacatcactcacctcgaactttcaataccggacgaattacccccactggcacaatccaaagcggttttatcctacgtgacgtacacgtggcaatccagtcagcatttcctttttttttaaaaaaatggtggggcccacctgtcatctcacctcctccttctcctcttcccctctctctctctctctctccccccttctctcggcgagcacggcagctcgcggctctacgccggcctcagctacgcctgctacgcgtcatcggccacctccccgtccaccaacggccacgttcgtcttctcccgcgcggcgccgccgccgacgacctgtacgccacgggctgcttcacctactgcgccgagctcacgccgacggcgcgccgtgcaccgggacgggttgttgccaggtccccatctcgccggacatcccctacctcggcgcggtgttccacaccggcaactggacgaacaccgcgggcggttcacactactacagatccgggcttcagtgacgggtcatctgtgacgggccaacgcaactcgtcaaagatgagtcatctctgacgggccgaaaaaatatcctcttcaatatatggctaccagggaggacccgtcacagatgtgaagtcatctgtgacggcttgcacttgtaacccgtcacagatcgtctgtgacgggtcacaaccatggctcgtcacacatgacatgtcatctgtgacgggtgtagtattatgaaccatcacaaaagagaccactcatctctgacgggtcttttaactaacacacgtcacagataacgttatctctgacgggtggtagttatgacccgtcagtgatgagtgaaaattcaaatttttaaattttgcaaaaaaacctcggattgaaacatgtcctatataaaagttgtagctcttaatgatatccacaactttataactaacaacatttctattagagatcatttacatccccgaacatgcattacaagtgatcagatctacttttaaaaacaaaattttgagttttttttcaaatgacatggatggatacatgccccgtatcaaagtcatagaactcaatcagatctacaacattataattgaaaatattttcatttcacaaaatttacatgttataaagtgagatatattttgaaaaatgaaattttgaattcttcaaacaacatcggatgaagatattttctatgtaaaagttataaaacacgatgagatctataactatttagttgataatattttcatttgaagtcatttagggtgttaaatatatgttaaatgattcagacaagcatagacaaaataataacattgggttagtagtcaatatgtgttaag

SEQ ID NO: 15828 - DNA, 553 bp, Oryza sativa
caggtagtggagtttacagaaatcttttaacttgctagtggacgcacgacgcatgttgggggcgaaactgcgtatgaaaattttcgttatcttccccaaattttccacccatatcgtgcaggtattccacagaccaaggatacatatattatgcatatttatgcacgtgattacactgcataaacaaacagttagtgggactgtaacaagacaatcaagcaaaaataggttgtgtcttacgtaagagtaataattaacacagacacagctagctcgtattgtggtttaattgtggattcctactcaaactacacacaatgaacagattaatttggagtagtagtggaatgcagtgaatataatcatgtactacagcagtatattatgcaagtagtccacttcttcagggttcaggggttgccttttacgcctgtataaattggtactcttgcgtagtttacaagcagctcaaaacacttagctagctagctcacaaaagcatcagagttaacgtacactcatctagctagggaagaagaagctaactaagcca

SEQ ID NO: 15829 - DNA, 1501 bp, Oryza sativa
aagctaaacacgtctgtcttaagcgaataacggccttccgatgcatactccggagctatgtaaccactggaaatggatagcagaggtaggcatgagaaaactggaacatatatgttgcactgcaccattctttatattttgttcagctcatacctggttcccacgactctccttgtacactcttctgctacatctgaaaccagtgttactgcagatccaaaatcagcaatctttgggttcatgtcatggtctaagaggatattatttggtttcaaatccctatgtacaatcaaacagtgcttgtgcaggtaaagaagcccctcagctagccctttaattatctgaagtcgcttagaccaatttagcaatgcgcccttccttttgtctgtagaatgattgcaaaagaaatgtactttagagaacatagtaattgcttacatactgttctttatcaaatcaacatagttttggaatcagacttttgtgtgtgtgcatgtgtgtgaaaggtgtttcaaatgtgttgttatcagaagcataataactgctttagtatgtgcacatttattaggaattggattaagcccgtctcgcaaaacgtattaaaaagagactgtttaaaacttacggaagataatattgtctaaactgcctttctgcatgaactcatacacaagaatcttttctttttcatgaatgcaccatcccaataacctaattaggttggtatgctgaagccttacaagctgcaattcacttttgaaatcaaatattgctgcatccacaacaaatcttttgatagcaactgtatgtccatcaagtagctggccctgcaatagaattcatgtagcattctattataacaaatcatattttgggtagacaaggagtatctaacattcatcaccttgtaaacagtaccgaatccaccaattccgacatttctgttctctgaaaaaccatctgtagcatccacaagctgaaagaaaccaaacttcctaaatcctggatagttctcttcagtttggatacaaagtctcattattgcctccatgtccattattttctgttcttgcaggtccactgttactggatgagtggtaaatgaccccatgtcaccaacgcaatttggacaaaagttcaataactaaaaatgagaaatgctcgacttctttgtacaataattagtgacttcatgatgtgcaaaagatatattacttatgtgagcaaaagatatattcatggtgtgcgaaagataaaacttgatgagaacaaatgattttcatcatgcactttatctacttcacctagtgtaaaaaatgtagaggttttttactgtccttggggttgtgcagtaccaaatcctaaccgttgatctggcatcatctaacgatcagaaatcgttcatatctcatggtactgcacctccttattaaagcggtatcatgggtggaagggtacttctgtactttcgcgtggggcatctctttctttcgcgtttcgc

SEQ ID NO: 15830 - DNA, 1501 bp, Oryza sativa
gcacctcgccggccgtcaaagtttatctccttttttgacagattccccgtgaacattcatgagcaaattgccacgataaagaccaaatttgacaacgttggtacgaaatttctcaagaaaaatgtgacgtgtcctaaatttcaaagggaagagattaatttagatggacttactggatgacccggcggcggcggcggcgttcgccggcaagtagaacggctgcgtggagtacctgacgacgcagccggcgttgagcccgtagccctcggcggcgcgcggcaggcagcgcccgacgacgcggtcgcgcgcggtcgccacgcacgccgcgcacgcggtggcgttcagcgacctccagcactgcgccgccgcgtacacccgcggcgacaccgacggcaacgccgacgccgacgacgacgacgacgcgctgtagtagtagtagtccctggcgcccggcgcggccgccgtgacgttccgcagcaatgcggccgacgtcgcggcgaacgacgccggcgaggagacggtggcgttggagcagacggcggtgtcgctggcgtcggtggcggcggcggtgaagttgtcggcgccgtagcggaggaagcagccgtcgaggtagatccggccgccggtggccgggaggcagtgcggcagcttgacgcggctctgcgcgtagcagagctggcagtcggtcggcgagaggtagcccatgcactggccgaggccgtagacggtgtcggcgccctcgccggaggccgcggcgccgaagccggagcgcgtgacgttctggtagatgagctccagcgtgttgacgaagctgacgtcgaagccctcctggtcggccgcggtggtgttcccgcacaccgtggccagtatcaccggcttggccgcggcgccaccggcgtcgtcggccgccgcggcgacgacgacgaggaggaggcaccggaacgcagcagcggcggcggccaaggagccccggcgttgcatggcggcggcgagcatggactgcacgtgtgggagtgtttggtctctagcttagcttctcagcgtgtgatcgccatggccgtctcggttttgtacgtgcgtgttgatgactaagctgagaaaataaaaaagagagacgtccctccaaacattttttaaaataattataagcgtgttaaaaattaagcgcggaatgttaaaattaaaatcacacatttcttatcattacactatcaaatacggagtgcatcttaagtctaagctgagctaaggtcatttgcactgatcagtagccggatggaatggacctgaagtggttaatgtttacatcgtatataataaatatgagaagagaaaaacaccagcaaatttaagtacaatttgtgaatttagttgaatattttgattaagatgtactagattttatcttaattttcgttagcacgtttttttaaactactaaacggtagtagcgaaaacttctgtatagaagatactacaaaaaacgtgcttaaaatttatc

SEQ ID NO: 15831 - DNA, 1501 bp, Oryza sativa
tattctggaaacatgcatatgtaaattaaaactacaatgtcaaacaaaaattagaaattcaactattaaatagtgttttgtcgagagacagcatccctgctttttttttccatgtcatccgaattgacataataaaatatgaaataattgaaaaaaaatcacatgcactcataatttatatgaaatatgccttttaccatggaatcattattttttttaccattagatttatcttaatagatagacaaaaagagaaaaggcccaatcccaaccctcctgtcctattacattatgtccgtacatatgcatgtctgcgccctcccccctcatgcacgagcacaacctcgcctcctattttccttctctcccattgtcctatttttatgcttattaattagatagaaaacatattttgtgatagcaatttctaaacaactataccacctaaactattttttttatctgtgcacctcattagattatttgcagtaaactttcatgagtcgaatccaaattaactactacttctgtcccaaaatgtaactatttttagctaaaaatgcttacattttaggacggatgtagtatatttaacaagtaaaagaaataaattactttagaccatattttggaggctagctattggtcagtcataaatatttaggaaaagccacaaagatttttaaaccatatgattaacaacatgttgcttacattataacaatgtgaaacacttttaagtagttagataacacatttgtggaaaataacaaataccgacgaagaatatttgtggagaaaacatactttgaagtatgacagtgctatccggttaatattatgttcttataagtttttgaaacacgcagaccacaatagatgcccgcgcgaatgcgtattaggaaatagttataacccctcaagccgccacgtggcatcctaaaaatactcccgagtcgccatgtgacattctaataaaatagagaaatctgaccatcgattttcacttaaacaggtgggcccattattttagatcgttagattatctttaaagaaaaaaaaaccctaccgtccctacctccgtgcaggatgcgtattgtacgctccctatcaccccttcttttttttttctctttgtttctttcttctttttttatctttatgaaaaaaaatccctacaaatagacatcatacgagtaagtccattaaacttcttagaaacgcttttaagccaccatgtggctcctacaaacgctcttgagccgccacgtggcgttctgataaattagagaaatataagaaattccaagaaaaaaaaagaaaaacatcgtaccatttattttctctttacacaccattagatctatatatgtaaaaaacaaatgtcacgtacgtccacacctctccctaggtccctcatctcctaacatgtacgtacatccaaagtacgtatgtctccccacccctctcttcatccttccatttatggtagcaaaatttt

SEQ ID NO: 15832 - DNA, 474 bp, Oryza sativa
gatttctatagtaagcagtaactttcatcttgtcaattgtaaattgttttgaaggaaaaaaaatattgacagaaaagtatactactcctgtatatctgaaggtttgcactttcagttatatagatgtatgagcccccacaaagttctgaattcagaatttctttttcaggagagaatttgttgctatccccaaacaacagaattatatgttgacacatatcaaagaccttttaatctactatgtcgagcaaactgtacttgtgagttgtgactcatcatagaaacaatgtgcttctttttaagctcatcattttttaaaaaagaaaaaacaagaacaaacaaactcactcactccagattcatccccatctccaaccctcagctaactaacaagggcacctttctagaactgctaccactttatattgatacatattgtaagatataaaaacctactttatgttcatgtcagga

SEQ ID NO: 15833 - DNA, 1200 bp, Oryza sativa
tgagggagtaataaacatgaatagcaagtcgatcataaagttgagtgattctttatcttggttataatctgaaattccgaactgtgatcttctcccaaacaatatgcttacgtgttcactttcatttggtggcactattctgctgcagcagttcagcaaaaataggaagccttggcaaatagcaatttcagaatcactgcattatagccaatagcagtcatctgatcatgcacatgacacatgactggatatttgcacatatggtttatattgtgatcatggattatttaattaaagtaatcagaaaacaatggtttcaaacacatgactggaaattgactgcattaagcccagtttttgcaccaattaagcactgcatccagctcagggccagtcaggacacaatttacccaataaaactcaaataatgacatgacacaaccaaatgacaggaaaaaatggaagaatatttgactcataaaactcaaataatgctggcgcctcgtaagataaaaataccgtaactctaatcaagtcccatgtcacttttttatctgtgtacaagttactcatttcaatttatctgtttgagatcagtcacagatcaagcataaaaaaatacttactttgctggattcaagggccattggagcatttcctaaaacaagatatgtgtaagtgcaactcgatctgtcaattaacctgacataaagaactgaaaaggttacttggaatttttaaagaacataagcaagaaattcgaagcctaattatatcattatatataaggcagatcttgctctaaaacataacaaatatcagaacattgcagcttgcaactatctgtagccaaatccctgtaacgtaaaactaaatagcagtctaggagtgtttcttgcaaccacctgagctgaagtcatcgtaagtgagcataatcaagagattagagggttggataaggaccaatgtctaacacaaatcagtggtgccgcactgccaccaccaaacccaatctgctgaacattagagggaatcaccaataaaaaagttcaggagcaagaattggaatcgaattaccagcctgatccattgtatgaaccacgatatgttatgatgttgttactgctgcagcaaagcaagattatagggagtgcgagacacgtcggcctcgggcgctccggagaccagtgacggcctgaa

SEQ ID NO: 15834 - DNA, 1501 bp, Oryza sativa
cttagcccgctaccttcctttgtcgaccgccgtactcaacctccggaagaccgtaattgaaagtgaaaaccatgaggaaaattaggaagaaacacatgccggagaaaaggtgatgaaaaaaaagtaaagtacaaacagcggagggagataaaccgaaaaaaaaacgaagaaaaaatcagacagaaaaaaaaagccaaaaataaaaaggaaaaaagggtgaaaaaaacagagggaaacaatcggaaaaaagggaaaagagaaagcggacagaaagaaagaaaaagaaaaaggaaaaaacgaacgggaaaaaagaaaaaggaaaaagcaacggaaaataaaaaagacggaggaatttttagcggaagccttacgcattttttaattgagtagatagatatagatataggtacacgtatagttttttatgagtaaatttcataaaactccatctattacggttaaatcacagggattgtgacacatgacacataactctacatattatggttctaagggcccctttgaaacaatggataggaaaaacacaggaataggaaaaatgtaggaattgaagttgtatgtttttccagtcctataggaattgaaaacacaggaaataaagagaagagccctttgattatagggtaaattggaaccatgccattataattttgtaaagtttgagatatgccatcggtatctcagtgacatgtaggacacacatgagtcaatgacatgtgggtcaggatgacatatcttaaattttgcaaaattataatggcatggttccaattttctcttgattataccacaggatacactcaacaaaggaaagcttcacaagaggtctaacctcttgcttattttcctatggaattgatcataggaatgcaatcctatggaagttttcctatctcttcctatgaatcaaatagctctataggaaaaaatccttaggaaaatgaatcctccaaaattcctttgctaatcctccatttcaaaggggccctaaatttggaccataattagtggggttatgtactctaatggtggtctatcagtttaaataaaaatcagtgattgagtttttttttcttttcaattgaaatttcaaggattttatctaataatttattagagtaccatgtgaacgtttataagagtaccttgtgaaggcttaggggcgtttgtacaatctttactgggcttttagtatataatagatagataattgatttccatttgatttgcttgtcaacatggatgcttcttctgaacttaagcactccaaagttacttagaaccgtagcaagaactttgtcatgtattccctccttttcaaaaatataacatctacaatgcattctgctactataattctaaacaccctaatacagtatgacttgataaactttagttatataaaggaaaaagtacgaattacccccaaactatcgcggttgactaaattatccccttgaacccgaaaaccagacaatgc

SEQ ID NO: 15835 - DNA, 1501 bp, Oryza sativa
ctggaacttattcatgaagatgaaatagatgatgatgaagacgacttggtgagtgctgacattgatagtgaagatgaaccctggtttaagcagagagtgcaaggaaagaatggaaccattctaacgaaaagaccaatatctccttcacaagaggaggaagaactgaatcagaggtgcagaagtgccaagctcagagttattcagaaggcgtgaacctggattaatcatatgatgactaaattctgagctctgaggagcagtgaggacatccatgcgtgaactcatataacatgtgaatgatcgcgcttgcagttgcaacaataataactggaaaaactagctcgagaggatgaaatggccatcctgtttctgcagttaacttagagagtagagcttaggtaagtccaaaaattaatctcactatttgcaccaccattttgtaccccattcatgtacactaaactctctaacaatagtttttactgcatctcttcttgttttttttttttggttatgcaggaagcctctgattaaattgcatattttaccagctaattaaacatatgatggttgtttgacttgggatttcttgctcatatcaattgtacttgtttacactcaagcagggtagggaaccaccacaaaataagtcaagttcagataaaaccaaaacatgcatattcagaatccaacgttggtgctcatcttgttcttggcagagatatggctacaaccttttcgtggctcacattgtcacccaatagttgatagtacaattaaagatcacctaaatttaagtcatttacttctcatatttcatattataagttgctttgacttttttctaatcaaattttaagtttaactaaattcataaaaagaatatagcaacatttcctacataaaataaacatattatcaaaatgtattaaaagttaattgtaatgaaaataagtttgtattgtaagtaatgctattttttaaaaaatttggtcgaactcaaaaagtttaacttagaatatattataatccgctttaacttttatctaagttaaaactctataagtttaactaaatttataaaaaaaatatcaattcttataacactaaattagttcattaaatctaatattgaatatattctaataatacatttatttggtgttgagaatattgaaggatttttctttaaatttaattaaatttaaagaagtttgattaaaaaaaaaaaaggttaaaatgtcacgcggacgtacgcaggcaagccagcgacgagtccgtagccaccagcgagagcggtgaatccggcggagccacgtcgccggcgccgccgatcgccaagcccacaagccgccacgtcaccctctcctcctccgcgccacattttctttaaattatttttctccaactcttaaatcgtaccatgagtcactgcagcgtgggccccacctgctcttctgacaaccacatccacaagcaccagcagccgcgagattttctt

SEQ ID NO: 15836 - DNA, 1501 bp, Oryza sativa
ttttaataacaaaaatatagaaaagattaatcatcattaaacacagtatcataatatacaactctttttatttaaagctttttacttttaaacatattattagtcaaagtttcatttcgaaaactatgctaaattcaaaaataattatattttgggacggagatagaactcgctactcagcaccgccacccagcccagccatctcctctgctctctctgccatggcttccaccgtcgccttctccgtgtcgccaattgtccgccgcctgcactgcaggaggccggggaggggaggactcggaggagcacttctatgcccgtcccgagaaccaaggccgtggcccgaacgccgcggcggcgtccgtgcagaccaaggccggaaaagatcaccgacgagcgcggagtggccgcccggctgccgttcccgacgccgcgggcaccggagatcgatcaggcctggcatgctcccccatagaagcattggattcgcaaagggggagaaatctcttgctgtcttcgtaatggacaggtgagttaaccctattccggtcgatcgatatgagaagtttactggcaaccataggtgattgatatgtaacacaacctcctaaacaatccgcattaatcacattgtgttcatctatgcaacagtttagtacacaatccatggtttaacaacaattcaaagtggccaccgatgagttgattgcacatggtaaaaattgctgatagactttgggcttttatccctctaaaaaaagaattgagatgaaaaaaaaaaaagaagagctactacacctttcacgatgatggctgataacacacacgagcattttgtcttattttatttggatgcgaactctgaaataccagcggctgacttagattccattagtactgatacccaattaccccttttgttacgcaatgcactggatagaaatagaataatggctgatatcatttgagatgtcagcggctgggttctattctccttttgacttgtatctgattggtactgatttctgttttgtcagcggctcaagattggagacattacttatttaccttctgtaccattagtgtcaattcccttttgttatgcaatgtaatggacatctatcttacacgaaattgaccatcatattataaagataaatcacaatgaaagtgaatacacaatgcaatagatttgatgcttctgaaagcatttctgttagtcttaacctcttatttttccatggtatgaactaatcagctgcctagagtgacccacagcactgctctgcctgcaacattgcatatagtaattcgagagcacatagtaaaccaaccataatgatttcccactttgacttttggtttattcatacgtatctcttgcatctctaggactttataaagcatcatttgttgttttatgcattgttactctacacagcaaggacctcagagaaacatacaagcaaggtgaaggttcccaagatgatgtcctcaattg

SEQ ID NO: 15837 - DNA, 1125 bp, Oryza sativa
tacagctcgtgagcaccacaggaaccctgatccctaaccttttctctccccctcaattttttttgagcctaccttggttgtgcatgcgctgtgctgtttgtcccccttcttcacgacgattttcaagttatacgttatcattcagatgcaaggaataaccgaaacgcgtgttgtcgtagctaccatgttatcattcagatgcaaggaataaccgaaacgcatgttgtcatagctaccatgctatcattcagatgcaaggaataacagaaacgcatgttgtcgtagctaccatgctatcattcagatgcaaggaataaccgaaacgcatgttgtcgtagctacaatgctatcattcagatgcaaggaataaccgaaacgcatgttgtcgtatctaccatgttattaatcagatgcaaggaacaaccgaaatgcatgttgtcgttgctaccatgttgtcattcagatccaaggaataaccgaaacgcatgttgtcgtagctaccatgtttcctttatatgtatatttattagtaccttttatgcctttcataattgaatggattgacatggctggcaaatgtctgtgttgctttaatatgccctcatttgggcttttatgtactagggttagttcgttatttcagtatatgcgcgatcccgtgttggactttagttaaagatcatgtgctggagtcactgcaggacaaggttgtcggaaggagagagaaaggagagcaaaagagtttggggatgaagggaaaaggggaaagaaatttaaggaaaaacacgtggcccaatttattatttgaagctgaaaatctcataaagcagaattatgatgtctaacggcataattgaaaatttgaaactctttatgtgcgtttctttccttttcttcaagtcaaatgctgaataggcaaccgctcttgcttcaatatccaatgcttaaaaaagaacttctgaaaaaaaatcattgtagtgttcccttacctttccttttttaatatgcaagatatgctctcttttttttgtcggatgtcctttatcatttcttgtactttctcatttattttgactctgttaacacttttgtgtgaacatattggaaactctgtagttgtacttc

SEQ ID NO: 15838 - DNA, 1501 bp, Oryza sativa
acgctctttgtaccctctctgtatcaagcgtccttgaaacagtggagcgatgaaacattgcatcagaattcgattagtgcatgctgctctttgtaccttttctgtatcaaagcgtcctttgaaactgtggagtgatgaaacatgcatcagaattctaacgattagtagtactagtagtatgcgcgtgctaaacgtcacggtgcatttttatttgtctttaataattgttaaaatttcatattagcaaaaaaaatattattatatgatatgtgcatttaaactttaattctaccgattagtagtatatgctagttcgccaaactgtgagagttgtctttctttatgtgcaagtcatttacgcctacatggggtttcctgtgttgtattaggatgaacttgtgcgtgaaaataaacataagcttaccacgttcagatgagcatatgtgcattgggaatatattctatacacataagtttcccgtatataccagctagcaaatatcacagaaaattttagaaaaaattagagacatatttttaatagtattacacatacgtgtgaaatcttatcttcaatatattttagctgtaataaaaaagacaattttttgacaaatttttacccttaaaactgtctgattttttttacggttaaaatacaataaatttgaatacgagacttttcatatatatgtaatactattacgagtaaatgtctaatttttatagattttttgtgacatttactaattggtgtgtacggagtgtgcacatgaagctcgtatgtatgtttccctgtgcattaaagggaacgatggaaggcatcagcatcgtcatcaaccccacaagtgcaaccccatccatccataaaccacggctccgacaacgaatcacgcgctctccaactcacacgcgtccgcatcaaccgagcaatgaatcacgatccctctcgatccggcttctttcagcttacgtccccgtcaccacaaagccccaaacggccaaaaccagagtaacaacccccagtaaactccgcatcagagaagcacgagcccaagcccaccgtgcagagtccgctccccgcaggagagggaaagagcgccccatgcctgcgcgtcgcgcgcgtccccatcgcgtccgagcaacctccagctggtccgacagccaaccgaacccactcacccaaccaaccgcagagcgagagcccaaaccccccctcccgcgcgcggacccggctcccgcccatcgcccttcaatctggctggcacctactgtgccaccccgcgtagcagcagtggacgcgcacgctctcgcgctcgcagcatcccccacccgtcaagtgcataactatataaagccgccgccccggtccgttttcctttcctcccaaatcaagaccaaatcggataatttcaaatccttgtcgagtgaactgatccatcgatggagtgggcgtactacggcagtgggtactcctcgtcggggacgccgtcgccggtgg

SEQ ID NO: 15839 - DNA, 1501 bp, Oryza sativa
aacaccacatccagcatgcatgactggagagcaaaaaagggactccataccagtttcagtttgtagtttgtacctcctcgtctctccacatcattccagcatcatatgcaagcttatcatatcaaatacttagtggtactgtagctataacgagcggcagtgttttggtttcatctccatgcatgcatcaagagtagtagttaattaattattaccgtcatcgatctcagttcatcgccagccgttaccatgcatggagggattgttatctatgggtcacggtagctccagaggctgcccccggcctccgacgggtccggcgaatcgtcggaggagctggggctgagcctcggggggctcatcatcatcccggcggccatgttccgcaggaactgcggcgtctcgaagagggcctcctcgtccaagaaatactggtggctcccggcgccggcgccgctgctgccttcctgctgcgcgccgccgctgcccgccgtggtgcgcgcggcggcactgctcccgccgcgctgctggtgcgctgatccagaggcggcaggggcaatgccgccgccggcacggtcgtgctgcagcgaggcggccgcggcggcagccgctgcgcggatgtcgtccgctgagctggacgcgggtggcgcggtgcgcgaggcggccagatcggggaagttgagcgccgcgtcgggcccacgcagcgcgcgcgccgccacgtcgtaggcgacggcggccatctcggccgtcgggaacgtgccgagccagatgcggcgagccttccgcggctcccggatctccgacacccacttgccgctccggctcctgatccctcggtagaaggggtgcttccccgacgaccgcggcggcggcggcccgtggtcagacatttgatcgatcggcttcagctagggcagcagctagcaagctaggcgcacctatatagttgacgacgacatgcctatctagctatagctagctagctagctagctagtatcatcagctcgatctgagcgcacgtgtgttcgatcgtggcagctgtgggttgagcgcgtgccgagaaacacacgagcaacgcggctatataaggaggcggcggcggcggcgagatcagagcgcgggagagaagcgtgaggaaagccatggcggtcgcttgcgatgagctggtgctcccgaagcgaacaagcaaataacaccacagccacagccccgcgcgcgttattttcaggcgggtgtgtggggattagaaaagtcgcgttgccttcgaccttactaatcacccaagaagggggctgtggcctttccgcggttgaacatggatttaaactgttccatttcaggctccataaattaattgatggccccaatatatttacccctgacctaaaattgcacatgcaaagtgtcgtgagtaatttggttattgataaagtcctactgcctccatcccaaaatatagcaacttttgattatgaatctgggcacatagttgtccagatt

SEQ ID NO: 15840 - DNA, 1501 bp, Oryza sativa
tccgcctccgccgatccccatccatccatccggcgagcgagcgagcgaggagggtcgccgtcgctcgccctgctgcttccgccgcatccggtacgcagatcctctttcccatctctctctctctctctctctctcgacccacgcactctttctcgaatttgcgttaaccctagcttccgttcttgaaatttgccttaaccttaatactagtagcagtttgatggttcccaaaaaggtttggggggtttcaaccgaacccccatgtcccatgttagatccgccactgggaatgtgcctgtacaattgtttgtgttacattatgtgctaaatctgtttctgatgtatgtgaaaaatatcgtactcttttcttcttcattttgatgcttcatttcagatatattacagagctttgaaggtttacctattttccatatgcatagctttgatgattggttttgatttttttttagtgtgttttgtgtgttcaatattgattgtatcatactctactactttccgttgtatgcctagcaagcttcatgtgaaaggccagttgagtttaaactatgaaggtcccaatacgctttttgggacatatctagtggaaataattattttttaatatcctaaagacatttaggtatgatacaaaatttacactaaagaaaactcccatagcttcagattgaattaaataaatttacctaaacttctttcatgttctctttattgcatttcccccattttgtgcatgtccccaagtgatgttcaggctgtctaatatgttccatggaagataagtatggctttactgcagtggtgaatgcggactatggaagataagtgtggttgtagtggtgaatgcatactgggtagcttgccttcatgctggatgctccttgtctctcagtctcagttttccaccatgtttgtcaagttaatcagatgcatgggaggggaatttgccgaaaccatcctttatttgttaccctccataagaatctccagctttttgtatataggatctgtgcagcaaaagtaagttgccctagcagtctgtacaaagaatatcatatctattgctaacaaaatatgtaaatttcctaccatttattctggtggcaattgaatatctaaggccctgtttgtagcattgggattacatagaacagaaattcctactaactggatatggtgtctcgtatgatatctttgagagaatcatactttcgaaatgggtcctaaacttaagtgcaggcagtgattttatatccatgcatgctttagtatcactagaatagagtgctagagtcacaactttaatttgtagcattaagtcattaacataaatgggtcctaaacttaagtgcaggtggtaattttatgtccatgcattcttcagtagcacctgaatagtgtgcaagagtcgcaattttaatatgtagcattgacatataattgtccttccatcctgcagttccctacttatattattttgaag

SEQ ID NO: 15841 - DNA, 1150 bp, Oryza sativa
atcttcgcaagcatcgtggatgaggaggcactggatctaacgtggagcttatcaacgtgatcctgcaccagcgccggacaaccacaccctcgcccagctcgacccgttggcatcatcaacgagccatcactcgcacccttgttgtcaaatggtccacaagtgctactgctgctcctctccgctgcctcctcccagtcatgttgctcattctcgagttgtcaaagggttccgagtatctaagtcaccagagcatgacctccaactccccaccgggaactcgtcattagtgtcttccaaagagggcgataatgtcacgagaacgactaggagatgagtgggatgaggaacataggaagggggatgatgcgtgggcccacatgtcaatgaggtggggagaaagagttagcgggagcattttgatccatatgcaaagttgcaaacacggtataaaaatacatctcatgcttatataatggcatacataaaataattttagttgtattgaaatcgtatggttagaaaataggtaaataaacattttctttcaacaccgcaaaatttacgatgcggtgctgctgaaaaacgtatccaggacagcttgtttcgtggtctggttggcaacagtttcctgtccgttgcttttccaaaagttcaaagatcaaagcagcaataacggctcatctcatctctatactagtaatcgcctagtcgccgtcggtattgattcgcgggaagaacctatcctcttcgaagccgtgaaatctcagccgtccatccatgatccaccggcccgcatcaccagaagcctgtcctaaatgcacgatagggaaccgtgctccgcacgtggcgactctcgtccgtacacgccgcgacacgggccacgcgtgcgtgacacgtgccccgctgcattagcgtaagacaggggttgattagcaagagcgtcctaattcgagggggttttgtacgataattttcaactaggattgcaagatcgggtaaatttgggaagagtagagggggttttagggaaggtgattagcagtaatttcagagttaagaaagggggattacatctgcctaagcagccgcgtgtcgatttcggtttcgtataaagccctaacaagctgtaccatggccgatcaccggagca

SEQ ID NO: 15842 - DNA, 1501 bp, Oryza sativa
ttcctttgttttcgtgaactatgtaatgtgcgggacaaatatatctagcgtagtatttgctacgaggcatacattctcctatggattgtggggtccactttggctagttgggcattagatttgggatggatggtatgaattaattcctccttacaactattgacacgtccaattattaaggaaaaataataattattaatcgtacattaaataaacagaaaaacaaggtaggattatccatctcctctctatcttctctttcaggtcttttggaagctgaccaagttagccaaacactttagaaacaatcttcacctcctatataagctagctttcactaaaattggagtttgaaactgggatatagaagatagagccataccaaatagtcccttaaaaggaggaagaggggtcaggagttatggttttttgttcctcttagtgaagggttaggggatacatattctttgcagtaccgtattttggaatggaagtagctatatttatggcgttatatttttcactaaaaacatagtcaacatgtatttacattgtaagtcccaagattatatagtaattacatgtgtaagtgatgtgtaaatgagatgtaagtggggtgtaattaacagtggcgaatctaatgaaaattaaggtggggcttatgaaaaactactacaaacatatctaccagtctatcaccaatcaaaacatcaaacttgtacctaaaacgaaagaaaacaaactgcactgtgaaaatgtaacaaatctacgaggctctagtatgttgccatcggccgtgtgttttctcacctgacccaaactactgttagctgactagaggacatatcaatgcccaagacggcgtcaggatcttctcaatcctcccgctgcatccatgccctttctacttcatacccttctttgatgagatttgcctaattaactaaccctggagtagagaaatacattgggcattaatgtgaatggagctggggcttaagccccaagcccccaactagccccaacggtagattcgcccctagtaattaacttcgttagtcatctctaataattacacttaattaacacattacctgatagaaaagatgtgcacatataggtctgtagtgttagttttagggtgagtttctttctctcactcattcgatgtttgagcgataatctactctcgatcactaatacatcgatgatagattgcaggtagccagcgcggatcgcgaaccacgcatacacaaacataatattcagcactaatctaaagcaaaatcaaagggctgaaaactcgactgtaatcaacgagattttgtggcgacacaaataaaaaaaaccgttttgagattgatgaacaagaggtgcatagcaaactttctatgtggtacacatgttgaagaacaacatggagtcataggagaggttgtgtgtcccatagctaggctctgccccataggccatgcaactatgcaatactgtcagggttact

SEQ ID NO: 15843 - DNA, 1501 bp, Oryza sativa
cgccgccctccccgaagcccggccgttttccttcgccggcttcccgtttgctcgccatcgacgccgttcatcgccatcggtgagctcttcacctaatcctcctcgttgtcaccctcctggatcactgtagaacactcccgaaccgccgctttgatcgccggacccctctccctccccggcggcgttccgcccttccccacaccgcgcctcgccgtcgccggcctctctcagagtctctccgccccatccgaccccgagaacaatttcccagagtcctagagatgctcccgccaccacgaattgaccccattctctcccggcgtgttttcccccttttgctcgccgccggtggccgccgtcgaaatccgccgcctccgtccagttccggccacatccgagccgaggaatggagtctgcgtctccttttccctccctccggtggtctcccttcctcccgcctcgcctcgcggccgctccgccgacgcgcgccgccgcctgccgtccatctcccggtcggtctcgtctttctcctctcgccggcccgcgtggctgccacgtaggcgccacgtcggtgccaactcggctagaccgagtcaaaccggccagcctggctagccccctccgtgcgcacggaccacggtgcgccatgcggctgcacgtgggcccgtcgcgcctcggtccacccggcgcaccaatcgtgagccgcatccacccgaaaccctaaacgccgcccgcgtgctcccatccctccgtgaaccgtgtcgccgacatgcgggccccacccgggacctcgcatggtgggttcggtccacccggaccgccccctctcccttccgcgcgcccctaatgggccgcctccttgcgcccgcgccggcccaatggcttggccgagcctccttcaacccattgggccgcgcctcacgctcggcctaaaagtccatatttcctccctccgtccaagtcagtgtccatctctcatgagctaaaagtccatatctgctccctcccaatttactcctctctcaccttttgtaggccccacatgtcaatgagtaattaaagaatattccaagaatattcttttccacgaattcaataaaccatctctcgtattccagaaaaattcgacaaatcatttccttgtccagaaaattcagataaacttccaatattcatatctctcgatccgtagctccgatcgactccgttccacttccagtatttctataaaattgagatctatttaatggcactattaattagtctaaataggatccttcttttggtcttttgtttaggttttctattgtttgcgtatagttacggttgcggattttcgtcgatcgtggttatctcgaagattcgtgaagctccgtgaaggccttgagcaaggcaagtcaccctttgatcaattgcccctataattgaaaagtcattattattttgtttgcaacttgcatgattagaatcacacacttaacttgcttggcctcggtttgcg

SEQ ID NO: 15844 - DNA, 1501 bp, Oryza sativa
taccttatgataggacctactaatttatactttttataaagttatagcctactaaatctaaaactcaacatgcaacattgccacattatcacccattaacaataattgcatatttaacctcatgcaaacatacaacggcatctataatttatttaattctacaaatcaatatgtaagcatatccaatcatatcccctcacatcatttgcacaatattttaacaaatctatctattattttttataatatttaaaatatacttatcaatatgtttcacattaaaacacgggtatcatatgtttcatgataagcactgataaaacctaatgtttcatttcattatttaccctgattgtcgaaaaaaacatattgagaattgcttagcaattcccgtagcaaaatgcggggaaccatctagttttataatagtagacatcgtacccgtcgacgtcaaagtgcttgtactagtttttcttccatttcaaggtacgctgattcatagagataggagagagaggttatgcgcgagtggacatttgtattgagtttcgtaaaaagaataggaaaagaaaaagaaaaactgtaggaaaaataaattgggtttatcacggcacgtaagtggtaataagaaaagaaaagaaaataggtaatgggtagagaagattgctaacttgatcgttgagctgctgtcggatgaaatgaaatgaatgaaatgaaaggtaggaagcttcttaacagaaaaaaaagagcggttatgtagagtatataattatatccgcagtaaagcgaaagagatatgtatgtgtgacgacttggcccactcaaatctatcaaccaaaagctgatgagaagaaactgactgactaagtgcaccatataaaccaatgaaagcaatccacgtctatacgtaaatagttagggacagattcagcacaaaaaatgtatcgtattcaagcagcagaacatcgattgagatcgatcgatcgatggatgatcggtccagctagcttaatgaaattattagtaatttgacgttgtcaaaaggcaagcgcattttccattttttgaggacaaaaggcaaggcattggtgaatggtgatagctactgcaattcactttttcttggcgatcgctagctttatactaatattttgcaatcgatcgatggagtgcgtccatgcgaccttttgttgactcgatcgaacatcgatgtatcctcctacctcagcttacatatatgcataccaaatcaacgggaaaaattcaagcaacaattaataatttcagtttgcacctctctctctatatatttaccaacggggccggctagacagtttactttcaggcaggcaggcagcagcagctattactatcgagctgaaaacgagttcagtacagctgcgggcatcgccggccggccggccggctgctccccttcaaccaaccaaaaaaacttaggcttaggtcgtcatggagcagcagttgtcctcgccgtcggcgt

SEQ ID NO: 15845 - DNA, 1501 bp, Oryza sativa
tcttattcaaattattttaaaattattatttatcttatttgtgacttactttattatctacaatactttaagcacaacttttcgttttttatatttgaaaaaaatttgaataagatgagtggtcaaacattgtaaataaaaactcaaaattccttatattgtgggatggagggattatatatctagcttccttccaggaaccaagaaatgttcagttctaaacgaagggctgacgaatcgtcacgaggtcaaccagtcaacagcaaatggtccttggtgtcctctttcgacctgtggtccataaccatgtgtacaattattcagaagtggtagtataccgttggcaacgtcctctagtttcacatttttcagggtgttttacttttctgaacttccgatcaacgtggagtttaattagcagtcagtcagcgcctgaagatagattgcaggctgcacgtgggggcgtagctacgtagccgcgtcagggtcaacgacactactttaatacatatacgtacgtatgtacgtacgtccagttctactatttgtctacccaagatgattggagccacacgtcggtcagttcgtcacccacacgctacagtcgaccaagctgttcagatacgcactctatatatcgtagtaaaacactaatgaatcgattgatctcgtctcaccagttaattaactttagtgtaatactatatactcctaccgtttttaatacatgacaccgttaactttcgaacacatgtttaatcatttatcttattaaaaaattttatttaaatgtataagatagtataaattacactttaagtactttaagtgataaaacaactcataacaaaataaattataattatataattttttttaatataacgattaattaaatgtgagaaaaatcaactctgtttatctattaaaaaaacgaaggtggcatgtgtcgcttttcatagcggccgtaaagaaggaaatggatacgccccgtgaagccgggcactgtcgtgtcgcagtctctctcccatccctcgtctatattggagtactccagtatattttgccggccgagcagtaaactagtactactagtaaaatagtgggcgcacaagactacagcagggaagccaagcaccaacggccgcacggcccgcaccgcgcgcaccagctagtagaaaacaccgttttcctacgtaattccgagccaaaaccacgtaacaatcgcccgcccacgtcccgtgtccccccatcccttcgccattggccggcacgcgctttgacgcagccgccgcagccgcgcgggtaacaataaaaacgcccccgtgcaccgcctgcctggcgaaaaaccggatcaacgcgagcaagcgctcacctcaccacctcaccctgcagcgacagaaagagtctgtagtagcgtacgatcgcggctagctatcgagctccagcgagaggcgtacgtgagtgcgtgcgtacgtgcgggagggaggaggaggggaga

SEQ ID NO: 15846 - DNA, 383 bp, Oryza sativa
cttattcgcggaataagcaaaacggtatatttgcaaacgaaaaataatttctgaataaaacatttatatacgtgttgttagcgacttacaagtaaaggttgaaaaataaatttcgatgaaaaaacctcaaaatcagatttaaatttaaagttgaaaatttaaattttggctgataagtataagggaaaagacagtcctttcgtcggtgagagtactgtgccggggtgtgtccatctgggtgtttctggtttttgagagggaaaattcaggcctgaaaatatctcaaaacggatggcctagagccctggagtgcactggactgaagcctgggccatggggaaaatggtccatttgctttgtttgccttgcccgtgtcccccagc

SEQ ID NO: 15847 - DNA, 361 bp, Oryza sativa
tttggacaacggaaagcctgtttcgacttgtcttctcccctccggcttttctgttccatgcgttttctgctctgcaactgcaagcaagtccctctgctagctgcgagcctcacgtgcccattcactctctttatttattgctgattcccgatcgatcgatcgatcgatcgatcagcaggcaatagttaatcgatctcaacaactacccatcagttattcaatacaatacagccattcagacagaagcaaggtctatcgagtcagagagatcgacatctcggcgagcgagatcggtgaattgatgggtgatcatggacgccggcggcaggcggcggcgccgctgctggagaagaagggcagc

SEQ ID NO: 15848 - DNA, 266 bp, Oryza sativa
agcgcgtcgcggccatagaagggattcggggagacgtggccgcccgggcgcccgtcgcgcaccctatcctcgccgcgcgcccgccggccaatcgccacccctgaatccacagccacgccacgcggcccatgcctacgcctcccacccgccacaggatctccctctcacgcgcgcgcgatctcataaaaacctcgccacctcgatcggtgaggtagcacgaggcggcctgagctgaacaccgcatcagcagcagcaagcagctaatc

SEQ ID NO: 15849 - DNA, 524 bp, Oryza sativa
tcgcatagcctaaaatctcaacaaatccaaccagctaatatggtgtaaatatcacgctgcggccttcctactctagtagcccaaccaccaactacattgcagacaagggactaatatgaacttagctaaaagttcctgaatctaaacctagcgaaagctaaaccgatcaacccctcggaacaacccatcgatctcggaatccacgcccaaagctcacgggaaaaacacgagaccaaatccgcacagatccaaccacggagaagcaggaatccacgcggccgacgggaacggcgggggccccctaacaggagcagcacgggcgcgcgattagccccccaatgcagccgcccctcgccgcgaggcgcagcacgacgagcgcgtgggttgggggggttagatccagaccttgcgggtggaggtggtgggcgagctgggccgcggcggcgacttggccgggtcctccgggtcaaccgcctccgccgcctggctgagcgggatcgacgttgactcctccttctccgcca

SEQ ID NO: 15850 - DNA, 1501 bp, Oryza sativa
ccccacccacctgcgcccgcgccgaccgtccccgcccaccacccatccccgcgccgttgtgccgccatacgagagagagaggagaagagtcgtgcgagagagtagaaagagaggaagtagggaagatgagtatgatatgtgggtcccacctttttttaataaataaaatgctaactggattgtcacgcgtacgccacgtagaacaaaaccgctctgaattgggttaagaggggtaattcgtctggtattaaaagtttaggatgagcaatgtctggttttttttagttcaggggtaattaggtcgaccgcgatagttagggggtaattcgtacttttgctaaaataaaaataaggtcacatggtcgtaccgttaaaaaaaaaaaagtcatggccgtgtcccttctggaccgcgtcggctttattggttgtgggccaaacccaggctagcccaaccctcctagcttcattaattctaacacggcatcaaagggagcaaaatgtcagggaaattaaatttggtttgcagtgttcgcgaaataaacacgattattacatgactcttcctccttgtcgtcgacgacgtcgttgatcctgcgtcttgcattcttgtgttggacgtgtgccattttaattttggaagtgtgaaatcgtcaattcattgagatctcggtcagttagtcggtatccgtcacgtctctcgtcgcaatcccatcggtgtccacaccacgccggaggtgtttcgttttgttttgaattttttttccctttgaatgaacgttacctcattttgtacccctcgcttaaacacgattgaacattttagagtatgtttttataacactacatgaattttgatgaaactattgtaaaattacagatttaaataattgtatcctaaactataatttagcggtaaattatttccaaaactacatattctagaaatcgtattataaaattagacctagaaattgtattataaaattagacttagcgatattcaagtaactattaagattacaaaagttttagttttctttacaaaactgatgttaaatttgtagttttataatacgatacctttaaatatgtagtttactgaaaatataatgttaaatctataattttgtgatacacatttttaaattgataggctaatcaaagtcttgtagttttgtaaaatttattcaaaactttaaaaaaccatggtgagatagatcaatatgtgtgatgtgttgctttacaatcatgtaattttaaattcaacttaaacaacaagaataacaaaatatggttgggcatgaactatagagtatagacaatctcatttgtttttcgattctgaatttgtcaaaaaaattatgacttagaatggacagctaaaatatatacataaaagagagagaaaaaaaagactttcctactggacgccaattacaaatagatagaaccctcgccgagccggtaaccacgggaagcatatcgatgacgccattttccc

SEQ ID NO: 15851 - DNA, 773 bp, Oryza sativa
tgtattccacctatttgtggtgccacgattcgaccaatttcagcgggcgtgcgaaatttcagcgcgtttttgaaaagtttttgtggtttcatactgtttcgttgttttttttgctgcgagcctgcgattcgacgtgtgttttgttttttcccacgttttttttttttgcaatccgagcgagattccaagttcctcctcgtatcgagcaaaccttccttgctggtgtttccccatcttccgtagcttcgtttcaatctcgggcgtcttgtcacacgtcacgacgtgtcattcgtttctgtctgcgacatcatgtgattctctgagctttcgattcgattccccgtgattttacgagggcttttgtctttggaagcgaaaggaaattgcaatggcgctcatcaaattttggtccctttcctgcttgttttcttgcaccttgtcgtgcctgcttaaaagccgaggcgactgatggattcgtggaattccattcttgtgtatctgtctgcagtttcagtcccatctcctgcttcttccgcttgctgcttttgtttgaaaatgttgagcgtacagtgcggcgatggctcgcgcttctgggattctttcggcacagagatgatactcagctcgtcgcattcgtttatttgtgcctatgaattttcggttgatgcaaacttgagcgaaatttatttatgtgttcgttgtgttcatctgtgtttgaagagttcgttttgtggtttgattttgtcagggcgcgagtgaagagaccgggagca

SEQ ID NO: 15852 - DNA, 1133 bp, Oryza sativa
atttatgccatctgtttactgcgtcaaaatgttaagttagctgatagtaacatcatattaggctatggtagcattaaccagtctgtgaagtgtttttgtttggtcagtttcgcggttgcatatatccaatttgtatctagattcaaggacatgtttcctgtaaaatgtccttttcactatcttctatctatttgatttaacatgcttttgcaccatatctctacctaaggccaatttatttgtttctccaggatttgcaagttaagtcatcaccacctccaccgccaccaccacaaccagctgccccgcacaatgatcctgccataatacaggtaccgcaatgaaacaaaaacattgaaaaatacttcttagagccgcacaactcatgcaattctgttctgcagtcgcactactctcagccagcatcggcttcttcaagtttgccttctgctggaagtgcagtattgccagacctcagctcccaggcagctcaatatgggcttcagaggccaagttttcagagcaatattcctctatatcaacctgggagtgttccatggggatcctctgctccaccttctgctggaaatgcatcaggcctttcagttcccccaatgtattggcagggatattatccacctggtgggcttccacctcatttgcagcaacctcctttgctccagccaggattatcagttccccagggtctccaatatgcaggattgaatcccactctatcgtcagggccacaaaaactgtcagaactgcagccccccttgctgcaaccacctggtactacccaaggcccttcctcaggtatcctgcccactacaacagcaccttcttctgctaacttactatctccagaaacttcaaagccccttctgccgaacatgggtcctttgtttactcctccagttccatctgtgggcgccacccttcctttagctagcctgccaacatccattgctgaaagtagtgcaatggccccacataattttagttcgcttgtgagcaataagactgcggatattccaggttcaacattggcataccaatcagtgtcacaggcagtttcttcgactgttgcttcatctagctcagcccatatggatatgcccgtacctttgttg

SEQ ID NO: 15853 - DNA, 1501 bp, Oryza sativa
gcagctctctggcaaattctgcacgcctgtcagccagccagataatgacagcactgtgatccaaattatttcaacaataatgccaaggtagtgactatatctttctttcacacacttgtgcatggataagaattttaaaaagagtaaatgcactttgggccacatattcttaccaaagtttcactttggactacccttatagtgatttttttcactttggaataggtagtgttaccaaatgttgtatttggaccgggtggccaacatgtcaatgagactaaccacctctctattgtccatttgtcacttacatgtgagccacccggtccaaagtgaacatttggcaacagtaactagtccaaagtgaaaataagaattgtaagggtggttcaaagtgaaactttggtaagaatatgcggcccaaagtgcaatttactctttgaaaaatatgttacaaatttcttatatggattttatatccaataatcaagatttttaaattcaaaatgacatgtgaaattttcttgttcaaggtgacgtgtcaaatcttcaataactgtttctttaaatgtattatggggctgactttttgatgtgacgtttgaccattcgtcgtattaaaaacttttgtacaaacatgcaaatatatgacatgcttaaagtaccttcgatgataaaacaagcctagttagtttttttttaataagaagaatggtcaaacatgatgtccaaaagtcaacagcatcatatatttaaaaacggaggtagtacttaagaagtacattgaaagaaacttggacttcaatatttgaatgcgaagtctatattccttttaaaatagaactagtatatttcaaaatttcgaagatattaaattgaaagttatattctgcgatctcagttaattaggtaattatgttagtattgagaagtaatctaaagtattttagtctgtttatgtacaatattttaattttcagttgaactaaggtgatcctgcttttatttctgttcctcaaaaatcctataggtactatcctcaattgaagtttgaacgtctagtcacttcgctggaagcaaaggtagtcaatctggtgttgaagacaaagtttcagaaattgatctgataaatgttgatgattcttttctatgcaccagttttttcgaattcttagatcctcaccatgggttaggtccatccctattttctggtgtaggatggttctattttttgtttggttagagggatggaacgaaccctattttttgtttggtttgagggataaagtgggatggaatggtcccatcacctgtttggatggagggatgaggtgggatagctggatagagatacttcctcaactagaattggtgaggttacctctcacgtgaacgatacattttagcttccacaaaaaaataataaactctcacactaaaaatacattcgtagcagccacaaaaatttaacaaaaacagaaatatgttgccatatcatgct

SEQ ID NO: 15854 - DNA, 1191 bp, Oryza sativa
agagctgcttttgtaaatcttccattggctccaaagatttaagttgcagtgcagtgacattcaaactacgaaaagggctgtatcatgagagatatagtgatattgtgaaggttctatgcacagtaactctttacttatttataatgtgaagctacccatcatatgtgtatcaagcctttttttatttgaatgtgaagtgttttttataatgtgaaactataaactttcctacttgctacatgcaatctgtcattttgtaatacccaattccgtgtgacaagggtatttgcgtgtattccctctcacaaatccaactaactaggtttagagctactaggcttcttaatattacttgatcatgtcatttgtagcttgaatttcttaatcttctgttcagtgttttcggaaatacttactggaatgttagttgttatgtactagaagtttcattgatgccatatatgatgcactaaatcacaaagagaaattggcatttaattctattggcatgtgtattgtggtcagggaatactagaagctttgacttttgtactgaatatatataattagcccaccaagccaattcatttgggaattaatgatcgagttattttcattcaggattgactttctctgctaatactttgtttcttggtaggattcaaagcctcatctcattgttgccccaaatgctggtatagctgcatatcctagttggattccaactattgtaagtataaatgttcttgattagcaacctcctcccattttggatatgagcatgattggctatgaatttccttgtgatactaccactcttaacttcacaaagttgacattgttccagctagtttcatgctaaagcatacatctggaacttaaagtgtattcttcacaaatcgcaaatcatccctttatctcagttgatgatattcaagtaaaaatcgatgcgtttaattggtcatcttttcttctctaacccagacaattttcaacagacatgttatctatggaagaaagtgttagcattatattgtcctcatgtgaacttaaattaaaaatacaccacactatgacagctttaactgatgattgccagtataacacagtatactctatgtcttagcttgtaacagacttccattttttgtgctcattctattcaattttcatttgaaggaaataattagg

SEQ ID NO: 15855 - DNA, 1501 bp, Oryza sativa
ctggtatagctgcatatcctagttggattccaactattgtaagtataaatgttcttgattagcaacctcctcccattttggatatgagcatgattggctatgaatttccttgtgatactaccactcttaacttcacaaagttgacattgttccagctagtttcatgctaaagcatacatctggaacttaaagtgtattcttcacaaatcgcaaatcatccctttatctcagttgatgatattcaagtaaaaatcgatgcgtttaattggtcatcttttcttctctaacccagacaattttcaacagacatgttatctatggaagaaagtgttagcattatattgtcctcatgtgaacttaaattaaaaatacaccacactatgacagctttaactgatgattgccagtataacacagtatactctatgtcttagcttgtaacagacttccattttttgtgctcattctattcaattttcatttgaaggaaataattaggaaagttgggattcctgcaattttcacggacttctgtgaagaagctgcacatctagcttcgtcctgcattacctccataactggtcaacccctcagagtcccagtatgtgttctgtttttccatcgtttcctttctgattgtagttatggagtatcaaactaataccatcatcatctatcatctcctctctcagattcaggtaaatcctttcaggcaaccggttgcagtggataatagtgcactatgcttaccatgctactccaactgctttgtttttgggatgcagaattgcaagtttgtatcaccatgaaatgttcagagattcaactcttaacaaataatatcactaactttttcaaagaaggcaaggataccatgaaatattttcatggacgaaattgccacctgtttttattatttagtctttcagaatagatgccttggttacttgtaagaatgtaagatgcactcatcagctcatgcttgtaaatacagttgtcgtataattgtagacctgtagtaacttgtaagatactacatatataataccctaaagttgcagaaagacttgctagtaggtagtagcaatcccatgctggacatggtgaaatatggatcagttatcaacagcttttgtgccaaggtactaatgaggtagtgccgaagaagcttgttggagacaaactttctgcaatagtaccattcatatggtgagttttctgcttttcatctaattcagtacctttagttatctaaatgtccctatcactgcatttcattttaaaactgacgctttcaaatttcttgtggatgagaagtttagatctaactttgattcataaatagaatgaccagcgttaacattttttttgtctatgagaatcatttcttgctattcttgttccaaattttggaaatattcccaatataaagtaaggttcttatggttttaatgataaaacggttaagttttttggtctcatcttgcaaacttttcttctc

SEQ ID NO: 15856 - DNA, 596 bp, Oryza sativa
taaaccgggactactgataagcacactgaatattaatttccattatatatgtgtttctaaaatagaaaataatgcattaaaattatttaaagtcgaaaaattaatgacaattacttcgaaaaattattgttgtctgtagtaaattaagtggataaaacgtaataagcaaatatatgatttaaaattaataaaaattctaataatcatatatacttagcatatgaatgatattaagttgttaaaaattgtaattaacatatgtatatacatacgacatgcatgatttaaaattaataaaaattctaataatcatatataattagcatatgaatgatattaaattaattgttaaaaactctaattaacatatgtaaatgccacatgcatgatttaaaattaataaaaattcaaataatcatatataattagcatatgaatgatattaaattaatggttaaaaactctaattaacatatgtaaatgccacatgcatgatttaaacttttaaaaattctaattatcgcatataactagcaattacatgatttaaaattgttaaaacttctaataattgtacgtaattaacatatgccata

SEQ ID NO: 15857 - DNA, 1439 bp, Oryza sativa
ctttttttccctccgaactcactgaattcaaagtaactcactaattttcttcttcggattcagactagctaactgctgaattcaatcttctgttttttttccctccgaattcactgaattcaatgtaactcattattttcttcttcgttcgttttatcttcagattcaaatcaaccactgaattcaaacttttgttgtttttcctccgaactcactgaattcaaatctgaattcaaagtaactcactatttttattatttttttatcttcagattcaaatcaaccactgaattcaaactttcgttttttcccccgaactcactgaattcagagtaactcactatttttcttcttttttctcttcttttttttaatcttcggattcaaatcaaccagtgaattcaaattttctttttttccctccgaactcactttattcaaagtaactcactaattttcttcttcggattcagactagctaactactgaattcaatcttctgtttttttccctccgaattcactgaattcaatgtaactcattattttcttcttcggattcaggccccgtttagttcacacaaaatttttacaccccctcagactaaatgaacgacttaattttttttcttcagcaccaaactgcatgacatttttcttccccttctttatcaaattaaatgaataagttcatcttgcaaatacactagaaaaacttactctaggatggacccttttctcggtgccaccatcattagcgttgtcatattggacgacggtgccaatgaagtcaaggacctatttggaagaaatatatttgcattttagtccttttgaaaattatttttaattttttatacaaataggtcattgacaccaatgacattggagtcgccatcttgatcatggcaccaatcacactggcgccgtgaaaaggaaccactcctgaaataagtttttctacgggtctatttgtaaaaaaagttttcaagaatgcccccaaaccatccaaccaaaccaatccggcccatcctctcccacgccaacctgttttgtcctcctaccatacatgtcgaagggtgaactcctcaagcgggggaccgtggggaccccctttctagttcagtccaggggcacggttgtaggtctgagagttgatggagagagaggcagagggggttgggcccctcgagagtgatggaaatgcaagaggtttatacaagttctggccgctatggaagcataataccctactcttgtgtgtgattgatttaggtgggagaataaaagtgcctttcttctctaggattcgcccctctctccactggggcatggacctctttttatatcttaaaaggttaccacaaaggcccaaaactagcttcaagggtaaggaaaatattctttacaggcaattaatgcttgtcttgtcttccgaca

SEQ ID NO: 15858 - DNA, 728 bp, Oryza sativa
cggagggccgcccggcgaggcggcggctggcggccgcgcgccggcggggtgcggcaggcagccggccggcgcgtcgcgcggtgagtctgcagcctgcggcggtggccggcgcgagggcggcggggcgcggagggccggccggcgaggcggcggatttttttttttaagaatttgagattgttgtgtgatgtatttgattggatctgattgttgtgtgatgtatttgatttgtgtgtgatgtgaatatttgataattttgtagaagttgtgatgtaattttttttttgagattttgtgatgtatttgagtatttgagatgatcgattgtggatttggaagcaatttgaaaatgattgatttgtgattttggggatgggattgatttgtgattttgattaaaaacaatgaagaaaataaaataataaagagcaaccggatctagtctttttagtaccaaccgggactaaagataaagcatctttagtcccggttgttaacaccaaccgggactaaaaatggatttttactcccggttttttcacccgggactaaagatagcgatctttagtcccggattcatagtcccggttggaaaaccgggactacaggagggttacgatctgggagtaaaaaccctttctccaccagtgagaagagttaccacagctccaagaccacaccatagaacaacctcgtcactggttatgatcatcctgtatccaaccagc

SEQ ID NO: 15859 - DNA, 1501 bp, Oryza sativa
cgaccgtccttcccacaacaaaatgttgtcgttactgaccacgcacgattgagtatgctggaagctactatcacatgcactaaagtaattaacagctaggggtggcagagcagtctaacacgtaattgatgtggctttcacttgaagatttcacatacatatatagtagcagtatgagcttaactactgtgtatttttatgtatatatgatttctctatcttagatagtactactttttaggcaagaatatatattaatttttgataaatgataattacagaatctcatgcaagcactacaaattaagcggtacaaatatatccaaacagatagttagctaatatatatgctgactaaaaaaacttaaaactacttaatcaagcggctaaactgcacaaataatattggcttgcaatttcttgacaaaaaatgaatgtgtacatgtataaacttgcattcatactctacttttctacccgtacacactgtgcagcagctggtccatggtttcataccatgcatgacgcaccctttactaggggcatgccatgcatgaccatgatgcatactatgacgcgcatttgacatcattagcgagcctgtcttaaactaatcaggcaggcaattagcgtcaccaacatatgcatggcgcattactcagcattatattgttgttctagtggctgttaattatggcttctacacctcaatctatctctcctctcaccacacacatggaggtcctgcatacataggcatattttcatgcagggcatcaattcccttcctccatgataagcaaagcaaagcaaacccaacccaacccaaccccaaagactgcacactgcacccccatcatgcatgcatatatgcattatatgtctagacatatatatcatatatatatatatatatatatatatatatatatatatatatatatatatatatatatatatatcctatggcgtagcttagctccatccacacatcttttttcttctctcaccaagagagaaacttttcagacgcaaatctctttaccatgcaactgaaaagcaggagagatctagcgagaccatgtcgcccaaaagctacacctctgcctgcgcacagagagagatatcgatctcctctgaaaagcagacataattaaggggagcacgtacacactacacacaccaccaccatttttttccctgcagagattctaccgatcatcttcaaaagaagagctagtggtggtcatggtggactcatggtgagaagagaggaaagaaagatagttagatagatagatagatagatagatagatagatagcacatcgattgatcatgcaaaggcatgcataaatgcatctccatccatgcgttggaaaagctagcagctagcttcagcttcctcctgaagcttgataagaccagagcttgcagatggcatgggctggatagatagctagtagagaaactaaagaattactaggaagatgtttgatgca

SEQ ID NO: 15860 - DNA, 1501 bp, Oryza sativa
tagcattatatcatgtaatgctgatataaatgatctaatggtatgaatcgatgtggttttccatttaaatatatcgtaagtttgtagtataaaatttaaaggggtaaaattgtctttctttgttatttagtgaggtcgtttttgttaaaaaataaagcagttaatgtagatcaaacaaatccgataccattgtggaggttatacgaatgtgttaacctaacaaacattcaaaataaagcggttattacttattagtagtcattgtttgcttaatgtatatctaccatatctaccatcggataagaagggattcgttcaaataccattatttagatgggcttcgctagaataccacccctaactacgacatctttgccaaaatagcattccggacaaaaatacctctatttcttcttcctcctcccttttgtgcttgaagaggttgctggtggccaccggggcgaggttgtcgccggccaatgagtcggggtgggccagcggctgagatgacgtaagcgacgtcacacacgagacgcatcctgggtgctgccccctctcccgacacgagcgacggtggccatggacggcgcgagcaggcacagacacgaccaccgtcgccgcgcggagcgagcgtgtggcggggatcgtggtaggatgagcttgatggagatgggagttggtgcggatgtccttgtcgccctgggaccatgccgacgagtgcttgcaccatcacttcatcctcccggcgtgctcgcgtggcggcgccgccggagctgctcaccacaccctgatggcgccgccatcgttcttttctggagttggaagaggcagaggtaagggtatttctgtccacgatggtattttgactaagatgcactagttgacgatggtattatagtgaaacccaattaaacaatggtattcgagcgaatcccatcctatgcaatggtagatatgtaattttctcaatgcaaacacacttgcagcatcaagcaactattcagagagagagagagcgctcttagttaaatttactgctgatgtgaatgtttttagcccgcagccggttactctaaggattcaaattagtatcatattatctttttttaaaaagaaagttttcaaataatcaaaatttcggagagtattctatagagtccctattctataccgtaggctttgtgtgtttcctcctcgggtgttgggggccctcacgagccagaaagaggtgggccgcccgccgcatgggctttcgcgcctccccgtgctcaccttttccaactccaacccccaccacccacacatccccaccaactctcccccctccacagtcactgacaaacatacccgactttcccctatggcccacccgcagtgacctgtgtctattcacccccacgtatcaaaagcctccgaacccaccgccccagccttgcgggtcccaccacactttgaactttgaattgcttcctcaatcctcatcagtggagagagagacgag

SEQ ID NO: 15861 - DNA, 1501 bp, Oryza sativa
gcccccaacttccttttctgcttacatcaagcagcaataattgatcagttcagtccaatagacaagtgcggtgccaatgcaagcaatccaactattcaagaaccaattatagtcaggaactgcttattttaacaggaataatttctcttattgaactggtacaattgtcttcgtcgagtttcagcctcatttgccactactggatttttgtttaagatggctgttcgtgctgacgaagtttcactcagatgcaaataaggaagagtcgtttctgatactgtcagcagcaacagcatgcacagtgagtgagtgcaaaagttagtattaggtgcaagatactgttccatgtgccatttggattagccatgagacgtttcatgagctcatcattcatcaatcaacattgtctaaaaaaaaatcactcatcaagcaagcaggtgatcatcgtttggaagatgtacagttgtcgttccaagattcagcagcatatgtctaggcataatcaaacgagtttatctccggtccttgcaaggtattcagaagtaagtacggtcctgattaacactaaacatatagtacgaacagaaaaaaaaaaatctaaccaaactgaactgtcagaaggtaagctctacagtactgcaactagtccaatgggacatcatatattccagtggatgaaaaaaagaagatatcctcatagtaacaaacaaagtactacatgtagcattatgccattatctacattttcttcaatgatctacatatatttagtctagtggtagtgtactactactctcagcttgtgctacaatctgtttcttgtcatattgtcatatgttttgttttctgaaatggtgttgctgttatcttcttgtcagtttaccatgctttatgaagattctacatttgtagtgaaaatattgaaactcacatgtgattcctacttgatctcaaactttcttttttctttcaagaaaagaatgagttgacccagaatctacaaagtacagacactgatgagatgaactgcacgcatgcatgaacaaggtcagcagcagactgagtgagtgagattcagaattttgtttctccatgaaccaagggacgcataaatcaagtcaacgaggcactgacaccgtgtctgaaatgacccaaaacaaaagtgtccgatcccaaggtcattccgacgcttgcatcgatccaagcaacagctgtcggcacggcgaaaactcgacgccgtctacggtctcctgcttctccaattccaatcatcctcaccaacagcagatgcatcatgcattgctagctatagctagctcttacaattcatgatcgaatcaatgtagaataatatagttattagtattcctctcacagagtagtgactctttcttgcaacagattagtaataaaaagcaaaaggtaaactggttcttggcttctcataaagccaacttgtgctttgtttaatcaccaactggttactactactgccattggt

SEQ ID NO: 15862 - DNA, 1501 bp, Oryza sativa
gtgcgatgaaaaaatcacatggagattaatttttaaaacgtagataactgaaaattttcaaaaaaaaggggaatgggcatgtgccattcgtccaagagaaaaggcatgtcacgaaagacagaagaagcagggttcgaaagacaaatgaccaaaagaaaggacccccggcccgttacggataaaaccacaggtaccgagcaataaaataatgcccaaaaaaaattgaaaaatcactaagagggtttaacaaggaccaatccccgatgactaagtttccatttttccaaccaagtcataaaaaatgtgcgaacaaaaaaaagagctgaggtagaataattgactaaataagtcataaacaatttgagggtgccaaatgatttagaacgtaaatatcgccatgaacagagcgcccgcctctcatcaagatctacaacttttatttaggtcatttttctatataactttttttcccaacagcttaatattgattttgaatatatgacaaatctaaacagcatttgtaaatacgaaatgattttacatgggaatatggtcaacaacaaagttgatcctctcatcaagatctacaacttttcttttggtcactttttcatccgacaaagtgataattatattattcacaaaaatcacatttctctcatctggttcataaacatcaacacatatatgtcaattttataaacattgatactatcactttgtcggatgaagaagtgaccaaaataaaagttgtagatcttgataagtcgtacaactttgctttttatggctttcccatttgaaatcagttagtatttacaaatgctgtttagatttgtcatattttcaaaatcaatttcaagctgttggaaacaaagttatatagacaaatgaccaaaataaaagttgtagatcttgatgagaggatcaactttgtttttgaccatattcccatttgaaatcatttagtatttacaaatgctgtttagatttgtcatatattcaaaatcaatttcaagttgttgggaaaaaagttatatagaaaaatgactaaaataaaagttgtagatcttgataacctctacaattttgttgttcaccatatttcgatttgaaatcatttagaatatgaaaatatattatgactgataaaatgaattattatacagcagctatatattttgtacgcacaaatataaagacttgtttggaaaaatggaaaaatagtcatcggtgacgggccttagttaaagcccgatagagatatctctatcgggcattatcttatggcccgtcacagatgagtcatccgtgacgggcctgaatgtcatctcaatcgggcattagtatggagcccgtcaccgatgagtcatctgtgacgggccctacggccaagcccgatagagatgactcatcactctactataactagggtttctcagatcggatcaaaaatttttctaagtcccgctacaatttcccgcctccttagaaccctagc

SEQ ID NO: 15863 - DNA, 1501 bp, Oryza sativa
tgtaattacatcgtaattatattataattatatttaaaagtttttcataaagaaacttacgaatattttatagattcttcctataattaactggctatatgaggcatgccactcttcttcaaaggataccatcaggaagtagacgtagacatagatagagatttagatttagatatctccatatctgtatctatatctaaatatgaatccatgtatatatacagacatgacaaatatacagatgatgatacatagaagatactgttagaaaaatctagtcataatttagcatattttaatccaaaaatataacataacaaacatggcatacgaaaaagagtgtcatcaagttatattgctaaccatgaacatgttaatatcataaatagcatcatctagtaacatgttcaacactaaagtgaataaagtgacgtacccagagaacgcttcagatctagaggcattgggggacgtgatggtgttgtcatcaccgttaccgtctcctcctccattggtggtagacacgatcccgattattgatatagaggaagaagaacatgatatagaggaagaagtgccaagagcaatcacgcgttcttcatgctcactacaaacttaatcgtccgcttacccgtgcaggtactcatgtgaacggagttccggaggcctgcgtcccgaacacttatgcccgcatgtgctcagaaccggagattgcgtaagctgctcaggaacagaggatcagaagggtggtgtgttccagaggaagaaccagggagatgaatagaaaaaatgccacactcacgcccatgggctcggctcggcgagggcgtgtggcagtcccaccaccacctcatcaaccgctcaataagtgctctcaattagcattatatataagtcgagttccctccatactggtttccaagacggtattaatccgggaaagtgatttcatccctcaagaggatatccccttgtttcgtgcatgttatctaaatagtcatcaaaaaaattggcaagatagattaatatgaaatatatcactccataaacatgatagttaaaattcaacttatataagttgtaacaaaaataacaaatatagatgggaatgtacgataactatttttagtttaatttgttctttttgttacaacttgtagaagttgaatttggtcttgcatgtttatgggtgatatatttcatattaatctatgttgttaattttttttcaattttttcataactttttttagatgacatgcaaacaatgagtggatatccccttaagggatgaaaatccatatcttattaattctaatattaattgtgtgccaatgaaatttactagaattaaattggacctagcctatttaattctaatgaatactctctccgtcccaagatatcgtatctagatttatggcataaacatacatgtagctatattttggaacggagggtgtagataggctgcgtgagcatgtgatttgtcttataaaaa

SEQ ID NO: 15864 - DNA, 1501 bp, Oryza sativa; identical to SEQ ID NO: 14968

SEQ ID NO: 15865 - DNA, 1501 bp, Oryza sativa; identical to SEQ ID NO: 14967

SEQ ID NO: 15866 - DNA, 1501 bp, Oryza sativa
tctacccatgtcctgtacgtatatacatagcaagcttgcaagccatgggttatacacttattacgtacgcttgattgcatgtagctagtatccatatatgtacggttgtggctctagttgtggttgcatgataattcgaagatgctttgtagtttctacagtgattgtatatttgtattgctcatgtaaaagtgtttaactgtatttaacctcatcacgtgtactaatgttaattaattaaatactgaataaaatttatacgtccctacatgaagggagagttcttgttttctcatttggggagttcttcgtggtgatcgatcgatttagttatgttagtagagccatactgttgctacttgtgaacttgaatgatctaattataaataattaaatacaaataaagcatgcaattattagacagttgatggatcaattagttatattgctgcttcacgccatagcatctactgatttgcgcccttctacattacaatattataccgtacacagataaaaattatgatgaccaatttgtagttccatgcctcttttttttttgcatcaattccaaatatgcttggataaatatttacatttcacattaaggacaaattatttttatcgaggaaagaacagctgagggaagtgctccccctccggtagtggactaaattttcatcgtttcatgatctaaggggatgtttagatccaggggtgtaaagttttggcgtaccacatcgggtattatacagggtgtcgtatgtggtgttcgggcactaataaaaaaataattacagaatccgtcagtaaaccacgagacgaatttattaagtctaattaatccattattagcaaatatttactgtagcaccacattgtcaaattatggagcaatttggattaaaagattcgtctcgtaaattagtcacaatctgtacaattagttatatttttagcctatatttaatacttcatgcaagtgttcaaacgttcgatgtgacaaagtgaaaaattttagggtgggatctaaacaggacctaaatctcgatcttattgctgcttctgtgataagaaagttcatatagtgccagcagaccattgggaagggatggggccttctaatgcgatgccccctccgtacacaaatatagcaagagatagtattggattatatacatattaatactacgaatctacatgagtagcaaatattcaagagttgtgactctgttcattttgactatcaagcatacacatggtatatttgtaataatcaacaggtggtgtaaaaattaatatataaattgttgcattttaatataacattaagcaaacgcataacattataatagcaatgctgtgaaattttctgaattaattactaatattgtagttcggtatgcatatatttacagttgtctatctacctaaaaaccatgaattatacaagatagacatttactaacgatgaatatatgtacatgaagcacaaatgtgg

SEQ ID NO: 15867 - DNA, 1501 bp, Oryza sativa
  unsure (1)..(1501): unsure at all n locations
tcctctctgtctccagattccttttcaagtacaactactgtgcaatgagtactacctaagcagctatatagcatcttataattcagacacaaagctggcaatatagtccatgaaggggttaaggaccatgtagtaagctgtctcatggggtcgatccatcattagaaccatgatgaaattgatgagttgagtcgaaaatgatgagctagccagccattgccactgtaccatcatttgatcgatctgctgcttaacccaaaccgatcgatcgaccgaccgaccgagccatgagaccagcagggctccacccagcagcagccatctcgacatgcccaaactggattgtctctcaattttcacccgggaccaacaataatgtcggcatgattaaggcccccgtttggttttagaatggatttttaggagtaattatgtttatttgtaattttagatgtgagagatcgagttagtgcagtggaaaggggtgtacgattccaactccaagattccgtgttcaattcctaacacgcttataattatttcttaaacaaatgtttggagggacgtagcgccctccaaatctcttttttttctagacaacaattttctcacaaaacaaaattacaacagtttacaaatctattcgaggttgaattttatgaacgatgctaatgctttgtaataatgaatagttgaatgcatgtacaccttatgcaaaagctggaatatttctttatccaaaaatacgaattcatgctattactctgacataccaaagattgaaataggtagatagcgtaggatttttcaaaggaattgaattaaatcgtatgaaaatcctgcaaaattcctccaaataccgtcagtaaagcttcttgcactgtggctagcttcaagctcaaaactgaagctcaaaaattcctagattggcacaactacacaacatctgaaatcgtgcagccgcactccatatatttcttacacagatcgatagcgactcacccaagcacacgtacacagcaacaaatattttggatgaagaannaatatctnccttgactggactagtttattagctgctaatctcacctgggacgaagaatccccaatattattattcagatgattgatacactcgcaagcatgcagctgcaattctactaccttcttcgtcttcttctcatcaagctctatagctgtattctgtaatggtgcccgttaagtcaaaacaacaacctcgatcgcaaactgcaggatcgtcccttggcttggcctcaagaatcttcaaagcagatccacccacgcgccaccagctcatcattgtcgaccaatcttcttttcttgatttcaatccatgatcttctcatctatttatacccctcgtcttcttctcctcctctcttcatcgtctccgacgccgacgaactcccactcactagtagcacttacttgtagctattgatctagagcacttaagacatggagaggcaaggcttggatc

SEQ ID NO: 15868 - DNA, 1501 bp, Oryza sativa
cccgttcatcctcgccggctcgtcgtctcgcggcgccgcctccgtcatcgtcattgcagcggcgtggagcacgccgtcctcgtcctcgtgcagccgctgccggctgtcctcgtcgcctccttcgccgtcccggtcgtcgtcgtcatcgtcgtcctctcgtcgttcccgggcgtcgcggcgttcgtccctccgtcgagccgttctcgtccgtcgtccgcgttcgtcaagcgagccgctgcagccccgtcgtcgtcttcgtcctcggctccgcgtcgtcaagcttcgtgccggccgcgtctcgccttcgtccaaggatcgccgccgaagtcgttccctcgccgtctgtctccgccgcgcccgttcgtcgttgtcgttcccacgcctcgtcgcgtggtggtaaggtctcccctcttgctgccccgtcctcgtcctttcgttgtcgcccgtgctcgttgtgcggttgtcgaccccggtacccgtgtaccggtgtcggtagtcgttcgcttgtgcgtgtggtgaccgtgttagtgtgcccgctcggtagccgcgtggtttccacgtgtgcagcccgtgtggtgtctagtggactccgttggtcggccactcgcctcggttgacacacgggatccgcttccgtcgacccgtggaccgtctctgtgtactcggtctgccgcggtcctttttgttgacatgtgaggtccgcatgtcaacggcgcagccttcctgtcttttctaggctagcgcttacacatgttttataattgcaaagcttaattataataacccgtaaatctccatataacatcattaaacttcggatgatcatatcttggtcatacgaactccgaatcgacccgttcaagtctcttaatgtttgttataacctaaagaactctgtgctttctttttatgtattgttattgcttctttataggcttgtagctttgcttgtgtgcttcgcgtagctttcgtcgttccggaggttcccgaagcgtggttcgcggccgtcgccgaaggttcggaaggccgttatctctgagcaaggcaagtcacatcatccttgagcatattgaatcccagtttataaaattattttaatttaaattaatgcattatcgctttatttaaattcccgcgttatcactgttttatttagccatgcctatttacctttgttatgaccttattattattgctattgttattattaccttgttcaccctaggataaacaaaaccccaactagtgggtattctattcatggttccactagtatgaatttaggtagatgcttcgctgattaattaggcaatattaggtggttttataactttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaa

SEQ ID NO: 15869 - DNA, 1501 bp, Oryza sativa
gcattcaaacggccggatttgctcccgcaaatctcgccggtgccattgatgacggccggacctcccgcgctggtttccttccccgccggccgccctctctccctcccaatcctatttaaaccctccctgcgcctccctcgcccgtttccgccacttgccgcaccgtctccccgtcggaatcgagttcgcgccgtcgccctctctctcctccgtcgccgacgacctccggccggccctctccgctcgccaggaccgtctcccgcctcggcgtcgccttctccggcttcgccgcatcgtcgccgaccccgtccaccacctcgccgagctcgccgaccgccggagcgccgtcgtccccatccacccgagtcgcgccgccgccttcctccgctccggccgcctcctttgtcgtcgccgtcgacccggggtgagccgtggaccgccgcctcttttcccccttcccttcccctttcttggccgccgctccgctgttcctatggccgccgccggcgaccataggggcgcgggcgccgcctcccgccggctgcaccgtggtggccgcctccgggcgagccgtgtggccgccgcgtggggcccagccgtcagccgcccgcgccctcgggtgcggctgacgcgtggggcccacggcgccggccggtgtgagcccgggtgcgccagtccaccgtggaccgtgaggctgccgcgtgggccccactcccgtggacccggtccgcgcgccccctcccctcggctgacgcaataaatcctttttaaattaaaatttaaatgaagaaattcgcaaatattcacttaaagaacatataaacttcaaatggccataacttagccatttgaactcagaattggaccgttcaagtctctaatttttcctcaagaagtcaagaacccatttttgtgctttgttcctgcttgttatatggagtttattagagtaaaagcctttttcctttccgttggtcgtgtagacgctgcagcttcggaagatccgctctacgtggaggttgaagccgacgtttgggaaagcgactaaggcaagtcacatcatccttgagcatattgaatcccagtttataaaattattttgatttaaattattgcattatcgctttatttaaattcccgtgttatcactgttttatttagccatgcctatttacctttgttatgaccttattattattgttattgttattattaccttgttcaccctagaataaacaaaaccccaactagtgggtactctatttatggtaccactagtaggaatttaggtagatgcttcgctgtttaattaggcaacattaggtggttttataactctagactttgggaatattcatatcacttggacattgtggaatggttggattattgtggaattggattcacacctccccctctattcaaaaccctcaaaatggttttaggctgggctcgcggtgcacggttttgatagtagcacctcggccacataaggaccggt

SEQ ID NO: 15870 - DNA, 442 bp, Oryza sativa
ctgtcggtaacatgggccgggggtatcgggaatacaggcttgggtagccgcggtcacccacgtggcctgaccccctcgggggggggggggggtcgggcccgagggtgacgtggccacccctccctctgtctccccgaggggtcgggccgctcctgtttcggccccgagggctggggcgcccccgtttcggccccgagggctggggcgccccgaccccctgtggttttggcgccacgtgtgtgggttaggtgagcacagcggggctcacctaaccgcatttatagcaggttggacgagcgcgccacgccgcatttaatgcggcgcagcgcacgcttatccggtccgtgaccggtcgcggtgtgtgaccggtcacagaccggtcagatcgcgggttaggtggcaacaggcggcctgtcacacgcctcgccccgtcccgtcggaa

SEQ ID NO: 15871 - DNA, 1501 bp, Oryza sativa
aaagaaagaaaataaaagcaatgcatgggctgtatagtactcatataggggatgctagaactggaatagcaaaaaggacatatgagacccctcttgtcaccaaaatacaaaatcattcctcaaccaaaaaaccagttctgtaaattgaagagtccgatatgtctgatttttttcgttgagagatgattttgtataatttggtgacaagataaagacctcggatatactttttttttaattacaactggaataccgtacagcactagaaggtcccaagtatagtaggccgaatgggcggcccggcccagcgcggtacgggcccaccaaaagcacggcccattaggcacggttccatagcgggccgtgccgtgccagcccacgtgccgtccctccggcccaagcacggcccaaggggacgtcgtgccgtgccgtgccggcacgggcccattagtggcacgtgggccggcgccggcccgaaggcacgcgggaggtcgaaagtcgcgccgtcgtctaccgcccgcctggcgcgcgacgcgtggaggcgaaagattggagccgcggctcgcccgatgcggcacgggcgcacggcggcgacgcaagcgtgcataagaacgggagattttgaccaaaaaaatatgcgaaaagaaaaggaatgcatgttggttgggtgcatcagtgcatgcatgtttttgacgtcgccgaggtcatttatgcagcaatactaagggagaattaattcaagaagcaattatgatgcatgttagttggggtggatgcacgcatgcactgcctattcggttcctgtgcatgccacacaaactaaccatgcacgcttgcatgctgtaaaaaaggagcgagttttaactaatctcgggctgcgctgcggttggtggctggggacggcgctacaggctgcggcatgcggcccgatggcttcggcctctcgtgctgtgccgggccacgcgtcgggccgtgctggcccacgggcttaggcgtcggcccaggcacggcacgcccgagcacggcccataagctcacgggcccgtgctgtgccgtgtcggttactgtagcatcgtgcttgggcgggcccgacagagcacggcccatttggccagctatatgggagagagagcaaacgaacggaataagttcaccagaggtcccttaatttgatagcgagattttttgaggtccctaaaccccaaaaccagaaatgtgtgcccctcaactctcacaaaccgttcacgggaggtccctcggcagtatttttgcccggttttgctgacgtggcatactagtcagcaaaaaaaattaaaaaaagtacgtgggacccacatgtaagtgacaaaaatatgaggtcagatcctactcagcatccctttttctctcctcctctttcgtctttatatttgccgcagaggggagcggcagcggcggagcgaggcggcggagcggcgggcgagcggctcggaggagcagaggggcttgggaccgggcgagc

SEQ ID NO: 15872 - DNA, 1501 bp, Oryza sativa
atatacaaatccatcataataacgttacatacttacaaagaaaagaaaacagcagcggaattaacggtctagcgatggcttcagctccactcccacaggcagctcaactggggtataagccaaacgtcttctccttccggatcctttatcttcaactgaggtttgatgattattgcaagaatgagcatatgacatactcaacaagccacacagcaaatatgcaagtgcacaaggattccaaaggatggcataatataggctcatttgcaaaagcagcatttagcaaagatttaagataagtaaaacagtagagtaattaatcaccaattttaatcaacactgaacagcacacccatgctgctcaggcccaaccaaacctgaacaaccaaccccggtcatacagatcaaacctccaaaccaggaattatccattccaaaccaggagtcaaattaattatcacattattaatattgatgagtagtgtgagactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccgtacctggatcataatcacccccttataaacaaggcatggactccccagcgatccccatggatgtcacgtcctgataaattcatcccgaaaataaaaatcattctctaaaaggaataatagaattaattaaaattcgaaaagaaattggcaaacactaaaatacgtgcaagaaaaattcaaatgtggcccggagaatttttgttaaattctccttggtctaaaaataagccctcaaattttacttgaattttcagagcaccggaaatatttattaaacaacaacatttatcaaagttcaataaaaagaaaacctaaaaatccctcctcttcctcctttgggccaagcccagcccgaagtccttccctcctccctctctttctctccctctccttctctccctcctcttgggcctcctcccctctcggcccagctccctttcccccctctctctcccgggctgcctctttccccccccctccttcccggcctgcctcggcccagccgcccggcccaagccgcctcccccttccccccccctcctgggccggccgcccggcccaacccgagcggcgccctcccgcccgagcgcgcacgtgcgcgcgctgaccgcgcgccccgcgtggggcccacgcgtcaggccgccgtcgccttcttcctccagccgccgcccggcttccctctccccgtgcgaaccctagctcactccctcctccaaatccgcttgattcgcttggttaattccaaaattaaataggggaaattaatccccattgactcctcttcatttccccctaatttcccctttgaa

SEQ ID NO: 15873 - DNA, 1501 bp, Oryza sativa
agtttttatcattaatatattatctatcagcaccttagaatgcaccgacgcatgcatggctttagtatctaggctatgatagtttgatctacggaggtagaaaaatgaactaaataactaaaaataatttatagataaaattttatatatgtattcttacttcttagcggtttaaaaagtgaatgacacaaaaactaactacaatgagaaaacatcaaaattaagttcaaaattaaagttttaaagtataaaatttgatcatgactacaaacagacgatgagagacatccaaaatactctatccgttcacaataaaagggacatggtagctcatcatttgtacacaaatataaaagattagtagtactagtacattaatcacccgtagtttaattttctttccattctaccttcaaccccttcttttataatagttttctttttgttctcattcttaatcgttttaaaagtctctataatttcttaaaaaacagagggcccggggcacttggtaggacagatccccgatcgattttccggccgtgcagatacacatcagaagaacatgcatggtgatctgttcttctcgatctctcttccgatcgaacggttcgatcagtacgcgcgtacatacacatgcgacagtacgcagtacacgcgattgaattactgcattgcatttttgcatcggcaataggcgttggtaactcggtgatgagcagtaacaagtgagtcagaagacgatcgatcgatcgatgaatatcggctgtgtttagttcacacaaaaattagaagtttggttaaaattagaacgatgtgacggaaaagttaaaaatttgtatgtgtagaaaaattttgatgtgatgaaaaagttgggaactaaacaagggcatcggtagataggccgagtttagttccaaacttttttttttcaaacttccaactcccatctatctatagggtgtgtttaattcctgaaaaaattgaaagtttgaagaaagttaggagtttagaaaaaaaattaaaagtttatgtgtataaaaatttttataatgtgatatgatgtgatgtaaagttagaaataggggagaaactaaacacggcctaaacacaccctatagatagatggaggggccacgcggttggccatattttaatttgcagttgcaaattgctcgcaaatggcagtagcaatctctccatcgtcgttgcagctgcagctgcagcagtagcagcagcctttgcttgcactggccgacctgacaaatctcgccgtatgccagctcgcctgcccgtccggccgtccggctggccggccggcgccattagagtacgcacgtacgtactacgacgttgaagacgaccaccaccagtggctggccggcttgctctgcttgtctctccctcttctctcacccaacataatctgaactatctgaagaaacaaatttgaggtggtatctgaacataatgggattacaaatttctctctgcttacaaa

SEQ ID NO: 15874 - DNA, 1501 bp, Oryza sativa
attggtcctagcttattccatgttctcaggatgaccactggtgtcagaaggttgaagctagaattacataatcattataaacgagaggtaaaagctgaaactatacttggtttgtttatctgatgcagagttactaaggaagttacgagaagcaatttgtatttacatttcctgtcacactaggcttgatttgctattttgctacttgccctactctatatagtggtttgatactgatatatgtagtaaatgtgtgacatatgcatctcctatcggcaatactttggggcaacacaacaaggatttagaagatgatactaactggctatgcgttattgatattagaatacttaggacgtgcgtaaatttatactccgttttcacagaactttctcataggacagaggttggcttcaaactagtacccaagttgttattcttttgcagacttttttatgctggtttatctcgagttgttcaggcagcctgacagcttgaggcaagcttaatgttgctacactaatataccgctcttttcagttttgtggatcggattgtgtttgtgatcttccaccaaactggacatccgaggaacttgtgttgaactcccttcgtgaagtgcaaatcactaacctgagaggaactgagaacgaatttgctgttgtggagcggctattcagttgggcagcagtgctgaaacagatgacaataaatttccataactcaatcaccgtgagcactgcaagagagttgtgcgagatgttactgagcttctccaggccagagataagcatgaaattttacattaaccagggatcacgtaaggttttgtatgttccagaagactaatgtgcctcatcaggcttgccagttgactagtgaagtagaactcattttgctttcttcctttctctgatggattgatgaaagaattctgtggacttggttctttgatggtgatgaaacacaacttatctgggttcccaatcctggaattgaatggcaagaatcaatctcttggttggaaaaaaaaatgaaacgaatttttttttcatctcatcgttctacatgttgggtaggcttaatgtgtggctccagcctccggacaggaaaactcttctgatctttctgctcagatatgctactgctgctaagctcaatctgcatcacactagactgtagctgaatgctacctggatttgtaagctagcctggatttgtatttcagcttggatttgtatttttggtcggatttatttgggccgtccatgcagatatctcgcagcagcagcagcatctgcacgttactcacgtggcatctccaactctaccgccaaaatttgtattctttttttgaaaaaaaaatcgttggctcccgcgaccgcgacgcctcgtcgcggccttggtggtagagtacaagaaggagccaggcttctcttctcctcgagccagcagcaacacgcacgcacgcaccacacacgtagcagcagagcaatggcgg

SEQ ID NO: 15875 - DNA, 1501 bp, Oryza sativa
caggctttatttttggattggtggcccggtggatcttggatagcttcttttttttttttttttgcgttggcacgttggtacgctacagtgctacttcggtcttggaaaaaaaaacgcggcttattctattgcggtatttgcagattacaccacctttgattttttttttgttgtattataagtacaaagtgtctatgtataaccttactcattaatatatttaaaaaataattattttactactacgaccttctatgtcatgggttcatagatgagagtgttatggttatagataagtcatacctcctgtcctacaacttataggatatactaatacaacataccttcatggcaaaatatatttccgtatatgtcggtgacatggggccgggggtatcgtgactagaggcttgggtagctgcggtcacccacgtggcctgaccccctggggggggggggtcgggcccgagggtgacgtggccacccctccctctgtctccccgaggggtcgggccgctcccgtttcggccccgagggctggggcgcccccgtttcggccccgagggctgcgacgccccgaccccctgtggttttggcgccacgtgtgtgagttaggtgagcacagcggggctcacctaaccgcatttataacaggttggacgagcgcgccacgccgcatttaatgcggcgcggcgcacgcttatccggtccgtgaccggtcgcggcgtgtgaccggtcacagaccggtcagatcgtgggttaggtggcaacaggcggcctgtcacacgcctcgccccgtcccgtcgaaacgatgagagcttcctggctctcgtccctagccggagccggcgtgctaactcctggagttggtatgtcagtcccggtcagatccattccaggcttcagcgcaagcatggcaaggaagtcgctggccattgaatgaaggttgaaatgggcgtccaccgggaaagctggcgaggggggcaggagacgtgtgctctgcttgtcagaggtcacttccgactgtagactagccctcattgtaaaaagcatgtttcctttcttaggtagcaagaggcccttgtggtgacccctgaccagataaaaaggaggcccaggcctaggagagggggggacgctggagggaggagaaaaaagggaatgggtgctagaccctgaactctggctcgctctccagctctctgtattccttcacgcacagatccaccagaacacaggagtagggtgttacgcttctcagcggcccgaacctgtctacgtcgcccgtgtcttgtgcacttcctctctcgcggacgttcctcagatcgagggcgaagaacctcacttagcgcccccggccgaaccggcaaaggggggcctgcgcggtctcccggtgaggagccccacgctccgtcatctggcgcgccaggtagggggcgcgcatgtctttctaagccctcgtcctctttcgtgtgcgccaagcttctcccgctcagcttaa

SEQ ID NO: 15876 - DNA, 793 bp, Oryza sativa
atagagatacactccctctgattacaaatatatagcgttttggtgactgtatcgctatttaaaatgttacttatttacatgtagagatagcacttgctattttcattaaatgataggttttgtagtactcactattcccactaaatgatacttatttacgatggccaagcaatacaccagggactgcaaatactacaccaataagcccaaacaaagatgactcaagacctaagagcaattactataaggctttaagtgcttcctctagaagtgttacatgggattaggtgatggtggagtagagaagtgagaagggagagaggacgagccacctctcatacaacgggcaatatctatgcaatctccaagaaaagtgtaaagagaaagtgtaatagtgtgaaagtgaaccaacaatataaaattatgggttaattggatccatgccactgtaattttgtcatattagataattccactactattcacgaaatctgctacgtgccattacaactttgtaaaattagatccatgccaccgccgtcacatttttcatccatcgccgtcacacttcagtgtgggattgggacccacatgtcagctccatcctcttcctccatcccctctctccttccttccccatctctcttcggcgagcatggccgacgaataccagcagcatgtggccggcaacagcagtagcagcagcagcagtagccggccgatggcggcagcgagggtcacgaacgccgtcgcgtcctccgtgcaccccacgttctgcacccacctgtgccgc

SEQ ID NO: 15877 - DNA, 724 bp, Oryza sativa
acatatcatatcactatgaatatgtatatgtttatgcagtatgtattacatgttgttttgtgtttatttatttttgggatggagagattcagctttcagcccccatcgtttggcatatctacaatcgaaaaataatttgtgaatgaaatttttacatacatattcttaatgatctaaaagtaaaggctgaaaaataagtttcgatgaaaaaaaaatcaaaatcaacttcaaatttaagtttgaaaatttaaattttggctgacaattcaaatttcccaaacataaatgatagaagaccacaactattttattaaaattgtagattgtagatttgcccaacttgagctaattttagaaaacaaaaactaaataatataggtggatcgggcccaacagatgctgtgttgtcgtgactacgccatccttggatcgggcccagcccacgccagaatggctgacctgtcaatttagttgcagcccaatcatggtagacccattagtaggagcctacggcccacatggtcttgcaagaggcccatccgaataaaacaaccggacgtcgtcttccccatcctggttgggttggagtcggagagccgagagcgtctcgccgcctaccgctcgctcatttgggcagaaaccctagccctaggcgagcccctaaaccccaacctcgcccgcgatttcctccccgagggcgtcgaggggaggtaggttggcgcca

SEQ ID NO: 15878 - DNA, 255 bp, Oryza sativa
aaggagttccgaataagaaatgacaagaataattctacatgaaaacaacaagtactacttagattgtatacatattgatcttcctaattttacttggacaagagaacatctatggatataaatacaagccccctaggaggagaggagacaaataaacaagccacaagccacaacatatacacaagccaagatacaccgccagatatcgacatcagagattagcctagacaaacccaatccggtgcctacgaaagc

SEQ ID NO: 15879 - DNA, 1501 bp, Oryza sativa
atgtcttttggcttgtcccctctcctcctaggggggcttgtatttatacccatacatgcccccttgtccaagtagaactagagagaccaatatggatacaatccgagtagtccttgtcgtttccatgtagaactctatttgtccttccttatccataactccttctatatacgaggtttgtttccgtataaaacatgttatgtggtgggccttgccgagcttagtcaattagtgttaggtatatagtatccataaccctgacagtagctcctgacttcaatgcaaatgaacgagttcatgtcctgaaccgaagactttggaataactattgtcgtgctcacctgaccattctcggtgagatcagagatatcgctatattccccttatcgacctccacaggcactatattgggtttgtctaggtcccaatgcctactcagaaggtatggagtttgcgactaagtcccccatcttgctataatcgagaatttggattgaagtcaagaaattccatctcggcgggtacaccatcgcttcattccatattctttgttgagctccatcaaccgttctcgagtaatcgagtgggcatagagactgcgacaaagccttgaaatctgactagactgttataatgtctgactttcagaaatttacgtagatgctaagacgaccaccacattgggcaatggccaggtgtatagttgtagtcaacaaatcacagaagtagtgagagaatcactacaccgcaggtcgaagaccagttatagtcataactcgaccacttgaagtggaggtacgagagattgctacgacctacgagttcgagaaccaggagtaggagtctctcaaccgtttgaaattgaggtgcgaggaccgcaacgtagtaggtcgaagaccagtcgtagtcgtacatggaccattagaagccgtggtgtggagatcgctacgttgctggtcgaagaccagtcgtagtcgtacctcgacaattagaagtcgtggtgcgaggatcgctacgtttctggtcaaagaccagtcgtagtcgtacctcgaccattagaagtcctggtgtgaggatctctacgtttctggtcgaagaccagtcgtagtcgtatctcaaccattagaagtcgtggtaggaggatcgctacgttgttggtcgaggaccagtcgtagtcgtacctcgaccattagaagtcgtggtgcgaggatgtcatgtcctgataaattcatcttgaaaaaaaaaatcattctctaaaaggaataatagaattaattaaaattcgaaaaaaattggttaacattaaaatgcgtacaagaaaaattcgaatgtggcccggagaatttttgtttaattccccttggtctaaaatgagccctcaaattttacttgaattttcagagcaccaaaaaaaattattaagcaacaacaaccattataagagtttattaaaaagaaaacctgaaaataatcctcctttgggccaagcctggtccaaagt

SEQ ID NO: 15880 - DNA, 353 bp, Oryza sativa
gtatatttaacgatgaatcaaatgataggaaaataattaattattacttatgtcagggttatggataccacatacctaatagtagttgactaaatctcggcagggcccaccacataccatgtcctatacggaaacaacctgcggatataggaggagttccggataaggaaagacaaccagagttctacatggaaacgataagaattactcggattgtatccatattagtttcccagttctacttggacaagggaacacctatgggtataaatacaaggccccctaggaggagaggggagacacgaccaacacaatcaacagacacccaccatagatcaagacacaagatcaac

SEQ ID NO: 15881 - DNA, 1025 bp, Oryza sativa
catgacaaggcatttccaaagccgacacaggtttaccatatgccgacgagaggggtcccagaccaacaacaggttagctcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcgagagcggaaagccgtacacccggtacgttccccgatccgcggttttggaaattcatttaattcgcaagcaccgacccaggtgtcgggttttccaagtctttgtaaaacccaagtttacccaagttgtttttttcagattttaagtttgaaggcgtccgtcgatactcgcactgggtgcacgaatatcatgacgcaactagatggatacaagggggacatgatataacaaataacaaaggaagggtcaaatgtaacaaattaggtaggtccgccaatctgccttgtagacgggacaaacagattaagtgcgatcctaacaatgcataatatttttcaagcaacataattaaatttcaaatatagcctcaagatgttcaaaggtggcttgccttgctcgagatctggagcttgatcctcgaaatcctcgcactgcgggtcttcgggctccgaaactacacgcgaaacgggacaactcaacaaatggagaaaataaagccctattaatgacctctaagcgtgccattaggtagatctcgagatttgaggaattttggaagttggacggagtcaaacggatttacggttgggaagatattgaatttctaagattattggatttttggtctaagggaaaaggatttaattaaatcctttttggaaaagaaaagaaaagaaaagagaagagggagggaaattagactttcctcgggcggctagggcgctgcccgagagaattggggcggctcggccgagcttaaa

SEQ ID NO: 15882 - DNA, 1501 bp, Oryza sativa
aatttagagaagcaccaaacatgtgtcatgataggatgtgaacgtataactccacctagcatgttttaaatttgcacttacatattacacatatatagttgcatatgtgaatacattttactcctacgtaataagagtttagtgagattaaagatatattattggtctcgtgtcagaacgtaatagcaattacctacataggatgtgtgtgcatgtcttttgtttggttgaagaacttatctttttcaagcttagtatgaaatatgtaaacagctctgtaagtattaggagcctactattgtagcagagactattcgtcgctcctttctactctctccgtttcacaatgtaagttattctagaattttctatatttatattgatgttagattcattaacatcaatataaatgtaaaaaatactaaaataacttacattgtgaaacggaggtagtatctccgaccaagacacaccggccgggtccttagctgttgtgtacttcaagttttcaagcaggtgtcagaaggataattgtcgaggagagtaaccttcatcgggaacattttgagtgggcataaggtatttgagctaatcacgagaagaaagccaaactacatgcgaaggatgtggatgaagctcggccatgatacctggaaggaatattctactagaagaaaccaaggaccattccaactgctcttacaagctagcacaagcataaatgggccagatagccaattgattataccatgatacccttagggttcctagtccaatgagggcaccgttgtaacttcacatgtattttttctagctataaaggctgacttaatcatgcgggggcgtatcatatcatatgtacacaagccctcacgtgtatatatcgtggacatgaactaaaatatataaaaaaatatagaaaaattatacatgtactttcattagtattgcatctacgtgcaaaatcacatcttcaaattcatcttacatagagtaacaaattctgatagaactataaccttaaaactatcattttttgttatgatagattaaaatataataaatttgatattaagattttacctgtatgtgtaatactatacatgtataaatttttaaattttttgataatatttgttatttggtgtgtacgatatgtacacatgatagcttatgtacacaaaacatgttcatgacgcagattacatctttactggaactgtgacagtgaaagccttttttccaacaccagcactttttcgaatgttttcagaaaaaaaaattccgaatgcatttatataaaatagaaaacaataaaaagcctaaaagagttgtccaagtcaggcagaatgggataggcgcttcccgtgggcgatgacgcctttcgcgcttatctttcccgctgctccgcgtcttccagagaagcgagacgaccttggcacccagcttccgtcactcgctcgccgcgctatataaaccccacatccttgcagcggttttg

SEQ ID NO: 15883 - DNA, 1501 bp, Oryza sativa
agcacaagcataaatgggccagatagccaattgattataccatgatacccttagggttcctagtccaatgagggcaccgttgtaacttcacatgtattttttctagctataaaggctgacttaatcatgcgggggcgtatcatatcatatgtacacaagccctcacgtgtatatatcgtggacatgaactaaaatatataaaaaaatatagaaaaattatacatgtactttcattagtattgcatctacgtgcaaaatcacatcttcaaattcatcttacatagagtaacaaattctgatagaactataaccttaaaactatcattttttgttatgatagattaaaatataataaatttgatattaagattttacctgtatgtgtaatactatacatgtataaatttttaaattttttgataatatttgttatttggtgtgtacgatatgtacacatgatagcttatgtacacaaaacatgttcatgacgcagattacatctttactggaactgtgacagtgaaagccttttttccaacaccagcactttttcgaatgttttcagaaaaaaaaattccgaatgcatttatataaaatagaaaacaataaaaagcctaaaagagttgtccaagtcaggcagaatgggataggcgcttcccgtgggcgatgacgcctttcgcgcttatctttcccgctgctccgcgtcttccagagaagcgagacgaccttggcacccagcttccgtcactcgctcgccgcgctatataaaccccacatccttgcagcggttttgccgcaatcaacaagaacaaacagctatcaccccgcgatccatttgcccaatcagatcaaggcgtgtagatttgattttggttttattactcgcaacctgcacgttgccctcagtcacctggcggcggagagagagatcggagatgagctcggtgtgcgcgaggcccgtcggcgtggggtaccttgtcggcggggcggcgagcagctggtcccagcggcgggggcgtggggtggcggcgccgcgggcgagagtgagggtgtcggcctcggcctcgaccgtggcgccggagaggcgggcggcgacgatgtacgaggtgctggcggtggaggagaccgcgggcgccgaggagatcaaggcggcgtacaggcgcgcggcgcggcggtggcacccggacgcgtgcccggggggagccgagcgcttcatgctggcgcgcgaggcgtacgaggtgctctccgacccggagcggaggcgcggctacgacatccagctccgctgctgcggcgccggcgccggggcccaggcggcgcggcgggccgggttcgccgactgggaggcgcagctcgccgggctccagtggcgggccgcgtcgcgggagacgtgggggagcaggatgcgccaccgtcagccgtctccgtcctgagccgagaatcgcagaattcgcagtggcttttttgaattttgaatttgtgttgagttttctctttttct

SEQ ID NO: 15884 - DNA, 1289 bp, Oryza sativa
ctcgacgcgacctataactttgtagttgaaaagtttttgaactaaaattgtttaaggtcccaaaatattgttgcatgtttatagattttgaaattttaattttaaaattacattttgggacaaaaaatgacttaaaataaaaaaaaattcaactaaaaagttgtagatcgcgtcgaggactacaagtttgatataaagtttgtctttattagagttcacatgaaaaagttatgaactatttttaaatataaagtctttagaccgtcctatttaacccagatgatattcaaatccaagtttagggaccggggtgacacaactgaacaggttggaggacctaaacgagtgatctaaaagtttaaggatcgggatgacacagttgaacaagtttgaggacctgaacagtcgatttgcgagtttcgggaccgggatgacacagcggtacaagtttagggaccggtgatggactttactcttattattttgtgatgaacaattatcatttgagattattgttttgatatttttagattattggtgaagtggttttggagaaggttgattttcagatgataaatagggactgctgtcagtttggaccagttagagcgaactgtggttgccgatcagaccggcgtgtgttgcgcggtcagaccggtcagcccgcggtctgatcggccgaatatgtgtcgatttcggtttcaggttgttttctgtagatatttgtggataaatcatgtttatgatttctagatgaatactaagcgttgttgacagaaaacacgaggcctgggagatctggttaactccagtgcaggtccaaaactcgccttcagatgtatgagcgtgccagttgatttgatcctgcaatcaacaagaaacaaagacaaagaaaccgtggttaaatccataaatgatagccgatcggctaagtgccgatgacatatcatttacctttgggccgatgtcatatatacatcgatcgacaaccataaatgaataaaaaggaactaaatctactcgatcggctgtagatattaataatatataatccttatgtcgatatatacttaaatcaagtgattgggatagatcggtcgccatgccgagacagtataaatcacttagatcgaaatatatattaacaacaagattatatatgttcatagcatagccgatcagatagatctagcatgtatcggctaatactccgataccactctgtattaagatattaaagcaaataggatataccaaacagaagcctaatatacttaaatgcagcaaga

SEQ ID NO: 15885 - DNA, 1501 bp, Oryza sativa
cggcagcaactccgaccgccgctccttcacgcgcggaatgctgcagtccatcaacaacatgacggtcatgcgcgccacgcctcgcgaccccttcgtcgtcgctactgtgacgggtcgttgcgacggcgaccccatcgacgtcgccaaccccgacatcgccgccgccgccgccgccgcggccgaccccgtcgtcgctcctgctgctgctggtggtccttgggacgaggaggaggaggtggagccggcgccggcaactaccgacctacgtgctgctgccaccaccggaggcgaggcgaccgagaccgagaccgccgccgtctgagctgaggtatactatctgcatgcggtcgggttggcctacgttgagaactggattacctttcgttgcattttagtttggactacgtagcttgcatgttgtctgtgataggatcagtagcgatcgccgatcgatggatatctgtgtgtacgtatggttttgcactcgatcgtcgtatttgaacaaagatatatatgtgatatgctgatctggggatatatgttactcctatgtggtgatgcatttcttggtgtgatgatcgatgcacgcgggtttaataacctagcctctattttgcttggattagtacgtttgatcatgcatgttgatttgaagaggtttttgcttcctcgcgttcgttatgaccatctcttgcagaccacaaatttagcacaagtagcacgcacgggcctactcttacactaacactaactagctaattgactgatattcatatgcagttctccaaaaaaaaaaaaactgcaatgttgatttttttttggcagaaattggctagtcatttttttggggggttttgtaccaaagttgcatcttgacatagggtgcgttcgttccggtgagtttaggtgagaaagtacctctattccgcgtgcacgcttcttaaactactaaacggtgtgttttttgtaaaaaatttctatagaaaagttgctttaaaaaatcatattaatccatttttaaagtttaaaatagttaatactcaattaatcatgcgctaatgactcacctcgttttgcgtatcttttcaatcttctcaatctccttctcctcaaactcacccataatttggcaaggcattttctttttcggttacaatgaaatcaaatgacgaatattttggcatttttggcttggttgagtatgctagtgcattagtgccatcagccaccatgagctgccatctgatctccctgcctggcctccggattcgaccgtatgttcgatctttctcacttgtttcttttttttttgaaccatcttttttactttcttttcttctttttggatatatcgatcgtgttcgtgtcgtgtccgatccgtgttacaacttacaacgaccgctcagacagccgggctgggccaattgtatgtacatacccagattaaactgggccgcgtcgttaagttgtcacacaatttgtagctgtcaccgtccagact

SEQ ID NO: 15886 - DNA, 1501 bp, Oryza sativa
ggcggctggcaagcgggccccatgggtcagcggcacaaggtggccggtccaccgtgtaccgggaccacgcgggtggtccaccgccggtccacaggaccgacggtccggatcggcctcaaaggcgatcggacggcgcgggggagccggctaggcacggctcggcttcaaagccgaccggcagccatggcggccggtggtgacacgcgcggtcaccggcgatgaccggcggcggcgcgcgagcgccggcaacggcaagcgacggcgcgggaggcggcggcggacggcgcacagaccggcggcggcagacgaaggcgacggcgcacgcgcggagggcggcggcgctcatgggagagagaggaaaggaaggaggagaggggattcctcaccgaggcgatggcggtgaccggcgtgggaagagacgagcggcggccggcgcttccgacaacggcggacggggtcgagcacaacctgggaaaggcgatgaccgggttagggagaagagaggagccgcggcacggcgaggagaaatggccggagatggaaaccatggcgagctcaccggcggcgcgagggagacggcgctccggcggtgattcgcggcaacgaagcggcggccgaggtagctctcgcggcggcgaagctagcggcggtgattgcgcggcgtggcgacggctctagcgacggcagcgtgcggccggaggcggcggcaagcggcggcgctagcggcgagcggcgcgggctcggtaggaggcacgggaggggacggcaaatgggggaaacgagagagggagctcgggagagtgatttaatgggcgagggaggggaggacgtggccgggaaccctcccgatttagccggcgacgtggggaggagagagagaaagaggggtgggattcgaactcgaatcccgccctctcgagcgcgcgcgcgggccgggagatgcgggggaagaggcggcgacgtggggaggacgcgggagcggcgcggcgtgggcgcggaaagagcggaggaggcggcggcgtggcggattcggcggcggttgccgttggaggcgggtggctggaggaaggggacgacctgacaggtgggccccacctgtcagcgtcccggagagagggggaaggagaacgggccggcccacaaggggaggccgagcgcgggcgacgggtggactgggccgacggcccaagaagaggaaaaaaggaggaaaaaggaaaaagaaaagaagaaaggattttcctgggattaaaattgcactttggtgatttttaattgataaaaattatttccaaggctctgaaaattccactaaaaatcctgttagcattatttgacatgtagaatccaagaaaaattccacatgccgattccgattattatttgcatttattaattagggaattagctctaggttaattaagataatttcttcggacgatttatttagccaatttttaaagcaagcaaaggggggaaaacttcagggcgtgacaatacctat

SEQ ID NO: 15887 - DNA, 1501 bp, Oryza sativa
  unsure (1)..(1501): unsure at all n locations
aataggcctataaaggagtagagtgctaatagttgatgtgatatttaaaaactataaagaaaacctcaatagaatcccaatgacgattaagaggagtaatgatgggcatgccgttaagcagcatggtcacgaagattggcgggacttatagagagtaaaaataaaccccaataataatcatgttcgatttttaaaatctcaatgacaataaggaggggaggtagcgggcgcgttgcaggggagtacagtggcaaagccactaaagatttggcgagatttatagaaagtaaaaaagaacacaaacaataattattatcgatttttaaaatcccaatgacgataaagagaggtggcagtggacgggccatagagtagtaaaattggcgatgtttgatgatacttctaaaatttatganaacgaaacccaacaagacaaaaaaactctaaaactataagggctaatgttccaaagagaataaatagaagtagtggtagatcgagcaagcaaataaaaaggtgacaaagaagtaaggggtagcgactggcgtgccttttaaaatctataaaattgttggaatcacgggaatgataattttaaataaaatcatgtgtaaaaaatagataattttaaattgatgctagccgcgcaattgcgcgggccgcccaactagatttatgtaatgtaagagaaaaacatatatatacacgtaaataagacctattttctttgatttgtagggattatgcatgtgttttgagcatcatgtatatataaagtcaaaggtataatttgtagatcaatatatttttcatagattttgtcaacaattcaagttattagagctataaatgaatggcatgcgagcgcaatagccaactactagctttaaattatatatagccaattcatacaatagttgcttactatactattaatatctggtctcacctgtcatataaacattacgtcttgatgttcgtgctgcagctagcctgctgcttttctctcttttcttttatctttttaaaatatgtttatagctggcttatagtctgctattgtctctactctccaagatcattgtatggttatggataccacatacctaatagtagttgactaaatctcggcaggacccaccacataccatgtcctatacggaaactgacttcagttatggagggagttccggataaggaaagacaaccagagttctacatggaaacgacaaggactactcgaattgtatccatattggttgccctagttctacttggacaaggggatacctgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaggcttgacttcagcagcgggcgactccactccacagg

SEQ ID NO: 15888 - DNA, 1501 bp, Oryza sativa
tactactccctccatcctataatataagacgtgcacatatttcaatattcaacctctaaaacattttaccaacacttagtataatataaaatgaattttgtttattaaaatttatatcattagattgagatttaaatttactttcatatggttataattttgttgttataaacttggtagtatatgaaaaattataagctaaaaattagttttggagaccatgtcaactttgaccatgtcttatattatgggatagagggagtatgttgtatgttgagatttaggtgtttagtaggcattagctttatagaaaaaaagagataaggtgattgatgagaaaagtagtactgtggatggtagaaatccttatattttagcacaatataaaatggaaaacttcttaataaatcaattttggcgttgccattttttggtagcgctggatgtgtatagtttgttgcaatttcaaattttaatattatttttgtgaaataaaaatttcgaaactaccaaagttttgataagatagcattggcaaaattgtttggtaacgttgattcgggtgacagatcatgaaccgttggatctaaaacttgggcggtggatgcacgttacaggtgccagcctaactaatttcaaccgagcagacacgcaacgccagcggcggcggcgaccggcggtggcggtggcggcggcggcggcggccggcgggacttcgcttcttttgtctcctcctcgacgaattgtctccggtattccggcagcgatttttccattcaggtaatcctcaattccttttgcttgctgccttccgccagatttttcctcttcctcgtatgcaatcccagttagagttcgatcgcagtaattaaccccgtgactagaaatcttccagcatcagaatatgtaattagttttattagagaagaatccgtgattagttcggtgcgtgtaaaggtagtctgcaacattgattgatttcgcccgccaaccgttcgacgaaatgacagagccgaagaggtactgttctcctacattaataaccatataaccttgtagatgtacaaatagtttgtgtcttacctcagatggtcaatataacgatcgtgttgaagggactgagccatctgcatgatttatttcttttaaggaaaaagtagttatgcctttttctatattcattatttcaaaataatgacaccacatatgtaaagttcggatggcctagaacgtgtgagggtatttgcccaaactaatgaactgcagtgtgactttttttgttagctcagcatatacaaaatatgaaacctgtaaagaataagtttgaaaaagctgcaattttaatgacaactatcatcttgctacaacattagcgacacatttcacttagctacaacaataacgaatggaattatcagagaattgcaactccattagaccctgaggtttttgactaggcagcccacttgtcatactaagcgtgcttggaggccgtgaaata

SEQ ID NO: 15889 - DNA, 1501 bp, Oryza sativa
cagtcaaataagacaaggttcaaagagatgagggatgacaaatagacttattccatggagaagcacgatgggctctcgtgtcttcggactggcccaacacagcctgagtattattgggccgtgcttgagatattagtgcagcccgtgggtgggcatggcctagcccgactgacctcagcccgagctgcccatttggccatctataggtggagcgcatggtcagcagcacaggctagcaggtggtggcctggtcgccgagatgtccatgggcgttgtgccgtggcaacaaggaagccccatgcgccgtgacccctgcacttgggtcggtaaaagtctaatttgactcccttaaatataggtagaatcgattcatatcattcaaccgcgaaacaaggtatatagtgtccacgtggtagctcattcaataggaagattaaaaataaacgtgagacctatgtggtggatggttcagcattctaacgctgtgaattgattgttgaggtttttagatgatcaatgtgaaaagactatagattggacgacaacaaccttgttgatgtcagttcatattttggattgtgttctttgctccactgcaatgcataattttgcagtgaataaacattccgttgagcacctaccgtgcaacgttgccaatgggaacaagaacaccaatagacagtatgaggcatgaccttgaacctagctatattataaggtttagtgaagattgaagctatgggaaacgattgacttactaattagctcagtttcctccctgattgtgagagccccttgcaatggcagtgcaaggcaggaccactgtgggagtggtgaagtggcgatgccggtggaagagaggatggcaacggcatggccttgccttcgggggcatggcagagtggcaatgctggtggaagagaggacggcgacgctgacggatggcaggaccaccggggacacagcagggtggcgatgccaagggaagagaggattgtgatggcgatggctgcacgaggaaaggatggaacaccagggcgattgcagtggcgaccaagacggagcaacccagccgggtaagggcggactaccgtggtgccagcggggggattggggaggctgcgatttgcggcgggaggaagctatttgcggcaagaggtgcgcaacatttgggaggataacggagatggcgaagtggcaatggctggagaccggcgaggggttttgcgacagcggcctcgcctcctcgcgaagtgccggcaatgcgggaggatgagatttgcagcgggaggcgcagcgacgtccgtaatgcgaggacacgtcatcctaggtggaggcggatagcaggcgaatggcacagccgcatggatggccctggcacggtagcggggatggcgtgcaagggagtggcgatgattaatcatgcgttgtttagggccatggagatggagtcacgcgttctcagtgggaaggattgagaattagtgaattcaccgtatga

SEQ ID NO: 15890 - DNA, 1501 bp, Oryza sativa
catcgccactcccttgcacgccatccccgctaccgtgccagggccatccatgcggctgtgccattcgcctgctatccgcctccacctaggatgacgtgtcctcgcattacggacgtcgctgcgcctcccgctgcaaatctcatcctcccgcattgccggcacttcgcgaggaggcgaggccgctgtcgcaaaacccctcgccggtctccagccattgccacttcgccatctccgttatcctcccaaatgttgcgcacctcttgccgcaaatagcttcctcccgccgcaaatcgcagcctccccaatccccccgctggcaccacggtagtccgcccttacccggctgggttgctccgtcttggtcgccactgcaatcgccctggtgttccatcctttcctcgtgcagccatcgccatcacaatcctctcttcccttggcatcgccaccctgctgtgtccccggtggtcctgccatccgtcagcgtcgccgtcctctcttccaccagcattgccactctgccatgcccccgaaggcaaggccatgccgttgccatcctctcttccaccggcatcgccacttcaccactcccacagtggtcctgccttgcactgccattgcaaggggctctcacaatcagggaggaaactgagctaattagtaagtcaatcgtttcccatagcttcaatcttcactaaaccttataatatagctaggttcaaggtcatgcctcatactgtctattggtgttcttgttcccattggcaacgttgcacggtaggtgctcaacggaatgtttattcactgcaaaattatgcattgcagtggagcaaagaacacaatccaaaatatgaactgacatcaacaaggttgttgtcgtccaatctatagtcttttcacattgatcatctaaaaacctcaacaatcaattcacagcgttagaatgctgaaccatccaccacataggtctcacgtttatttttaatcttcctattgaatgagctaccacgtggacactatataccttgtttcgcggttgaatgatatgaatcgattctacctatatttaagggagtcaaattagacttttaccgacccaagtgcaggggtcacggcgcatggggcttccttgttgccacggcacaacgcccatggacatctcggcgaccaggccaccacctgctagcctgtgctgctgaccatgcgctccacctatagatggccaaatgggcagctcgggctgaggtcagtcgggctaggccatgcccacccacgggctgcactaatatctcaagcacggcccaataatactcaggctgtgttgggccagtccgaagacacgagagcccatcgtgcttctccatggaataagtctatttgtcatccctcatctctttgaaccttgtcttatttgactgtaataagtctattgtgtgtccctcttctctttggttgtgccttatatagctaattaaagtctttggatccctcaactatctttctt

SEQ ID NO: 15891 - DNA, 1501 bp, Oryza sativa
tggagttggagctagctttgtggaatttgtttagtgtagacttgtaaaacttccgaccatgaatatgctgttctttttttttaaataatggaaataatatcccggcctttactcaacgagctagagccaattattacaacgtatcacaaaaaaaataaaaaggttcacaaaaaaaaaaagaagataccaaccgttaaaaaaagcaaactaaagactaccaacccaaggtaaggattaggcctggtttagttcccaactttttctttgaattttcaacttttccatcacatccaaacttttctacacacacaaacttccaacttttctattacatcgttctaattaatcaaacttccaattttggcgtgaactaaacacacccttacacaattattgaattctgtttatgaatatccatccaaaattggtaaacagttgcataaccgttgtcttaagattacggcatgtaacttttaagcactcgccctcttcatcacacttttatagttgtgcccaagacctgagctaatgagttgtcctgaaaattacctacatatatgaaatagatggtggtttgtcaaaaaatcatgtcattcctactcaaccatagagcccaacgtatagaagaagctcttataagaataagtttcttatttttctcgtctacccataagccaatctaaaaaaacatgagatatgctattaggaaggtaaagacaaaaaaaataataaactgctctccaaataaactttacaaaataacattccataaaaagatgttgaatagtttcatttttcatagagaaagatgttgaatatgcggttcctaaagagttttttctttaaaaaatgtcccataaaaaattgttgcaaaggtgttgaatcatttttttttagtgtgtgtacatgtgtgttatgtgaaattcatagttaacctggaagaccagcgctgtactgttgtattgttgatatgattgttaattttggatatgatgtgatcgttgtacttaacaatagctgaacgatgatattccgaacaactttcctagcccatgcatctctccagtttgctactccctccgtcccaatacaaatacaacatagtatatactatgtgacttattctactataaatcttgacagccgtttatcctaatcagcatgtactcgatcctcagcgtatactgttgaggatatggatcgcttcatcgctctatcatcagttcatcactcaatcgaagcagcgaaggacgcggggacgccgtcacatcatcacaagtaacgcgtgtgcacgctcatctttctcatgacgctgaatggcagatacacacgcagctgcttgcacgccactgcacatattgacacacggagtatatatatatgtgcgcgccaccagctgatccattttcatctgccaattctgccatggcgaccgcaggaatatctttttccccggttggtcccgtcccgttcgaggacgtcgacggcgagctgccggcct

SEQ ID NO: 15892 - DNA, 1501 bp, Oryza sativa
tctcggaggaggatgagcactaaagcttgtgtctgcttggaagccaagtcagctagctagctagcttgtaagtaggctgtaaaatgctgaagctagaaacgattgtaaacagtgaaatgaattttctgccgggccggcaacagtgaaatgaatttcgtacgctattcatttatttacaaacaatagaagttgatgcgaaaaacacacactggcctgcaagatctgcttaacttcagtgcacgtccaaaatcttgcctttaggttcgtgagcgtgccagttgatttgatcctgcaatcaacaagaaataaagacaaaaaaatagcggttaaatccataaatgatagccaatcggccagtcgccgatgacatatcatttatctttgagccgatgacatatttgaatcgatcggcagtcataaataggaaagaaagaactaaatctattcgatcggctgtaaatattaatggtatataatgcttctgtcgatatatacttaaatcaagtgattaggatatatcggtcgccatgccgagatagtataaatcacttagatcaaaatatatattaacaaggagattataagcattcatagcatagccgatcagatagatctagcatgtatcggctaaaactccgataccattctatattaagatattaaagcaagcaaaatatatcaaacaggaagtttaatatacctaaatgcaacaagatcttaatataaagggcggatttaacatatcaatcaagcatataaaatataaaggagttaaatcaggtaagatcggctgaaaccccgatactaccctaatcggcaaccaaaagcaggctagagattgagattctaatcacgacttataaggtcaaacttaactgatgcagttataagtatggaaagaataacagtatctagacaatcaagccgttggatatttcataggatggtggataccctatataatctaagtcgatattagtatttaaccttgtcggtgatatgggaccgggagtattgcgcccggaggcttgaggcagatggaatcgcccacgtggcctggcaccttcggggacgtcgggcccgagggtgaggtgtccgccctcctcctgatttccccgaggggggggggggtcgggttgctcctgccccgaccccgagggccgaggtgccccgaccccctgtggggtttgcactatgtacataggttgggtgaacacggtagggctcacctaaccgcatttattgcggtctggtcaaacgtgtcacgttgcatgcagcgcaatgcagcgcgctcttttatccggtctgtgaccagtcacagaccggtcggatcaacggttaggtggcgactggtggtctgacgcacgcctcgccccgtcccgtcaagacgagagcctctaggcacacgtctccagccggggctagcgtgttacctcttagagatggcacttagccctggttaaatgaataccaggcttcatcccaaccattacaggcaaga

SEQ ID NO: 15893 - DNA, 1501 bp, Oryza sativa
taggttggtagtcctcctgtatctctatccagcttatagaattagagtcgggagaataggaggaaaccgaaccaaatctctacaactgaatgatgaatttcaaaatgctaccccgttgatccacattggtaaaaaatcctctttcgaattcagcactaagtccatgatgaaggtgttgtctgccacgcatgcgacattcatcgcatggttgtatgatgcgccacttttggttaagctcgacggggacatcacgtgcgccttctcgaagagcattgtggcactgtggtccttgaaccacgcttccagatcgaagaaggtggaaaccatcgtatgaggacgcgtgaagagaaggagaggggaaatgccacatgtggccttgcgggccgaaaccgccgccgcttcagcccttgcccacacgtcgccgtcacagcgctcgcccgccgccgaaccgcccgccgatccgatctagcgagataagggagagagagggagaagaatgaaggaaataggatgaaatgtgggtcccacattatttgtgtgaatgacaaatggggtccgctcatattgtctttaattctaatacacataagcgccacgtcaactccacgtggaatgaagaccgagtcaacatcgccacgtagacgtcacgtcaacgaaaccgccctccaaaaccgccgagggagtcaacttgcaccggttttaatagtttggagggtcgaaatatccgatattgtggtttaaggatatgaataagattcgaccactagttaagggagtcaaagtgaacttattctagagcaaaattagccattttggctcacctgcgcctaggtcgtggcccacgaaacgcgggaccgcgagcatttgccaccggaataagttcactttgaactccgacccctttcgccgctgccgctcctgctctccctacacggcaacctcccgcggacggtgaagggggagagaaaggggaagagaaagagaagggagagaaagagggaggaagaagaagggaagaagaggatgactttgggccccacatgtcagtgggtcccataatatttttgtgtaaatgacaaatgggtcccacatttcttttagttgtattgtcatataaatgtcacgtcaatgccacgttggatgaagacaaagtgaacactgccatgtaggcgccacatcagcgaaactgctctccaaaaccgttaagggagtcaaattgcatcggttttaatagttgggggaggaaggggtcaaaatattcggtattgtggttcagggatagtggaatacgaattatattcgaccactagtgaagggagtcaaagtgaacttacttcctttgccaccacacctagccccggcccgtcagatgcaaaagccgcgagcaacattgtttgttcatgctgatatgcacatgcctcaacatatatttcaatgagtaaagtacaccattggtccttaaagttggagcgttgtgtcacttaggtccatgatcttgtaa

SEQ ID NO: 15894 - DNA, 704 bp, Oryza sativa
  unsure (1)..(704): unsure at all n locations
tgatattttagaataactttcatataaaaggttttcacacgaaacacaccgtaaaaggttttcacacgaaacacaccgtttagtagtttcaaaaaacgtgccataaaaatccaaaaagtttatccactctttgtcatggtttncgaaacgggagtattggaagattggaagagaggttgtttttcgtagatgagatgagatagtgagcattgatgtttacccctgatttaactttgccgtgctacagtagtagtaaataataacagtagcagtgaggcacagcatcactgacaaaccctcatcctcctcctcagtacaccagtagagagtagtcactcacaggagagaggagaggagaggaggctactagagaagagaagaggagggtggattggatcatccattccattcctccgcccaaagcctctcaagtctcaagcccttaccaaagaatccattccgctccgatcgatcgatcgatccccacttttcccatccaccaatccaaaccctagcttgcgctcaccatgtccacacccttcgacctcaactccgccgctgacccccaaaccctagcgccgcccaagcgtggccgcggccgccccaggaagaatcccccaccgccaccgccaccggctacggatccgaatcctcatcctccatcaggagcaggagcaggggcaggagcaggagcaggtgcatgc

SEQ ID NO: 15895 - DNA, 1501 bp, Oryza sativa
ttctgacctccccctgtgcgccggtgagcggcgcgttctcggacatggtgagaagcgctgcggcgaagcgctggtggaagtagtcgttgtcggcggccatccggcggacgtagggcgccgtgcgggcgtcggaggccagctgctggtccaccaggaggagcccccgcccggcgagcaggttgcggtagtacatgttgtcgatgagcatgggcgtgacgcggtcgttgcgcgcgtacaccacctctctcgtgtcctccgtcgccgcagccgtcgggcacctcccccgcaggtactccccgtacgccgcctccatgctgccgtccacctgcgggtacagcctccccaccaggttgaagcagtggacgcgccccaccgagtgcgcgcccagcagcgccaccgctccctccgtgtccaccccgatggccgcgaacctcgacagcacggtggacacgctgtcgttgtggttggggatgtactgctccaccacgccgtagtagctctccctgctgtcgcgccgccccgtccgcatggccaccgagggcccacccagcatggccacgccgtcgcgggcggccagggcgaggatgtcggcgcaggagacggtggcagggcactcacgctcgacggcggccttgatggcggtgatgtacttgaagttgcgcatgccgaagctgcggtgggaggactgctcggagacgcctgtggtggtggtggtgtggagcagcagggaggcgtcgcaggagtagaccatgcagtcgtggaagagtgccctcaaccacgacaccgccgtgttgccgtgctcctcgtacagcctccgcacctcctccctcaccacctcctccgccctcgggcacctctccgactccgagtagaagttgagcttcagacctcctcctcctcctcctctggctatggctgtggcgcagctgcaggccaccatcacaatcaccaagctgcgcctcatcatcaacttctatcgatagtcgttcttcggtgcttgttccactgacaccaagcacgcacgcaagagtggattttaagtgtggtatatagcgtaggcatccataggtgagctcgatcgtgatggatggatctatccaattagtgcaagtgcgtgctagttacccgcaagtaagtaccagacatggacgcatgtacatgtgcatcaatgagctgagctccctatctaggtacatacgcacatggtcccaaactctattagttattattatcgggaatctgtaaaccacattccatatagtaaaataaagataaattctgacaaatttataaacttcaattcggtttcgcgattcgtactctagtgggcttctcctccaactctgacgatccgcagcggcaatcgtgattagttagggtcctgagttagggtacaaatggaacagggaagggtggaaaggggagagggtctcctaggctaggcttagggggattcacaaagaattgtcttagaattagcttaattaattagaccacccac

SEQ ID NO: 15896 - DNA, 963 bp, Oryza sativa
tggacggagatactccctccgtttcgaaatgtttgacacttgatttttagcacatgtttaaccgttcgtcttatttaaaaacttttgtgagatatataaaattatatgcctacataaaaatatatttaacaatgaatcaaatgatataaaaataattaataattacttagacgaatggtcaaatatgtgataaaaagtcaacgacgtcaaacatttcgaaacagagggagtagtacaaagcgagctcatcagtgttcactccaaccgttttaggttgtgtttagtttagcacaaagtttaaattttgattgaaattagagatgatgtaactcgcgagctcatcagtgttcactccaaccgttttaggttgtgtttagttcagcacaaagtttaaattttaattaaaattatagatgatgtaactgaaaagttatgtgtgtatgacaggttgatgcgatggaaaaagactgaaatttaaatccaaactttagatctaaacacagcaattagcaaataagccaaaacgaaccaacccaaaaatgagatgtgcatagccaaacaccatttactatcatgggcaattataagcaacccaaaaaagagaccgaactggattgagtgaagcaaactctttcttattcatcattcatagtatgtaccatgacatgccacccgcgaccgagaatatacattgccgagaggcgagagcccaaagatggacataaaaatttaaaaagaagaggtgaaaattaagtaaaaacaccgcagaaaaatagattggcgcgcttccacgctagctgcaaatatcgctctaataatctgcatgcttcggacggagaagcacatcggatatagagaggaggaagaagaggaggaagagatgagcggcggcggcaaacggcgaggaggccggcggcgagggcaggcgcacggcgacgagacgacggcgtacggagcgccatc

SEQ ID NO: 15897 - DNA, 1501 bp, Oryza sativa
taatttaggcctatgggcttaatctcaaactggagtaggaatcggtgtgggtttcttttttgcgtgacaattgggcgcgctttttttatgcgatctaaccaaatctgatccgaaacaaatttttttgctatatatttgttgacaaattttatcccaaaaaattgacagatgtaattacagtacaatcgtagtttaattacactgtaacttgcatgtaattacactgcagttatcgtagtgttattacactgtaacttgcatgtaattacgctgcagttatcgtagtgttattacactgtaacttgcatgtaattacactgtaactacagtgtaacttgtatgtaactttcaaaaatctttctgtaatattttatttcggtaaaatggaggctgtgggaacaaatccttacacatatgtgtgtgctgtgattttttatttaacgattcaaaattacgtgaaacttatatacaagttatacggtagttacatgcaagttacagcgtaattacatataagttacactgtaattacatataagttacagtataattacactacgattgtactataattacacctatcaaatttttagaagaaaatttgtcgacaaatgtataggtggtcccgatccgaaatcggatgcggtggaaaaaatagcgccagattagaaatcggaaaaacgcggtgatggacgaaaaaatgcggatcagaggatgagacgattggaaaaatagcaatatttatattagttaagatatgactagaaaatgggcgtgcttgtgatttttagcccgtaggtattgctaagtgctagtatttcaagatttatagtgtcatattattttaggaattagtttagttatatattgggttaaacctatccaagtgttgagcatggccaaaaacttctaaggtccttgatgtaaaatctatcattaaattgtagttctactattaggcgcgctcctaatattacaagcgccaaacatgcatcagctcaggcccaccccaccccatgtcccagcccaggcccaccccaccccatgtcccgttatcccactcccaccattgtcggagtaaacgattgtcggtgacatggggccgggggtatcgtgactagaggcttgggtagccgcgatcactcacgtggcccgaccccctcggggggggggggggggtcgggcccgacggtgacgtggccacctctccctctgtctccccgaggggtcgggccgctcccgtttcggccccgagggctggggcaccccgaccccctgtggtgattggcgccacgtgtgtgggttaggtgagcacagcggcgctcacctaaccgcatttatagcgggttagacgagcgcgtcacgccgcattcaatgcggcgcagcgcatgcttatccggtctgtgaccagtcgcggtatgtgaccggtcacagaccggtcagatcgcgggttatgtggcaacaggcggcctgtcgcacgcctcaccccgtcccgtcggaa

SEQ ID NO: 15898 - DNA, 1501 bp, Oryza sativa
tggaccgactgccactaggccaataggatagcaacatcgggactgcccaaaaaccaaaactaacaaccgggcaccaagctcaaccctatttacacctttgggattaaggggggagagggtgagagagaagaatggatcccttctcccccctacagcccgccaacatagccaacttgcataagctaggccgccactgtaagaggataacatgcatttagagagagcttactccaattaccagagaaagtttttggaaaggggcctcctagacgtctccagggagatcaacgacgatgagcaccgccgccgtcgtccgttgaggtcttagggagaactacaacaaggttttcacccgccagctataacagaaaaaagggatggctcgacaacgtcctcaagaaggaagatgatactcgaagtgccgtcgttgtcgtccggtacagtcgggctaggttttcacccactgcctgccccctatcgatccacagttatcgcttcattactccaccaccggccatcctttgtgagcacgtggacaccaccgcatcgacgtccccgccggccagcctccgcgggtcttgtgggcttatatataatcgcctaacatttctctgcatgcattcggcccaacatgtaggaactaggaaataagacgaggttcaaccgaactaggtcactgccattgcgggtcgtgccaaaatattctggaagcttctagaagctagaaccatctggtctaggattttactgggagatatagctgggctccaatcacatggtaagcccaatttaacttggaaaaagtacacgcaaggccctcaagatacaaagccgtctctcaaccacaaaaccggatatccggcatccctcaacttataaaactggtccctcggcagttttaaccccggttttgtcccacgtggcgactgactcagcgtgggacccacgtgggccccacgtatcagtatgaaatgtcatctctgtttcccctcttttctcgtctctctcttctatctcaggtgacggtggtcgcgactccggcggtgaagggcggtggccggcccggagctcggcggggcgaggcaagagagactgcgcgagctcaagacgtggttctccggaccactccacgcggagtcggcgccgggctgcgggcggagcgcggcgggcgagagcggcgatgggcgggcggcgggcaagctccaggtcgctccgtgcgagtcacgtcaccgggggcgcggcgactggtgggtgtgggcggccgccctcctccgactttgccccctactcctcgcacatcacctcctgccggaggcaggcaggcgcggactgggcggcgatgacgacgactcgccctcctcatctccccgtctcccgccggcctcctctcccacttctcccgccggtgcggtcggccggctctccccccactcccgtgctgcatccaaatcgaattgagatttgagatagtgggagagcgccatttgagttgagatggatg

SEQ ID NO: 15899 - DNA, 698 bp, Oryza sativa
aattcctgcagctgtttttcctcgttccctacatattttatattacttaggacaattcagtcactttctcgtgtagtgaactaacgacaattcggtaatatacacgcataatatacctgtaaaaatccgagagaaatattaccttggtttgtttttttcttgaagaccacattgagagagagatgccttttcacgcatcttggaagtaagcaccttagatgtacgtatgtggtgcgtctctgcttgcgtgtgatgccttggcagcacctgcagatcgagtcatgtgtatttctttccttcgaagaaagagcatgtggtgtgtgcatgtctctgcgtgtgaattttcttgtctatcgacgaattgttttgtgtcaatgtctggtgcacttgcacagtgcacacatgttgttagggttatgaatatcacatacctaatagtagttgactaaatctcggtaggacccaccacataccatgtcttatacggaaacaaccttcggatatacgaggagttatgcataatgaaggatgaatagagttctacatggaaacgacaagaactactcggatttatccataatggttttcctagttctacttggacaaggggacacctatgggtataaatacaaggcccctaggaggagaggggacacggaacaatagatcaagacacaagatcaacatacaagccaaca

SEQ ID NO: 15900 - DNA, 456 bp, Oryza sativa
gccaaggacatgccgttttcttgtagcgtattgactctcagaatatatctaacaaaactgccgttcgtgcacatgtatttaattacgttgtaaattgacaatccattctctcttctctctaatcgtaaactaaaaacatgtgtgttaattagactatgattttaaaaaacaactcaatacttagaaaattattttcacagctccctttatttttacaaatgggctaaaagaagattcacttgtgaaaatatataggactctcacagtcaacaccgggccggcgctgtattttagacgaccaagacgcaccaacacatacgttatattaaaataaaggagcacgaacaccaacaacaccttgcttctcacattttccttaaactctccacacttccctctcctcttcgttttttctttccacagcacagaggacactgccttggctcctccttcccc

SEQ ID NO: 15901 - DNA, 1501 bp, Oryza sativa
agtttcacactaaattaataaaaaatggtgggacccacgtgggccccatatgtaatcctcaatcccctaaggttgctggcttggtgctactcctcttcctcctccagcattgctcctatccagcggtggcggcggaggcgagcggcacctctccctcccccgggaatccggcagtgagaggtcacgccgcgccgtcggtgcttctcctcacgccgcagccgttgtcgtccttctccccagtccccgctgccgccgaggatgatgacgacgacggtggcgcggggtcatctcggatgacgcagtcacgcggaccagcacagagtcgtcgagggggacgaggtcgtggaagcggcgggcgacgagggagcagcggccgaactagatcagggcagcggctttcggttcacggtggcggcaccagcaccgatgggggagaagaccgaataccgggacaggctggtggagaacgccttcatggggctgttcgcacgcaaaatcaagaagtacgccgtcatctccagctccggcgggaaggagaagaagaagagctcgtcaagaagctcttcctgccgacacgttgggcagttgggcctgcgagttcaacgccgccctcaccattccctttttccactggctcgtcggtccatcagaggtataattcatagacacaactagttcatcgtcatgaactcattatgaacccaaaagttggcattatcaccactgactctgcacatgatcaaacagggagacccaataagaaaaacacgttcattttcatccatcaaacccggaatctgctcctcttaacaacagaacctggaatctgctcctcttaacaacagaacccggaatctgctcctcttaacaaagattttatggacatcaaacccactgtcagaattatgattgtaagtatacatgcactggaaacttctcctttccgttcttgttccatggtctcactggataaaacaatagcaaatgaattaggcagttaggcacatctcaaaggtaactaaaacagaaccagcaatataatcagcactaaagcagggcagaaatatggataaaaaaccaaccatatgaacaactttagcatacagatagagatagcagtagcagatatctgatccatcacgaagcatgagagatgaggcaaaccttgctgcctgctgcctgcctggccctggcctacggcgccgctgccagccgttgcccctagcgcccacccttgacgcagcctacgctgagcagcacccgcaccaagacacgcgcccagggacggcacatggcgtagcaacggaggagccccttcaccgggagacaggccaaaatcacccagatgagcttgttggggaggacgggaccggcgtcgccgagtagtcggcagaggcggtgcagggggaggaggatggaggcggtgggccggcgagggaggagcctggaacctaaggcagcggcggattcccgggggagggagaggcaccgctcacctccg

SEQ ID NO: 15902 - DNA, 1501 bp, Oryza sativa
acccaaaattaacattatacaaaaaatggaatgctgaatttatgccggttccgtttttccaaacagatctcgaaaccgacaccaaacaaaaattcgccaaggtgtttgacacaactcggaacggtggaagagagggagggagtcggactcggccaatggggcgagtgggactcggccaggaggtggagtggatggcagccgaattttgtgtatgggataaaaaggaaactgatttttaaccaatccaatctactatatctttccaaaacaaacttgactacttccaaaatcagatatggtaattcaccttcctcctctcgtgcacgacacaggcacggccaaaacaaacacacacaaggatcggcaaactctagatgcaactcaagaactccaaaactaaccgacagaaacttctgaaaactacaaaaatagaaccgtggcagcgagccgattccgttttcgtaggtcccgacaacaacagagacacggtggcagcgacgactgtggtacaaaacgtgaccagaactcgaaactctaaacgaactagacgctaagaccagcaacacgtcgtgacaatgcaacacaaaattcaacaaagcaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaaacaatctgatattgcaaataggaatttaatacaaatgataagttggggttccgaagaacaagcagacggacggtctagccgacacgcgcgctgcaagcaagtagcaatggctaaactttcatctaaacaaaacccaagaaaccctgaaagggtacctagctatttatgggggtgggaggaccctaggtcgtcctccacctggttggggcacaccccacatgggccccatttggggccgggtcccaaacaaaagttacaagcccataggcccaagacaggtgacgtagcatcttgtttatgtgattgcggccaaactacatggaaattggcgatgaggctgcatctgttagaaagaggactccgagagctttccaccaagtactcacgggccgaaaacggaggtcgtatgcagcttcggcggccatttgaagtcagcagtgtagcaggtggccgaattggattttggcacttggaggactcgaacttgatatcttgttgttcatccatgatgtgagcaacggatgtattcgtagtagccatggtcac

SEQ ID NO: 15903 - DNA, 1501 bp, Oryza sativa
tgggtgagagccgcgctgcctctctctctcgatctcgatctctctctctctcgaaaccgccgctgcctatagctcattgccgacgctgccgcacgcggccgaccccgaccccgactccgcctcccgccgattccgaccccgacttcgacgcggctgccaccgctgacgacataacgtccacgcaactgccacggcgacgatgcgacacgccctgccacgccgccttgagctcgccacgccgtcgcgccacaccgccgcgacgccacgccgccgccgcggcatgccgccgggtcgcccgacgccgccggaacgcgcgccccgacaccgccgcgacacgccgccaccgcgccgccacgccgccgctccgctgccgccactgccgcgcgccccgacattgccgaacgtgaacgaatgtgaacgaacgtgattgaaacgtgaacgaacacgaacgaacgtgaacgaaacgtgaacgaacacttaacgaacgtgaacaaaacgtgaacgaatgtgaacgaaacgtgaacgaacgcgaacgaacgtgaacgaaacgcgaacgaacgtgaatgcacttgtactaaaagtgtgagaacgaacgcgagcatatatgattattatacgattattaaacttagcatataatatgattatatatatatagttgaaaacgtgaaatacaatatatgttcctttgcatttagactaatacattttcctggtaatgttgtagagaagacgtcgtcgtcgtccctcaagctgaagttgtagctagccatcgaaggaattcgcgcaggcaagtgatgtaaagaagtgattgttagagatttaatataagattattagagttttaatataagattattagattattagcatatgtgagtgttagattattagacttagcatatgtgagtgttagagattcgtgatagacttagcatattgtattagacttagcaaatgtgagtgtcagagattattatattattagacttagcaaatgtgagggttagagattattagattattagattgttagacttagcatatatatattattattacaattttaatataagattagtagcgatttaatataagactgttagacttagcatatatgattattacaattttaatataagattagtagcgatttaatataagattgttagacttagcatatatgattattacaattttaatataagattagtagagatttaatataagattgttagacttagcatatatgattattacaattttaatataagattagtagagatttaatataaaattgttcgacttagcatacatgattattacaattttaatataagtttagtaaagatttaatataagatcgttagacttagcatatatgattattacaattttaatataagattactagcgatttaatataagattagtagagttttaatattacgcttagcaaatatgacaaatagacttagcaaatatttcttgtatgaacaga

SEQ ID NO: 15904 - DNA, 1501 bp, Oryza sativa
ccgccgcctccacctcctccgctgccgccgcatctctggggtgagagccgccgccgccagatctcccttcatgcatctcgatctctccgatctcgatctctctccgtcgcgccgcccgccacgagacgccgcgccacgacgacgacgcgccacgacgacgacgcgccacgccgccgccttcgccgccgccgcatgccaacgccacgccgccgccgccgtcgccacgccgccgccgccttcgccgccgcgcgcgcaatgccgccgccgccacgccacgccgccgccgccacgccacgccacgccgccgccgccacggccccgcaacgccacgccgccgccgccgtcgccacgctgccgccgccgccgccacgccgccgcgccaaccgccgccccgatgccgccacaccgccgttaacgaacgagaacgatcgaacgaacgagagcgagaacgaacacgtcaacgtacattgccgcgagaacgtgaacgagaacgagaacgatcgaacgaacgagagcgagaacgagaacgatcgatcgaagacaagcgagaacgagggaacgaacgtgaatgagaacaagcgaacgaacgtgaatgagaacgagcgaacgaacgaggacgaacgttaacgtgaaatgcaatatatatatatatatatatatatatatatatatatatatatatatatatatatatatatatatatatatatatatgttacttcgcatttatcctaatacatctttttgtatcttgcagaaaagacgtgttgtcggagtcgtccgtcaagcctgagtggaagagctagccctagaaggaattggagcatgcaagtgacgtaataatataaatgattgttatatttgtaatgcaattaattaagattattagacctgtaattagacttatcatataagattgtgtagtgttctaatattatttgagttttaatataagattactttatttgtaattagacttagtatgtaattattgactacggaattggtgcgacaagtagcaattgactattgtagtcttaattagacttagcatatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattgtagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 15905 - DNA, 1501 bp, Oryza sativa
gggaacctgctccggaacacgtgctcctgttcctcctcctccaccaccatggcgggtaccgcggcgtcgcccatgtcgcgatgccggtcggcggcgcaggcttcttgggtggtggtgggggtggccggagctctggcatttgtagagagcgtggtgacgaggggtggcgagaggaaggcgacgacatggtggtggtggtggtcgtggcgaggatgacacggttcttgtgtgttaccatgactagtggggtgtaggtgaggtttggttgggtcatggccttttggcttgcaaagagtgtgaatcttcgaatgctggtagaaatggagaggatcgtagtagctgttgttaactataaacagttaataataataatcgatcttacgatgattttcttgatgcataataataatcgatcttacgatgattttcttgatgcattttgtatatcgtgtaagttgtgttgtgcctgaatattaacagaccgtagtagcggataagtgtaggtgcatacggttcacatgtcagatgttataattttggggatttggggataaatcgttgatccattgattttgccctagaggggaatatattgtatacaaagatatgggaaaagactaaaatgtccttagcacactaatacacacactaacacacatatccttgacaccccaactgcaatttgcatttgatacttaaatactagattaacaacataatacgataaatacaaagttcatttttttttgacaaattactgccaggcatttgcctaccagtatagcttgtataaaaagaaatatttacatcttactaggaaaaacagaaacccacaaaataattacaaaatttgtaactaatcaaaaactaattgcttgagaggctccttcattctacacatatgtagaagaagctctttcctgaactgaactttccatccatgaaaagttggaggtacattatgaaaaatcaagccatttctttgcttccaaatataccaggagttgtaaagaagatctccaggaaaccttcgtaccaaaacgaattctcactagaacaatcatctggaagaaatttaaataaggagaccaatcaaaacccaaatactgtcaacatcggagactaaaagggtaggtaaagaagagatgtagccttatctctcttatacccccagagcaaagaacacaggtgagatcatcattttccttagcatagtgcctgcaatccaccatgtcccttgtattaattctgtctaaagagaggagccaagcaaacactttgattttcatcacacgctttgtcttccagatccaaacaagcggccttggaggctgtaagcatgaataattcattttttaaaatctttgagcagaatacttatcaacattccaaatatagctccaatgatcacccaacccctcacttaaatggacattgtcaagttcagattgcaaaactaaaaattccccataagcttcagcattcattggtagcataaagc

SEQ ID NO: 15906 - DNA, 1501 bp, Oryza sativa
ccttaatttttttattcttttgggccgttcgatccagtactactaagttaggcccaatatgggtatgtattaatttaggcccaattatgttttctgatgatgtttttatactttatccgtttcaaaatgttagacaccgttgattttttagcacgtgtttggtcattcattttattaaaaaaatttaagtaattatttattcttttaatatcatttgattcattcttaaatatattttcatgtacacatatagttttacatatttcacaatttttttttaataagatgaatggttaaacatgagctaaaaagtcaacggtgacaaacattttgaaacggagggagtatattattgtgtctacctcatgatgagccggtcgtagccggcgaagccggccgcggcgaggttggcggcggtgctggaggcgagagtctgctggtctcggccggagaggatgaagactctgaatcctctgcctctgagcatctggaacagctgcgccatgccaggtacccccgggcagatcgccttgctcgcccacttcttgaacgccaccggatcatacgccctgcatccacatcgatcgatcatcaagcaattggagtaattaacagttactccctcggtttcagcttataagacgttttcactttattcaaaattaaattattttaagtttgattaaatttatagacaaatatataatatttataatactaaattagtttttatcaaatcaataattgaatatatttttataataaaattttttaggttgaaaatgttactacttttctctacaaatttaattaaagttaaaaacattttaactctgacaaaagtcaaaacgttgtgaactcaaacaggatggagtaatagattacacgtatgttagctagtctgatcagtgatcagtgatgacaatctcacaatctctgtacccgaattgctttgcctggtagtagaagaggttggacaggcacgtgtcgtcgacgtcgaacacccaggcgtcgaggccgtcgtcgccggcggcgagctggccggcgtaggcggcgatctggtcggcgacgccggccacgtcgcgggcgtactgcccccacgccatgtatctccagacgtagccgacgcacggcggcggcacggtgggccagttcttggcgttgttggcctccaccatcacccgccagctgaggcagtacggctcgtcgccggccgccggcggccagaacgaccacgccgggccgccctccaccgccgcaaccaccagcagcagcacggcgagagcggccatgtcgtcgctcgcagacagcgagatggagagagatcgagaggttgcaatgcatggattttatgggcgacgcgcgcgcacgtacgtacgcgcgctttaatcccgtgctgccttttggtcgacaattccctgtgcagaaagcgagcgatgctgctggattaaacaaagcgtgtgcatgatctcagcgacgaattagcgcaaagatatcgtcc

SEQ ID NO: 15907 - DNA, 1501 bp, Oryza sativa
gcggtggcatgtgtgcacccaccgcgtccggtgcagcggcagcagcatgcgcgccatgaacgcccggtgctcctccttgagcggcacgacgaagccattgatgatgctgccgcagatctcgagcagctcgccgacgccgcaatggcgctcgggctccgccggggacgtgccgtagacgaaccggagcagcgcgacggccatggtgcgttgcataaacgcgcgctcgacggtgagcttggagtagagctggtggtagacggtcttgaggcggtcgcgctcgcgcggatcctcggaggcgaagagcgccacgaggccaacgaggaagctccggtcgacgtggttgcggagcgtcctggtgtccgcggcggcgaccgcggcggtgagcacgtcgtagacgaggtggaggtgcggccacgatcgacgggagcagcaccatcacggggacctcgtcgtcgagcacgtcggacggcggcgggagcgacgacgggtaggcggacggcggcattgcccggaggcaggaacaagttggcggcgaccatcttgaccagcgccaccatcacccggtggtctagcccctgcggcggctgcttcttcccgctcaccacgtcagcgccacgtgagcaaaaccaccctccaaaaccgctggaagagtcaaattacactggtttcaataatttagggagtcgtcctatccggttttacagttaagggtgacgaattagattcggtgaacaattaagggagtctaagtggactttttccgaggctaaatgcatcgttgcatagggccagcccacatatagtcaggcccaaccaaaccaaacgcctcactacacgtctaatcctagtccacctggaagaggttttgcccgggcccacctgtcagccacccggagacaacaaccttagccccttctccagcttccccttcctcaccggccacgcctctctcgccacgcctcttctccggcgaccgccgccgccgccgccgaagaggattcgtgaagtggtccatgtccatgtccacggccgcgtcgtcgtcggcatcggcggtccggccgccgccgacgtggggggcgccgtcgcagaggcggctggtggagcagcacctggcgtcgctgccgcgcggcctcccgcgggccgcccacgtgcgggagctccacgcgcaggtgctcaagcagggcctccacctcaacccgcgcgccgcggcgaggctggtgtccgcctacgcgctcctccgcctcctcccgtcctcccgccgcgtcttcgacgcgatccgggacccgcacgccgacgccttcctcgccaacaccatgctccgcgcctacgcgctggggggcgcgccgcgcgacgcgctcgccgcgttctccgccatgccgcgcagggacagcttcacctactccttcctcatcaaggcgctctccgccgcgggcgtcgccccggtccgcgcggtgcactcgcacgtcgtcaagctcgggtccgtcgaggacaccttcgtcgg

SEQ ID NO: 15908 - DNA, 1501 bp, Oryza sativa
aatatagtgttagttgtttgcaatagagcataaatatatgtcctccagataagcaaatgttgtccaggtttattatgttacaatgaaatactgcatcctgtcatgagggacacaataaataggtttgttaaaaaaaacataaggtgacaggacaaacttctaactttattagtgactaactttctatcatttctttcttttctagcttgttccgttcaatctcgccactagccgtgcaatacggggctgctgtcccatgacactggagtagtacttgaccgtgcaaatggttatggaaacggtatgtttaacataaaagggaaaaacaaagaaagcaaaaggtttccatggcagtacaacacctgttagcacattactgtccggatggcaagttatttttttccatgtttccaggctgcacaggatccagcatctgtactagaaaggatcaaaccgcatttccgagtggatggtctttgtcatgtctcagtacgaaaggggcactctttttatttagtttttggggaaataattgaaagctgtgcaatcatcctactcttgtcagactgtagatcactgtagcttttgcttgatctttattcgatctcccttcctttttcatgtttcttgattttttctatgaggggttgtgtggttacaggcttacagcaatgctagctaatgggtctacaaaatcaaatgccactgatgacatgctgcatcaccttcgattgatggatatctttgctgatgcatgccctggacaacacaaagcaccctccatttctgtatccacataatagctagcctcatacgtgtcaaaacttccatgtgtttcgccgtacaaccaacacatgtttatggctgccagacaagcaagaattatatatacgtctcccccacaaggaacattggaacaaacatgctgttcagctggagatgcatgatgccaacgttgacggtgtatggctcagaagaagaagaaagattctaataactcgagtggacgtctacccgtttattacatgttaactggataattaaaaaaaattcaaaaaaattgataagatcatggttcaagaaagcgctaggcgctagttggacggatagggggcgcctagcgcctaattggcgcctaggccccgcctaggcgggcgcctaggtcgggtcaaatagttaaattcaagaaattagtaggcatattgcatagaaattagactatataacactaaaatagcaataaaacactacctaagtaatttaaccgcctaatgcaccattgaatgcctaatcgcggcggctacccggcgcctagcgcctaatgggcgcctaggcggcgcctagggccgatttttagaacactggataagatagatcgatatgtaatatatcgctctataaacatgtaagttcaaattcaacttctacaagttataacaaaaataacaaatttaattgtaaatatgtatataataatttgagctttgtttgttatttttgt

SEQ ID NO: 15909 - DNA, 1501 bp, Oryza sativa
ggtgagatggacggcggccggggagccgatgaccggcgacggcggtttcaggagctccaagaggctcaagacagcaactacggcgacgacacaacctccaaggcatggggtgaagtgccatgcaaagccaagaaatcaaactacgaaggtagtatcatttttgagtatctgatagtgaaacaattacagttcttgtaatcatcacttcatcagtgttgtcagtgtaggggctttctctcgttcatattggctatcttttccctctcactgccatcgtaaatgcaggcaacatgtaagaagaggagccagaaactgggcgacagaatcacagctctgcagcagttagtttcaccttacggcaaggttaattaatcaacgacctagctagtgttttctatccatgttaatcatcagtgattttgctgatctgagagcgttaattttctgaacctgatcgtccgagcagacagacaccgcatcggtgctccacgaagcagccgcctgcatacggcaactccaccaacaaatccaggtaatcgcgcgtcagacatcgtagccaggcacgacgagtccatgaccaaggtttacaaaaccttacgagtttttaaaatcacgataaacctcatggtaatagtacaattttcacgataatcacgtggttaccataataaccgttttaccgtaaaatgatgataaccccacccaaaataatttggtgaaccctggcatctgcaacccaatggactaagtcgttttcgcgtgtttcacatgataaaaaaagcctgcagaatctcagtgtttttcacttcctcttcagattctgacagcgccttaccctggaacaagctcctcctctgcatcgtcgcagcagcaggtcgtattttctgttcttgaaagttgcagccatgtcatgtccttctttactgcaattgcaacagttttgtggctgcaggatgccggaggaggaggaggcacggcgacggagcttcgccggcgaggcctgtgcgtggcggcgctgtcgccggccgtcgtgagcctcgcggcagagggcggtcgccgccgcacggacgtcgaggatcagaagaggatctggttcagtaatcagtagctgcaactgtaaattaaacgagacgtggcagctcgtttgaacttactctaatcggagttacgggaatactactagtttggatgtttgattagcagtcacgcgtccacgaagttacggggctgtttggttcccagccacactttaccattacttgccaataaaagttgccacaccttgcctaaggtgaggtgatcaaattgttagccacaacttactaagcctaagggaatcttgccacacttttttgagccattgacacgtgggacccaatttgttggaggggaatcttgccacaactgtggctacaaccaaacacctgtcaaatttgcctaaccttaggcgtggcaaactgtggcaaagtgtggcttgcaacgaatgcattaggcgtccttt

SEQ ID NO: 15910 - DNA, 1501 bp, Oryza sativa
gcgtagatcaccgcgtgtgcagggatgcatggtatggtgttgcggacttgacagaaccgctgaatatacgagcgaagtgactcatcatcccttcgctgtaccgcgtgtaagtccgcttcttcacctgggcgcggatatgtgccttgaaagttcatggtgaactgttggcacaaatcctcccaggagtggaccgacgcgggtggcaagttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccgataccaccagccgggggcacggagggctggtcctcacgtccatgtcgaggtgacactctggacgaggaggcgccctccgttgcacggggagtacgtcggctattacgccggcgctcgatgttgaggcgggcatccggctccccatgctgatcctcccgagtcgaaggtgtcgacgagggagtggcagccgaatgacgtgcagccgccgccgctcgccgcgccctccgccttgatgacacggaaccggtggtggcggcgccggaggtcttggtggtggcggaccgtccaccagcacccaggcgctgctgggccgtcatgaccaagttggccacgttgtccagccatcgctgagctggagactcagggtcatggacgacgggcgggtgacgtaggagcgcgccagcagcctgaagcgcgccctgaggcgtgctgccgtcgccgtagacgaggaggcgtcgctccccatctcgccgttctcctgcatcacccgcgaccggtgatgctgcggatttatcaaccctctcgagcgcctccccctgcttaggactttggtgtggaggtgggggagtacgagctcgacggcgtgggtttggctccccgtcgtcgccgctcacactcggagagaggtcgtgcgccttcgcttgctcggccattaggcagaacaagggaaacttggcgcacacggaagagtatgagagctcagaaaacacacgctgagccccctacctggcgcgccagatgacggagctcgtggctcctcaccgggagaccgcgcaggcccccctttgccagttcggccgggggcttagggtgaaatctcaagctctcactctctctgtatgtggaaatatcgtatgccagccagaaaacacgagacaccgacgatctatacaggttcgggccgctgagaagcgtaataccctactcctgtgttttggtggatctgcgtatgaatgagctacaagtgtgagctgacttctcccccgttctaagctcataatctgggaaagaatcaaccaaccccctctctatgggcaaggtcctccttttatacttcaaggggataccacatgcacccttc

SEQ ID NO: 15911 - DNA, 1501 bp, Oryza sativa
aaaaaatgataatggaactgaaatatagagataataattccaatagtttaccaatttgcaagaccaaattaaatgcaaaaaacacatcagattaatatcgttgaattaaaagagatagcaagtgtcacaaacctagctcagattttgcaaggcggacgtagagctcctggccaccgtcgacgaaccccgtgtccatcaagtcgccgaaccactgtatgcacccgctcccgccgccgcggatgtcggcgccggcgtacgccgtgcaggagcagttggacaggcacctccagcggcacccctcatgagtcaccgtggcatccacggcgcagccgtgcgtctccggcagcttcacgccgcgtaggaggtagaacccgtcctcgcctccacctccgctgctgccagtgcactgcagcggcgtcctctggccgcacccgccggacgtgttccgcatgtaccactccgccggcgagcgcggtgtgaagcccctgatgcagccgcagacggtggcgtcgacgacgttgcagacgccgaacgcgccgcacctgccgtagttgtcgcactggtccctcggccccgaccagaagttactccacgacatcgccgaccggtcccagaccatgcgttgcatgacgccggattcgttgaggagcacccatgacatcggcgagccgtcaaggttgcggaactggtaggagacctcgccgccggtggcgaccctgaactcgaactcgaacatgtcctcgaaggtcgtcatccacgggcccgtccggtacgtcttccggcctcggctccacacgtgcagctcaggtgagccgctcgtgtccgtactggaagtcactgggcgacgggtctttggcgccgcgccacgacgagagcgaccactcggcgccggtccggaggtccttcccgacgcgtatcccggggaggaacgtgtttgtctggtgctcgaagctctgccacagcacgttgccgtccttgtccgtgagcaccaggttgccggtgtcgaaaagtgtggagattatggataccccatatctacatggcggtcatattccagctgggtacgggataccgaataaagatagaataccttcatgaggactcggattagattctaaacttgtatgtcatgggaatacccgagatcctagtcggttacgattgtattttatctgtaattacatattccgttagggatatggactgtacttggtaaagcggactccgtcccctatataaggagggtccgtgtgcctctcggggcacggtttttgtttccagtttatacaatcaataacacactcggcggaatcatccccggacaggagtagggtattacttcttgaataagaaggcctgaacctgtataaaaattccttgtctcgaaacccatccgctttcctagcttgatagccacccccttttattattgccgaaatcttgtttcgacagttggcgcgccaggtaggggtagcgtcaagtttttgccgactaagtgcga

SEQ ID NO: 15912 - DNA, 1501 bp, Oryza sativa
agctggccttcgcccccaccacttcactgtggccaggcccactctccagatcgcgtaccaggacctctcctggactgcgcttcgtcgcctggcccacgactacagccaccgtctcggaggttccgccttccggcagcttccacgccttccctctggccactcagacgccaggtacccttgtccgtacagcgagtctcagccagtgctgactcgcatggtcgagctttcggaggctcaggccactcagcacgacctactccttgaggcttaccgctcccttgcccgccgctacgccgctttggaggcccgtttggccgtggagggtgtcacctcagttgacactatctcttgggactcaggccgcctctgccacgccagccacctgtcctcccacagctcccgcggctctgcccgcactcctagtggcccgcgctcccccagctcgcgtgcgccgtactcaccagtgtactctccctacccacacccagttagcccttcctacacccccggacacaccccagttgcttcctcccgccgtggcccacgctttatccgcaccgcgcggaagcgtgttgttggttcttccaccgtgttccgtttccactacccagctcccccaccgccagcggcccgtgctgctgccggccctcgacaggttccgccggtcccttcgcgtcagccgatcgacgtttcttcgactgaggagccgactacaggaggcagccaggccgacgaggagtagaggaggcagtcttcagcagccgtccgtgtgataggcccttttgttccgccgtgtcacgtcctgataaattcatcccgaaataaaaatcattccctaaaaggaataatagaattaattaaaattcgaaaagaaattggcaaacattaaaatacgtacaagaaaaattcaaatgtggcacggagaatttttgttaaattctccttggtctaaaaagagccctcaaatttttgtggaattttcagagcaccggaaataattattaagcaacaaaaacaattattagagtttattaaaaagaaaaaaaacctaaaaataatctggcccaaagtcctccctctctcccctcggcccgtggccgaagtctccctctcctccctctccttctctccctcctcctcttgggcccctcttcccctcccggcccactccctcctcctccctctttctcccaggccgcctccccctcctctcctcctgggccggccgcccggcccaagccgcgcccaagccaggccgagccgagccggccgtgcacacgcgcgccgcgcgtgcgctgaccgcgcgtccggccgcgtggggcccgcgcgtcaggcgggtcatcgtcctcctcccgcccggccgtcctctctccctctcccgtgaaccctagcgccattcctccctcaaatccgcgcgattcaagcatgggattcccaaattgattagggggaattaatcccctttccctcctctctctttcccccttaattcccccttgaa

SEQ ID NO: 15913 - DNA, 1501 bp, Oryza sativa
  unsure (1)..(1501): unsure at all n locations
tagcacttatggctaatcatggcctaattaggctcgaaagattcgtctcacgattttatatataaactgtgcaattagagcatcccagcagctcatctaaatttcatcatccacactcccatttagatagtcatcccaaaagattcctactccatattactttttactccaacggatcatccatattacatccttcatataccaacatcctatattttactaatactttaaaactaccacatatttatcaccactcttacaaaaaaaagaaaaaagtacgaattaccccctgaactattgcagtcgtccgaattacccccctaacccgaaaaccaggtatcactcaccctgaacttcttatatcggacgaattacccccatcgactgaatctagagcggtttcgtcctacgtggcgtacacgtgacaatccagtcatcattttcttttaaaataatggtgggacccacatgtgataccttcttttccctaatccctctctctcctctctctatcgggcgcaacacgcgtacacggcaaaggcggaccggccggtggcggagctcgcctgggcggtgggcagccagtgggagcgagcggttggcggcggagacggaagttcgccgggcgtctggcggccagtggcaaagcgggcgagttggcgacggcggcggctgaggccgagcatgcttggggacaaaggggcagaggcggaggccggtggtggaccgggctacngaggcggaggnggagctgnntnggcnncnggtggtgnaggtggatcaanancngcgccacacgccgcggagcagagctgccagngtgncaagngcgnnnnccctgnannnnnnnnagnngnnnggngaggcgagctggcggcggaggaggcgagtgcgaccatcctcctctagccagtcatcgccgctgttgcccccaccatcctcctcggggcgtgggccccactggccgtcgccctccccgcgagcgctgccgcccgccgcctccagtgtcctcctcagcgccgcccgtcgcctccaccgttctcctcggctcgggccaccggccgccgtgccctccccgcgacaccgccgtccaccaccgtcctcgccgcatagagagattgagcaggatggaagagagagaaagggggtgagggggagagaagctgacaggtgggtccccccgattattttttttaaaaaaatgatgactggactgccacatgtacaccacgtgggacgaaaaccactttagatacagtcagggggtaattcgtccggtataagaagttcagggtgagtgatacctggttttcggctttagggggtaattcagacgaccgcgatagtttaggggggtaattcgtactttttcctaaaaaaaactccccacctttatctcttcactccccaccttctctaccgccgatctccccgtctttctctcttctctaccgccggcgccgagaggacggggaggacgagggccgaccagaggggcggc

SEQ ID NO: 15914 - DNA, 1501 bp, Oryza sativa
gtatttttctagtaaatttaaaaatacaacttcaaatcagtaaacttgttaaatgtatcaacataggtctaaaatttggcgtacgtgcaggtatggccacacggatactggcgttgtatcatcctaacccaacaccgtctacaccaagccatgattttaaaaaaatttactgctctatttttttttcgcttcttggttcacctctaatttggagaaaatatgtccatttgcacgaaattcaagtggatggccttaaatgccaacttgctcatttttagagaaaatgatgtgggagcgctctatatttttgcactcgttaccagactattatatccgtgatgctttggcgccttgcgataatagacttaacagacatattgaaggcatcaaaagtgaaaggcatccctatggcccatcactgggtttgtcaacagtgacgcgccgcaaatgcccatcacttttagggtgtcactactatgcttcagtttttaggtacgtaggtggtgcttgaatctcctgaagataaagatgaagataaagattaagtgtttcatggaaaacaagatggtaataacgtgcgattaattgagttttaattattacaaacttgaaaaatggattaatctgatattttagagcaactttcatatcgaaagttttcgcacgaaacgcaccgtttagcagttcgaaaagcgtgccacaagtatccaaaatttcatccaagagttgttgtagtgctataagttacattaatcctgtgcttcactcactcctagaaataagatttttgcaggcggcccaaaaccattttcacaggcgggggagaggaccgccactaccatctcgcctgtgaaaacagaccattttcgcaggtggacctgtggcccgcctgcgaaaatcatctcagaaaaataaaaaaaaccacgggacgccgccgccggcctcaccacggccgccgccggctagggctcccctccgtccgctgccgtcggcgccgtcttcgtcgttgtcgtcgcgttgacgaggagagccggcggcgcgcggatctagagccgtcgtcgtcgctcgtcgtggccggcggcgtgcgcacgtgggagaggagggagccggtggcgtcacggtcgtcattgtcgtcgtggccggcgtcggagggagccggcggcgcgcggatctggagcggagggagccgtcggcagcgaggagggagccggcggcgtcgcggtcgtcgtcgtcgtcgaggagggagcccgccgatggcgaggagggaggcttcggcgcgcggacgtcgtcgtggagggagctggcggcgggcggacgtgggaaaggagggagctagccggctatttttctaagtgtgtgtcaaagagagagagataggagggggagggaaatgaatggtagagaggagaggataaggatggtggagaggataaggatgactgattttttttggtaggtactatttttgcaggcggaccacgtaaggtgcgtctgcgaaaat

SEQ ID NO: 15915 - DNA, 1501 bp, Oryza sativa
  unsure (1)..(1501): unsure at all n locations
gagtaggcgagcgatgaagagagtgatctgaacaaaatgaattggcaccgcctaactaatcactttggattatacaggagcactacctgtagtctgtacaccccccaacaaaaaaaaaggtccaatcctaaatcacgcacgccgcacagcacgagccaggccaaccaaaggaacacgcgagcgcaacggcacggcatgatccattgatccactggacagggagagggagagcgagaggaagcgacctgctcggctgggatgatggcgaaccggagccttggagccttgcgccgttttgcgcatgccccgcgtgttgccccagccccacactcgaatgtgcctccggaatccacaaatgcagaggccggngatcgcacccaatcacggatcttcaatctccaattgcctggctcggtgttcgcctggcggccacatgtccccatccatcgatccccctgtgcgctatcgcgccgcatcgatcggacgaggctaccgcaaatgcttgttttgtttgcacgcttgtggagctgtctgtgccctgtagtgctgaattgctgattgcatttttcttttttgaccacactgctgatgcaattggaaatggatgtgtgcatgggtgtaccgtgcacagaagctactctagtagacaccaaccaaaataatactctctccgccccgttttaagtgtgaccataaattttcgcgtccaactttaatcatctgtctcatttgaattttttttataattagtatttttattgttatgagatgataaaacatgaaaagtactttactcgtggtttatgttttaaattttttttaaaaaaatatcaaataagacggacggtcaaagttggacgcagaaaaccatgactacatttaaaatgggacggagggagtagttgctaaatttccgcagccatcaaaccacaggcaccagtgcacgaccaacttgtttgaaatgataaaacgtcagattaaaatataaaataaaaacacgtaattacgatagaaatataagtgtaaaatataaaaataataaggaaatgattgttcgagtagatagctggataaacataagaacggaatcagaactagagatagtcaaagtttggagctcttgcttagagcatgtccaatagaatcccaaaataaaacccggtactaaaaactttgtttttctttaaaaaatggctccaacattttctttatagagatgtccaaaaattagaatccctaatcccatgtcttgtttctcgctctccgcgagtacgtgggcacctggcgcagtggaggtagcacagtcgtgccacgctcgacgagaggagttgacctccgattatgttagtgcagttcttttttaataatggattttcgttaatctgacctctatatctacgaaagatatcagccaaaaagatacaagattacctagactcacatctcaataaagagtggaacataatacccccccaaaaaaaaaaactacgacctcgacaca

SEQ ID NO: 15916 - DNA, 479 bp, Oryza sativa
cctcacaaatattggtaccagtgtctggtgccttgcagcaacgcaggtaccaggcatggtacctggcagtaaccccaggtaccaggtaccaagtatggtacctagagtacctggtactaggtatcagacctggtcctaggtatcaggtctaaacccatgtaccaggcctggtacctagcagtccctactaggtatcagacttggtacctagcataaaacccaggtatcaggtctaaacctaggcaccagacatggtacctcccagtatagggggtatcagccctcacaaatattggtaccagtgtctggtgcctagtagcaacccaagtaccaggcctggtacctggcagtaaccccaggtaccaggtatcaggtctaaacccaggtaccaggcctggtacctggcagtccctactaggtatcagacctagtacctagcataaaaccaaggtatcaggtctaaacctaggcaccaggca

SEQ ID NO: 15917 - DNA, 1501 bp, Oryza sativa
ggacagccgggtcctcctccgttggaaccacggcaaccacaccctatctgcagtggccgatctagaaaaataattcattggtatcataacgtgtctatcgatattataattatagtattgtaatatatgaacaagcagtttaaccataacttttatcgaaagtcgtcggtatcgtttgacaccgatgttaatactgtagattcgcccatacctgccaccgccggtggcgaccaaccaaaaaaagttcgccggatcgatcgatcgatcgacgcatggcccacgagcggatcgatatgatgatcacagacagcatccacacaaaaagggagatgaaaagatgcgaggttccttcgcgcgcgcgcgcgcatggccggagatcgacggcgaaagcagcaaatcggtcattcgccgccgccgttgccatcgcccacggggatccctaccactttggtcatggcttttgggacgaatagaatagaacctaattttggagctaaagcagtaacaacataaaatggaccacggtatccaaaaacgctacgaacattcacattcagattttttgtgtgtgtgtgtgtgtggatcgacaaaaacaaattcttcgctccatcgatccatctcttcttcttcttttgttgattgaaatgaacagaagcatgcatgattcaaagcttttggggggaatttactccaaaaatcaatataaaaaaataatcgagcttcaatctgcggcaaaatcaaaagagctctcgtttttgtacagtgctgtgctgtgttacgtgtaccgaatcgcatatccatgcggagacgagcttcgcctactcggggcgtgtcatcctgggcagcacgtgcagcgacaccacccgcttcccgcccggcgccgccacctcccacatgcgcggcggcggcggcggcgccgcccacgattccctcctcgctgctggtggcggcggcggcggtggcgtgacgtccacgatcaacaccttcccaccgccgggggccaccacgcaggccttcccgccggcgacggtcatctccgccgcccccttgaggcggtcggactcggctaccgtcctccagcggtcggcgccccaatcgtaggcggtgagcgcgccgcgctcctcgtcaacgacgtacatggtctcgccgtcgtccgggggcgacgccgccgcggggcccttccagccggcgagcatgccgggcggcatgtcctcccagcggccggcgcggaggtcgaacacggcgccctccttggcgccgggggtgcggaggttgaccatgcagaccttcccgccggagcagacggcctccgcggcgtcgcggctgaaccgcccgtcgcgcagcggcgggatcggctcccacgcggcggcggggggcggcgaggccgcggggtcccacgtcgcgccggagcgggcgacggccgggtcgtagccggcgccgacgcccccggcgacgaacacgcggccgcgcgccgcgccggccgcgcaccagcggcgcgggg

SEQ ID NO: 15918 - DNA, 1501 bp, Oryza sativa
gtcaccttgctgccctctacttggacaacagggtcttttttttcaaaatatttttgtcggtataatattttttgtaaatattaaaaaaaattaaaaatgaaaaaaattccacgaaacacgcgtttttgcggagtggcgccaggtgggctcaggagttgtggggccgcatgtcagcgagtgggtgccaggtcgcgggtgcggtggaggagcccccacgtaccgcaatccgagtgtccgactactggactgcttgttgtcttgtgattttgctgtttggtgcccggcccggtggtaaatagcaccaacaccccttgctctattttccttccaagtactacaagtttgaaaaagattattgacctgattatcatagtggattatgtaggcgaagtaaacttggcaaatagtttagatctaagctaagcaatgcagaagataaaatctggtggagtacagctgaaaagaacatagccgactccactgatcttttggaataataaagagaaacccatcagagcatcgcattagaatgacaataaacacttacacatatattctttttgcatgctgttgcttgtgctttataagtcttcttttaagtgtacgtatatatcttgtaaaatttggaatacggaaaatgcaatctgaaatacaatcgtaagattaaatatattgtcctctagaatatggaactcagtgacaaaaataaagtggttaattttgaaattttttgaaccgtagaagcacgtatagcatatgtattattctcttttttaccaggcacgttagcattcttactattccaccctttgtcacatttgattattcccacatttagagttaatctagcatgtcacatcgaaaacttcctgatttactccatgttataaactgcacaaaaatctacaaacggcaacgttgcagtaattggtaaaacaacaggctctatcatataatgtcagctttcaaaggctattaggattacgtgttgaaagactaatttcatctaaattaatcctttagcatacaagagggaagactagagcatccacgtccacacaatcaaagctaattcaaccttcacatataagcattctttaaacctctcaattcaacttaataaggacctcaattatttatttataaacacatgtgaagagaagaaaaaacttttataaatcagttaagaaaagagaccaataattttcttttaaaaaatagtactagcagccaccgaccactcccttgactataggcaacgcgagaagaaaaaaacccagaaatgcgagggatagaacgcaaaaataaataaaggatttatttgaagacgattaaagaaataaattaaatagatttacgaccacaaaaaaggaacgtctccttcctcctcttgctataagctttcgctttcataaaagccattactccctctcctccattgctggcctcccgcctccgcctcctctcgcctcgcctccgccacccatggcttctcgaaacc

SEQ ID NO: 15919 - DNA, 1501 bp, Oryza sativa
gttgcacgaattgtgtttttttcattcttaatctttgtcttacagcatactagtgattgtactttgtgctagtgagcatttgaattttgaagtagacgaaagatttcgaaaacgatatggggttgctgtttgcaatccttttttttacataaaatttgtggcagttgaatctcaactgttaatttgcaacgttgacatgtaaacaaagtagtgtgggaatattttctttacgaaaagtcaacttctttgttcgaatttaaaaagtgatccagactaaccttaggaattatttttcttaataatggaaatagtttaatctccggtttctggcaacttatgaattatttccaacagaaacattaaatgaacatagataaaattaacgggagacgtttggtttctacttatttgaaaacttttgtcgcattctgaaagtgtccttacataatcctgtatatgcaaactgataacgcataaccactctatcgacgtcaaaagcatatttattaagcagatataacaataatgaaatgtagatagagacatatagctcgaattggtaaataagtacatatgtatatacacatagccacataggacatggacacaacacatgataccctcttaaaaatagataatatgacatgatataacagctgaatatgacatgcactcgttgtcgcgttcaatttcttcgtaaccgtcgaacaacgcacacgcacacattcgttttcggatagattctcaatacttcgcatggaagtaacacggcacgcgtttacttggagtggttcgttggattagcgcgttaattaattacctcctttccctccttgtattaaccgacgcttctgccctctagttgtaaataggagagatcataggtagcatagtgcaaaagtaccagtggatctctcatctcagccgtccgatggccggccaccacacgatccggccgtcgagccaaagagtacagcacttagcacgtgaccacccctttttcaatttcttttccaccacgcgatctcgatgcgtcgttctagcagcaagtaaaataatcaaatttcctttttgtgtgtgattaaaataaccaaattatcgtcgaattgaccggcaacacgagcagtcaaattactaaaccagccattttttgtttgatgggagaaatgaagcaaccactccaacggtaattaagttaagccacactcacacacctaaccacatgaccgaaccgacaatcgcagcaggcagcttggaatgattaatagattagctccaaacaagttgctaaagatttaatcacacgcactcgtaacagaaagttcaagtcgacacctcagctaagcttaaggcttcgtttttttaaaactataattttctaattgttcgttagcatgtttttaaactattaaatatagtatattttaaaaacttttttataaaagtttctttaaataattaaataaacttatttttaaaaaaatataataatcagtactaa

SEQ ID NO: 15920 - DNA, 1501 bp, Oryza sativa
gagtgtggcttaacttaattaccgttggagtggttgcttcatttctcccatcaaacaaaaaatggctggtttagtaatttgactgctcgtgttgccggtcaattcgacgataatttggttattttaatcacacacaaaaaggaaatttgattattttacttgctgctagaacgacgcatcgagatcgcgtggtggaaaagaaattgaaaaaggggtggtcacgtgctaagtgctgtactctttggctcgacggccggatcgtgtggtggccggccatcggacggctgagatgagagatccactggtacttttgcactatgctacctatgatctctcctatttacaactagagggcagaagcgtcggttaatacaaggagggaaaggaggtaattaattaacgcgctaatccaacgaaccactccaagtaaacgcgtgccgtgttacttccatgcgaagtattgagaatctatccgaaaacgaatgtgtgcgtgtgcgttgttcgacggttacgaagaaattgaacgcgacaacgagtgcatgtcatattcagctgttatatcatgtcatattatctatttttaagagggtatcatgtgttgtgtccatgtcctatgtggctatgtgtatatacatatgtacttatttaccaattcgagctatatgtctctatctacatttcattattgttatatctgcttaataaatatgcttttgacgtcgatagagtggttatgcgttatcagtttgcatatacaggattatgtaaggacactttcagaatgcgacaaaagttttcaaataagtagaaaccaaacgtctcccgttaattttatctatgttcatttaatgtttctgttggaaataattcataagttgccagaaaccggagattaaactatttccattattaagaaaaataattcctaaggttagtctggatcactttttaaattcgaacaaagaagttgacttttcgtaaagaaaatattcccacactactttgtttacatgtcaacgttgcaaattaacagttgagattcaactgccacaaattttatgtaaaaaaaaggattgcaaacagcaaccccatatcgttttcgaaatctttcgtctacttcaaaattcaaatgctcactagcacaaagtacaatcactagtatgctgtaagacaaagattaagaatgaaaaaaacacaattcgtgcaactacggggaccgaatcgggaaaaaaaaacaacgacataatctgcagtttacttgtacccacacccactgtctcgtattctattcctcattccttctctttttttctcgctttgtttctcccgtcgtctgatccaccaccgcaacgcacgcacgcacgcgcgcctcctcctccctccgcggcggcgaccaccgcgcgcgacgccatcgccgccacctagggttagggttccggcgacccccacccccggcgatcgcgcgagggatccatccgtcctctcctccatgtccaccgac

SEQ ID NO: 15921 - DNA, 1501 bp, Oryza sativa
tggaggcggtggcgaggatggcagcacacacggcgcggcggcgcgcacgcacgcggccaggggacggaggtggcggcgaggacggcggcgtggctgagacgcgcacggcggcgcacacgcacgtggatagggcccggaggcggcggcgcagcgctttgaggatctcctcctagtactccaaagctcgtgctgttgtggtcaccggtggcttcaagttgggcattacggcctcccaatatgcatcgcgctgcccaaaaacatgcaaacacgatcatgcaagcagtcaggccacctcactgagacataacatcgaacactaggcgtgcggcaccagtaaaacgagccagtgacgccgagccgagcagaccaacctgtggggagcacggctgacaggacatcgccttcccagaggtggaggtgtcagtcatcgggccgcgtgatggtgagctcctgcggcggcggcaccgatccgatggagggggaggtgaaagggaaggaagagaaagcgcggggcggagggaggtcgacggagcgtgcagggcatgccgccgtcctcgccgctgcgtgcgtgcgtgcgcgctgccatgccgtgcgtgccgccgtcctcgccgccgcctccggccccgtcctcgccactgtgcgcgtgagagagaagaagagtgagagagacaagagagtgggtcccacattttttaatgaatagaatgctgactggactgccacacgtgcgacacgtagaccaaaaccaccgcggattgggtcgaggggggtaatttgtccggtttacatagttgagggtgaggaatgtcctattttatggtttagggggtaattcggtcgaccgcgatagtttgaggggtaattcgtactttttccaaactgtaatagtgtcatactatgatgggattacattggacgagaaaattagaacactatcgaaccggcagggatgatctagtagtgatccgaaacatagactgcatttttctcatattttccgttagcaagcttatcgaacggcttaaaaacacagtacattttcgaaataaattattacttaagttttttttattaaaattcaaataaatttatttttaaaatttataataggtactggtaatacttaattaattactatggagtttggccctatctctgcagagtggccactggacggcatccgagccatacttaatttaaacaaacctacttaaaaaaaggggattaatatggctggagtgcacatgacgctgtacattttcgcatgccatctctcccccaaaagcggggtggtctaaacttaacgtgagtggaaggcgttcataatatatcttcaccctctccactacttcgtctccaccaccagagcatctaatttcacgctccaagcagtatacttcacactctcgctacctcgctaagctaagctagctctccttcaacgccacgtcgacaatggcggaccagccgcagcagcagcagccggagccggagccggaga

SEQ ID NO: 15922 - DNA, 1245 bp, Oryza sativa
atatatagcgtatgcaccacttgtgcttgccgcacttgacgccgccggtgaccgccggcgtaccgttccccggcggcggtgcgaactgcagccagcagtcgtactcgtagtagtgggtggtcttggtgggccagaacctgtacgtcagcgtcgtcttcaccctcacgtcaaggtagggatggggatgaaaattttagtgggatggggatgaggaattgaggaaggaactccctcttttttaatacctgggtagggacagataattaaaagggaattcctcctctactttgtctaagcaaatctcagcaaccatttttattaagggaaaatttgaaccatgccacataaattttacagaaaatgtgatatgccaccctgacccacatgtcattgactcatgtgggttctacatgtcattgagatacgggtagcatatcttaaattttacaaaattaaggtggcatggttctaacaaacccttttattaatgatctaatctccaactaaactcctctatcaatttctatcacctgttagatccagactgctgagattccttcaagaaaacgaagcgttgacctggaccggagactggagtcgatcagagccgtcaaataaacaaccgctcggaattgaacctgagtggacaggttgttaaaaaaaaaaacctaaccagtacggtagacgcatttacaacttagaaggtgattagatcggggagtaaagttttatcgtgtcacatcgaatattatatagggtgtcgtatggggtgttcgggcactaataaaaaaataattacagaatccgttagtaaagtacgagacgaatttattaactctaattaatccgtcattagcaaatatatattgtagcaccacattattaaatcatatagtaattaggttcaaaagattcgtttcgcaaattagttgtaatctgtgcaattaattgtttcttagcctatgtcagggctatggataccacataccaaatagtagttgactgaatctcagcaagacccaccacataccatgtcttatacggaaacaaccttcggatataggagtagttccggataaggaaagacaactagagttctacatggaaacgataaagactactcggattatatccatattggtttccctagttctacttggacaaggggatacctatggatataaatacaaggccccctaggaggagaggggagacggacaacatagataccacaaagccacaagc

SEQ ID NO: 15923 - DNA, 1501 bp, Oryza sativa
ccgaccgtagccacaaatgctttcttttcttatggcttataattaatatgggtctcatactgacataattgtgtctcttaagatcaacgtagagcacaagtttaatgtcaaattcactaattgccaatggtgacttctcactgggcatgcccagtgagaagatggatgtgatgcagatattcttttaaaaagttgagtcaaattgtgatatagaatagacaacggtacaaatataattttcccttttgaaaataagcaggagtgatccttcgacactactttaaaaaatacaaatataatttttccttttgaaaataagcaggagtgatccttcgacactactttaaaaaatctaatagggttgatggagccgtttgtaaatgaatataatgcccgctattaattatttgaaaaggatagagtaattgttaagaatatttgaatgagattgaaaaaaagatagaatattgttccacataatattttttaaattaaaatatatagttattatgggatgtaacgatatacatctaggatatatcctagtcaaatacctagtaaaacaaaggggagcgaaattaaaggatccacataggagtggactgaaagttaggagggaaggattcatagttttttcgcgattagtagtctcccggcaaataatagtctctctaccatatatagatgtatatatgtacatatttttttcggacgaatagtacaaattagacaggagattaggaggaagggattatttacttcaggagatataatctaataattgaaaataataagtttactggtttaagtgtaaattgatcgctccatgttttgttttcttccaatttttttagattttattgatcctaaattatcagtttaactacaaattaaattgagacattaaactgcattaaattgcttgcaattcctaggaagtagagagaagggagagagaggaaatatatgtcctgcacgtagcccatgtacgtatacaggtatgtacgtatgggttcgttacgtacaggggggagagagaggtggaggtggaaggatttgtttcggttaatataatggctgaatataatgggtccaccaactttaataaaaattaaaggttaatctaatggctgaatataacggtttttttctcagaatttcttggatttctctatttctatagagcgccacgtggcagcctgagagcgtttataggaagtttaatggacttttagtatataatagatagataatagatagatatggtatgaacgctcacatatggagtacatgacatgatcgtacacacatactttttccttgtatatcttgagattgatgaaatcattacaaagatcaacataaactacatacgtatctctatcgatggatacgtcgtctatcactgaaaaataataaggccctttttagatttcactcaaaaattttacaccctgtcacatcgaacatttgaacacctgtatgaagcattaaatatagg

SEQ ID NO: 15924 - DNA, 1501 bp, Oryza sativa
aatggtttcttgaccgttcttacgtgcagttcggatcagggttttgactaagcttatcagcggcaagccaaacaaggaggattattagtgtaggactaattaaacattagcttttgcagacttaaaataatttttttaataaaaagtatttgcaaaaaatatcagtttgtagcgtatgaaacatacttaaagaaagcgaggaagtagctaaacatggttgatttagggcctcatcatttgcccctacaaataatcaatcgctaccaaaattagattttaaaatttaattttgggatttaggatattttcaatgtagtttttttaaggattggatattaagttgctaataaccatttcggttgcacagtgtgcccattttagaagatggtccatattgatttaaaaacatgttctccaaacattacttcttttctttaggccttgtttagcacaacctaaattacagatccagactagttttggagtttgtaagttaaattatagtggtttattttttttattttctctaaaataagaacaaactgattcaatcaattattatcaatgtaatcacaaattcaaatccaacaatttatggagctagaaataacctgttctaaacaacatttgatgtgtgccatggccttatagcgctagacatttattttatcaatcttgaagaaattaccggtgcctttttatcccaccaattgtatgtaagcaaaacctatgagcttataacgcccttacatgacttcaaacacgacccaagtatgaactatgttgtacttcaataccatatttcagggacatatccgatggaaaccatcaaataagtgaaaacacgtgaaaatcggaactaaaagtttaataaattcatgaaaaattactggagagaagtgtaggcatgaaatatattcaccaaatatcaagttaaactcaactttatttgggagtaacaaaaatgccaaatttcggatgaaaaataatagaacactattcacctaaaatttgtcttttatattctctcaaataaaagttgagtttcgacttgagatttgatgtaaatgtatttcatgtctatatttatctctattaatttttatataaatttagagaacttttaaatataattttcatgagttttcacttatttaacggttttcacatgatatttccccatgtttcagcctccaaagatgacaacatgtgtgcgatttacctgtacacgtagcttggcaaaaggttgtagtacagcctaattgtccatgttaggtggtgtttggatcatggacttaactttagtctctgttttaaacactaatttagagtattaaatatagactatttacaaaactaattatataaatgaaagctaatttgcgagacaaattttttaagtctaattaatccataattagagaatgtttactgtatcatcacataggctaatcatgacttaattaggctcaatagattcgtctcgcgaattagtctaaga

SEQ ID NO: 15925 - DNA, 1501 bp, Oryza sativa
attatatttaaaagttctctaaatttatataaaaattaatagagataaatatagacatgaaatacatttacatcaaatctcaagtcgaaactcaacttttatttgagagaatataaaagacaaattttaggtgaatagtgttctattatttttcatccgaaatttggcatttttgttactcccaaataaagttgagtttaacttgatatttggtgaatatatttcatgcctacacttctctccagtaatttttcatgaatttattaaacttttagttccgattttcacgtgttttcacttatttgatggtttccatcggatatgtccctgaaatatggtattgaagtacaacatagttcatacttgggtcgtgtttgaagtcatgtaagggcgttataagctcataggttttgcttacatacaattggtgggataaaaaggcaccggtaatttcttcaagattgataaaataaatgtctagcgctataaggccatggcacacatcaaatgttgtttagaacaggttatttctagctccataaattgttggatttgaatttgtgattacattgataataattgattgaatcagtttgttcttattttagagaaaataaaaaaaataaaccactataatttaacttacaaactccaaaactagtctggatctgtaatttaggttgtgctaaacaaggcctaaagaaaagaagtaatgtttggagaacatgtttttaaatcaatatggaccatcttctaaaatgggcacactgtgcaaccgaaatggttattagcaacttaatatccaatccttaaaaaaactacattgaaaatatcctaaatcccaaaattaaattttaaaatctaattttggtagcgattgattatttgtaggggcaaatgatgaggccctaaatcaaccatgtttagctacttcctcgctttctttaagtatgtttcatacgctacaaactgatattttttgcaaatactttttattaaaaaaattattttaagtctgcaaaagctaatgtttaattagtcctacactaataatcctccttgtttggcttgccgctgataagcttagtcaaaaccctgatccgaactgcacgtaagaacggtcaagaaaccatttcggttacatcacacaacacagcctcatctctcatgctgtcatgcttgtggtgcacctagcaattcctccctccccatctgtcttcctcctctaatctaatccacctccccactaatccaccagctgtgtacactgcagcagcagcagcagctaaccactctcactaaaaactatagcagctgcagtaacagcagcagcatcacccaccttcttcttggtcaaagccatccatcccaccactcacccatccctcccagtataagccaaaccaatccatagaggaggaagaggaggaccaggtggtggcacacctaagctttgtgcagtgccattcacgcacctgcagcttccagctttgccacatgg

SEQ ID NO: 15926 - DNA, 1501 bp, Oryza sativa
atgcatgaggtatacgtgagatatatgcatgcatgtgtgaggctatgtcgcgcgcagccatctcgcggcattactcagccggctcgcgatgccgcatgcgcggctgacccgcgggactgcagtgccgcacggccaagccatggaccaatgcaacacggtaccgttcgtccacgacaccggattgtcccagcagacggtcccgtaccttcacattgcgccaaacaatcgtgttaccatttcgtggcacacgtatatttttatatttttttccaaagcatgtatataactgtaaaaatgctaaaaataaaatatattttcatttttgtttctaatacaaactgaatctgaatctgcaagactacaactcaacagtggagcaatggcctgaggtcacgacccaagatcatccactacttttaagaagcgtttgtgcatacggccaataacccatttacacaggtgttttcagacatgcatgtagctatggtatgtagatatcacatgatttgtgcgggcggaataccgaccatccttggaaattttcacgggtgactctcttaagtacttacccgtgaaaatgaatttttagtttttgatctctatagggaaaaaaactcaaaaaaaaatctcgtattttagcaggcatctctcttatgtcacaagtcacatgatttcacacatgaataggattcgaacctaagtcctatcatttagtgcatagtctccttaccatctcacatatgaagcacttctgactatgagttgaatgctattcttttttactctacctctcataaaacttgcaacatatattttacactctaaataatataaaatgaaaaagtcatcaactaaaaagttgtaaaccacaccgagctctacaactttaatataaagcatatctccattcaagctcatttgaaaaaaaaataattttttttataaacatatataccagagagtttctaatgaatatttgctcccctaagcaatctcaattgaaaaaaaagttcaaatataaagttatagatatcattgagctctacaattttaatatagaatatgtccctatccaaggtcgtttaaaaaactaaaagaaacaaattcaaaaatagatctgagaacaaaaaacgaatagaacattttaactacaaagttgtaaatctcgtcaagggctacaattttcatatataatacgtatctgtcagggttatggataccacatatctaatagtagttgactaaatctcggcaagacccaccacataccatgttttatacggaaactgaccttggatatggagagagttccggataaggaaagacaaccagagttctacatggaaacgacaaggactactcggattgtatccatattggttttcctagttctacttggacaaggggacacctatgggtataaatacaagaccccctaggaggagaggggacacacccaccatagaatacacggaacaatagatcaagacacaagatcaac

SEQ ID NO: 15927 - DNA, 1501 bp, Oryza sativa
aagatatttgaattttgaaagaaaacggtgtcggtttctataggttggaaataaaaatggaattcaagtaaatcaagggaattttaattcaagaaggggttttaaatatattaaagaaataaaatttaaaaatggtattttaaaataaagaaaagggcatttaaagaaactaaaggataatttaattttaaaaaggtttttaaaataaaacaagaaatttaaaattaaagggatataaagtaaaaaaaataaatttaaaataatttttataggttaattaaaataatttagaattagaaagtaaataaataaggaaaaggggtacttaaataaagaaatttaaataaaattttaaaaattaggaaatttggtatctaataaagggtttgaaattagatggttaaagaatttttggaattggatcaatggttggagagatatggatctctaaagaatggaatttgaaataaatcaaataaaagtagaagagttaccgtataggtggggcccgcttgtcagctctttcttccttccctatttcttttcttccccttctccttgcgacacagatgaaagggagagagagccgagcagaggaggacgtgggggggaagagcggctctagcggctggcgctcgtcgacaacggcgacagcggcggcggctggtggcggccggcagggctagggtggcggccaggtgtggggagcaaaggaaagcgacggccggtggcggtggattggagagagagagagagagagagagagagagagagagagagagctccgatttttgtgatggaaatggaggggttcgccggtttatataggaggcaaaggcggtcgagggagagatggtcgacgatggcacggctcggcgtcgagaggaaatggaggtggcggcgttgggtgtcagcttgtgattggacagcgaatgggcggctcgatgtcggtaactgctcgagatgacgctcgcgggacggcggtggagaggatagtgggcgaaggcaaggtggcggcgacggattggcgcggcaaggtggcggcggcggattggcgcggcaaggtggcggcggcggattggctgggcggcggcgcgctggtttcggcatgtcagcggcggcgacatgcccacaggaagagaaggggagggagataacatagacttgtgctaattgggccgaatgaagggactttggcccaaaataaataggagcctttggcaatttgcggatagatttgaaataggattcaaaggaaatgaaagaggggataaatttgaggactttttgaacttgacaaggaaaattaaaataaagcttttaggttaccaaaaggatttgaaaatttttgaaatagaaacacaacctaattaattagagatataaatttgaaaaggataaaaataggaaatgctccaatttagtcaaatgcaataagaaccaaaagtaaaactcgtcgcgaaaaattttctccaaaaattcaagatttttgagtatgtta

SEQ ID NO: 15928 - DNA, 1501 bp, Oryza sativa
  unsure (1)..(1501): unsure at all n locations
cttgttttaacaagaaaaataattaggacataattaatcaaggtaactgtatatgtaatttgtccttttttgttagaattataagtaaattgaaacagggaagactatgctccatatgtcaatgcaaaagcacagcatgtgccatgagaccatagtacaaaaaaacggtatcgggccggcggttgagctggaaaaaaccggaaccggcgactttggtggcttggttaaaaaaaaagaccgcccctgcaatcaaacaagtaaaaaaccagtgaaccgggcggttttatgggagccggtgaaccggtagttgttttttaataatcgaactggtttaaaatttatcctcgcagtatggcattatgaatttattatgttacaacgctatatttttttatgttgtggcgatataataatagatatactagtttatttatacatattttcactaatttgtgatgattatatatttaaaataatgcaaatcaaatataatattaataaataaaaaaccggtggttcgaccggtgaaccggtgaaccgacgactagagcgggttgacctccggtccggcttttttactatgcatgagactgaataagtacggctcagtgccgcctaccatttcgtcattaatatattttctctcgaatcaaatccatattgtttggccggaagttggcacttctattactaaaaaaagaatagaatccagtatatttttagtacgtatttcattcaagcgtcgccaaacgttggttcagccagccaatcaatcaagattatccattttgaataaattagttcatggcgagattcaccatctagtttagtaaaccaagctgaatgattgtagtggcctctgctctaattggcaggatttgctccgatctgctgactgataagtacgtacgtgctacgactttgcctccagcttttgatcagcttcacactaataatacgtcatcgttccgtttcaaaataaacaaattgatcttattgatatgctccctccgtttctaaatatttgacgccgttgactttttaaaatatatttgaccattcatcttatttaaaagtttaagcaattattaattttttcatatcatttgattcattattagatatacttatatgcatatatatagttttacatatttcacaaaagttttgaataagacgaacggtcaaacatgctaaaaagtcaacggtgttaaatatttagaaacggactagatttatttattttaatatgagggaagtacgaataattcacgataacatgccaagaactcctcaatgcaaaacggcacatacgtacaaattccttgcacacgagaacttgttaggaattttttttatttataattttttttattaaaagttttacaaaaataattttccattttgaaaattgacggaaatagtcgcctaccgccctctgggagggcgattnttcaaatcgccctcccagagggcggcgaaaatgacgtggcagacggcc

SEQ ID NO: 15929 - DNA, 211 bp, Oryza sativa
ggctacgagggcatcgacctgggcaggccggccgccacggtgtcgccggagttcagggtgacgctcgggacggcgaacggcgcgtgcgtggaccgcgcggccgtgaccgtgctgtactcgggcgtggcgctgggttgggcgcgcgcggagccgcgcgactgcgcggcggggcgcttggagagggacgtggaggtggtggcgcggggccagg

SEQ ID NO: 15930 - DNA, 203 bp, Oryza sativa
ggcgcgccacgcgatccgggagcggcgggcggcgcacgtggagcggctgcgcgacgccacgtccaggcggctgtccgtcgcgcgccgcatccgcgacctcggcatggacctcggcgcggcgagcggcaggttcgagtaggcgcgcgccggcgtccggcgaacgctgcggcggctcgccgtcgtcgccggtggcggcggcgcca

SEQ ID NO: 15931 - DNA, 1501 bp, Oryza sativa
gagatggatgaagtcgggcgtcgatggacattctccagggcaaatgaaggctacacgagctgcggcccggtagtcgagatgtcgtacggcggagggttggtgcccaatgctaggggctcagttctgcctgcctgtcccgggtatcccggccgtaggtaggattgggtcggtactcttgtctaaggctaggatgggttggaaactatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctccacaactaaaatatggaatggttggcctgggttggcttgggacgagctggaacccaggtcgggttgccagttcggtccaaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacctaacccctactattatccccttgtacccccttgcattaatcatgcatctgccggtgtggcttgctgagtactgtggttgtactcattcttgctcaatcttttcccccttcagtaagagaagctttggagaagatgtcttaggtggagtcctggcttataccccagttgagcgcctgtgaagatggagccgtaggcccgctagtccgctgccgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaaatggataaaacctaaggacatattttataaataaaattatttgcgaaagttcctctttttctccttcccctaatgctatttgcaaaaggtttactcttttctttcttcggatttcaactaagtactagatggtcagctttgcgaagaagaagatgtcgtcagttgtttgccgaagctccggaagactgcaggatccgccagcgaagcgaaggaagcagtgaagccagctgtgaagcaggagtgaagatcttggagaacccgtcgcagaacctaagccaccctctagtgtttcgtttgtcgtgtgtttccttgcttgtgtgtgtagcgcgtggtttgcatcggtgggtggtgatgtaaccatgctaggttgtttgcttaatcaacttgcagaataaatgaaacaaacaacacatcaacaaaaagagttagttcctttaaggtcctgtccctagctctggtctattctttccttgtatgcttcccctct

SEQ ID NO: 15932 - DNA, 1501 bp, Oryza sativa
ataaattaactatttacgcttccgcttgataaactctgaaatgtatcaacttttggtgtaccttgcctcctgggacaaggaataatacacgcacgtaaggaacgcccgttgggtcaattccggtcgtgacaaaaagacaggaaggctgcgccgttgacatgtggatcccacatgtcaacctaagggaccacggtagaccgagtacacagagacggtccacgggtcgatggaagcggaccccgtgtgccaaccgaggcgagtggccgacaaacggactccactagacaccacgcgggctgcacacgtggaaaccacgtggctaccgagcgtgcacactaacacggtcaccacacgcacaagcgaacaactaccgacaccagtacacgggtaccggggtcgacagccgcacaacgggcacgggtgacactgaaaggactagacggggcagcgagaggacggacccttaccaccaagcgacgaggcgtgggaacgacgacggcgaacgggcgcggcggagatggacgggaatggcggagacgaacggcgagggggcgacttcggcggcgatccttggacgaaggcaagacgtggctggcgcagagcttgatgacgcggaggcgaggacaaagacgacgatggggttgcagcggcacacttgacggacgcggacgacggatgagaacggcttgacggagggacgaacgccacgacgaccgggaacaacgagacgacgatgacgaccggggctggcgaggagatgacgatggcagccggcagcagctgcacagaggcaaggatgacgtggaacacgccgctgcgatgccgacgacggtggcggtgcagcgagacgacgagccgggcgaccgatgggacgtcgatcggcgaggacgaacggtgacgaggaaatgacgatggcagccagcagcggctgcgcggaggtggaacacaacgctgcgatgttggtgaaggtggtggtgcagcggggcgacgagccgacgaggaggaataggcagttggcgcggcggcggcgttccggcgaacttcgggcgacgccacagccgggccggagaagaggatggcgcagcagcaccgacagaggtggcaacgacgtcggccggcgctcaggcgaggcggcagggatggctggagatggtacagtggaggcaaagccacttgaagccggcggggccgcgtctccggcaatttccccatgaatcggaggcggcgccggggaagaggaggcagctgcgacgctggggaaggcgacggcacggccggccggcgtgctgaggcggcggcaggggcggctggaggtcggccggcggcacgggagagagagggaggaggcggggagaggtggtgaggccacgggagaacgcgggagggggctaaaacgatagatcggaggatggggattccattttataggcaaagggaaggagccggccacgggaggagcggggaacggcggcggaaaagccggccggcggccatggaaggt

SEQ ID NO: 15933 - DNA, 1501 bp, Oryza sativa
cagtagtaaagcatggaacaaaatggtgatgctctagagtctagaggaccacggctagacgtaccgtttgccatgtcaatagactcgacatgtacctgcaactcagccagtaaacctgcaatattcaaatccactccagtcagtttcagcagaagaacagagggaatatcatgaacttgcaaagagatgcaatcatgcagacgcactctaataacgccttcccgggaaatttcagaacaacggaaaaacgaatccttgccaatctcaaaagtaggcacggattgcgaaaaccgtaagtaacttttagatgatataaaattttcaatttgctgagaacatttcccgagtaccatatgttacgcccggcacttccaagttggtaacaccatagcacgaattttacaaagaattcagtagacaagaacccttctccgcggccgacctaaaaaaagagagtcaagaatccatattcctagttcccgaaaatccatcatccctagttcatcatccaaatcgccaaccgaaaagaaaagagagtcaagaatccatattcctagttcccgaatatccatcattcctagttcatcatccgaatcgcaaattgatcgctcaaattcatgcttaatccttcaaatcaaccacaaccgctggtctgtactgacaacccaaccgaaacataccttcgatgtcgtcgggggtgatgccgtgcgcctccaggacggagagcggggtgctcatgagcagcgcgatctccctcatgcggctcaccacgtccaccatcatgtgacgctccaccgcctccgccaaccacctccgctcctcctcgctgccgcgcaccaccacccacacacccccaaccaactctccaccatcagccacacaactcaagcaaacaagaagaaagaaaagaaaagaaacggaaaaaaagaacccgccacattccaatttccccaacagcaatcaaccctccgcaagccaaatcctcctcacctgatggcgcgagacggccgcgtcccgtcggcgtaggagaggctccatttcagcagccccgaccagctcagccgatctccggccatcccctaccgtcgccctcctccctcccccacgccttcccgtgcctattatgccgccggtgtccgctcgatcgctcgctcgcctcgtcgagttcttgcgttgcgtgtgaagcgcgagatatttttctctccccttcttcttctcgtgctgcaccggattagataggggtagagtgctacgagaaagtgacaaatgcgtgacgtcacgtcacgtcgcggcgtgggggagaagaaggttggggatagggatggatccctctggaatttactcggccggccgggcgggcgggcgggcccacccaccgcacgcgaaccctatgggccggcccacgcgggcccatttaggatcggattggcccagctgttttgtccgctcggtttccgaccattcgttccgcttcgggcggcgcgaggcgaggataatggcg

SEQ ID NO: 15934 - DNA, 1264 bp, Oryza sativa
acgaatggtcaacatatgctaaaaagtcaacggtgtcaaacattttgaaacggagggagtatcatctcacccggcagtgtcccgtagggcccaggcacagtgtcaccgtgtcgccgtctcgccatggctccatgcttcttcaaatcggcactgacaagtcacagctaactttgcagtgtttgttctgtgacgagagcattttttttcctgcccaaccgaactaatttgggacaaaagaagacaatgaaaagatgggtgagcattagtctgtgttagtgtgggttattcttgatagaatggaattatgcatgaaagtgttttaatttggagggcagacaggaatgcaaattaactttgattcccagcagccggaatattgctgaccatggaattgtcactccctttttagtgtcatgctaagacatgcatgcactaccaaatatacacacactactatcacaaatggcaaattgagttgtactgcacttgtctactcataaattccatagtaaggttagcatgcttgggtttgcatttaggtgtgtgacgcatgaattgaatctggacaacgtaacgcacttaacatgaaaatctgtcaggttgttactctctaccgtagtgcaatcgatagccattcgcatgcccggattagacaatcatgcatgagtttcgttgtagtgcggcattaagaagtcaaaaccaaagaattcatctgtatgtgcgagtgtttgtgcgacaagagagagagagaataatcaagacgaagcttactaaactagaaattaaattactccatccatcccaaaatatagcaacggagggaataattgatttgccaaaatcaactgaactttttctaccaaaccgaaacataaataaacataccgagcaagctagaattttaaaagaacaaaacattagaatatgctgaaatatacaattagactctgggtgaacctagctaggatttgaattgaggtataattaggaaagtttaagcaaaaccatgcatgcatgtacaaagaacacatccaattaagcatagctatgtatgcacaattctaacaaaacaattagtgtattcaggcataatcacgcattgagcagtgcatgcagggagtaaaactcaagaaatattttgtagtgatcgagtagtccaaagtatgcaaaatgaccaagcaattgacacaagcgtgaattggtgcttgcgaagaacaagatgcaagagcttatgatcgagcagatagctagtgaaggagcaagt

SEQ ID NO: 15935 - DNA, 1501 bp, Oryza sativa
cgccacgaactcgccgcacgcgagccggagcaggagcgactggtccgtggacgtgacgcgcgcgacgccctcggcgcgcagcgcgtccgcgcggagcctcctgacctccacgtcagacagcgagcggtggagcgacacgagccgcgacatggccgccgccgcctcgaacgccaggatcccgagacccgcctcctccctggcgccgccaccgaaccgcgcgcgcaggtcggcgagccatgacctcgcccccgcgggcatgccaaaacctcacacccgacacggcaccactttacttaccaagctcaagaacacaaggaaatactatcaaataacacccaacgtaacgagcagccgcgcagcagatcaaatatcatcagtatgaaatcgagacaggattgttcatgcggattacgcgtctaaacagcgaaggagcagaaccagcacgcgaccggacggtatccaagcaggattagccattaggagaagaaatacgtgtgctcggcagcgcgacccggagcgggtcaagagaggcgaagtcgtccacgcagccggcaaatcacgagaggccatgtgcacggtctacccgtccaccgagccagccgtccacttcgatctcccactggccaccaccaccactagctagacatgtcaacgtgccatggaattcctcccatcctctcgacccaaccgggcgggcgctgcacggccggagacttgcctcggggaagtcttgcatcgacggcgacgcctgtcgactgtcgtctcttcccgctgggacacgaccgatctacgtaggatcgcgagatgagaacgcgcgagcgtaaggcgccgctgctgcaacgccgctcgcttagtttccacatgtgtcgacatgtcgatcacctgtcgtgggtaattgcacgagagagatactggacgtccttctcattctcaatttctcactcgattaatacgtgtgttttgaacaggtagcaagacctccaataccatccttgttcccatctgaaacagtaattacataaaacggtacggtgcattaacgcgtgataaattaagtattagccatttttaaaaaaaatggattaatttaatttttttaaacaactttcgtatagaaacttttttaaaaaaatgtaccatttagcggtttgaaaaaaagcgtgcgcacggaaaataaataagaggggttgggaacgcacccgagtgcctgatctccacggatgtaatctatggctcattcattgctcaattacgatccgtttgctgcaaatgcacaccgcctgattctgctcagctatatcgtatacacgtatcccaaacaaggttacaccgtatacgtatgattagaaggtacgtatatacgtaaggctgtgtgcctgtgtccatcgatcgcctctacattgcgatcagatgccactactctgtagtattattgccacgtacatataggtacgcgtcgtgttgtcatcgatggcgcaatgcacgccaatgcgactagcta

SEQ ID NO: 15936 - DNA, 1501 bp, Oryza sativa
ccttctccgtccctctccgcgcccgcacctcgcgcccacgtcgccgctcttcccccccccacatctcccgcgcgcgcgcgcccgcaagtggtgggggatttgaatcccccactttctctctctcctccccacgtcgccggccaaatcggccacctccccggccacgtccgccccctcccgcacctatacatcgctctcccgagctccctctctcgtttcccccatttgccgtctcctcccgtgccccctaccgcgcccgcgccgtcacacccgagctccgccgcttgccgccgccttcggccgcgagccgccgccgctagagccgccgccgcgccgcaccatcgccgccgtcgcgctcaccgagcccgcccgcacctcggccgccgctcgttttccgtccgccgccgccggaccccgattcccccacatcgccggtgaggactacctctctctccttctttctttaatctctctcccgtgcatgccgccgccctccgcacgtgcatcgccgcgcttcggccatgcgccgccacctttcggccgccgccgccgcttcccgcgccgccggtccccgccgtcggtggtcgtgcctcgccgccgcctcgccccgctcggtcttgaggccgagctgagcccggccgatgcctccctccccctcccttttctccccttcacgcgtgcgccgccgcttttggccgtgccgccgctccggccgtccgccgccgcctttcgcgtcgtccgccgccgtctccccgcaccgccggcggtcgtgcgccgtcgtcgcctcgccatggccggccggcttgagccgtgccgagcatgccgccgcccactccctcccccttgagccgctgcccgtggggcccacatgccggcgcctccctcgcctcccccttgagccaccgcctggtggggcccacctgccagtcgccacctccctccctttggagccgctgaccagtggggcccgcatgtcggcgcagccgccccccttccgctgacgtcagccctgggacttattgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatggttttgtttcctttttctgtagtcttatagcatgttttgcttgtgtgctttgtttgtcgcgtaggtttcggccgtttcgtcgatccgcagtttctcgaagacgttgctgaggtctcatcagttcgagagcaaggcaagtcatgcaatacgtttgatcatattgtacccaatttacaaatatcccgcatttctattaaatgttgcattcttttacaatgtaatgagggatgggtccttttactcagccatttattgtttaccatatgccattgataacctgggtatcaaaatgattagatgttggtttaggaaatgcttagccatgcttagttcaac

SEQ ID NO: 15937 - DNA, 735 bp, Oryza sativa
aaataaattggccgaagaaattatcttaattaacctagagctaattccttaattaataaatgcaattaataattggaattggcattgtgggatttttcttgggttccacatgtcacaatatattaacaggatttttagtggaattttcagagccttggaaataattttaaccaattaaaaatcaccaaagtgcaattttaatcccaggaaaatccttttcctcctttttcttttcttttccttcctttttctctagatgggccgtcggcccatctctctccccgcgctcggcgccctttcctggggccggcccgttccttctcccctccccgaagtcctccctccctccctctctccttcgggcgccgacaggtggggcccacctgtcggtcgtcttcctcctctagccggttggagccgagccccaaccgccggcgccccacctccccacgccgcccgccttctccgtccctctccgcgcccgcacctcgcgcccacgtcgccgctcttcccccccccacatctcccgcgcgcgcgcgcccgcaagtggtgggggatttgaatcccccactttctctctctcctccccacgtcgccggccaaatcggccacctccccggccacgtccgccccctcccgcacctatacatcgctctcccgagctccctctctcgtttcccccatttgccgtctcctcccgtgccccctaccgcgcccgcgccgtcacacccgagc

SEQ ID NO: 15938 - DNA, 1501 bp, Oryza sativa
agcggcaggaccagatctggctgggggagaggaagagacacgtgggagagaaagcgccgagcatgagaggtaagcgtgaaaaacacgtgatgattaagaaaattcagtttgggtttttttttccgatagaaattcagtttgggttaggatgcatacctaaaacgaaacaacttattaacgtatatctttaaaagtttaggaaaaataaggaaaaagatggaacagaggaggggagatgtgatgaacgaacgcagcttaattaacatctttagaatagacctatgttcctaatttgatcctatgggttgagagttgagacagaatggctcggcactcggaacatatctgcatatattgaccccagagatgtacgtattgatgattaatttggtcagcttttgtcgtgcatggacggaaagcaagcgatgatgagacgtgcatgcatggaacctcgatcaccaaattgggggtggtgtcgcctttggatacgtccgctcgatcaatccatcgatcgatatgatctgatcgacacgaacaacctacgattacgaggccagcccttccggacgattaactcgatcctgtgattggaacaaatagatgtacttttgatagcaaggaacctatatacagagtgcatgattaaagagaatagagtggatcgtcgaattcatggcttatcatggatgttgtcgaggtgctttattctagtacagctcctaccttttagccgttggcattcaccttttatcgattactggtgagaggaaaacaatgtcactgcgaactaaagaagtaatagtaatatggtgatggagttgtgggtgtatgactacacctatgaaggtgggcttttaatatgattttagtgagatcaatgatatatcgtgggatttcgtctttttaagtttgtgttggggagcgtatttgcacaagtcaaaatgtgatattgtgcatgtgcgactactgtgtgataagaaaatttaggaacaatctaagctacaccactgtagcacattcagttggctgccttgggctgtgaatcgaaccgactttccagaagcccagcaccatcgcatgtgtgaggtttgattttagcccatcaatcctcaggaaccgggcaacaatcctcatatgtctattttaccacactcaacctttactccggatcggattgcctctctcaaccacaataccggatataacgcctcctcaatctttgaaaccaaagcaaattatttcgttttcggagataaacgtggagttatatccagtattgcggttgaaggagacgatttaatcgggagcatagagttatcaagcaaaatagacttgttcttcattccaaagcctaatagcccatccaaggtgggcccaaatcaaaagcccatttgaagcaccggcagtgggcgggcctcccacactatcgctcccccatccaccacaacacggacacacggtcttccccaccggcgacgacgagaagcggcggcgcgtgcca

SEQ ID NO: 15939 - DNA, 1501 bp, Oryza sativa
gtacagtcgtgtccaccttttcccattaatgaagatcatgtgtggtggttcaagtagtattgtttttgcacgcacgtagttacacgtagcgattgtctgaccatgccgaatgtatggtaacattgtaacatgttcgttaattatcatattaaggcctggccttcattggttgactagccagcaataggaacaaatggatgtactaaagtgctataatgtaacgcagttgtactagtcctcaagcatacaactgcagatcaaggaaatgacaacactagtaattaactagcttaacactgacgtttcttttatttcttaaaacttgtgataagacatgaagagcatgaagtacttgatgtcaaactcaaatttattctctctatataattaattattaaactgccaaaatgtccaatcgagtagcaaccaattaggatttcatcgatctggagtatccagctgactgcacacgctgcgaaataaatatgcataagtctcatcttcttatgtttcttttttcataaaaaaaatgctacttctagttaagttctgattggcactcacgaccagctagctcaaactaaactaatgaagcttaatttgattgattaaacaaagatcgatcgaacattgcctccttccggagttgttaaaccgtcgcttcagttgagagtcccactttcagtctttcagagtgacggttgttgcatcttcacttcacatacattattccttcgcatgtccttttaatttctggtcctggagcatcgacgatgaatgtgacagaagaaaacagaatatatatcataagatactgtacttatatgtatagtactatactgcacacataaagaaactgagaagtgaaaaaatgcagtgtaatgggccaatgactgcgatatgatcgataatgacgccactaaagaataagatcgccgagaacatcatcgtgttgctgactgtacttgacatcaactcttgtccttctcggcgcctcggcggcgagtcaactgtccgacctggcgccgcctgtgaaatatctccgtcgtccaaccatcagtgacccggtcgtgaaagttttttgcaggcccactgcccaaccgaatcactatagagaaaagtgtgtagtactactaataattaccagttgttttatcaaaaaaaaaaaccagttgctggtatgtggaattttattagtacggcttaactagtgtaatagtcaccgtcaagattgtcaggttggcgtgcagccacacgcacatgcatcaattgtggcacgtgtgggttttacaggcaagcagtaaggtgaagaacgtggttggacatggaatgacttaatcatttttttaggagcgttttttctttaaaaaaaggttagagcatattaatattgtagctgttggataaggcatgtttggttgagtattatggatgtacagtcttttagagaaaaatgactgttttggtttgatgccaaaacttaccctaccaaataattggc

SEQ ID NO: 15940 - DNA, 1083 bp, Oryza sativa
cgagaacagtagtcgtccttaattaatttgtctgcagctgagctggttgaaatcgattgtctaaacaagataggataaacgactagttaacttctactagtagctactacttgtagtcttgtctgcattgtacgtgtttttagccaatcgatcacacatctagctagttagatagtcatgtacgttactgcttcaactgcttgtcatacaggagtattcatgaaattcatcagtgctgatgatcaatctgcagtgcattgttcagaatattggatttaggagaaaaaagacatactcctatatatgcatgcgtggttggaaattattaatagtggcgtcgaaatgaagggaacgaactagctagacaacctctacgacgactcatgatgacaacgtagatgtagtcatatctagatcatcattaatccatgcatggacattatttctctgaactaataaatcatgcatgattaagaagttaggatgaattaatccaggccggcaagaggctgcaggttggccgtgagttccctacttccctagcttagttccacatgtacctgaaagctttgcttctgcaggtaggcaagctatcagctgttgtgctttaagttgcctcacgaggaaaagcaagcctttttaggccaatataatttgctcatgcgcatttgctccgccaaccatactgttggtagcgagcaagaacaacatgcatgttcaattatatatattgatgttaaattgttcatcgatcgtttcatctctgtacgatccgtcggtgatcgacgcatggatggccgttgtgctttttgcagtttttgcatggtacttcactgctttgcatcacgcatggcatatgcatcacatcggcaactatctatagtacatatatattggacgatatatctcgtcaattaattattgctccctattccgtatttctagctataaatctgaacacatatttatatagattcatagctattaattattatattttgagacgaaggtaggactaatttgctggatcggtcgttaggcgttaggcctggcatacatgcatatacatcgatcattgatcaa

SEQ ID NO: 15941 - DNA, 1152 bp, Oryza sativa
gatccgattattcaactcaaacaaaaaaaaaagacaggaaaaaaaaagtgtgtgagagagagagaggagaagccaaaaatcctcacaccctcctcgactcgactagggcgcacgcaccacgctgctcgcttcccctccatctcttcccattccccccctatctcctcctccgccccggccaccgccgccgccgccgccgcgtgacgccgaggaggacgaggaggtgacgatctcccgcgcggtgaggtgggcgggcgagcgagagggaggaggtctctccccgattggaacgggcggaggggggttggcgaggtcagatccggacgacgcggggagaggaggtgccccggcggcgcgattcgtgggggggctcccggcgaggtgaggcattgcccgaccgtgaggtcccgatctgtctcctgcgccgcgtaatctatcattttctctctctctcggtgtggcgttcatttcccggggaggcgttggattggacgaggggcgatccttgcgtggcgggcgttgtttgattggatcgggatggttgctcgttgcttgcccgcgctgtaatttctattagttgttgcatatagggcctagggtgaaagaacagaacagaaatgggtaacttcgacgtagatgatttaatgctgcttaggttttactcttctcgcggccgaaagtagatcgttgggttggaattagaggtggttttatatgacagtagcggcgccctaatgactagggtgtttcggaattataatagtttctacatgatatcagaattataagttttatatggtatcagaattgtagttttttatatgatagcaccttaggacactatcgatctcatgtcagctctgttcctttgtgctccacaatgtcttacttcgggttccgtatacattagtcgcttgcagttgcttgatatgtgatgtattaggttttactggcaaactagtgaagcatagcacctgctcgctgttagctgttgtgttcccgagggttaggtttaggtctacctctgttgatttctcattttgtggtgtcagcgcacgttgaagctgaactttgatggcttttggttcactattatagaagcaaaaagggtgaggcggatagctgagctgcatttccctgaagattgattca

SEQ ID NO: 15942 - DNA, 1501 bp, Oryza sativa
tatcgtattaggttcttatattgactcttctctcaatattcattatttttaattctgaatttcagctatttttgaattgtatttctacttggactctcctttttttttctctgattaatgtgagaatttctagcccccacagcgaacgtggtgcctccttttaaagctattttaataatataatagatttcgcgagctaaacgggagccttagtgacttactcgacgagacaattgcgcccggaaatgctaatgggcgggtgatcgctcccccgcccgcccaacgatcacccgcccgccctctcccctgtactactccatacactcctcccctactacagtacaccacacaatttttttaaaaaaaacaaaaagttagaaaaaattatgtatagaaatactatatataaaaaatttgaattcaaattcaaatttgaatcggctatgtaaacttttggcttataaactttaggtctataaactttacgtgtataaactttagatatatagaaatactatatatagaaaatatttgaattcaaattcaaatttgaatcagatataatttaaattcaaatttgaatcgggtatgtaaacttttgccttataaactttaggtctaaaaactttaggtgcataaactttagatgcataaaaatactatatagagaaaatatttgaattcaaattcaaatttgaatcagatataattcaaattcaaattcaaatttaaaacgggtatgtaaacttttgacttataaactttgggtctataaattttaggtatataaactttagatgtatagaaatactatatataaaaaatatttgaattcaaattcaaatttgaatcggatatataaacttttgacttataaacttttcgtctctaaactttatatgtgtaaacttgaggtgtataaactttagatgcataaatttactaaaataggaaagtaatgtggtgacaaaaaagaaaatcaggtggagggagagaggggaggggatcgatcgctacccccatctcctggcgatcgatcgcccgttaggatcccccaattgcgcccccccagttgttgggaactggagacgagtcagatcatcgacccacacagcgtgatatggaaggcccacctcaaaaggtcgcgtcgcgtcccgccgagattctggaagcgaaaggctgagcgcaatcgcggggcgtccaagtggcccctgcaaaaaatcccccccgaaatcccaccacccccccgcggcgcggccgcatcaacccactggccctgcggcggccacccaacccaacccaacccaacccaagcctcacatctgatcacgacgcccacccccccacgcaagatcgccgcgcccgcgccacgtagccggccaaacgcagccacacagccccggccacgctcccgcctcccgcaccataggccgccccccgcgccctcgcagtctttaacgtcccagcctctcgtttgcctcgcactcctgccgcccatcac

SEQ ID NO: 15943 - DNA, 1501 bp, Oryza sativa
actggtctgattttttttctttgtggtcactgtttgcaaggtcttgaggtcgtggacaatagctacttcatcaccgaggacaacgtcggcatgctgaagctcgccaaggaggccaatagcatcttggttcgtcgatcagcgcattgactcatgttaccaattcgcctataaaaattgctaacatctaaccgtgacatcctgtgattaattggtacaagtagtttgactgccgtatcccacgccggagatggtgggttgcgcagtggtgcactcaaacggccacactgcggcggccatgtccacgggcgggctgatgaacaagatgaccgggcgcatcggcgactcgccgttgatcgggtcgggggaaggcaaggccatcatacgctccacgctggcgtgcgacgtcgccgccgtgatggagtacaggggcgccgggctgcaggaggccatcgactactgcgtcaaggaacggctggacgaagggttcatcgggctcatcgtggtgtccagcaccggcgaggtggcgcacgggttcaactacaccggcatgttcagcgggtgcggctgcaggagaaaagagagagaagggagagagaggggggaggaagaagggttggagagagaaaggatgacatgtgggtcccacagtatattttgtgtgtaaatgacagacgggtcccacaaaatatttttaattgtaatgccacataagtgccacgtgggatgaagatcgggtcaacaccgccacgtcagcaaaaccgctgagggagtcaaattgcactagtttgaatagtttagagagtcatcctatctggttttacgattgagggctacggattagattcgggtgactttttaagggagtcaaactctttcctttagccacgaccaccacggcccagtaaacccacgccgtacacagacaggtccagatcggaggatttccaggccgaaacgtacgagcccgccgctcgatcgcgcttacgtggtcgtctggtcgaggcggcgcgcaaagcgttccggtgatccggacttccggatgcgagcgcgtggggtgcaatgcaactatgcaagtgcatagtgtgcaaaacgtggccgtgcacaagtgtgtgtacttcttttgttagagacacaccagcgtgtacttggggagctagctagctgtggtccaaagtttggtttaacgtcctaatgcgctgttgttatggggcccatacaatatctgatatataatttgaagataagcatataaaatgtgaataaaaggaattaataaaattctgcgggaccagagagaaaaaagaaaaacgcaaagagagaagataaaattttgatagaaactggcaatcaaggaaaaaattatgaaaaactacacaaaagattgcagaatagcaaattaatgcttgacaacataaattctaataggaaaagggatcaaataatctgagggagtagttcctgcaaaatctgtacccgatatgtgtctcaacgtacacaacta

SEQ ID NO: 15944 - DNA, 1501 bp, Oryza sativa
ggaaaataagcaagaggttcaacctcttggaaactatcattttactttgtttgtttcctatggtgctatcaaagagaccctcttcatatttcctgtgtttttcattcctataggattagaaaaacataccactccaattcctatgttttttctattcctttgtttttcctatcctacgtttcaaagaggccctaaaagtgcatattgggactaaaatccattagtccctcttggaggtactaaagtggcagcctctctctagagtctttagtctctagatccaaataggaccataatcttgtggtgtgtgcgtgtattagtggaagacaaaaccctctcatagcttgcagtggtcttgaaatccatcctacaagagggccgcttatggttttctacaagcacaacgtcttttgggagtctagtagaacccaacagccacccttcccttttcttaggagcgatttcaaatttagttccccctagcattttttggttattttttctcttgtgtcctcaggcaatggccgtctggccggttgcgtcgtttagttaaactctgttttcttctaatatattgacgtgtaatttttttgttcgttcgcgaaaagagatgattgcatatttggttctttctttatagaaaagtagttgtgtacgttgagacacatatcgggtacagattttgcaggaactactccctcagattatttgatcccttttcctattagaatttatgttgtcaagcattaatttgctattctgcaatcttttgtgtagtttttcataattttttccttgattgccagtttctatcaaaattttatcttctctctttgcgtttttcttttttctctctggtcccgcagaattttattaattccttttattcacattttatatgcttatcttcaaattatatatcagatattgtatgggccccataacaacagcgcattaggacgttaaaccaaactttggaccacagctagctagctccccaagtacacgctggtgtgtctctaacaaaagaagtacacacacttgtgcacggccacgttttgcacactatgcacttgcatagttgcattgcaccccacgcgctcgcatccggaagtccggatcaccggaacgctttgcgcgccgcctcgaccagacgaccacgtaagcgcgatcgagcggcgggctcgtacgtttcggcctggaaatcctccgatctggacctgtctgtgtacggcgtgggtttactgggccgtggtggtcgtggctaaaggaaagagtttgactcccttaaaaagtcacccgaatctaatccgtagccctcaatcgtaaaaccagataggatgactctctaaactattcaaactagtgcaatttgactccctcagcggttttgctgacgtggcggtgttgacccgatcttcatcccacgtggcacttatgtggcattacaattaaaaatattttgtgggacccgtctgtcatttacacacaaaatatactg

SEQ ID NO: 15945 - DNA, 1501 bp, Oryza sativa
gccaacggcggcagcggcggcagcacctctactggcagcaccacctctacttgcttcctcaccctgactagtttcttcgtcttatgcatctgtggggatggatccgccgccatgagagaagaacgcggagacgtataaccaaattgtttaccaacgagtagaggaaggtctacatataagcgagcagtcccgtatacatccatccttttttttcagttgagatacgggtttataactaatcagctgcaacggaatcgatccggaggctccgagattcgcgcggatctccgcatgcgtggcgtggatcgatcgattgatccagaggtcaagggactgtggggatgtacggaatactgaaccctcgatatcgacgccgacgcggtcgtcgcatgaacagtaccgttgtggaccggcttagagagcagatacaatagcaggctataaactagctataaatatatttttaaagagataaaaaaaagaaaagcagcgggctacatgcagcactgtatgacaggtgagaccatgtattaattgtacagtaagcgactattatatgaattggctattacattagatatagatgatttggaactagtagtggactatactattaaacttgctctgaacagcatcatcaaaacgtctcagagcaggtacaatagtagtctataagccagctatatataaacatattttaaagagataaaggaagagagagaaaagcaacgggctacagatctatagtcagctgcagcacggactccaagacgtgatgtgtgtatgacaggtgggaccaggtatgatagtatagtaagtaactattattatatgaattggctataaatgatttggagctagtagtgggctatactattaaacttgctctgtctaaaacagagggagtagtaatagggaaagtcatttcatccctcgaggggatatatcctcgtttcgtgcatgccacctaaatagtcatcaaaaatataaaaaaattggcaacatagattaatatgaaatatatcactccacaaacatgcaagtttaaattcaacttctacaaattgtaacaaaaataacaaatatagttgtgaatgtgcaataactatttttactttaatttgttatttttgttgcaacttgtagaagttgaatttggacttacatatttgtagagtgatatatttcatattaatctatgttgtcaattgttttcaaatttttttataactatttagatgacatgcaaacaacggagggatgttccctcgagggatgaaaatccacattcgtagtgtcgatgtttgatatcgcgactatggtatctggatggtatggggatcgttggtaccatggtatatgcgagattgaggcaaaagagatggagacagggatttttatacatgttcgggccccttatcttacatgtaatagccctacatcctgttggccgaagccggtcgttactcttattcaccataatcacaccaatacaatattt

SEQ ID NO: 15946 - DNA, 1501 bp, Oryza sativa
gtgtctctggtagattcagatcaaatcagggagtttcgtgcattttgtccaagaagaacagagtcggctgtgtcgatgcatgctttgaactgttggatcgcttgcatgaagtgaatattttgccccaaaattgtttgttgtgtctgcttggctttcatgcagttagtcttcttgttaaatgtttgctctatctctagctgtctactcgttggcatctggttcgatggtgggattccaatccaggagattcggttgcagatatgcaacatttctcagtggtcagtgctcgatcgatcggggaatgcgtttcctgctcgtgagtttgcattgggtgcaagtttggtgttgcttgcttggattgtggttcggattgaattgagaatgggaaaaaaacatcgttgcgattttatctgaatgctgctttcgtttcaaagatgaatggactgatcggttcgaactgatccatgcatgtgcctgaattttcttctgcatctgaagcgtttcgtttcagatatgcatatggaatccctagtatgttctgtgttgcattcttctgcatctgaagcattttgtttcagaaatgaatttcaccatttggattgatcccctagtatgcatgttctgcgttgcatctgaagcatttggttcagaatggtttcagatatgcatttgggttgatcccccctatgttctgtgtttccggatccgaagcatttttcgtttcagtgatgcatgtacagatctagcagtatgttcttggtcgtttggttaattggcatggacgcatggtaggattccagtccaagagatttggttgcaggttttgcaacattttagtgctcgatgttttcctgttcatgaatttgtatcgggtgcaaatgtgaaagtttggggttgcaatttgcttggattctggtgtgatttgaatagagaagggaaaacattagtgcaaatttatttgaatgccgcattcgttgcaacttttcctagtatactgcctttggttgattaattgcccaactccctgtatgtgcctgaattcttctgcattcgaagcatttcgtttcagagatgtatgtcccaacatgttctgagttgtttggttaaattaaacccaattccctgcatgtgttctgctcatgctttcttccggattactcagatggtatcctgctttgttgtttgatttacaaaatttcttctgaactcttctgtttctgtagatgttctgaattcttctgtgctgattcaaatgagttagcaactagccaatacttggctcctgttgctttgagaaattatgactgttgattcacctgttgctttcttctgttttgtgtttctgttccctgttaattgctgcacaatcgttaaccggtttgaattggcactaattctgaatttggggacaggggatcacacggctacacaatcgcaaatctatttgaattggcactgtttctgacattggggacagcgtattgcacacttttagtcgaca

SEQ ID NO: 15947 - DNA, 1501 bp, Oryza sativa
ctaatcaactaaaaagtgccctcctgtattgccatgcaccagtttattgcacacttcacttatttatcagcaggtaaactaccaacctatcacttctctttgctagacatatttttttttgccaggctttgctagacatactttggttagtcttgaatttatttatcggtgcatattcccttttggctttttaataggcttgaagaggaccacttaattttgatgcttatgaatggatgaatcataatgttagagtacatattctgcaactctacactaccataattttgtataattgtccattccactaaaatctcatgctagatatatgcacacttacacatgcagaaatagctttatgctgcgcaaagtatgccaggcaagagatcggattttttacaggcttacaaccaaaacttggcaagatagcaataaacaggaacagaagattgcttgataggaaaagtagaaataactgtaaagagcataccatcagggtgatagaacttggccaatcgcctgtatgccgtctttattgtctcctcatctgcatccctgtccagctcttcgaaccatacaccgcaccaaaaagacgcacccataagtttcacggctaattccatgtccacactacacagtacatatcaaactaaaataaactagggcacactgaaacgataagaaactagcaaccaatccacaattttggcatcaaacagctagatcaaacgatcagattctggcaaccaatccccaatactgatcaccattgaagctccatcgtatcgaaggcagtgataacaaaatcgataatgttccacacttccacacaacaaaatccccaggtaccaatcctgattccaactgcatatccactagctctcaccagcaggggggggcaatagtgtcatcataccgagcgtctcgtacggtgatttctccgaatcccagctcgctgcgcgcgtagacaccctcctccgctcgccccccgcggccctcgcgacctcgtcgaagacgaacgcggagggcgccctccacgggacgcggaagctccgaccgagcggcggcgcgagagcgacccgccgactggagcctcccgcggcggcggcggcgcaggtgtggagtagggtggagatggctcggaggccgctcatcgccggcgacgcggagggcctagggttagggcgcggaggaggggagagaggtcggagcttggaggcgcagtttttccgtcttttttttttcctttttgtggtgaaatggagggaacgcctcgcgatggtgacacgtggatcacttctcttctctaaaattcaaattaaaaaaaatgtaggtgcgatttataccatttcctttctgattacagcgtgtatttcactcttgctgcaaaagaacacacatacagcaaatttttcaagccaagtacaagtatgatgttcttcattttgctcattttgtagttgcaggtgtggagaatgagcatatgaatgagcaggcacat

SEQ ID NO: 15948 - DNA, 1501 bp, Oryza sativa
ctccatcatcctctatagccaaagtaaggaactccttattatgtgtggcttgaacttcctatgcttacattgatataaggattgatgtatgctaattatcggtattttgctttggtttttggttggctatatgatatgattgtattttatttccaaatatagtcatatgaatgtattttttttttcaaatgatgtggtcttcatgttcaatattttgtgttgtgtatgacctcaccaactaatgtgaagaggtaactatatctaagcaatccatctacatccctccaaccaacacaagagataggatcattccaactcatcatatccctcaaaccaaacagaaaactaggtccgttctattcctagaaccaaatagaaactaggtccatcatatccccaaaatacaaataaacctaacccatctcatctcatctccaaaccaaacacaaacctaaagtataagaaatgctacaaatgaccaaaatgattttcttacgtgaatgatgatgtggcaaaagtattgcttacgtggcaaatggtattgatcacgtggaacaaccaagtttacaaaaatctattgtttttaacaaattttgtctgagattcacaagtttaatttcggtaccactggaaccaacctaaacaaactgtgagcctaagatagccagtttaggttacctgcagtagaatctacccacctagatataagtcaacaacagatgtttatattcatagctaatcatgattttagtggaaggcgacacttattaacatctacccacctagatatcagtcgacaacagatgtttatatccatagctaatcatgattttagtggtaggcgacacttattagcgacgcgacatttagggatttggggtaatttcatcaatcttaaattttggctagctacatgtgtacatgcgcccatacaaatgtgcgtgggtacgtaattgtctatatactatgtgttcggatgagaaaaactagccttaccctgtttatcttcttcttcttttttttaataatcaccggagaggatatgttccccacttgaatcttccattgcatttaagagaaagatcttggggttacagggagcgggcattgccggaggcaaaccattacaaatgttgaggtaaaagagggttcgagaaaatagcattccaggattgaaccattattctatcagagcgttcctcttctgttcttcatctcataaatcagagttcagagagagaggataacgctttgctccatgacgaatcttccctgaacccagtctacggacgtccacacagaacacctacacccaaccccaccacgcagtctcgtcaacccatagctccccatccaaacgccgggtccatgcaccgaaaccaccatatccacagccggtccatggacaaatcaggaacaccacccaaaccccaaactcgtcttctccctccctcgcgcgcgcgcgcttcccgccactcgctgtcgcccgccgcgacgccca

SEQ ID NO: 15949 - DNA, 1501 bp, Oryza sativa
ctaaacggcttgtgtaggtgttgcccggtgacctctccgaggagattgtggaggaggttaagcgtgcttggccgaactccagggttaagcgcgcttggcctggagcaatttgggatgggtgaccctgatgtccaaagaactccagggttaagcgtgctttatccgtggccaagagggggacctgatgtccaaagaaactccagggttaagcgtgcttggcctagagcaatttgggatgggtgaccgaccggaaaattcgtcccgggtgcacacgagtgaggacaaagtgtgcactagagcaatttgggatgggtgaccgaccgaactccagggttaagcgtgcttggcctggagcaatttgggatgggtgaccctgatgtccaaagaactccagggttaagaactccagggttaagcgtattttgtctgtggccaagagggggacctaatgtccaaagaactctagggttaagtgtgcttggcctggagcaatttgggatggtgaccgaccggaaaattcttcccgggtgcacacgagtgaggacaaagtgtgcactagagcaatttgggatgggtgaccgaccgggaagattcccgggtgcacacgagtgaggacaaagtgtgcactggagcaatttgggatgggtgaccgaccaggaaattcttcccgggtgcacacgagtgaggacaaagtgtgcactggagcaatttgggatgggtgaccgaccgggaaattcttcccgggtgcacatgaggacaaagtgtgcactggagcaatttgggatgggtgaccgaccgggaaattcttcccgggtgcacatgtgcagaaaagacttgtgttaccctgtgagggcagtttatgacatatgaaagctgtcatatgtaagcggacccgccctgggagaggcgggacgttattatcatgttttttaaactactaattcctctatttcagattataagtacactagtattttcatttacacttcaaatcatcagattaaaaaaaataaaaactactagttggctcgtattgttcaagtgtaagatgtggccaagattcctggtcgaatgctttcttaacgaagaccgccatccttattcttgtttgatgggggtttatccccgagagggagagtgagggtttattcccgacagggagagtgaccactacgtaggtttttattcatcaagaattggaatccctcccttcttgtctacttcctctattttataatgtaagtctttctaacattgcatatatttatataaatgttaatgaatctaaacacatgaaacaaaacagagggagtatgttatttcaccgtctttaccgaccaccaataagacctttattttatataaaaaagttcattattcaaaattaattactttggagggatccaaagtacaatattttaaacgaaaagactaggaattttttttcacctagtacccctgtttaatttagatttatgttaaacccggcacggtcctatcc

SEQ ID NO: 15950 - DNA, 998 bp, Oryza sativa
gtccatgcacatttcagctcgatctacacaaaagttcaaattgaaccaacaaaagtaaaaaactaaaaaagataccgaagcaaaatttcagtaacaacagattattttttttagggtttgttggaaccatgccaccctaattttacaaaatttgagatatgtcacccgtatctcagtgacatgtaggacccacatgagtcaatgacatgtcggtcagggtggcatatcacaaatttgaaatttgtgtggtatggttcaaattttcccttttttttagagtaaaatgcatggagggtcattaaacttgtttaagtgtgtcatataggtcactctacttttaaaatgcacatttgggtcactaatgtgagataagtgagtcacttacccatctaactattcacgcgagcatactttgtacacatggcatgccatgtaggattgaaaaaattgcatttgaaaatatgcaggaaaccccctatgcattgtgattaaatcgtctcgtatcaattccctaaataaattgactagtaaacagatcctgaaatcagtgcatgacacgttcgtaggaggctgccaatattcttattcccgctgaatgcatatgtgatatcaattttttaatggatgtgttagaccattggaaattaacagatactagaccattgtatggcataagaattcaccaatttgttggcatgcatgttttgccatagtggcttctacttttacttttaatttcagagacactacaggctttcataaatcaacatttcttaatgatgttccacatctcaaaatcacatagaaaacgatcttacattaactgataacatccatgagcagtcaacactaagttccactaaccaaaagccataaatttcaaaaggggaataaatccaattgttgaattgtgcaccttttattttgcattttgcaacattgaaaaaacaagatagaaagcacccatataacttctatttttttttcttctggctagg

SEQ ID NO: 15951 - DNA, 1501 bp, Oryza sativa
tggcttcccctgagcttaaagaatttgagcttttggttctagaatctgggtaaaattgttgtaatggggaagactgtatgactgtatttgtagtgcatgtcttaacttgtcggatagtgtaatccgataattattatgcggttagctggttacctctcatgattactgtgctcatgtgctgtgcaatttatgttctttgttttggatgtacaatgctgtaaccagaatttggttgtgtaaggaaactattaaaggttgtgcgagggcagtgtggctatcgctgcattttagcttacaagtccctcgtatgcagtaaggtttatgtgttcaaagccaaatgcggaagcttttcgtcaatgaagttgacacacttaacttaagtgccttataggtttttgctattattgatgtggttgacatacttggttgatttggtttgtcattgacaatttagctcttgtgtttggtttcaaggaaggttcttttttttgtcaaaacatgaagaaacaaaatatcaaatattgcctctccaatcttatacaccctccacccacaaatataaagaatctaggttgtttagaagagtttaatgttcaggtgaaattactttgatgcccctgggtgtttacttgattgggaaagatcattcctagtgatgcaactactagtaagtaataaatccaaaatcccttatattcgtggataaattttgaatcccaaaatcccttatatttgtggacggagtgagtatatagttactaaacaatagttccgcatttctaatttttcacctatggttgtatgggtttgcagaattatgcagttttctttttgctattgtttcgtagggcataaagaaggtaattaattcggttcttatttatttcctttacgcttctgtattttcagtcctcagtgtgtagagtttaaagtagtgatgtcatgtgtaagtatggattttcttttaccactgaatccctcatgcgaacttggatatgtggtccttttctgcacagttagtttatcaacacttcttggttatgtaatttgcagctactcatgtggaacaaccagcactacaaacatgcatttgcagtacacatcattcatcttaaactgctttacctattgggtttgctgataattatggctttaaagttagcaatgcccatttcatactgtaacggttatttgcttctgaaatcatattgaaatgtggcatgttatgcttcagaacatcattgttacgttccaatttgttcatgtgactttcatcctgttctatgtggatcatctacccaggcaggagcattccatgatactgcttgcatttgatatttggaaaagcttttgcttttagcatttgttttcctctctttggaatagcttcctctgacccagtatctgtatattattggactgcagtttataccttgtttcttctgattttattggctgagactatgctcttcctggaatgaaatgacaagtagttattacc

SEQ ID NO: 15952 - DNA, 1501 bp, Oryza sativa
gagctctccttttcttctcccttttcttttcctctttctccttttttttctttctcctctcttggtaggcatggtcctccttttatatctcaaggggataccacatacaccatttctacctatccttcttttgggtggggacccattctactttgaccaaaacatggctcatgccttcgcctcacaccgggataaccctgtccttccttcatttatgggcggagatttgcaatggctgctgtccgaatgaccctccgatgggatgggtcataccaacctccagatgacggaggcaggtgcaacgtgggagcacggttgtttgctgatgacgtgaccggcgtcagaccagtcacaaaccggtcattcttgtctaccacgcgtcagtttagcatgccacgcgttagcccttcttcataaaatgacttgcttggaatggttgcgatgaagcctggtatgaatctagccgggaccgacgtgctaactccaggagttcccacgccagctccgtctagggacgagtgcctagaggctctcatcattccgacgggacggggcgaggcgtgcgacaggccgcctgttgccacctaacccgcgatctgaccggtctgtgaccggtcacatgccgcgactggtcacaaaccggataagcatgcgctgcgccgcattgaatgcggcgtgacgcgctcgtctaacccgctataaatgtggttaggtgagggccgctatgctcacctaacccacacacgtggcgccaacaccacagggggttggggcgccccagccctcggggccgaaacgggagcggcccgacccctcggggagacagagggaggggtggccatgtcaccgtcgggcccgaccccctcggggggtcgggccacgtgagtgatcgcggctacccaagcctctagtcacgatacccccggccccatgtcaccgacagtagccccggcgtcacgccagggcgaccgcccccctcgagggaggcgatcgggcgagatgccactccttaggccccgtgacaggtggggccggtccccacaggcgggcagaaacccaacggtcgcaaatcgcgcgcatcggcaagggagaaaccgatcgacaataatgagcggcctcttcaagaccgctacattacttgagtagcgcgcgaatcgggacgaaccggttcgtttcgcctagtgtgtgatgatggtgcatcgtcagcgagcgtagttaacgcgcgcacgatatgtcccatcttgactgccacggccgcacatccgcctcgtgcgccgcaaacgggcgaacgggattagtggaggagtgggcgcgagaaacgagggggcgagatagtgggagcgggaagcgaggagccgggcatagcgttggcaagggtataaagacgccgaggaagagatttgtttccttcctctcgccactcttccccttgccttcgccacttgtgctctgacactccgtttcctgcgccctaccttgccatactcactcgctctcaagc

SEQ ID NO: 15953 - DNA, 1501 bp, Oryza sativa
cgaggtgcagctcggagccatgcctgaggtcgcacatctcggcggtcatgtcgtcggcgagctgcctgccgccgtagatcagcgtctgctgcggcggcgggatcccctccgccgcctccacctgctccttgatcctcgccaccgtctccgtcgcctcgatgctcacctccacctccttccccgtcagcgtcttcaccttcaccgttatcatgctcatggcgtcttcgtcttcgtctacctctcgatagctcgagtagatatgaacttataggtggatgagcttgcgtgaccgtaattaaatacttcattcgtttcatattataaatcatttgatattttttagtcaaaatttgttaagtttataaaaacatttagcaacatctaaaatatctaaaatatcaaattagttccattaattctaacaatatatattttgataatatgtttgttttgtgttgaaaatactactatatttttcttcataaatttgattaaacttaaaaaaattaactaaaaaagtcaaacaacttataatacttcctttatcttataatataaagcgtggtcaaagttggtacggtctcgaaaactaatatttagcttataatttctcgtatactatatggtttgtagcaacaaaattataaccataagaaagtaaatttaaatctcaatctaatgatataatatttaacaaataaaattcattacatatcatactaagaattggttaaatattttaaaggtttaatcttaaaatacgtgcgcatattatattatgagatggagggagtatgaaagtatgaaacagaacggatagagtaaattcatacataaactcaactatacaagcgtaaaataataaaagagtaaagtccatcaccggtccctaaacttgtaccgctgtgtcatcccggtccctaaactcgcaaatcgactgttcaggtcctcaaacttgttcgactgtgtcatcccggtccctaaacttgcagaacactcatttagatcctccaacttgttcagttgtgtcatcccggtccctaaacttggatttgaatatcatctgggtcaaataggacggtctaaagactttatatttaaaaataattcaaaacttttttcatgtgaactttaatgaagacaaactttatattaaaattgtagctctcgacgcgacctaaaactttgtagatgaaaagtttttgaattaaaactgtttagggtcccaaaatattggtgcatgtttatagattttgaaattttaattttaaaattacattttgggacaaaaaaatgacttaaaataaaaaaaattcaactacgtcgccagccgaattcacacacggtcaagccaatccttcgctagtaagtattcaaacgtggcctcccgccactcaaattcatcttggccgccctctcacagcctctgctgccccagccatatccaaagatcgagctcatccatggcgatgacggtgtccgagctcatccgctcctccta

SEQ ID NO: 15954 - DNA, 1501 bp, Oryza sativa
ttcgtcaccgagtacgagaaaaaggcatgatacaaagaatgtgcaaagatttggttagactgtgctagagttgtggcaggaggggtaggataacaaatgaagtacttctattatggttagatacgatagatgccaccgatgtcgtgaaaaggatgggttgcctaatagggtggtgttgagggggaaatatagggagagaataataggggttagtgaagaggggatgcaaggtgaagtatgtcttatccaatatggctaatgccgtctcaaaactaagtgttgtacattacattaaatttgatgattagaacccccacacatatctaatggcttttcatcccgacacatacctaatattttaaatttatcaataaatgcacttaatgcattttgtcttaccatcttaggttgctaattgtgtggctatcactttcataccatgtcaatctagctaatagctacctataatgctagataattccatttttacacaagtcatattgggtgataataattggtgttccatatatgtctttttagatactagtatgttcttatcgatgtcttgtctgtacgttggatctgaatcatgtgtttagtaagacattataagcgataatataaggtagttatataattgctcagtatagaatactcaactagggtgtgtttagtttacatcaaaattagaagtttggttgaaattggaacgatgtgacagaaaagttggaagtttgtgtatataggaaagttttgatgtgatggaaaagttgaaagtttgaagaaatattttggaactaaacacggcgtaaagcattggctacacggctatacctacatctgaattgatccattcttgtgctttattttagtactacttgactcatctgttgctttgaatgtgaagaatgaagagtgacccttgacacgttcaagtcaacaagggctagaaattgaacggatgaaccgtctgccacgcaaaagcatttcactcaactaatatgcgcgtagctctagattatgtgctgcacgcggatgtgtactttgccttgtaattatgggtgttgcatggctatgttgcaaaaaccagcaggtatcaaattaaatacaatttacacatggcagaggtagtatgcagaaatttgtagaagtcggagcaagttttgtaaaggggtagtttccacatccaattttatatccatgtaagataagatgtgatatatgcaatatatgcaatataagatgtgatatatgcaatatatcacatctacattatctttagcatactatccccaataattttattttatttgtttgtccaatctcctctttcttttatcttcttttttgaaatttgtgtgaaggttgtctcttacatgaggtagtggcggagccagaatatgcttagagtaggactaaattagtattatctacataaatttgtgtcagggttacggataaggtatatcctctacccttggatatacgtcgtatactgata

SEQ ID NO: 15955 - DNA, 1501 bp, Oryza sativa
cgccgacgaggcgtgcacggaggatgaaccgaggaagagaaaagggggagcaagatgactcggcctaacatgtggggcccacgtgggtctcatgctgactcagcctctacgtaggataaaaccggggtcaaaaccatcaaaggacatatattatgaccggttttgattagttaagggacgtcggatatctgattttgtggttgggggacgtttgtaacttgatgacaagttgagggactttcggtgtactttttcttttttttcctctggggacctattcgggataaatgggctcttataggccgaataacacaacgtaccatgtgatgagatgactcgaaacacttccgcattgattatgccttcctctgtaggcctgtcagtcgtttttttaagaataaaaagtccactttgacaccctcatatattggtatgtatgtctaatatgattcgattttgctaaacatctgtcgagtgatttcttctctgatatttgattttttttggcggtaggatcgtgcgtcaagattagtggaggaatcagcgcgaatgacgtttcttgcttttttttttcttgctcttgcttttcctgcttccttatcgctctctctccctttcttttccaaataaaaattgatttctttaactgttgaaaaattaagacatttttaactaaaataaaatataaaattaaagccttatataactaaaattatatttgtaaattcaattgatatgacatgtaagtgcactgtaattttgataaaaatgttgtgtaagtaaatatgtattagttattttatttaaaatataaaattacagtcatatataaccaaaattacatttgtaaatttagttgatatgacatgtaagtgcactgtaattttgataaaaatattatgtaagtaaatatgtatttgttattttttttatagtccattcgatgcaagggtaaaaaaaatctgggtgatttttttttgttagaaatcacctaacaaaatggataggcagtttcaatatgatttgtatctctcaactgcaatatccgaatattttgatcctttaactatgaaaaccggtgtaatttgactcactaaattgttttgaaggtgattttctctagggcccacatattagtgtttcctcctctctaagctttgcaccagcccggggcaacaccgtcgagcttgagctgcttcccaggatggcggccaccttctccggcgaagaggtagcttaagctcacccgcttgtctgcgggaaggaagacaatggcggtggcgaccaacgtgtcctgtcaagctcacccgctcatccctaatccggcaagctccctctcccatgcagcttgtgctcagggaggcaagatgcattccatctcttgttgcgacggatgtgatttctctcccctctctcgtaccatcctatcaccgggcgggaaagtagtcgtggcagtggttctaccagaggctatggggaaggggagcgtgaccaggaagca

SEQ ID NO: 15956 - DNA, 1501 bp, Oryza sativa
ctgcatgggagagggagcttgccggattagggatgagcgggtgagcttgacaggacacgttggtcgccaccgccattgtcttccttcccgcagacaagcgggtgagcttaagctacctcttcgccggagaaggtggccgccatcctgggaagcagctcaagctcgacggtgttgccccgggctggtgcaaagcttagagaggaggaaacactaatatgtgggccctagagaaaatcaccttcaaaacaatttagtgagtcaaattacaccggttttcatagttaaaggatcaaaatattcggatattgcagttgagagatacaaatcatattgaaactgcctatccattttgttaggtgatttctaacaaaaaaaaatcacccagattttttttacccttgcatcgaatggactataaaaaaaataacaaatacatatttacttacataatatttttatcaaaattacagtgcacttacatgtcatatcaactaaatttacaaatgtaattttggttatatatgactgtaattttatattttaaataaaataactaatacatatttacttacacaacatttttatcaaaattacagtgcacttacatgtcatatcaattgaatttacaaatataattttagttatataaggctttaattttatattttattttagttaaaaatgtcttaatttttcaacagttaaagaaatcaatttttatttggaaaagaaagggagagagagcgataaggaagcaggaaaagcaagagcaagaaaaaaaaaagcaagaaacgtcattcgcgctgattcctccactaatcttgacgcacgatcctaccgccaaaaaaaatcaaatatcagagaagaaatcactcgacagatgtttagcaaaatcgaatcatattagacatacataccaatatatgagggtgtcaaagtggactttttattcttaaaaaaacgactgacaggcctacagaggaaggcataatcaatgcggaagtgtttcgagtcatctcatcacatggtacgttgtgttattcggcctataagagcccatttatcccgaataggtccccagaggaaaaaaaagaaaaagtacaccgaaagtccctcaacttgtcatcaagttacaaacgtcccccaaccacaaaatcagatatccgacgtcccttaactaatcaaaaccggtcataatatatgtcctttgatggttttgaccccggttttatcctacgtagaggctgagtcagcatgagacccacgtgggccccacatgttaggccgagtcatcttgctcccccttttctcttcctcggttcatcctccgtgcacgcctcgtcggcgatgctggcatcgaacacctcgatcatccactcctcctgcaccacggtgcgcacccactgcggcatatcgacgtcgtcgatccttggcaccacgttcgtcggcggcttccccgtgagaatctatgacgagccggcgccaacgccatcgccgtaga

SEQ ID NO: 15957 - DNA, 1501 bp, Oryza sativa
gcgctgactcatctacctcgtccatgactatggccggcgttggccttgagctcccctcctcagcaacgagcccggtgacggtgcagtgtggaagcaggggcgacgattttcttggctccctccttccctccccgttgacggtctccctccctagtcgtcgagacaagccgagctttctttcctccctctctcctttccctagcgacgagtgtgggctgccttaacgatgctgccaattttttatgaataacatgtgtcttagtttggtcacgcgttcttagtttggtcacagaaaatattgacgtggctgagaatctcctacttataagcttgagtaaggatgggaatggttagggtcgatccatttatgcactaaacctatccgtaaatttgtcataacggatttgtagggtcgctccaaaaatataaatggatcaaacggatcaatttgtcctaacggatttgtagggttgctccaaaaatataaatggatcaaacggatcaaaccattagaacctaaggttcaaggggttcgatctaaaatgacttcacatgtataaatgtttcaaaaatttgtacaaagttgcttcgctatataataattcattcctacaaaattcaactaaatttaacaagtttttaaagtgtgaacgcaagtttaaaaattttggatccgagttttacatgtaactagaatttttgggtcttagcaacacattatgggccccacatgtatgaagggctcaaaatttacacaaagttgcttctctgtgcaataaattattccaccaaaattcaactgaattcgacaagtttttatagtgtgaacgcgagtttaaaaattttgggtccgagttttacacatataactagaatttttgggtcctagtaatgcatcgtgggccccacttgtataaagggctcaaaatttatacaaagttgcttctctgtacaataaattatcccaccaaaattcaactgaattcgataagtttttatagtgtgaacgcgagtttaaaaattttgggtccgagttttacccatatgtaataagagtaaccgatccatttggatatctatgtataacctattgatataatagactcatggtggatcaaccctattaaaccatggataaacgaactcacttaaaacggtttaggttcaatccatatcctaaccattcccatcctgaccgcttgaggctgaatggcacataaacgtaccgtgaaagttcttagctgaggagagaagcgaataggccggcgatgggcgtggacgcatggtgcacgagcaacgaccggacgagtgaatgcagctgaggcgggaggaggcggtgtgggggagggaggcgcacagcaatgcgcgcgcacgaggcgcctgtgaccgtgcggctgtggtggtggtggtggtacctgtacgtggtggtggggtggtgcggtggcccgtgggccgcctcgccagctgcggccggccgcgcgcgtcacgcaccgcacggctc

SEQ ID NO: 15958 - DNA, 1501 bp, Oryza sativa
aaaatcctataaattctataaaaaaaaaagcagaacatatatcccttgattttcacttaaattggtgggtccaatattatacaccgttagataaaattgatcttaaaacaaactaaataccatgggtcccacctatcctcctcccgcgcattggcaggtggagtatatacgtacgtacatggtacgtacgttcctcccccacttttttttattttttcttctttcttcttcttttttccatttatatatataatggatatatttttaaataattataattttacaaataaagaatctaccatcatataacttaaaccggtttactttgtactattattttcaaataatgcactattttaaaataaattttacacaattatatcgtgtacctatcaaataaataatatctatattaactaatttatacgtgcacttaagtgcacttaaactgatggccccattatataaatcatcggatctactttttattacattgatatattattctcaagtaatgcactgtttcaaaataaggtgcacaccatgtgtacccattaaaacatcaatttaaaatatatattaactaatttacacttacactagaactggtggacatattattataatcatcggatctattgtttgcttataaataaagcgtctgaaattctctttttgcccgctgcacaatacacgtctgcacctttgcctttcacacttgtgacaaagcgtagtatctgagacatctaaggtgatcgcaaccgatgtagcgctaccgctttgccacatatcaaatcatatatggagatgattaattttgttaataacatgaaaagaaaattaaaggtgtgatgcagcgagagaataattaagtaccatgggttatgtttttctcaatactaattagctctatttaagttgaaaccaagaattgattacataataattgtaatgtatttgtgttatgtcgtatttggattttgtactatttattcgtacaggtgaaaggaatcattatgttataaatgtgagagtaatattgacgaatatccatagaactcttactacgacaagggtgataaatagagttttaaggccctctctttttttttccccgattccatattttggatttttgtttgcacgctttctaagtttctaaatgttgtcttctttaaacaacattctaactttttagaagtcaattcattcgtttataccctcaaatagctatcacataaattatataattcatcaatttcatctatcctaaaccttactatatatttttttcatgcaagtcatggtgattagtaaattggtgaacaacggatcatcgaagtcgtaagatgaatatgtaagagttactctgaacaattgtaaataggtatcaaaattaattgctattaattagacataatggcttgctagccacaaaattaatttctctctacatgtatagaaacatggacgaaactggaacaaatactaccatatgtcc

SEQ ID NO: 15959 - DNA, 1501 bp, Oryza sativa
taattttaaaaataaaccttttcaaagcttatttccaagatatgaatcttttgtataccacacgaagaatctcttatgtacactttttcatagcctcaaaaatcgattgggtgactatttcataagttgacacatgtgcattttgttatacctcgtagaccaaatattgaaattttgatcattcaattagtaaatattttttttctgtagatggaaagcatttgcaaagtaacaaacttgtgtatgcaccttaaacaatgataaattcaaaaggaaaatatttgaggagagaaatttggaagagaaaaaaataaggaaaaagaaaagaaaagagatgggattggaaggaggagacgatcaggattattgggagaaaaacaaaacaaaaaaaggagaggaaaaaaagacgtcgataggaggagcgtgcaagatggggaagcggaatggtgtgggccggttgggttgggctgggagggagaggggttgggctaggataggggtgtataatagttattctagacacacgttgaattggatttggacgatatataaccaactcaaacacggacgacgtaccaaaattccagcagaaacatctttaattttttataataggagatatatataaagtatggtgaacatatctcagagggtggagcaacaaccaaagagtcgtcacactagccgttcatgttcttttcagcgagacagtaatgtatgtgctgctagtaagtcagtctctttcaagtcgactactccttctagagatggatctaaacttgctactagttcggtgaataaatccacatctaaagttgaatctaccgttgcatctggttcaaaatcatgaagtgtacagtgttatacttgtagggagaagaggacattacatgagagattgccctaatcagaaaaatgtattgataactagagagggctatatttctgagagttcatcagaaaaattcagaaggtgtacatcttgatcatactctagctgcatgctattgagattttgatgttttatcaatggatgatggtgctaaacagaataatggtttatctatgcttccatgcgtagtacagcaagatagctctaatattgatgaaaaggggcagtgctgtaatattttttaattagagtgcaaaattcaggggaaggtatgcaaattaataattgtggtggcactttcactaatgctatccgtttagatttggtgcatatttatctttgtctatgagaaggcttcctatgccgtgttatattcaattaatgggtgaatcgagcggagagatgcattttctatcgggagcaatatgttcataaagtagactgtgatgtggtgccaataaatgtttgtcacttgttttttgaagaccgtggcaatttgattttaatgcaacacaagagggccagactagtcacactactagaaaactcattttcggcgtcgtaggggatcgattttcgcaggcgggcatgtaattcggagccaaaacc

SEQ ID NO: 15960 - DNA, 1501 bp, Oryza sativa
agtcaatatactaagttcactgagttcccattaaaaaaagtgtaatatttgttggcattagaattcaagtctcggtagaatggtagatatatatgtcatgcatctgcaattttatcaccatcgtaaaatagtgctttcgtgggttatgtattatgtactagtattgcagaattaatgtcctatattgtgttttgcttatgaccaatcgttatttaattttgtcaccacagtatgaagggattaagggacatgacaaatatccttactcaagtctatagttacaaaaaaatatccttggtttttggcaattaatagaagaattttgtaaaatacacatgattcgatagggtaaaacacgggtaagaaatattttgaaatgggaacagtattttttattttaaaaattaagaaataacattttcaaatcatataatagttcaattaatagaacaaaaggagttgtttttctattttaaatcattgcaatttgaactgaaattatcaaactcgccacctcttgaggtgtatctatatggcttcataacctagaaatactttcactatcaatgacatttgaaatcattagaaagatgaaaatgatacacatgaccttgtcttgagaagtggacactttcgtattctcagaaacttgttacttccttaggacataaacttatgttctccgactacttgttcttttcgacgtgtaacattgatcaaatattttattagaataaggtcataaataagaagtctaagatatcgtgaaaatattttacaggagaaatctacaaatatcaattttatgttatgaagttaagtgtttaaaaaaattattgatggccaaaatttgatagaatctattccgaagcgtccaatgtttatgaccggagtggatagattttacgaatttattctaatatgaatttatggttgaatacttaacttaaaatccaaggaacctaaaaaaaactagaagaaactagtactaacaaaaaaaacactctcaattataggaaaactaattactgactactttctccatccaaaaaactcaatctagtctagcatattatggaacaatgaatctagataaaaccttacctagattcgtcggtttggattttttttatggaaggagtccatcagggaaatgattttcttaagacggaggggggatttggagattgcttgatccccatccgtgtgattcaaaccgatcccaatcaccaaactgcgccgccggccgccggaatatgcttgtcactgtataacagctcaccgctcgtcactgacaacggcatcttggactccttggaggcacgacaaatttacaagtcagttgctgccactgttttctataaaatcaaaacttgcacggaagtgaagtgaagcgagatgggatcttgaagttgaagacaaggcagttgttcagtctcctctagcacagcactagcgagtgactgccccaggcggatattctgaatccaaggaggaaaga

SEQ ID NO: 15961 - DNA, 1501 bp, Oryza sativa
cgacgacatacttgccgggaggagaggcggccggcggcggcggcggcggcaactccggatgctgcagcaccacgacgttgttcggcgcgttggccgcgtcgttcgccctgagcttcttcctcatcaccatcttcatctgccttcgagcactccgcgttgctcgtcgccggcgtgatcgtcccctggtcatggagcaggagcagcggcggccgacgccgcctaggttcggcctagacgccgccgccatcgcgcgcctcccgtcgttcccgtacgtgcgagcccgtgacgacggcgaggtctcggactcggcgtcgtcgtcgtcggtggagtgcgcggtgtgcctcagcgccgtcgacgagggggagacggtgaggcagctcccggcgtgcgggcacgtgttccaccgggagtgcatcgacatgtggctctcgtcccgcgcctcgtgcccggtgtgccgcgggaaggccgcgccggccgacgagctcgccgacgccatagtcgcgcgcatagcggtgacgcccgacctcgtcgggccacgcgtgtctatgtccgtcgtcgtgccggttgagatgctgaagggtgaaatggtgggcgcgtcgtcaacgtcgcgtgccgcgtcggcgccgccagagcagctcgatgcgcgagcgcctggcccggaaacggacttggagagtaaatagcagtcgttttccggtgagccttgtaaactctgctttgtttttggatttacaaaatttgaggagcgtgaaatgttgtatatatgttttgaaatttacattagtcgcttcttgttcatatttacttattattcttctctagtttttagcatcgttgcggaagtgcatgcagctgatcgattgaattatatcatccaccagatattcagattgagattcgatccagtaggactctagctaggaggtgatcgacacggcagcacgtatgtacatttacacacaaaaaaaagaaagaaagaaaaagcatcctaacgtgcggttaaaatgttgctttagtcccttttagggacattgttttttgtaaagatgttttcagacatagttgaccatgcaaacatgaaattaaccagttaacttgaaaccacgacatgtacacgctgttttatccccctttgaaattttctccaataattccagtaaataaatggtgtctgtaatctgttgtattgttagaccaagtcatgcaactttctttatggcaccactcgcaaaattttattgatccacagctatcatattcatgtcgcacctccctgatcaggcattagaagctgcaaaatgtgaattggcaaaatgaatttgttaactcatctgtgggtatgatcatccaaagtatttgaatccattttacatagtacaacatataactttcaaaagaaaaaaaagatatcgttgttttggtggagacagatttcgctcaatatataataggaaaatacaggaaatgctaaagaaaatctgacagtaagcaaaacaatatg

SEQ ID NO: 15962 - DNA, 1501 bp, Oryza sativa
taaaatagagttttgaggattaaggattgggatttgggatgaaaggtccataatacatcgttggaagatatcacacatatacacataattatacactcacacgatcgatgcattttaatttaacacgcaagcttaataagtggatgccgttgatatatccgtgatgaaccctaattaccaagttaattagcgctgaaaatgttacattttgtacgtaaccgtggacattaacactatattattgaattctagcggatgagggccaccatatgtactgacaacatcgctactgttcggaagatatatatattcccagactttatagttccgtgcagtgatttttcgattcaaatccgtttaaagttttatctgagaaaaaataagtgtcacgtactgtgctctgaccgcctagtttaatacagtactaccatgtactgtagtgacatacgaaatacattcactgcggctacagaaaataatttaatttgaagacgactaaatacattcgcaaagatggttcgaccgaccgcctctaacaaaaagcttttggcgatattattgatcgacttcaatcacaaaagaatattgttttacaatccgtacgtactgtcaatataagctataacttcgatcataattaactatttttaaatatatatattatacataagaaatagcatatattaacaaattctttataacaaaacgttcaaagtactctctccattccataatataaaagtactctctctattccataatataagacacaactacttctttagatatttcataatataaggcatgcatgtatgtatgcagataactaggacattttctctattaaattattacttttaaaatcctccagccttaaaatctctaattctcactactggagaatgcatgtttgctggtttgctcaaaaaccacaatattcctggttcgaataggaaccaggactaaaatttatttttaagtcctggttaaaaactttttaagctttatatcatttttagttctggttcaagaagttgtccgatcgagttagaccccaattatttttagtcccagttggtataaacaaccgggactaaagatctatttttagtcccggctgtttataccaaccgggaccaaaataaaaaaaaatcacccaagccacgcgccagtacttctcaagttctcatcttggtccctcccccttcctctctcctcccctctcattaaatagcctcttatcccttctctcccgttcctccctcttctcctctcttcctccacctcctaccacgtgaggctgttgatatttcttaacgtcattaatagaaatacaattctcagcaatggcgcaaaaataattctggtatattatggttacagagttcatccacaagcgcatggatataccattgtagcatttcacccgagagtattccaagggtatcgtatttattttatcccgtgggaagatcatgtagagagaacttaactaatagtt

SEQ ID NO: 15963 - DNA, 1501 bp, Oryza sativa
agaggagcctctggaagatgaaggttttggtgtctagctcgtgcctgccgtcaagcgcctgtggtcgtcgccctagtcttccgctgtttcccgtttgtctttgtgtgtgctgggccttcgtcgcccatgtaataaattaactatttacgcttccgcttgataaactctgaaatgtatcaacttttggtgtaccttgcctcctgggacaaggaataatacacgcacgtaaggaacgcccgttgggttaattctggtcgtgacaagttggtatcagagcccccttgaccctaggacgagccttagatcccaagccttagcaatattttcgaaataaaaatcttttgttatttgtgaaaatcctctagtctctctctgtcctgctgcttcatttatcgtcaaaatctgacctttaaaatgttgcttttctttttgtttttgtttgtagatggccggcagcatcaaccgccgtggtctggacctgactggcttcgttttggagctgcggggcatgtgcgttgtcctggggtatccgcatggagtggactaccagggcaggcagctcccggagcaggagggtgacgatgcagagcgccacgctgcttgggaggttactgcagtgatcctcactggctcacccgagaggacttcgttggcagtcaccgcaggtggagattctttctccgccgcttgccagaacgccgcactcctcgccatcggcacacttcaccagcgctacccggacgagttgcagcactcgccctaccgctaccaccctcgccgcggaggagcccgcgattacgccatcttccgggatgctagctcggaggatgacgctaccatcatgcacctggcgcgcatggtggaggcgtacgacgcggcccgtatcgacttccatcagatggtgcgccgtgggatggtcaagaacaacatgaagatcctggagctgcgtcaggagaatctgcagctgaagaaggacctagacgtggtggaggcgcagctgcatcagctcaagatcgcccagggagaggtctgccgccccaagcgccgccgtgtctgccgcagccagaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacggaggatgcgctgttgctcaccttccgtcctggcccgtcgcagcggtagacgagcagttagtaggcttgcgcgtgtgttctttctcgtttgtcttcttgttgggttgtgtggggcacggttatgccggtctgtggtgtaactgtgtcggagcctgtctttattttatttgcttaagcaacttgaactttaatgaaccaatttaatagcagtaataaattcaagaattatggtagtcgtgggtggttagctttaattgtcagctctctctgtttgctggttctgtgtggggttttc

SEQ ID NO: 15964 - DNA, 1501 bp, Oryza sativa; identical to SEQ ID NO: 15798

SEQ ID NO: 15965 - DNA, 1348 bp, Oryza sativa
atatatgtgtacctagatttattaacatatatatgaatgtaggcaatgctagaaagtcttataacctaaaacggaggagtagtatttatacccaccaaccaatctatattgaccagttagtttcttgtgacttgtagtagtactttttattatggaggttataacttgtacggattttgactttttcttgtattatttgaccacttgtcttattcaaaaaattttgtgcaaatataaaaaacgaaaagttgtgcttaaaatactttggataataaagtaagtcaaaaaaataaataatgatcccaaaaatttttgaataagacgagtggacaacagtacaagtaaaaagtcaaaatcatttatattttgggacagaaggagtactaattaactcttgttgcccaacaccatttcatgacagattggaggcatcgttggttaattataagagaaaaatattacccactgacatgtgggaccaatgtgtcagtggtcttttcgctgtttttgtcgcactgaaatggcatggagggtgaatacttgacccctagcctactctgtttcgtttgcctcaatttgtagagtctattggatggtctacctctgttccaaattacatatagtcctcaatcaaaaatgtctatttttttatcgttaattttaaatatccgtgtaatttaacttgtgaattatatattatgaaagtatttgttttgatgaatctaaaaataaaatcttatgatattaaactaaatcaatggttaaagattgaaaatgcttaactttaaataaacctaaaacaactaatttgaagcggatggagtattataaagttgaaaaacagatttaaaacagttttcaataattatatatatatatatatacacacacatatatatatatatacacacacacatatatatatatatacatatatatatatacatacatacatatatatatatatatatatatacatatatacacacacacatatatatatatatatacatatatatatatatacatacatacatatatatatatatacatatatatacatacatatatatatacatacatatatatatacatacatacatatatatatacatacatatatatatacacatatatatatatacatatatatatatatatacatctatatatatacatgcttttgctaaaatagtgtcatttaaaacaaggtttatatgtatcatactttttctttacttcacccctagataaatctggtatcagaaatactttatagtatctttattactatatcttaatttagagatgaaaagttaatggtcaaagtcacctcaaatactctagt

SEQ ID NO: 15966 - DNA, 1501 bp, Oryza sativa
gtttggatcctcgttcccctcttcttcattccagtactggctgcttccctccgcgattgtatcgtacaatatctgttcctcatcgcggtcagccatctgttgatacaagaaacatctgctaagttacgagacatttatgttttaacaatctaagtcatgtatgctaagtgtaaatgtcgtacattagaaccctacacaaccttacgtgctaagtctaattacaaatcatgatataagctaagtctaggtgacgtatattatacaaccctagctagtaaataattatatactaagtctaattacaaataaaataatcttatattaaaactcaaataatattacatgcatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgttaagactaaaatagtcatgtatgctaagtgtttcgtgcgtatatgctaagtctaattaagactacaatagtcaattgataggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttttgcaagatacaaaaagatgtatttggataaatgcgaagtaacaaatatatatatatatgtatatatatatatatatatatatatatatatatatatatatatatattgcatttcacgttaacgttcgtcctcgttcgttcgctcgttctcattcacgttctcgcttgtcttcgttcgatcgttctcgttctcgctctcgttcgttcgatcgttctcgttctcgttcacgttctcgcggcaacgtacgttgacgtgttcgttctcgctctcgttcgttcgatcgttctcgttctagttcacgttctcgcggcaacgtacgttgacatgttcgttctcactctcgttcgttcgatcgttcttgttctcgttcgttaacggcggtgtggcggcatcggggcggcggttggcgcggcggcggtggcggcggcggcgtggcgacggcggcggcggcgtggcgtggcggcggcggcattgcgcgcgcggcggcgaaagcagcggcggcgtggcgaaggagagaggccgagagagatcgatcggccgaaaacgtctaagtgttggtgaagaagacgagggcgcaccgggaatatatatacgcccggatctttactcccggttgttgagaacaaccgggagtaaa

SEQ ID NO: 15967 - DNA, 1501 bp, Oryza sativa
tgacttgaattcgcagccacccaagtgatgttgttgttggagcattccgtcaaacacttggtaggcgctagaggagacggtgccatgggtggtagagatgatccagcattgagtacggcagtggtcgccttgatagaggcacccatctcctcgaagaacttgttcctattagcatctatctcgtccaacttcttcaaaattcgatcaatcttctcatcacacctacgcttggcctccatttgttcaaacttctccaatatccgatccaaagcttcatctagccatttctcctcttttttcatggtggaattgatgggaatgggctcagatatgctctgatctttcttggacatcgcaggttggcttggcgttccatcgaacagttggtgggcgctgcttggatgaaaacttccccaacccaattcctgctccctcttgcatggctgcctccccaacacctccatgacaagaatcccaatgaaccgaacggctctgataccagattgttaacaacccacttcttccaacttaatagcaagcatccaccatacaaggaacaattgttttgggatgaaaagagaagaagaaactaagtaatacaaattctggaagcttctagagctgagagagaaggctgtaagtaggaggagaggtaggggagagagatcgacaagggtgcccaccggctgcccaggtcgccgccgccgtcgagagcttcagctccaccaagtccaagtgatcaatcgatgcccccaaccttcctgctgctgctgcttttgttgcctctccaactgggccttcttgggctggattggaggattgttgtaacggtccaaccatagcccatccggtcctaacaatcgaatacgaaataaaaattaatctcataaaagtttgactggaacggcaaatctgagtggaagattaaaaccgtcgaactcattgagatgaaggttgaaaccgtcgaactcgttgagatcgatctcagcacatctctagaaattgattccatcgcacttctcgatggaaagctcgacgcaaccctacctggcgcgccactgtcgaaacatgaattcggcaataataaaagggggtagcgcacgatacctaaaagtggatggatgcagagacaaaggatttagacaggttcaggccctctcaataagaggtaataccttactcctgtttggggatttgaatccgccgggtgaattatagatctgacgatctaattgtctcatgccccctagagggcctcctgcccaccttatataggatggggggcaggattacaagataaaaaccttaaccaacacggtatcagtttcctaaatctactttacaatattaccaaaccaggactttaggccgttttgtaatatacaaggaaacgtaatacccaagtcatgatctgttacatattccatatatataagttatcccttataactagtcggataaccatgtcgtgtgggtatagggtacccataatctccacagt

SEQ ID NO: 15968 - DNA, 1279 bp, Oryza sativa
ccgcatggtccttcggcagcagcgcaagcgcacgaaactcataaacgcctaacattgtatggcgtactcccttcatcctacatagacttaatttgtctatcttctttatttctccaaaataaaaccactccctctacgcataataccattttttaagtagaacttgctacgttctaggtagtgaaattttgatgaaatttgatcaaaatttagtcaaaattcatcaaaaaacttggaagaagaacccatttcgctgatgcttggtccgtgtcccaacccatggtgaatgcctttcaaatcgaaagaacatacatgttcctcttcatatttaattgataagaatttttaccgttcttagggaggtatcaccaggtaccacctccatttaacccttgatttgaaaggggtaggattaaaattcacatgtcttagctgtcaccgtcttgtactgtcgctgtaactagttgatgctgcccttctgccatctttgcaagtgaagccggcgtcaccgcgcgtagagctgccctcagtgtagctggattcagacaccttagcaaccgattaactgcccactgggtcaatcctggttgatacttgagaggaaactacagcccgggaatctccatcaccatagacaagctctctgtcttcttgtgagcacgcaaacgcaggaacaccttgcaagccatgtctaacccactgccaccgcttgagaactactatgaacgcagagcaattgggatgtggaatttcatccctctaggggatataccctcgttgtttgcatgtcatctaaataattactaaaaaaaacttgaaaaaaaattgataacatagattaatacgaaatatatcagtccacaaacatgcaagaccaaattcaacttctataagttacaacaaaaataacaaactaaactgaaaatagttatcgcacattcacaactatatttgttatttttgttacaacttgcagaagttgaatttaaacttgcatgcttgtggagtgatatatttttatattaatctatgttgtcatttttttcatatttttttatgactatttagatgacatgactttcccgagcaattgaacatatacacctatatcggaaaaaaaatcaaatccaaatgaacctaggaagagatcaattgggctggattaatttattttagagaaagacagagtgaaggtgcaggggatgaggagcggaggagaccgcgtgaccgaagtagggagcgaccgatggtgtccgcgctagagcatgatcggaggcga

SEQ ID NO: 15969 - DNA, 1501 bp, Oryza sativa
gaattaggcgacgcttccaaaagagaaaaggaagaggagatctcggagatcatttcccctctattgatttggccggagaaggaaagacgcggccgaatttggaaggagacggcggcggcttgcgctagggtttcgggcggcggcggcggcgcgaggaagacggatccgacaagcggggcccacctgtcagcggctgagagagagaggagagcggcggctcggcggactgggccgacttgggccgagggaaagagaagagagggttttgggccggctttcggcccaaagccaaaagaagacttttaaaaccttttcaatttaaattatttcttaaatgcaattccatttattaaaaatacttccttagctcaaataaatcccagaaaaatctaggaattatagaattaagcaaagtatttaatgaaattttatctggcccaattttatattgagatttaacaaattaaaattagatcttctcttctaggcttttaaaatcatttctaataattccttttaaacaacaatttataatttaaggatttttaaacaagaaaagctcttaacaaatctaattagatcattaatgatcaaataattactgaactgttctttgtatcatttaagaattgagctctgaaaaatccgagaaaatttcagagagttgacttaatcatggagaatttaacaaaaattaaatccatccatgctttacatttaggaaattttatttcccacatttaacttcacttgtaaattaaagaacacttaatataaattctattattaatttattaaataatttataaatcctgaaacaaaaatcaggatgtgacaaatctaccccccttacaaagaatctcgtcccgagattcggaacggctagaaagaaaaacggaataggtaaactgcagtctatcttattattccataactccgataattattctaaggctttaaagaaaactactgcttctttgaaactggtggctgagctgcaacacttgaagacacaactcttgaagatgcaactggcactgcattggctcctgtgacgacaatgttgttgacttgaccttgcggctgctaatgcttcggcttcggacactcttttgcaaagtggcctggcttgtaacagttgaaacatacctgctgctcccttctactactgttattctcctgagtctggtcctgctgaactggcaccggctgattagcttgctcgatgttaacttcattgctttcattagtctctgatttgatctcaccaccgatattcaactgttgcgattgtccttggccagcggaaaaaggttcaccaatttggagtggcttgatacgctgcctctggctactgccttgtgcctcttggaatacagtcattttccttttacggttatccatcctgttcttcttgtcttcaagtcgaattgctttgtcaaccaactgctgaaaatcagcatagtcatgagagatcaacgtaactgacagttcatccttt

SEQ ID NO: 15970 - DNA, 1501 bp, Oryza sativa
cttaccaccacgcgacgaggcgtgggaacgacgacggtgaacgggcgcggcgaagatggctcggagacgacggaggcgaacggcgagggagcgacttcggcggcgatccttggacgaaggcgagacgcggccggtgcaacgcttggcgacgcggaggcgaggacgaagacgacggggctgcagcggctcgcctgacgaaccacgggcggcgaacgcgatcggcttgacggagggacgaacgccacgacgagcaaaaccgggaacgacgagaggacgacgacgacgacgaccggggacggcgaggagacgacgatggcagccggcagcggctgcacggagacgaggacggaggcggcgccgcgagacgacgagccggcgaggatgaacggtgaaaacgacgacagacaccggcggtgttcgggtggaggggaggcgaggccgagggcgaccttgccgctgtgatgccggaggtggagatggcgacgtcggccggcgcacgggcacggcggaaggggctaccgaaggcgacgtcgacgaggagaaacgagaggccggcgcggcggcggcggtgttccggcgaaactgaggagcagccggaggagaggacgacgctgcgacgtcgacggaggagacggcgacgtcggtcggcgtaccggcgacgaacagcagccggccagagacggtgtagtggcggcgacgccactggacgccggcgggggcgcgtctccgatgatttccccacgaatcggaggcagcgccggggaagaggaggcggctgcgacgccggggaaggcgacggcatggccggacggcgctcgggcgaggagggagaggcggctggaggaggccggcgcgggggaaagagaagggcggcggcggggaggggtggtgaggccacgggagaacgcgggagggggctaaaacgatagaacggaggatggggattccattttataggggaggagagggagccggccatgggagaggcggggaacggcggcggaataggcgcccggcggccttgcaaggtgaccggggttggcgcgtccgttcccggcgattgggggcacgattcaagggggaaattggggggaattgaagaggaatcaatggggattaaaaccccccaattaatttggaaagagccggcttgattggggcggatttggaggaggaacggcgctaggtttgcacgggagagagaagaggccgtgcgggaggaggaagacgaccggcgcgtgggccccacgcggccaggcgcgcggtcagcgcacgcacgtgcgcggcacgggtgggagggcgccgctcggcttgggcccggaggcggcccaggaggagaggagggagaggcaggcccgggagagagaggggaggggagggagctgggccgggagggggagggaagaggtgggccgggaggaggaggagaggcccgggagaggagggaaagagagggaggagagggagactttgggctgggcttggcccaaaggaggaagga

SEQ ID NO: 15971 - DNA, 388 bp, Oryza sativa
tacatatgggtccgcggcatgaccaccctcgtgggacgtagattctaatcactcgagtggatgtccactcatttagtgtatgttaactaaatgatcatgaatttttttttaaaaaaattacaagatagattaatatataatatatcactacataaacatgtaacttaaaattcaacttttataagttgtaaaaaaagtaacaaatcaaacttttgatttgttatttttgttacaacttgtagaagttgaatttaaatttgcatgtttgtggggtgatatattgtatatgaatctatcttgtcaaattttttaaattttttttatacccatttagttgacaagcaacaaataggtggatgtccacctaggtgattaaaagtgtttcccc

SEQ ID NO: 15972 - DNA, 944 bp, Oryza sativa
atattgtttagtgattgcagtgacctgagtagcacctcaagctcccgagtttaaatataagaattggatttgtatcattaaactagcacataaatataagaggggtaatatagtcaattttaaaaaaattaacggtcaactcatgttcaattaacaaaatgggcataaaggagatcaaaatgaaaactcaagggtatataaaggatgaggcaaaattaaggggtacataagggattggacgaattctcaagcgtatatagaggattttctcattatttgaagtcaaaacagtacaactcatttggcattaagctcaacagcgatcattttgtttaggcttataacctcttataagcaaaaagtctaatcagaaataaacaattattttttgttttgctttttgaaatccgtaagctcattttacaatgttaaaggtcctctttattacacttataaaccagcctataagtcgatacgtctaaccataaacaaacaaacaagaagtttattcatttagctttttccaatccataagccactcttaaattattaagccgtggagaagccttttggtttatgtgaggtagatgtatgactctatccttaatcttagaactttaaattcatcggcttgttaattatataagcaaaaggctaacttaaaagtctaagccagtaaacctaagcataaacaaagatgccctaagcaaaatctaggtcgcgaggtacttttttttttcttgtttgaagtggatgtagaacttcaccattaaatttaattctttaaaaccaccaacttataaaacacaaaagaaaatatcggcttaacagtctaaaccaataagcctaagcctagataaagaggatcttaagcactatggttgtttttcaaggtttcttttgaaggtatcttcataatatatcttgcaagattgtggacgagt

SEQ ID NO: 15973 - DNA, 1501 bp, Oryza sativa
cgccgcgcccgaaaccgccgctcccgccctctccgcgcgcacctgcgcatacgtcgcccatgctcccgcgccacctcccacacaccccgcaaccgccgctcccaacccttacagttcgagtatgcgtccgatggtggtttcttcgaggagtaggcttcatccgtgtcgtcgaggatgcctgtgaagtggtgttcctgctgcaatccaagtcaaggcttagctctagttatctttaattttccgctgcatttatgatgttaactttgtaagacgtggatgtttatgtcaactttgtcgtttgcgtaccctggccagtcctggacaggggttttaatgcacgttctgcatggaattctattcgagaatttttgggcgtgacagttatggctaccaaccgtctcaagcaacatacagacggtcgaatgtaacggacagctcacagtgaaattcaactataacataacttttttaggccaatccttcacccagtccagcagtttccgactgttcatttgaaaactgaatgtaattatttataaaatattcaagatgatattagggtatacacaagattgcgttaaagagataggagatgctcactactggagaatgcctcttttctcccggttcgcaaccccctgtaatcccggattgcaaaccgggagaaggaatctgggactagagatgatgatgatgatgatctttagtcccggtttaaatacccgggagtaatgatgcatctctactcccggttggtgttaccaaccgggagtagagacattttattttatttgcttgtagattattgtttttagctatttgcacttgttttccggctgaactcatacacggatcatctcccgacatcccaaatcatccacaatcccaaatcattcacgacaacaaaatcatcatccattatctcaaaccatccacaacaacaactacaagaatctatttaatctgtgacgaaaaaattcgtcatggatcacttaaaattcgtcacagaaatttgtctgtgacgattctacttatcgtcatctattgagcgtcacagattaaatctgccgatgttttctccgaaatcgtcatggatcagcacaatctatgacgttttttaaccgtcatgaaatgcttttgggctcgtgtagtccagcccaggcccaacctttgtgacaaaattaaacgtcacatatggttgccacgtggtggccaacatggcaggtgacgtggttgttgacacgtgtgtgatgacgtggttgacacgtgtgatgacgtggcaaccaactgttttgatggcccattaattatttaacagcggcccatcattttttttagaactagtccattttaaaataggcctattttaaaattggcccattttgttaaccaattatcagatcaaagcctactaaacagtcccattaaatttgagcccaccaaattcaatccaatttctcataccatctcagattcaaacataataacagatactatctca

SEQ ID NO: 15974 - DNA, 409 bp, Oryza sativa
actacataaataattgtttgttcaggagtagtactagtacttactaatctttattcataagtaaaccttgggaaccctaactaatgatgaaatggcatcagaaaaagccatgcgtgaagtgtcacgccaaggatatgggacaggtgtcgaccctgggattcgcctacagtttttttctttttcaggggattcgtctactgttggctgcaccgcacaggctactgcaggaggaagagagagagagagagcgcacgtaacgccgcggggaatgggtcacgcgccacacgtgggcgacggccccgcgcggtggcgaggcgaattgggtggaggggacggggggccgagatatgtcacatcgaatttttgatacgggccggccgtggccgtgggccgcgcggccacgtgacga

SEQ ID NO: 15975 - DNA, 1501 bp, Oryza sativa
aggaggcccaatccacgctacaagggggaccaatgggtccagtaaacaaccagctagcatgagctgtctgagagagagatcagccgaagctatgtaatataaacatcaacgaagaacaagtagaagggggctaagaactggaatatgcgcggtggcgtaggcggcggcggctcgatccttcggggttgagaaatcttatatgcgcaattcgtgattaattccagttcctgagagataatcgttgggagttcctaacaacttcttctgggtccctttcgtggacgagatcggcaccctacgagggcacgtgccgtcgtcagccctgggaggcatcgccgacgcggtccggggcggcgccagggtcgtctacgctcgcatcggcggcgtagacatatccatatatttgagtcggttttaagatcgttcacttttggtaatatataaggaatcatataagaaatatgtttaaaaaaactcgcatgctaacttgggacgatcggactcccaagtacatctcatgattttctaaaaatatatatatccaagcgaactcccacgttaaatttcattttaactaaaccaaatatataagattaaaatagatttcacccgttgcagcgcacagacatttttctagggaataagttcactttgggtccctctattcgttgttcagtccgattttcgtcccttgaccgcaaaaccaggtacgacccgtcccccaacttatgaaaaccaggcaaacgaggtccctcaacggttttggctgacgtgacgcctacgtggctaatttgactcggtcttcatctaacgtggcgcttacgtgacaatttgatctggaaaaataataaagctgtgggacccacatgtcattttcacacataaaacaataaaaaatagtgggacccacgtaggccccacatgtcatactcaccccctcatcttcctcctacctttccctctcccctctctccaactctctcccctcctctctccagcctccaagcaccacggcccacggggtcaggggaggtccggcggtggcggccggcgacgcgacagccgccgccggcggcgagctccacctctcggcgcagccgtgcagacgttcagtagagctccttgttcacgtcgttgagtacagcatcagcatcgagaccatggacaagatcagacactttcgagggattccactgggggtactcgtgccagttcggtagcttgctcactcctggccaaacttgctcatttggggtgcccagcaacctggaaccaaacaatcaagataaatcaccaccatgaatacacgattatgccccttaagtttgccagcgaacacaaagaacaattgatgaggaaacaggcacagtacttgaaaatgtgcagaagctgctgaacctcggaatctccagcgaaaagaggttgagtagtgaccaactcagctgaaatgcacaagatatatcaacactgtcaaggcatgaatcctgaagaaataataatt

SEQ ID NO: 15976 - DNA, 1501 bp, Oryza sativa
ctcgccggactccaccaggtagcgaacagcgatggctccgccgtaatctcgcccaccgcgcgagaagcgacgaaacaccatgggtgctatcttcagattgccatcgccgtcttcgtagaactcttctacttcaaaaacatggaggtgctcttgcgcggtgaggaaatagaaggctcccttgtggtgtatgacatcctccagaagtcgcccagcaatggtgttagtacaggtcgtcgccactgcaatctgcttccccatgcgccagaatgcatgaacgcgtggactatacaagctggcccggtgaaagacgatggcggcgccgacgcagcccttgtcctccggtggcgaagagagggtcgcggcgaccatgacgatgtccgtgtcgaaggctggtctccccgcgaagtcccagcgggcgatgtcgggtaggtagaaccgctgctcggtgcggaggctgaggagcgcgtggcgcttgatctggccgaaggcgaggaagagccagccgccgccgtacgtgccgaagtagcgcgcggcgcgcgcgtcgtccgggatgccgaagccgtgcccgcggcagccggcaatggggcacgagaaggaaggcccgtctgcgtcgcgcgggacgaggatccacgggagcgggctctccggcgggtgctgctcccccttgacggcggcgcgccaggtgcggcatacgcgggccatgcggcgccggtcgacgaggcacgggaggcgcttgtggacgaggcggaggacgtcggcggtgagaccgcaccatgaagcgtcgtccattggagaggcggaggcgcggcttgccggtggcgaggaggcgaggcggaggcgcgctgctgtgtgttggggattgattgattcctcctctgcttctcgaagcggaaggagaaaggggggatttggtttggaagaagcagaggtgggttgcttgggccaccaaacgatgtaggccttatatattgggccaattggcttgggccacgagttaagagaaaatgttatccacgccacacaggaataatgtttcatctgagatccatgtgtgtacccaatgcagaatggctggtgttcatgacttggattgcattagtgcaccatcatattgtgttgttagtaatgcgttttcctcatcatagaagagttctttgatcagttgcatcaaacggaatttgcagtgaagatcgatggattgcttcttgagactggtttcagtcgcttctcttatcgggatccaattagaatcctcagtgtatgacacaaattagtttcataactaattcaatcatactgacataacacggtgcatcggtgtcagctaaccagtcaacatgctgatgccttgtctttgttctcctgacatactagttgttttgtgatcagttgcatggggatagctagatgcagaatgtggtcatgaaaaagtagactttctacagtacagcccattaatctgcctccagaggaagctacttttgggccccaagaaagctgg

SEQ ID NO: 15977 - DNA, 1501 bp, Oryza sativa
cccttaagttcctctattagttatagtattaggaaagattttaaaaaatttttgttggagatttttttattaatagattgaaaatttttaagctagatttaaaaactttcgatttaagatttaaattttaaagtcaaattttaaaaaaaactttcaactcagattcgaaaactttcaactctagattcgaaaatttgaaaacttccaacttgagatttgaaaattttcaatttgagatttgaaagctttcaactcgagattcgcaaattcagatttgaaaattttgaaaactttcaatttgagatttgaaaattttcaactcgagatttgaaaactttcaactcgagatttaaaaactttcaagtccaaatttgaaaacttttaagttaagatttaaaaatattactagtaaactaatcactagtaaaaataggaaactaatcactagtaaactaattatgattttttctcctatccatgcagtagcaaactgtggaaaaaagaaaaaaaagagaagaaacagcggtagaaaaaaactgcgaaaaaaagaaaaagaaaaaaagagacgtgcgcgtatgcggtgggccttgtgggccggaagtgcgcgccggtaacgcgcgcgcgaactagcattccgggggggaggcggcccatggtggacttgactataccatcgagggttagggtcttggggcgttcttgacggtcgctgcaatggcgcgctcccacacagcggcatcctcttcggcaggggctgcgatggtggcaacagcgctagccatggctcgaggcggtgatgcaatatggcactgaccaactagtgtgaaatgagtggatagagagagaagagatatgagagagctgacatatgggttcataggtatttctgccattcacgtgatttccgagcttgacttgtcagctagacatcaccaccaagaagtacggtgttgacctagctcctgggtacatcagcgtgatgtgccccggctgccacgcatattgccaacatttccaacataagaacatgtaacctcaatggcacttggcatcgatccaggatccacattagcagttaggtttataggacatatttgtgaaatagatcttataaaaggtctgtaatgtaaaataccaaacaacggaaccgtgctggaaaatttcctgctcgtcgtcttttctaggcacgtttacgtaattacgttacgcacgcgtactcgtgctactattacaactctccgcgaccacaaaaaatcgagagagagagaaaaaacgaatccaacttagcagaaattttcgtgtacccatgaatcggaagtcagatgctagtcaaaaatgattttgctaatctttatccatgtggagtcaccatggctgcttcataagtcatcgcttacgtaaacgagcgttcgtatttctgtgtagagaaaaaaaacgagagctccatcattatactcggcaggtttttcttagtaacatatcacattcatctcagaatata

SEQ ID NO: 15978 - DNA, 1501 bp, Oryza sativa
tttgaacttgagatttggtgagaatgcatttcatatctacacatatctctagtattttttttcatgaatttataaaacttttatgtatgattttcacgagtttccaacacttagctcgttttcatcggatatgtccaaaaaagttacctgtatgtatactatgaggaattggacgagccaagtctgtgcttggaagctttaccggctgaggtaaccctgctacttgattgagctctagttccaccttcacctttgtgtactaaattgacgctgccccatgaagaccacctcaccatcaccatccctagtatcatcacattgtcgagctccaccttcacctccctcagtatcattatatcaacgagctccaccttcgcactctcctccgcaagctcccctggtcgttagaagtggaggttcgggaagatcgaggaggggtcgctggtttgaggagcgttgctcctagttcaagctacatgggagagggagctgctcatggaaggggctcgagctcggcggtggatgtgtggtagaaatggactcattgatagccccacgagagagttaagctaaactagtttgatgcttcttaggaaaaatttatgcagttgtgcagtagccagtagagatggattagtgttaattaaagaagtgttttcaaaagtagggattgactattatcaaagaagtgcgcaatagagatggaattgtgttaaagaagtgttttcaaaagtagagatagactaatgtcaaagaaatgttttcaaagagttttgaccaaaaatatatttaacttaatagttaaaaaagatgaactagtattaaagaaatgttttcaaaagtagagatggactattatcaaagaagtgcgcaatagagatggaattgtgttaaagaagtgttttcaaaagtagagatagactaatgtcaaataaatgttttcaaagagttttgaccgaaaaatatatttaacttaatagttaaaaaaatgaactagtattaaagaaatattttcaaaagtagagatagactagtgtcgaagtcaaaatgttttgaccaaaaaatatttataactttgtagttttttatttttttaaaggaataagttcactttgactcccttaaatagtgactgaatctaatttgtatccctaaactacaccagatatctcgacccccaactcttaaaaccgaagcaacttgactccctcagtggttttggaggacggttttgttgacgtggcgcctacgtggcggtattgacttggtctgtattccacgtggcgcttaggtgtcattacaattaaaaaatagtgtaggacccatttgtcattcacataaaataaaattatggggcccaccgtggggccttctctctcccttatctctctttctctcccctccctcaagttccttctcggtcctcaccgctcccttctccctcttccatctctttcccgtggcgggcggcgagggccagagcggcggcgggcaagcggag

SEQ ID NO: 15979 - DNA, 1501 bp, Oryza sativa
ctcactggaagaataaaattaaatgcaacacattggatgcatcacaaattcataataccgacgtaactttaaaagtatgacatgcaagcacacaacaaactaagagtgctcttaaattaacgaggcccactcacagatcatcaaaccttgtattattattgcaccaatatgttgaatatttccaaaaaatgtaatgtaattccattatattaaaaaacttgaattttaagttacaattacatcaatatcttggtttatacgtcatttcttttacatgagacataaattggattggatgtatgaaaattcgtacatttaaatttatttcaagaattggttaccccactcatagatcatcaaacctactgttgttacataaagatcttgaatgttatggtgtctggttaaaaacatattggtttagatgtccttcctttcaaacaagaagaagaaacataaatctgattggagtgtggaaaatcgtgcatttaaatttatttcaaaataatactactttcatatataatactagccgagtttctaaaagtaatttgcaatagaaattaacgataaagttgtagttcgaaaaccatctaaatatctaaaaccacgtgttttatgatcacgaggtgtgactttttatactactggctagtactagtaacatgcaccatgcagccacatggacaaggttttttactacactagtgtctagtgcattcgcaccagtcatttgcataacttaaatacctatagaaaaaatgaaaataaattggtaataattattaggatgatataagtcgataaaaatatatgagagtaaattcaatctataattatatagaccaaaataataaactcggaccgtaaataggatttgctatttttatgtaaattcattcgataattatatagataaaattaataaactcggaccgtaaataggattgctatttttattttatttatctactagaaaaaaatgctcgtgcgttgcaattggagaatattattttaatcttattattgttatattggttaattaaggtgaaattcactttgttaaattcgcttggatatatttttcgttagaaagtcatgagctgcaattaggagtccgattagcatgtgagtttttcttaaagagatttcttatacgattccttctatattttcaaaagcgaataaacttaaaaactgactcatacacggatggatgatgtaccaaagtatcggcaaaaacatcttcaatttttataatagcagagaagagatagatcgaatttagatttatatgtttacagagtgatttaatcatcatgatatatcttgttaaatcttatcaattttttcacaactacttatcacacatttacacgcatacacttggccacttaggtgtaaaagaacagccatatatactggcaggcaatgcaggctacatctctcaacacccaaagcttgtctttgtcgcgaacacaagctaccccaactccggcca

SEQ ID NO: 15980 - DNA, 1501 bp, Oryza sativa
gacgaaggtgttcgatattccacgggttaggcagctccgtgccgtcgcccgtggccagccgaacggagcccggccgggggacgccgatcactcgatacggatcctcccacattggtgagagcttgctcaatccagcacgcgtttggacgcggcgtaggacgaggtcgtcgacgtagagtgatcgggcccggacgtggcgctgatggtagcgccgcaggctctgctggtagcgcgcggctcgaagggccgcgcgccgccttcgctcttccaagtagccgaggtcagggggcgtcggcttccttctttttgtcgctcgcaggcctcccctttcgggtggcccgcggagcgccctcgacggcgaggacatgaccctcgtcgtcggtatgggctgacctcttcttcctcctcctgtcacgccgccctgtctgagcggcggatccgggggcggccgaagctgccactccggaaccggaggagttccaggtccaggcctcctccttgcgagccactcggtccgcgagctgaaaaagctctgcggtagtctggggctctttggaggcgatcttttcgagcatgcggttgtgccgcacaccccccctgaacgcgtagatcaccgcgtgtgcagggatgcatggtatggtattgcggacttggcaaaaccgctgaatgtacgagcgaagtgactcatcatcccctcgctgtaccgcgtgcaagtccgcttcttcgcctgggcgcggataagtgccttgaaagttcatagtgaactgtggcataaatcctcccaagagtggaccgacgcaggtggcaggttcactagccaaccccgcgcctgtcccttcagggccatgggaaagaaattcgccatgaccctgtcatcacccccagcggcctcaatcccagtcgtatagacctggagaaactcggtggggttgacgctcccgtcatacttctcagtgatggtgggccggaaccttgggggccaacggacattccgaagactcgccacaaaggctctacagctgacaccaccagccgggggcacggagggctggtcctcacgtccatgtcgaggtgacactctggacgaagaggcgccctccgttgcgcggggagtacgccggctattacgccggcgctcgatgtcgaggcgagcatccggctctccatgctgatcctcccgagtcggaggtgccgacgagggagtggcagccgaatggcgtgcaacagccgccgctcgccgcgccctccgccttgacgacacggagccggtagtggcggcgccggaggtcttggtggtggcggaccgtccaccagcacccaggcgctgctgtgccgtcatgaccaagttggccacgtcgtctagccatcgctgggctggagactccgggtcagggacgacgggcgggtgacgtaggagcgcgccaacagcctgaagcgcgccctgaggcgtgctgccgtcgccgtagacgaggaggcgacgctccccatctcgccgttctcc

SEQ ID NO: 15981 - DNA, 1501 bp, Oryza sativa
ggttttatgtaaaaaaatgttgctatgttttttataatcttattcaaaacttaactactttttttaatcacctcatatttttctcattgtcacacgggtcgtcctgcgtgacgcggtccttacggtgcgccgggtggtgaaggcgaggacgggacgggcgtcagacaggtggacgaggtgccgcggcgagggagatgggttgcgcggcgagggcagagcttgcgtccacggcgtccacggcgaggaaccggatggtgttcaccgactgctccaccgccgccggctgctgcgcgtggagggcagtcggccgtcggcggccgacggcaaggcatttttgacatgaaacaatggcgacgttcgcattcccgactacgtccgttcctcttcttcttccttggttaaggccaagtaggcagaggacgagcgggcacgcggcatcaatctttagaatatgagtggaagcgaaaatcatggaatttagatgaaagcatgttcattttgctagtttaaaaaaattgaccaacaaaaagtcaagacgagtaatataaaacatagtgagtattttttttagctatttcacattgtattgggaccaaacgaaatttagtacaaaatttcagtttgcaatccacatgtaaatagttcagttcgaaatttagttcaaaattttggtttatcaaaggcaaatatatttagtttagaattccacaccaaatacagatttgtagagaaaaaaggacgaacagggtagtttgcattcctaatcttatcgtgtgttttggttagaaaacaatacagtaacgctcgtggtccacatgtcagaaatacatcgcggcaaaattctcgcaagcgcgcggcaaggtcgccaaaaatctggtgggtgtggctaggtcaccaaaatccccaatctctctatccacctctcatcccaatcaacccaccacatcgcgccgccgtccaaggccgccgccgccgcgccgcgtcccatccaaggccgccgccgccgcgccacgtcccgtcaaggcgaaaccgccgtgccgcagccagtccaggccgccgccaccgcgcaccctatccaagcccacgacgtcgccccgcgcccatccatttgctgtcggtcgagtacgagaccccagcccgcatgcgcaccaccgtgccggcgccaccagtcgccacgcacggcagaggattggctgctcttccagcaaccctccctaggactgattcgtctcaggtgctgttgtcttgctcccggaatcctcattcggccttcaagtttcatcatctttttgattagtgaccagttctagaatttactagtcaggttgcggttgtactaagggattgcagaactaggttgttatgccatgtgaaagtttgtgtgattgatgatctgaactaatgtttgatattttatttctcagtcatacaaactaaactaggcctttcttattcttgaacctttcatgaatagaaggacatttcctaacataaatttatt

SEQ ID NO: 15982 - DNA, 1501 bp, Oryza sativa
ctccgctttccatctccacctccaccgcactaccagtaccaccacgtacgtccaccaccacctccacctccgccgtgcggacgccgccggcttcccaatcccagccgcgacgcggaggaggaccaaattcctcccccacccctccgtcaaatctgcgcgcaccacctccgaggtaagcctctgcgctcccctgctccggcctcgggttctccctccacagccagccgagcgggcaaggcgccgccttaggccgctattaatttgttactgattcttcgctaatcgctacgatgccctgcttgctttctcattttgtggtctcgtgtgtctagactctagaataggtagcgcggcgtcagcaggtttgggggttcggtttgcggctgcggagttttctgcctttcaggcaaagccatggttataaccagggttcaaattttcggtttggccgattctatcggaggtcaccgaaatttccaaaattttgaacaaatgttggttaaatttgaacaaaatattaccaaattcataaaaaatttagaaatttcggtcaaaatattttcgtatcgtatcgggagggtccgaattgaccgaaattccggaattttgaaccctggttataactgggtgggttaatcttcagggaggcttgatttagaatttctttagtttacaaagaataaaggcttgtcaaatgttttgtgtcaaaacttatagtaacaagtttaggacatgaaacatggagagagtttgatgatttctaaagagcaatggtaattcggtggttctacactagtgtggtggatgtgatccaagctgtcaataatgaggccacactttggtagtttggtctttggcgggagctttgaaactccaaaagctgttgtctaagtagttcttgcgtcctagagaggtcggcttgagtttcttcagtttttgagtgggtgtgtgttgtgttctgtaagactttcggtgggtgggtgtcagggtttgtttaaatcttgcatcccttgcatttctttctctctcttaatgaaatgatatgcatatctcttgcgtgttcgaaaaaaaaaaatcagtgcttctactttcatcacatgatggttttggacattttggcctctgagagaccctggcatggattgacttgttggaacgattgctactgctcatttccttgtcttttgcagcatataaacatgaatgcaataatttctctccaatttttccaaaatagaaatctagcttcggttcaagatcagcaagaagtctgacatataaatgtatggaaatgacagcaccagtatctgattaaatttttgagtaaataatgaagactgctggtaaaaatatcgtagttgaagtaagagagaagagagaagagagaaaaaaagtttgggtctctagggacctgatcaatgaatattaaagtcctgggatccattaaagttttgagtaaatattgaaaacaactactgaaaactcgatgtaataattattc

SEQ ID NO: 15983 - DNA, 1501 bp, Oryza sativa
ataatagtttttttatccatcgatgtctttatgaccaaattcacggttaaagaccaaattacactattactaaaatatgaaaataaatatgttacttttgggctatattttttaacttttgcatgcatttcaaactattagaagaaatataaaaaacaataataataaatatttatcatcctacataacttcacgataattaatttagatctacatttctaagagtaaaatgaacataactaggctgtgttcattccatgggttacgacctaatctctagagcaccagaagaagcgactcattagcgcataattaatttaatattagctattttttaaaaaaaatgattaatatgatttttataaagcaactttcgtatagaattttttaaaaaaaaacataccgtttagcaatttgaaaagtgtgccctagaaaaaaaaaaagaggaataagttgggaagttaaagcaaagaacaaaagaagtaatattcccggcctaactcatctcaaaagaggggtaattatttttctaattaggtattacatcttaaaaattagaaggaagaattgaaggaaaaattttaagtcgctatgtgttacatcttaataattagcaaaataataatttgaaattttatgaacaaaataaatcattggttttcacttaaatcatttattaaaaaaaaaggagagaaccccctccccaaaaacatcctctcctcacatgcgcacaaacacaacactacccgtctcctcactcctcggttcgcactttcccctctgcccctcatcgatatttttatagctatcaaactaaaaggagaaataatttttaagccacacattttatttctaatataaattgctctattcataacgcctatgtttgaaacttaaaataagggtagtataaaataaaacaataaatagaaaatattaataggaacattgtttcctacttttcattaaaattggaacaaccattacatgttccattgccataacatttttttaaaaaaaagatactatagatcacgcatatatcagggatggaggtctacaaaataacttttgaaatttatatgtaaatatgtaaaaaattgcgtcaatatgaaccaactaggaggactagcttggtacacataaaacatattcattaacaataatagttatttaggatttgctaaaaaaaagaaagctcctaaacattctattaaacaagacaaaacaccacatgtcaccaaacaaattaaatcaaactcctttatagataatgaagagatggtacaaaattgtttataggaatgtattaaatattatatattttaaaagctaacaaatagattgaaaaatttatctaaagcaacactcattttaagttttcttcaaacataatctataatatatgcccgcgcaacgtgcgggctacctttctagttttagataatgttttcatatttccgtaatactattacaggatgcaggaagggcatccaacatg

SEQ ID NO: 15984 - DNA, 490 bp, Oryza sativa
  unsure (1)..(490): unsure at all n locations
tacccatgaattcagaaccccatagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagtnggnagctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcag

SEQ ID NO: 15985 - DNA, 1501 bp, Oryza sativa
ttttttgacgtgttttaaagggcacattcgtaggtcccatttgacatagctccacatctagattcaaactgaatatgaagttcttaagttcaattatagtgatttagaattttatatttcatctaaaataggaacacaattacattcaagtgtcgttaatgtaatgagtaaagttcatcaccggtccctaaacttgtaccgctgtgtcatcccggtccctaaactcgcaaatcgaccgttcaggtcctcaaacttgttcgactgtgtcatcccgatccctaaacatgcagatcactcgtttaggtcttccaacttgttcagttgtgtcaccccggtccctaaacaggacggtctaaaaactttatatcaaaaatttcatgtgaactctaatgaagacaaactttatattaaaattgtagccctcgacgcgacctacgactttgtagttgaaaagtttttgaattaaaactgtttagggtcccaaaatattgttgcatgtttatagattttgaaattttaattttaaaattacattttgggacaaaaaatgacttgcaataaaaaaaattcaactacaaagttgtagatcgcgtcaagagctacaagtttgatataaagtttttctccattagagttcacatgaaaaagttatgaattatttttaaatataaagtctttagtccgtcctatttgactcagatgatattcaaatctaagtttagagaccggggtgacacaacttaacaagttggatgacctaaatgagtgatctgcaagtttaagggccgggatgacacactcgaacaagtttgaggacttgaacggtcgatttgcgagtttaggaatcgggatgatacaacggtacaagtttagacggtgatggactttactctaatgtaattgtagatctagatatatggagttagtatatgcgtatttcatgtactaaaaaaatgagttcaattatccctctctcctgttccataatggccggcgtggcgttttcttgtagtgctcgaagtgtactcatatgtttttttttccgttgatcaatgattggtatttttaacacacaagaacttgccaacaaaaagaaaacttgcgagccacatcgttccaaaatagttgtaattaaatgactaatcaaagaacgtcataccgtcgatttctttttagctgttcttgtttgaattcagctatgtactgcgagaaaacacacacacacacaccttgcaacatagtgtcccatgtggcaaacctgaccggctcattggtcacggccacggactctccaccaagtcatcccgcacctcgtcctcggtcagatctgccgttcccgccgggccgcgcagcctcggcctccacgaagctcctcacgtctccacccttgtacaactagtacaacctgggtccactccgacggcggcctcgcccactttaaaccaccccctccgcctcgctccccttcctcccaccagccaccactcgcaaagctcgacct

SEQ ID NO: 15986 - DNA, 1501 bp, Oryza sativa
aattttttttttaaaaaaaatacaatggggctcacatgtcatcccctctatctccttactttcctatctatgtttatccccttctcggcagtggtacgacgacttcttccataggacggcggtgggactgtagcaaaacacgatatgctctgggtactccatgcctccatggtggtgccaccgccttcgttcgccttatccaagaactcatgcaggcattcgttgtcgaccttgctttacattatatatggttttgtggttgaaggatatgaatttatcatatccgacctatatcgaaggagtcagattgaactttttccaacgaggaatgggtccgatctgagattgcacccactttattaaggactcgattgaatgagtcggtattgaggcccattcaactgtattggccaaacattttagtataatgtcccgcttatgcattaggatggcgaaaacgctaattggcggctagttgcgcgcgcccttctttttttccgtttctctttctgtttggttttctccggttttttttggtttctctttctgtttggttttttccggttttttgtttctctgtctattttggtttttccgttattttggggttctctttctgttttggttttttttgtttccccccccctttttttttccttttttctcttttcggttttttttaacatatacgtatacaaactttttgtattcatgtatacaaactagtttatatacgtacgtatataaagtttatatacgcacgtatacaaagtttgtatacgttatgtttttttgtttttttttattttttaatacgtacgtatacaaagtttgtacatattgtatacaaagtttgtatatgtgtatattttttatacatcaacaatatatacatataaaaatatattttttatagaaataatactagtactaatagtagtagtgtaatagtaatagtaatactagtaactactagttgtatagtatagatactaagaggagtggggggtggtcgcgcgcgatggggcaggcgcgaccagtcgccaggtagccacccccttaggatggggccaggatttatgcacatccaggttttgagctaacgtgcaaggttcaggttcttgtacgctttgaaataaaattcactttaggtccctcaactataggtcgagttttattcacaccactcaaccataaaaccggagtgtccctcaacttttaaaacgggtacaaattaaattcctcgacaatattgaaagcgatttctagttaatgtgacgcctacgtggcacgatgattgcttgacttattaggcccatcccgtgtcggcatgacccaacctttgcgccatgcctgggcctctgtctcgacacgatgggccgatacggcattggcccagtccaacgatcagggagttaaatagatgagagagacaaaatagatttattcagccatacaagaaatgacccaaacagatgagggatgaaaaatagatttattc

SEQ ID NO: 15987 - DNA, 1501 bp, Oryza sativa
aaacggttatcacacaacttgggattccagattacaacactataatcaaaattccctaagataactaaggccatgaacctttacttactgaagtctgatgaagtgtaaataaaaactagccagagcacatcataacctgacaacactgcatgaccacgcaccagtactaattaccgcgtgagatggaatcatataatataaaaacctaacccaaattcgtctacacaatccaacaaaactccaaatcatggcggacaaataccagtccagcagtgcggtgcccatgcgtccactatttacaatcgcacacaccgagtgtagagacaaaaactaacatgcccatcagagcaggagacttttttattatcccgtgcacatgcagccaatacggaagcggattctccatctttagcccattaaagtcagggattcacagcgatttgccctgtgaggtggcgctgctggactggagccacccaatcggcgagctgatgagcgagctctaccgctacagtgccgcatctacagtgaacggaatcgcacagccccatccgcttgtcgaacgaagcaggcgattgggcgaggcgaatccggcaggtagcgaccgccatttgcagtaatgcgtacagctccagcgcttgctaccgtccaaacgggctcccggttctccggagccggagcagcggctccaccacgcgccgccgcggcgcgtataggcagccgatcgagcgcagccacggccacgactcgcgcgcgaatctgaggagagagagagagagatcaagtgagcaacgtaccacgagcgcgaagcgggaatgcggcggcgaggccggagcacgggactccggtggggaaatggcgtggagcagaggctcctggttgtggccgcgctgtggtattcgctcgctgctcctctcccttctacgcagcgtgctcgcggcggccggcggagggggggagtagtggtggggccgggtgggcagagagatgccggggaacagcacatgctgctggatatctggagatgcgatgcgacggcgatgccgttggggttcgttgacctcaccggtgatgccttttggattgggttgggccgagcaaaaaaaaaaatttgtgccccaaatgggaagggattatagctatacaacttctgagctttatacgtttgtatgtaaagtatatactaagaacaagtttaatagtatagtccactactagcttcaatttgtctatagccaatctaatagccaattcatacaatagttacttactatactattagtatatgatcccacctgtcatacacacattgcgtattgcagctggctacagatctatagcccactgttcttctctctcatcttttatctcattaaaatatgtttatagatggctaatagtatgctattgtacctgctctaaggagactagaggaggggaactggtcacccatcagcgacttccgagtcaatagtctctagttatagttgtcgacgaggga

SEQ ID NO: 15988 - DNA, 1343 bp, Oryza sativa
tggttgtactcattcttgctcaatctttcccctcttcagtaagagaagcgttggagaagatgtcttaggtggagtcctggcttataccccagttgagcgcctgtgaagatggagccgtaggcccgctagtccgctgctgtttatttttgattgccaggcctgaagcgcctttgtaataatgtaaatattatcgatataataaaaatgtgtcttttatatcatgtttgtgtggtgtaccccggcttttcctgggacggggattaatacactagcgttcgggaaaaggcaattttcccggtcgcgacacgtactcaaaccaaaccgtatgtttcgtgcgtcctttccaaattctttaaattttctgtcgaaacatcgacaaaccaaaccgtaggcccgctagtccgctgctgtttatttttgattgccaggcctgaagcgcctttgtaataatgtaaatattatcgatataataaaaatgtgtcttttatatcatgtttgtgtggtgtaccccggcttttcctgggacggggattaatacactagcgttcgggaaaaggcaattttcccggtcgcgacacgtactcaaaccaaaccgtatgtttcatgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttcctgtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacatcgttaccatcagcagctatttcctccttgcccgtttgatttgcttcaaatccaacatactgagcaaagtccggaatattgtcgtcttcc

SEQ ID NO: 15989 - DNA, 1501 bp, Oryza sativa
tgcctgtggcaatgtcgtgccgctgccttaactctgctaccttatccacttctgcttttggaatgtattccggaccgctcggtccgatgatctaagactatgcctgcgggcttatgatgtaataattcgcactagactctcatgtatgtgtatttggtatttcagctatgaacttgtgtgtaccagactacttgatccagggaaatggtactgtttacacgattgattcctgttataaaaacgggggtccacagaactgaatcggcgagaagaggagcgatctctaagaactcaagaacggggaagagaaaagaactgtccggaagaggagtgggcggcgataactacggcggttttgatgtgactaatctctgaagattcgctgcctgtaactgacaaaaaaatttaaaaaatacgggcatgcatttaatgaccgccgatcacttgagttaaaaagtaactcaatttaacgaccaatgccatgtgcccccaccgcgcagtgacgcgcaaacgagttaaaaaaaactgccctcgtgccaacacgcaatggagttgcgtgtgttcagacggagttaacgaatacctcaccggaacgagcacgacgaatgcccccccacgcacaccttgtcgcaccacatgagttaaaatataaaccaaaaaaacaggtaagtcgtgtgacaccgtcgatacgtgccatgtactgatgagttgaaaaataactggcttcttaatctcacttgcgcatgcatgcccgctttttagttaaaaaataacacatggcgttatgtgggcgcgggcatggtcataagttaacaaatgactcatgaaagttgggcgcgggtgggatgtgagataatgtggtgcagtggtgggtgtggggtggacgcggtattctcataagttatcaaatgactcataaatggttggcgtaggcgggatgtgaggaatgtggggtagggtagggaggtgttgtgtcaggcgccatctaatacgtggcgcctacggcgccatatatatatatatatatatatatatatatatatatatatatatatatatatatatatatatatatatatataaaatatgaaccttggttcatatgcacctcactcatttgtgtgacatgtgtacacattataatcactgtaagatgtacatatctagctttgtatccttatagtgtgagcaggggttggtacatgatctaattgccaagaccaaaatgcacttgaagtagtactccactcatattggacaatgatgactcatcactcactcacaattctctgttgacccatgcgcatggtagtgctataaggtacaaatcacttgattaagtcatatcattaataaccgttgttagcacttaattggctaagtatctgtttatgtttcggcatttcacctcaaataatttcttttggtgattttgatttctcatgagttctcataatgttttgcgatacatcaatttgtttaacaaaaaaaatgtcaaccc

SEQ ID NO: 15990 - DNA, 1501 bp, Oryza sativa
gaattaggcgacgcttccaaaagagaaaaggaagaggagatctcggagatcatttcccctctattgatttggccggagaaggaaagacgcggccgaatttggaaggagacggcggcggcttgcgctagggtttcgggcggcggcggcggcgcgaggaagacggatccgacaagcggggcccacctgtcagcggctgagagagagaggagagcggcggctcggcggactgggccgacttgggccgagggaaagagaagagagggttttgggtcggctttcggcccaaagccaaaagaagacttttaaaaccttttcaatttaaattatttcttaaatgcaattccatttattaaaaatacttccttagctcaaataaatcccagaaaaatctaggaattatagaattaagcaaagtatttaatgaaattttatctggcccaattttatattgagatttaacaaattaaaattagatcttctcttctaggcttttaaaatcatttctaataattccttttaaacaacaatttataatttaaggatttttaaacaagaaaagctcttaacaaatctaattagatcattaatgatcaaataattactgaactgttctttgtatcatttaagaattgagctctgaaaaatccgagaaaatttcagagagttgacttaatcatggagaatttaacaaaaattaaatccatccatgctttacatttaggaaattttatttcccacatttaacttcacttggtaattaaagaacacttaatataaattctattattaatttattaaataatttataaatcctgaaacaaaaatcaggatgtgacaaatctaccccccttacaaagaatctcgtcccgagattcggaacggctagaaagaaaaacggaataggtaaactgcagtctatcttattattccataactccgataattattctaaggctttaaagaaaactactgcttctttgaaactggtggctgagctgcaacacttgaagacacaactcttgaagatgcaactggcactgcattggctcctgtgacgacaatgttgttgacttgaccttgcggctgctaatgcttcggcttcggacactcttttgcaaagtggcctggcttgtaacagttgaaacatacctgctgctcccttctactactgttattctcctgagtctggtcctgctgaactggcaccggctgattagcttgctcgatgttaacttcattgctttcattagtctctgatttgatctcaccaccgatattcaactgttgcgattgtccttggccagcggaaaaaggttcaccaatttggagtggcttgatacgctgcctctggctactgccttgtgcctcttggaatacagtcattttccttttacggttatccatcctgttcttcttgtcttcaagtcgaattgctttgtcaaccaactgctgaaaatcagcatagtcatgagagatcaacgtaactgacagttcatccttt

SEQ ID NO: 15991 - DNA, 1501 bp, Oryza sativa
atgtccgagtggttaaggagacagactcgaaatctgttgggctttgcctgcgcaggttcgaatcctgctgtcgacgtacttttttctttcaagtaaaacagcaccagacggcttattagaaataaaaataaatttgtatataaaactttttatatttatatatgtgttctttgtgacttaaaagccaatgctgaaaaaaaaagtaggttaaaaaattaaatttaaaaatttaaaatttggttttttctttggcttattaggccatccgatgggagcctaatttcctctagccccactgcggtgttttcatttcttgtcaggtaaaacagcaccagtacaaagtttaatttcctctagccccactgcggtgttttcattttcttgtcaggtaaaacagcatcagtacaagtttaatttcctcgagccccactgcggcacgatcattccttgcacgaacacgtatgatccaccaagtccgcgatccgttgaaaacttgaaacggcctcacgggcagtgtcaacaagagcgaacgtaccaggttttggtaaatgattcttcttcttctcatattcagttctggtgcgcatatcctgacaaatccgggaatcgcgtactctcacaatttattttctactaataataagaaactccagtatacccgctgaacttcacgatccgttcaatctaccgagatcagtgtaaggtggtgtttggatcaagtgactcttatatcggatgaatttgaagtattaaacatagactacttaggctgcgttcgccaccgtgagattgggagatagtttgttccgttttccgcgcgcacgcttcccaaactattaaatggtgcgttttttaaaaaaattctataggaaagttgctttaaaaaaatcatattagtccatttttaaaatttaaaatagttaatactcaattaatcatgcgctaatggctcacctcgttttgcgtatcttcccagtcttctctatctcccctttctcaaactcagccttataaaactaattacataaataaaagctaattcacgtaacaaattttttaagcccacttaatctataattagcgtatgtttactgtagcatcatataggctaatcatcgattaattaggttttatagattcgtctagcgaattagtttaggattatagaatgagctttattaataatctatatttaatatttataattagtgtccaaaccttgatagggacttgaaagtctacacagtagtacagtaccactcgtatatccgcccaaatttttgggttcacactcggcggcacactcgaagctcccaacaaccaaccaaaccccaaagcatatcacaatcagtggggagggaagggccccttatttattcgcattcctctcctcatcatcactcatctcccttccctgtcgattaccttctctccttcctctgttcctcctctcctccacacatccaggcaggcaacacaagaatcatccgggagagcgaca

SEQ ID NO: 15992 - DNA, 1501 bp, Oryza sativa
ccttccacgctggtgaggcagagaggtacattgatggcggtgacaagggcagtggggtgaggaataagagaagtgacatgtagggcttagagggtgttgcaagattcttaaagccatcctagtattttaaaactcgagtgatattttttcgcattttcagctaactgacaaatcgcaagcctcacctaatgcatttttctttttcatgatcctccaagatgcaaatcaatcccacttgttcttatttttactcaaatatgctaataaatttgtaatgctacgaaaccacactcggaagatttgcctcttgccctttttttttttgccgggtcggccaacgaccaatttcattaagattggaaagaaaaacaaggagaatgttacaacgacattacaatgtcgcgctagtccgggagagatcccagacccagcgtgaacaagcaaaggggaaagagggaaggtagggcagaaccctgacaatacacaacacgattactctccaaaatgggagaagatcccagctaccctccacaccgcaatttcttcttttatatcctcggctagttgcttcggaatctttgacacatgctgaaaaattctagcattttgttccttccaaataagctagcaaattaacataaaggcgttgtcgaagtccaccctgtagctcgtcctaaaacggcgccgcgttgcaagccaccagtcagcaagcatgctgtcactgtccgccgggattgcaaagtttgcattgcaccatcttatgaactttcgccatacttcctcttgccctcttcccccgctgctgcatgtcaccaatagagatgaaaatagagcggatacatgcggatagcattcatatcacatcggttttcgtacttttagccggatatgaaaacaaatacgaatagctgggatatagacataaatatgaatgatctcgaatacaaataaggattgaataagaccagacacaatacataaacaaatatgtctcggaacacgaaatccacctaaacttctaaaatgtgtatccgtcggaaagtctaataccatatttgtattcaactattcatgtgggaaaaacatttgtatttgtatgattgtatccgtatctgtaccatcctaatgtattcaattttctcgataggctccgttttcatccctggccaccagcggtcatccaggatcatgcacgcgtttaccccccgcaacgcagccaaactcaacggcgacgcaacaagccacaacgctcaacgcatgccttgcgagaccggcaaagccatttccatgtcgaaccagtggaattcacggcggcaggcgcgcgcgagcatcgcatgcccaagctaaatctgagggaaggaaaattagcatgttgcttatatttggccgcagcaatggcgcgccatcgcgcgcatgccccgttttttgcgtgcgtgtggtttccaactttggctcgcccctccgggcgcaaacaccacaacacctcgcgcccatgcgagga

SEQ ID NO: 15993 - DNA, 1501 bp, Oryza sativa
ctcttagtattgtgacggtatagtttagatttaaaatttttaacacactattttttgcaaacaatgctcctggccagggttgctggtaaccaccagttaccagcagtttccagtaaggacctgaaccctgattaacatatctatataattccttatgtgatcttcttaatcatggaaaatcatcagctaaagcctagcccattctgtcagctcctctgataggggatcaaaatattaataaaatattgtcattgttttaagaaataacaaaatatataccacctaagtgggaatgccctataattcctatcattgatttaaccaacaagctaatatacagcacctaaaaggcaatgccctcaactattgtcattgttaaaatgtccctaatcattatcatcattgcctaaagtaggttaaagtttgaatgctttatacaagggtaccataataagttgatgatcatccaaaactctctcaacgactataaaacagtacaaaatttacacactgtcaaatcaactaatacaccgatgcagatgccaattaaactgaagatgatccccaagggaaacaaagcaagcataccatatgggaaaccagtatcatgtaactgagccagatccaagtcctctttcgcccggcaaattttctgatgccgccacaaatgactcgttccattggaatgtccatcagaacctttgcaactcatcagaatatggcagtagcggcattccgcgctttgaaccactccgtttacatagataggcttgtactcatcccacaccttggaccttttcttagttctcgctctgaaggcaacgtgagcttcatctgacgccacccctgacggcaactcgtcactgtcatgatcatccatgggatccataactgcctacaaagatacaccacaatcatattatttttacagtatgtggttaaacaaaacacaggaaaagtacaacaaagctaagataagatcatacgtaaatgattatgaagcatgcagcaagcttaacacaacaggcaacctcaactacagtctacagagagaagtcccaacaagagatgatacgactacgattttgtgcaaattagcagtgcttgcgagcttcaaccacaatttacaggggcaaggccacacgggagttcaactgaacatctggaccccaaatttttttcggaaacaaactgctcttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctga

SEQ ID NO: 15994 - DNA, 1501 bp, Oryza sativa
gatcgtgtcgtgtcgggccggcccattgtgccaagggctcggctcaggcatggccgaactatcgggccgtgccgtgcttgggttgggccgttgggccttggccttatggccatctacaactccatgtctagcataggtccgtatgcgatcaggaacccaaaccccctcttgctccccccgtggcctgagcacttggacaagcgccctcaaagatcatcccctaccagcggatgcgaccgtcatcaccgtttgccgtgtagcggatgccgtctgacaccaggctaggtcgacggcatcgcacaggcggactggactggctgtggtggccggcagcgacgaggatgggagggctccggtgcggcggagaggagggcttggcgaggagggtgtttggtggaagatggaacgaggtgaggcgaggcggttacgctggcagcactcatctcgtcgaagaagagcgaaaaacatttcgtatgatcaccaaaaaaagagacaaaaagatttcggaaattagtgaaaatgagaaaatgacaaaatccggcgcgggcttgagattgatatttttttcaaaactcattttaaagatggtataatagcaaaacctaaagaggggcagccatgaacaccttttgcatcttaaataaaagaaaagaaaatgaacaccttcttttgccactgtgacactgacaaggtgacccacctactctactcacacagcagtagattcagtagaaaaacaaaccgcaggcgcatcgcatttacaacatccgacacggcccccctccgagccaccccccgctccgcgtcctcctcctcgtgcgctctctctctctctctctcactcgctcgcttctcggggcgcctcctccacctgtctcgcctccccctccccctccccctcccaggaaactccgtggcggcgacctcccccaccgccgccgccgccgccgccgcagccgcagcctccggcgccgcctcccaatccgggaggatccctccggacccgccgattccctcgccgccgcccgtgtcctcccgccgccgggatcgatctccgcggattcgacggcttcatcgaggtatcctcgtatgatggctcctccccccccccacgtagcggctcctttcgagggggttggttggttggttggttggttggtcgggggggtttgaggtttgaggccccgatgtttgtttgggcgtgccgtgtgggggaaggtgtgggagttttttttttcctcgcgtgtaatttttggcggtgttggatcgggttatgggggatagctgggaggttagcgaggtttggggtgtgtggttgggatgggagattggttgatcccgtcgattaggggtgtcccgcggcgagatttggtcccgttgcgcatttctgtttttctttttttgaaatgacctgattaattcaatccagttcgtagggtgtagctctctgtctggatcagattaggctttagtttatccatgtgtgattgcttcctagatt

SEQ ID NO: 15995 - DNA, 1501 bp, Oryza sativa
ctcaccaacacaggtatctcgctcatggtcagggtggactcggcgtatcttcgctcatcgatgacctcactaccaaatcccgaaggctcacgccatacatccaattgcaacagtacctgtgattcccacgtcagagaggaagaagagcggagagaaagagagagaagaaagatgggaggggagtgaggtttttttttcttttagtgtaaagtggtaaaatataaacaatttggtaatcacgatgataaataatcaaaattattaggaaagacggtatttaagaaggtactattgaagagaataacaaatagtccaaaatccctctatcgtggcaccctacaagtacctttgtgctcctacttttaaaaaaaaacaaaaaaaacaagggactcctaccattgcgaatggaatcaccagtaaacctatgagaacaagagaacaaatgagaacgtggggacattagggttctaaaaatcgaacataactatcgttggaattttttttttactttctagaagtcacaccaatcatcggcggctctgccattgtactcatgtacgacccgcccgctgcctctcatttttattatcattgcgattttaaaaatcaaatatgattatcattggggtttattttaatttcatgaatggtgagatggagaaaagaagagtgaaagagagagaaattgacattcctcatgaaagggataatccctacacaaacttcaataaaaatatgagagtgttatagagtgttagagttattagagattataaattagagacaattagaacaagtttaatagtatagctaactaatatgtataataaattaactataaggttgactatatttctccttcatctttctctctataaatttagtgaaaatgtcttgtaatatttgcatgagaaccaatatttttcatttttatttatctctcttccatataaatttatagttgacttactattatcctcactcttacatataagctcttaatctattattatatgatatgcataaaattagtgacagctgataacaaatcttcaacgtgcacaccgacgaatcccagctactcccccatgcggagcattttccgagggatatatgcgtgcgctccctgctacgggctacgctgtgatccccgtcttcaatttctcgttcgctctcacgtgcgcgtcgcatctccctacaacgcgctgtcgcgcatgcattcgctcacgtgcgctcgcgtggcacggtggcacagacgtgcgctcgccttatatataccgtaccatggcaaatcgtgatttgcaagagagctataccgatcaccatcgcgctcggttgacccaagcgcgcggccatggcatcactctcccagctaatcacctgctctctatcatcaccgagcccctcctctccaggagcgagcttttgccttaagcctcgccgcggcgccgtcggacgggtctcgtgcacatcgtctcccgcggagcccgacgcctctagg

SEQ ID NO: 15996 - DNA, 1501 bp, Oryza sativa
tgtttagatcctatcaagctgtttcactgtgtcacatcgaatgttggaaacatatatgaaatattaaatatagacaaaaaaaactaattagatagattgcgtataaattacgagacaaacattttagcctaattgcttcatgatttgacaatgtagtgctacagtaaacatttgctaaatacggattaattaggcttaataaattcgtcttgcagtttacaggcggaatttgtaatttgttttgttattagactacgtttaatactccctccgtcccaaaatatagcaacctttgagcggatggaacagacgtctgtctagattcatagtactaggatgtgccccatctattcaaaggttgctatattttaagacggagggagtacttcaaatgtgtgcccgtatatccaatgtgacggcaaaaatttttacccctgcatctaaacagtcttaattagtttttcttttttaagagagagccttaattagttacattaattagttacatgtacatcttgtgtatttttagacaatagaaactttattaaaactaggtcaattacattaaaataatacaattatactgagcccacttccaacctctacatcaagacacccacagccaaaaaatgacacccacaacaaccaaaaagagatgcggaaatataatgtttaacacctatcaattcacacactagattgtcactcatactcatggctaaagtattcctgtgccatatggtccaactgtccaactattaagagaccatcggaatatgacaatagtgtctcaaagtttcagcttatagaggacagcccaacaaacgaagccattgcgtaactaaggaaataacttaaaaaaaaggagaagatccatttctttttgtaaaaaataacttcattcttgcataattaaagtaaccaacaaagagttgttacaccccattaacaaatttcaaaaaagtttccgaaaagccggtgaacatacacaaaaacggagaaaacaaccatggaaaaaagttgaaacacacttaaaaaaactgaaaacatactataatagagtagaatggaacgtttaatccatcttactagatcccgttgcaacgcacgagcatatttgttagtgagaagaaaattccgaaactaccaaattttggtagaataacattggtaagacaatgttttgtttgttaccctatcaaaatttggtgaatttgataacaccaaaatttggtaggtttgaaattgataataaagtgaacatgcccacttctccatataaaaaagtgaatacaggcagtttccggtccaatctcaccgctgcaaacgatggccataaaattctccatataataaagtgaatacaggcagtttccggtccaatctcacccatgcaaacgatggccataaagcgtaactgctgtgttcatgcagccaggggattatggatcgtgcctcaaatcgttgattagctagcatgagtcattcagtcttttgttta

SEQ ID NO: 15997 - DNA, 1501 bp, Oryza sativa
atagattggttggaatcaatcctttgttttaaagcactccatagattatctcccataaaataaaaattctctagagtttctatgttttccatttgttttaaagggggcctaattttctattgttcatggaagcttggaaaggccatcatatatgcatatatattagaaaaaaaatattcccttaaggagacaccctctcattttttatctcacttaaatagtcatgaaaagttaaaaaggacaagttaattaatatgagttcacaggcatgtaggtttaatttgacttttacaagttgtaaaaaaataaaatatttaatacgaatgtattatatactaatatactagtttcagtttagtttggtcttccatcacaactcgtagaagtgaaatttgacattgcatttctttaagtgatatatctcataaaaatctatttttttaatttcttttatgaaactttctatgactatttaagtgtcattcaagaaacgtgaatgtcctctcaggaaagaaaatctatctccacatatattttttggagacaagcaaaatgcatggtagtcctatgctagtactaattacccggtcggttgtttgatttggatttttagacttatagttcttgctttgttagattcagtcacaaatcaaattttgagctagctgcctagctacatgatacagaggaccaccaatgcacaaagtttggttgagaaaagaatagaagctgagatcgatagaacagaagctccaccatgtgcaatcatttcatccaaaatcttaagttgttgagaaaaaaaaatatgcacactagcttggtgataagcctggtaaagtttagacatggttcaccagctgctttttattatactttatgaggttttcaacatggatctcaaatcacacccactttaaacttgatgttctttcgttctttcctgcgaaaacgtcaggcgagaggtgcaatttaaaactgctcgtgatggcggcgggtagccggtagacatcacggcacggattttgatctcaacttctcaagtgccgttccgaaatatgcacggttttttttagttggcgataccaatataccattggcgctggagagaggaatcccgatcccaacggcgatggcttcatcaaagagttcttccatacgagatcagtacgaccacgacgacgctgggagatcccctgcaaaagccgtgttcataccggcaggccttcctccgcgctgaaaagattcccctttcccgccactttcccaccacgtacgcccgccactcgcgccgtccccaccaccgactcgccccccgcccaatcccggccgtccagtgccctccccgcgaggcacgctcgatgtcccggccgtccacgtggcccgatggaatgctgctcggtggtgccccgcgcgactcggtctccacgcctacgcatccacgtctccagccaggtccaagttggcacgtcgcgctgaacgcctcctcttctcccagcatcca

SEQ ID NO: 15998 - DNA, 1501 bp, Oryza sativa
ttgatcaaatcgttaaagcttgcacaggcgatgttatgataactaaatatccaaggaaatgtgtgcataccaaaagctgatggaagctggacgtcgagatcagacatgaaatttgctagttgagtttgattggtctcaaacagatgaaagctgatttctttgtctcaatgcaagctgcaaacattccaatcaaacgcatctaaaaaagataagtggccagcaagaagtgcatctccaaaacaaaattatttcttatcatgattgggtctgatggcatctatccaaaaaaaatgcacatgaaatcaaccagggaaacataagagatacaggctacagctcaagtacatccaacaaaaatcgaggtggatttaagcccggaaaaaatccaacaaaaatgcaccagtgccgttttacatattattatatgaccccatatatcctaccaggctaccacacatagttcctgttagggatggatttcttggtggtagaacagaacattcaacaatttatgtcaacgttgtattataaagcagatatggtcttgcaataagtcccactaattgggtaattcgcgcaggtacagaattatcaaaacgtatctgacgcaaatcaagcataaacatcaatacacctcccaacttgcaaaattaaattgtgttaactcatagacagaagccaattataaaatcgatcattctaagcagcaggaaatcgaaatgcctcttttacggacactaactaaaatagcgggatcatagcccatgatgtatgaacatattagatcaaaacaaaacaggtaacgtctattaacactaaaaattccccaaatctgacgcctgaattcgccctaaaaaaatccagcatcttcgcgtcgaggcaataacgaatgaacctaacctaccaccactttccactcccccagaccctggacaccaccacccaatcggacaaaacgatctccaaatcaacgacaggaccaccccccaatacctacgagatccacttcgctcgtggcgagatcacgaaacgcgtgaggaactcccaccacagaaggatctctcgtgcttcagacgcggaaaacggtcggaaacggtcggaaaaaccctctaccatttccattttcattttattttctcgaaaatggaatcggaacggtatacttggaaacggtaacgatatcggttatatcggtatcttggaaacggaaccgtcggaacgggaatataccgatatcggacggaagtcgaaaattcatgtcggaaacagcgaactgtggtatcatcccgcatttaactatgtatgaagatgaccttataatttcacccttgcatcattacgctgccacacaacaccgttatatgatgattaataagttgacaataagattgataaataatataaataaagttcaatgatacttcaacatcaatgtggctaaagcatacaatgtggcttacatgataggattacagcataactaatattgtccgactttttt

SEQ ID NO: 15999 - DNA, 1501 bp, Oryza sativa
gccaaaaatacccagcacgttgaagcaaccatttcatcttatgagccgattaatgagtaccacaaattccttcatgtacctcacctatcgcaaccttggcttgatcggcacttaaacatttaagcaacaccccatcaatcgtccgttaatatagctcatcatccaacaaggtgtactttaaagccttataatgtaatttcctcgaagccgattgagatggattttgcaaatattgaaatacatcatacctctaattatcggctgtgatcgcagcaacttctatttcaacatctctcaacatcggcttatatcctgatgcaccctgagccaagtcgttagcttctacattctgctctcgagacacatgctttaaagtgactagccgaaattcattcatcaattctcggcactttttattgtaaaccatcaatgtatcattcttgcattcatactttccaacccttcctttcaaaatcggagccgatagcatgtacttaaccacattggctttacataccacagtgcattcattggacaatagataataccttaacttggtgcaagagaaatacaaatacaagcacaacttttccacaggagaataccttgtttctgcatccaagagccgacgacttaaataaaacacaaccctttcttttccttcaagctcctgaatcaacaccgaaccaatcgacttgtcaccagccgatagatataatctgaaaggtatcccttttttggaggaattaaaactggtgggggaactaagatattccttgatattttccaaagctttctgctgttctgccccccaagtaaacttttgatcggctttcaacctcaacaaaggtataaaaggttctaatcttcctgataaattagagataaacctccgaacaaaatttatcttgctgatcaactcttgcaactttgccttgtcctccggaggttgaatcttttgaattgcattaatactcctttgagtcacctcaatccccttctcgtgaacaagaaatcccaaaaattggccagccaatacgccaaaagcacactttatcgggttcatcttcaagccatactttctagtcctctcgaaaaccttcctcaaatcggctatgtggttctctatttcctttggcttgacaaccacgtcatcaatataaacttcaaccaaccagccgatcagatcatggaatatgtaattcatggctctctgatatgtagctccaatgctcttcaagccaaaaggcatcacaacccactcaaacaagctgattgcacccgtacatctgaaagctgtcttatgaatatcttcttctgccataaagatttgattataacccgcattaccatccataaaactcaatattttgtgtcctgaagcagcatctaccaactgatcggctaccggcattgggtacttatcctttggggtagctttgtttaagtcccaaaaatcaatgcacaccctgactttgccatttttcttgatgactggaac

SEQ ID NO: 16000 - DNA, 1501 bp, Oryza sativa
gtggattaatctggccgatcatgtccataccccatcctctgaatggccacagtttgataataggattcatagctgatgctggtgctctttgaatcgctccaaacttctgacagtcttgacatcctttgtagtatctgaagcaatcttccaacattgttggccaaaaatacccagcacgttgaagcaaccatttcatcttatgagccgattaatgagtaccacaaattccttcatgtacctcacctatcgcaaccttggcttgatcggcacttaaacatttaagcaacaccccatcaatcgtccgttaatatagctcatcatccaacaaggtgtactttaaagccttataatgtaatttcctcgaagccgattgagatggattttgcaaatattgaaatacatcatacctctaattatcggctgtgatcgcagcaacttctatttcaacatctctcaacatcggcttatatcctgatgcaccctgagccaagtcgttagcttctacattctgctctcgagacacatgctttaaagtgactagccgaaattcattcatcaattctcggcactttttattgtaaaccatcaatgtatcattcttgcattcatactttccaacccttcctttcaaaatcggagccgatagcatgtacttaaccacattggctttacataccacagtgcattcattggacaatagataataccttaacttggtgcaagagaaatacaaatacaagcacaacttttccacaggagaataccttgtttctgcatccaagagccgacgacttaaataaaacacaaccctttcttttccttcaagctcctgaatcaacaccgaaccaatcgacttgtcaccagccgatagatataatctgaaaggtatcccttttttggaggaattaaaactggtgggggaactaagatattccttgatattttccaaagctttctgctgttctgccccccaagtaaacttttgatcggctttcaacctcaacaaaggtataaaaggttctaatcttcctgataaattagagataaacctccgaacaaaatttatcttgctgatcaactcttgcaactttgccttgtcctccggaggttgaatcttttgaattgcattaatactcctttgagtcacctcaatccccttctcgtgaacaagaaatcccaaaaattggccagccaatacgccaaaagcacactttatcgggttcatcttcaagccatactttctagtcctctcgaaaaccttcctcaaatcggctatgtggttctctatttcctttggcttgacaaccacgtcatcaatataaacttcaaccaaccagccgatcagatcatggaatatgtaattcatggctctctgatatgtagctccaatgctcttcaagccaaaaggcatcacaacccactcaaacaagctgattgcacccgtacatctgaaagctgtcttatgaatatcttcttctgccataaagatttgattataacc

SEQ ID NO: 16001 - DNA, 1501 bp, Oryza sativa
ttggccaaaaatacccagcacgttgaagcaaccatttcatcttatgagccgattaatgagtaccacaaattccttcatgtacctcacctatcgcaaccttggcttgatcggcacttaaacatttaagcaacaccccatcaatcgtccgttaatatagctcatcatccaacaaggtgtactttaaagccttataatgtaatttcctcgaagccgattgagatggattttgcaaatattgaaatacatcatacctctaattatcggctgtgatcgcagcaacttctatttcaacatctctcaacatcggcttatatcctgatgcaccctgagccaagtcgttagcttctacattctgctctcgagacacatgctttaaagtgactagccgaaattcattcatcaattctcggcactttttattgtaaaccatcaatgtatcattcttgcattcatactttccaacccttcctttcaaaatcggagccgatagcatgtacttaaccacattggctttacataccacagtgcattcattggacaatagataataccttaacttggtgcaagagaaatacaaatacaagcacaacttttccacaggagaataccttgtttctgcatccaagagccgacgacttaaataaaacacaaccctttcttttccttcaagctcctgaatcaacaccgaaccaatcgacttgtcaccagccgatagatataatctgaaaggtatcccttttttggaggaattaaaactggtgggggaactaagatattccttgatattttccaaagctttctgctgttctgccccccaagtaaacttttgatcggctttcaacctcaacaaaggtataaaaggttctaatcttcctgataaattagagataaacctccgaacaaaatttatcttgctgatcaactcttgcaactttgccttgtcctccggaggttgaatcttttgaattgcattaatactcctttgagtcacctcaatccccttctcgtgaacaagaaatcccaaaaattggccagccaatacgccaaaagcacactttatcgggttcatcttcaagccatactttctagtcctctcgaaaaccttcctcaaatcggctatgtggttctctatttcctttggcttgacaaccacgtcatcaatataaacttcaaccaaccagccgatcagatcatggaatatgtaattcatggctctctgatatgtagctccaatgctcttcaagccaaaaggcatcacaacccactcaaacaagctgattgcacccgtacatctgaaagctgtcttatgaatatcttcttctgccataaagatttgattataacccgcattaccatccataaaactcaatattttgtgtcctgaagcagcatctaccaactgatcggctaccggcattgggtacttatcctttggggtagctttgtttaagtcccaaaaatcaatgcacaccctgactttgccatttttcttgatgactgg

SEQ ID NO: 16002 - DNA, 1501 bp, Oryza sativa
cgtggcagcggcgcggggcgcgaggcggcgagcgcgcggcgcgaggcgacgggacggaggcgcggcgcggcagcgcgatgagacggcgcgcggcggcaggtggcgatggcgacggctaggggcgcgaggcgcgcgcggcaggggaggggacggggctagggaacctcatcgagcacctagtgcgcaatgaacagtgctagctcttatttaaccctaatttaacctattctctttataaatcttattctttaattcctaatttttccacaaatgaagtttacataatatttgtgttgtttcaaccaaaagattcactctagattaacattacccatattttatttttatataattttcttgaatttaatcagaattaattcttattccatcgcactaaaatttaattgttactaatatggtcgcgataatattttatttatttccaacctcacctaatctttattttaaattatatttcaattatttatttttcccgtttaattttaggctttattcctcattaattattctctattcgcgatctatgaactccgaaaccaaattccaatgaaataggtgaataaaatcggcatgatgcaatttatttaaaaagtttttgaaggcccatatttttagagttttgattttcgttggtcgaattttcagggtgttacaaacctacccccttaaataaatctcgtcccgagatttcttaccggttttcgaatagatgcgggtattccgtcttcaagaattcttcgctttccaagtggcttcatcctcagtgtgattactccattgtaccttatacatacgccacactttggtcctagtccttttttctgcttcatccaatatccggactgggtgttctggatacgtgagatcattgctaatatgaatttcttccaacggagcttgttcctccggcactcgtaagcacttctttaattgagacacatggaagactgggtgcacatcggcgatattttctggtagctgtaactgatatgcgacttctcctcgtctagccatgatttgaaaaggtcccacatatcttggcgctagtttccctttgaccttaaaccttttcgtgcctctcatcggagaaaccttcagataaacgtaatccccttccttaaactccaggtttcttctttgggtgtcagcgtaactcttttatcgtgattgtgccacttttaaacggtcacggatcaggcgaaccttgtcttcggcctctttgataatgtcaggtccaatgtaacgccccgattttcgttcgggttttaaaatcatttaataatgcatttcaagaaattatactaaaagttaaagcaatttattcgagcgaattaatgggagaattaaaattttccctttaaaaatcattggccgggaatattttggagtattctttgtgccctaaaatactctccgaaattttccgtgaattttcggagctcgagaaatagttttaatagcacaaagatcattgcatcaa

SEQ ID NO: 16003 - DNA, 1501 bp, Oryza sativa
ccacaggaatcggtccttatatgcgaatacaggacagtaccacataggcacaacccccgcatcgcgagttttttcaaacacaccgacgccacatgtcgggttttcaaggcttctcaaacccatttcccaaattatcgacaaacaacggtgtatgtggaatagttggtataagtgctcagagagcacggataccgaagtaccacaagggtggagcgacaaggaatcagggtaatacgacctacaggaattagtgcgactactgggtaggtccgtcggtttggcacgcaaaccgaggccaagcatgttaagtgtgtgattctaataatgtgagctgcaatcaaaataataatgattttccaattataggagcaattggtcaaagggtgacttgcctcgctcaaggtcttcacagagcttcacgaatcttcgagaaaacccgcgatcgacgaaaatccgataaccgcaactttacgcaaacaaacaaaaacctaaagaaaagaccaagaaaaagaccctatttagactaaataatagtgccattaaatagatctcaattttacggaattactggaagttgaacgaagtcaatcgggtgagcggttgagaagatatggattttctaaggattatttgattttctgtctaaaggaaaaggaattattaattcccttggaaaagaaaaggaaggagggatcggatttagacttcctcgggcgacttaggcgcagcccgagggattcacaaggcttggccggccattgggccgagcgcggccacggggaggcggcccattagggggcgcggggagagagggaggcccaacggggtgggcgcggtccgccgcgcggggtcccgagatgggcccgcatggcagcggtcgggtgtatggtggggagggcgcacgcggggacgggcgagacggatcggtggattgggtgcggatgcggtgcgccggtcgacaaggaggcggtgggcccacgtgcagcctcatggctcaccggggtccgcacgcacggggatgaaggggcgagggcgagcggctgaccggcttgactgggtcaagccgacgtggcacctatgccaggccacgtgggcggcgagaggaggaagaaggggggatgccgagatggacggcggacggtggccgagttcaccggagtttgatgcagaggtctagggccaaggggagcacaccggaacgatggctaggataagagggagtgagcctccggctcggattcgccgggggggattcgatggcgacggatttcgacggtggcggccggcggcgatcaaaaggggaaatcgcggcggggcgacgagaggtcgattcaaggaggagggagcatctccggggcgcggggaactcatttccggcaccggatggggcggaggactgccgaggagggctgacgacggcggcggcctccgggagcgggcggcaacggcggcaagcctatggcgggcggcggcgagacctggggcggcgtccatgcgtgtt

SEQ ID NO: 16004 - DNA, 1501 bp, Oryza sativa
ctaggaaagacaactagattcctgaaaacaacaagggaaaaggagaaagagtttgtgtctaagcaccgagaaaaactcctaggggactatgcatcgccgtaacccacacaaagctttccttcttgcacaatacaatcaaccattgtctctactgtggaaagtatcccctcaaagacgcgagtgttcctttccagcccaggtgccaggtaatcaaaaggatgagggaatcgaaccccttcctattatgatccagtagccgctggcgagaagactccaccaaatatgaagcaaatattgtcggcagggtgagagggaggtcaactcaatcttaggtagcaacttgagccaaacttgtcacatgaagacacactctaccaagatacaatagcgtttccagctcctacgcacacataggacacatggtatgactgtccatccctcggttgtgcattttatcagccgtccaactctgtaactaaagtgcaagcccgagaaaaaagctacactttgcgggacaagcgttgcgccaaaggaaggaaggagatcaatccctcaaagaacgcgttgtaggtcgaggcaatgttgtacccatcatccatccaacgctagatgaactcattttggatagagtcaggaagttctatactctatttcatagcgtaaggaattgggagagcatgcacacagtcagggcgctggtgatgtcatatatcctagtattgccggctaggccagcaacaaccgaagtggagtcttgacgacgcacagggacgacaaggaacagatctggggcgatcagttgaatcaactgtctgtcgatccagttgtccaaccagaacaacgagcgacatccatctccgatgacgaccatgacagattgactgacgcatggaaaatctccgacacacactgcacttgtggtaggttaatgttggcctagcaggggtctctaatgcgctggagccaagtccatcgcattgcatttgcaggacccatcctatgatccgtaggttcatgatttccagggccccgagctacttgatctaatacatcttgggttaagcgacaaggcaactcctaccatagactgagtccaatccattccaaaggaaggattcctgccatttgtcaacggttttcaagacccattcggcaacccgatggcaagggagaggtgcaccgggatggaggagaggacggacttggccatatggcccgaggcccaacggcccgacccaaggaacggccatttggcccggcccaagcatgacatggcccaacagtgggctgtgccggggccgatgccttgacacagtcggccggccggcatggcatgatcaaagaaaatagtagtgggatccaaaatagacttaatcaaccatataaggcaaggcccaaagagaagaggaatacaaaatagacatatttctagccatacaagacaccccaaagagttgagggatgaaaaagtagacttattctatggagaagcacaatatac

SEQ ID NO: 16005 - DNA, 1501 bp, Oryza sativa
atcaagtagctcggggccctggaaatcatgaacctacggatcataggatgggtcctgcaaatgcaatgcgatggacttggctccagcgcattagagacccctgctaggccaacattaacctaccacaagtgcagtgtgtgtcggagattttccatgcgtcagtcaatctgtcatggtcgtcatcggagatggatgtcgctcgttgttctggttggacaactggatcgacagacagttgattcaactgatcgccccagatctgttccttgtcgtccctgtgcgtcgtcaagactccacttcggttgttgctggcctagccggcaatactaggatatatgacatcaccagcgccctgactgtgtgcatgctctcccaattccttacgctatgaaatagagtatagaacttcctgactctatccaaaatgagttcatctagcgttggatggatgatgggtacaacattgcctcgacctacaacgcgttctttgagggattgatctccttccttcctttggcgcaacgcttgtcccgcaaagtgtagcttttttctcgggcttgcactttagttacagagttggacggctgataaaatgcacaaccgagggatggacagtcataccatgtgtcctatgtgtgcgtaggagctggaaacgctattgtatcttggtagagtgtgtcttcatgtgacaagtttggctcaagttgctacctaagattgagttgacctccctctcaccctgccgacaatatttgcttcatatttggtggagtcttctcgccagcggctactggatcataataggaaggggttcgattccctcatccttttgattacctggcacctgggctggaaaggaacactcgcgtctttgaggggatactttccacagtagagacaatggttgattgtattgtgcaagaaggaaagctttgtgtgggttacggcgatgcatagtcccctaggagtttttctcggtgcttagacacaaactctttctccttttcccttgttgttttcaggaatctagttgtctttcctagttagttttagaggcggatggccccatacggtagggtgggccggctggcccagcttgctaccagcccataccccatcccctcccctcccgggtcccgacgggagcattgagccacgcgctaggtcgttgagttgggctaggcccttgagtgcattgaggctgatcgaagtacaactactcaacgcctcgactccatgaacgcacgtagccacgcaccgccgtatgtagaaccctatccgctagtgctgccacaccagcaccacattgtgaacctgggagccgttcactgccgccttgttctctgccaccttattctgcatcattggcctcggttgtcctcaatttttttctcaatctacatcattagcctatgttgattgcagcagcaaaggaaaaaagaacattttttgggtgcgtatctccatccatacgtgatttgctcttctgggatttgtgttg

SEQ ID NO: 16006 - DNA, 1501 bp, Oryza sativa
attcacccatggtttccaatccctttcggcccaatataaggggtgagcttctgtgtcagtagaatagttagcgcacactttttccgttttatcgtataccaatctcagtccgactccccagcgctcaggcgcacccacgcgtgccttatgacgtccgtgccgctaattacataattagcaaaaattaccatcattagcattattttctagaaaacacatatacacataatctctatctctactattataaaaattaaaaatatttttgccagtactttggtacgtcatccattaatgagtcaattttaatttcgttcgcttttggaaatacatatctatatttgagttgggttttaaattcgttcgcttttgaaaatacaggaggggtcatgtaagaaatctctttcaataaaacttacatgctaacttgaaatgatcggacttctatttacagctcatgattttctagaaaaatatatatccaagcgaattctcacggtgacactattataaagattggagatgtttttgctagtactttggtacgtcatccgtgtataagtcgtgtttttggtacatcattcatatatgagtcggtttttaagttcgtttgtgttgacagaaaacacgtggcctaggagatctgcttaactccagtgcaggtccaaagctccccttcggatgttgttagcgtgccagttgatttgatcatgtaatcaacaagaaatagaagcaaagaaaccgtggttaaatctataaatgatagccgatcggctagatgccgatgacatatcatttatctttgagctgatgtcatctgtgtatcgatcggcagttatgaataagtaaagaagaactaaatctactcgatcggttgtagatattaacgatatatactcttatatcgatgtatacttaaatcaagtgattgggatagatcggtcaccatgccgagacagtataaatcacttagatcgaaatatatatcaataacaggactatatatgtttgtagcatagccgatcagatagatctagcatgtatcggctaatactccgatactactctatatcaagatattaaagcaagtataatatatcgagcaaaagcctaacattcttagacacatcaatatcttaatataaagggcagatttaacatatcattgaagcatatagaacaaatatagttaaatcagatacgatcggctgaaactccgatgctattctaatcggcaactagaaggcaggctagagatcgatattctaagcatgactcaataggtcaaactcaactgatacagcattaagtatgaaaagaagaacgatatctagacaatcaagccgctagaagtttcagagaatggtagatatctcatatactctagatcaacatcaagatctaacctaatcggctgccctctgcgtacagatattagccgatagtagattaggtggcgatattgctagagattatgtaagatatatgataactcgacgaa

SEQ ID NO: 16007 - DNA, 795 bp, Oryza sativa
tgcttcagcgaatttgtgatgatggacaccaggcgttgcggaaggtggatcacatggcatggaaccatggatggatagttcgtcccttatcctgtctctttttttttttttctggaaaacagaggatagtactggatttgagtatgaacataaatagtgagggaatatgaattcatatatggaggaaatatatgtcaagctaaaagggaattgccctggtctcccggcaaaaaaaatagagaacatcactgatcacgaatacttattagtgtgatatactatcacgcaagtaattatcatatgactattcgagcgatatgtccatatgaaatcagattagcaacttaacaagcacatttagccgtgtatatgatatgtactgagatttttcttaaaaaaggaaaataggccactagagcgcaggggtttccagcacaccttaaacaggagaccacaacttagtacgaaactaacactaaggcctggtttagtttccataacaaaaagctaacaaacactaaacgaatcttttaagactaattacgctatgatctgacaatgtggtgctacattaaacatttactaatgatggattaattagacttaataaattcgtctcgcaatttcctggcagaatctataatttatttattttgttattaaactacgtttaatactttaaatatgtgtccgtatatcccatgttaactaaggttgtgtttagttcagcgcaaagtttggattttggttgaaattggagatgatgtgactgaaaagttgtgtatgtatgacagg

SEQ ID NO: 16008 - DNA, 1501 bp, Oryza sativa
aatcttattcttattatacggtttaactaggatgaaatttactctggaaattcgcttttttttttttgaaaatcattagctgcaattaggagtctgactttcatctcaagttagcatgcgagtttgtttaaagatattttttatataactatttttgtacttccaaaaatgaacgaacataaaaagtgactcaaacaagaatcaatattttcaaaaacgaacgaaattaataaccgactcaaacaagaatgacgtaccaaaatatcggcaaaaaacttctttaatttttataatagtggagaagtatccatacatacgtacgactgaaaaaaacaatgaagctttacctactgttcatctaaagaaacaaataaacttacgcacagacttactataaagatcaataaagcataaaaaaaacatacgtacttagtaccattggagaaaaatgacgatatttaaaatatgattttctattatttaaagataaaacgtatcactctataaatttccataaatatcactgttgatttcatttaaattgataggcccgatcgattctttagaacattggataatgtatacattatatactaaaagtccattaaacttcctaaaagtgctcctatgttgtcatgtgttgttctacaaatgatactatgttcatcacgtgtcagtctaataaattactgaaatacttaagaaatctagaaaaaaacaaagcaaattttcattaaatttgatggacccattatttataactattggattatttttttttagaaaatcatctccttaacccgggcctacctaaaccagtacgtataagtttcattttttttaaggaaaaaacaaacgaatatatgtatgtatgccccctcttccctcaattcttttctctacatttttacccattccttcttctatttgcatgctttattagttagaaaagcaacaattatgtgtaaaacaataaagcatctacatcatataaataatttttgatccgttatgtaaaatcaaaggtgtttttgattattattctgtgatgaaaaattggcattgaagattattggttttgttatttagaatttattcacgaagtggatttcagaggtgattacaggttcattatttcatgtgaccgatcagaccgggcaggtgttgccggtcagaccggcgtgtaatgcgcggtcagatcggcgcagcccgcggtctgaccggccgactctgtgtcggtttcggtttcgagttgttccgtgattatgtcatgattatgggcttctagatggatactatacgtatgtaatactgttgttcgctactaatgagtcaagtttgagataacttggtctcggaatatggtttctttgtttatttcatgtgtaggtgacttgatacctcgggagaatatttgcggtgatggaccggaagtcggcttggggataagacgacgtccatggtggtcaaagatcatgcgggatacttaggctagagttga

SEQ ID NO: 16009 - DNA, 1501 bp, Oryza sativa
gatgatctaaaaggccatataatgatgaaaatttatttagatgattggaaagaatcattatgatgtaactaaccaaatccaccgaccacagagatagtagacccaaaaacagaaacagaacttggagtttagaaagctcgaatgcagctgatacagagagccctcctagaactgcagcaatttggagatttctctcaattgatcccaaagtcagatcaacaggagataggaaagcagaagtatcgatcccatttaacttcagctcatccaatgtataaagtctttgaggtacctgatatagatttcagtagaaaaaaaaaagactaccaagatcaaaatgtagagaaaaggaaaaggctaaagcttcattttatttaggcaaaattatgaatagcattagttgaaatcagcactaaatatatcctatcgccctctcggctcatgaattctttgccaaatcagtttaagatgcacataaaaatgctccaatctaagaacgaaagcagagcgggtgaatgcatcatcatcacagctgctaataatcgcgagacaacatcaggacaaatattacatgacaacaaaagccaacctgcctcgccgcgccaaagaaccggagcccgccatccgccccctgcgagccgcgcacgagggacagcgcggcctcgtcgttccccttccgcagctcctcgtccacctgctcgagaaccgccctcagccgcgccgccggctctgaggaggtattcgcggcgcgggcaggcggcagcagtcgcagcctgacggcggccgcgacgccgccggcggggtgcggctcggtgaagcagtagcagcagggcgcccttcccagcctcatcatctttaacacgtggaggccgaagaactgaggctggtaaaataaaccgagcagccaaacattatccaaaccaaatacttctacgtagaaagatcaaaaaaaaaactacgtagaaaaaattgattggccgcttatgtgggaatgacacatcctcgcaatggacagggatttctcgaaaaacaaattccttacagcataaatggatatttaagagtaagattagagcagcctttttaatcaccgactttataatagaataaattaaaactaaataagtttatataatctaatatgatcgtgatgcttacgataattttgttcgaagagtattatactcttcgaggcaactcaccattttttatatttttagactaagcatttcttatttatgctgccatatttatcataaataaaaaatagatttctatttttttataaaaaaacatggtacaaatgcaagtgccctcaacgcatgtgtcacaccctaaaaatcctaaatatataaattgttgtttaattggaattattagaatttattttaaaagcctagaagagaagatctaattttaattaataaattccaatataaaatggggccagataaaattttattaaatacttcgcttaattctataattcctagatttttct

SEQ ID NO: 16010 - DNA, 969 bp, Oryza sativa
atagtaaatgatttcaaatggaaatatggtcaacaacaaagttgtagagcctttcaagatctacaacttttattttggtcatttttttccaacagtttgaaattgaatttgaatatatgacaaatttaaacatcatctgtaaatagtaaatgatttcaaatggaaaagtcatcaacagcaaagttgtacaactcatcaagatctacaacttttgtttcggtcacttttctgtataacttttccccaatagtttaaaattcaatttgaatatatgacaaatttaaacaacatttgtaaatactaaatgatttcaaatggaaaagtcataaacagcaaagttgtacaactcatcaagatctacaacttttgttttggtcattttttcatccgacaaagtgatagtaatattattcacaaaaatcacatttctctcatctggtttatgaacatcaatactgatgtgtcaattttctaaacagtgttactatcagatgaagtagtgaccaaaacaaaagtgatagatcttgatgagttgtacaactttgttgtttatgaattttccattttaaatcatttagtatttacaaatgttgtttaaatttgtcatatattcaaattgaatttcaaactgttgggaatatagttatatagaaaaatgaccaaaacaaaagttgtagatcttgataagctctacaacttttttgttgatgacttttccatttgaaatcatttagtatttacaaatgctgcttaaatttgttatatattcaaattcaatttcaaactgttgggaaaaaagttatgtagaaaaatgaccaaaataaaagttgtagatcttggtaagctctacaactttgttgttgaccatatttccatttgaaatcatttatacaacagttatatatattgcactcacagatataaatacttcaaatggaaaaatagaaaaatagtcatcggtgacgggcg

SEQ ID NO: 16011 - DNA, 1501 bp, Oryza sativa
aacctggagtcagaattttttttttgttttatcatgtctcctctgttgcggctgttgccttcagatttattagaccagttcatctcaacccagaaaagaaaacaactgaggcagtaactttccagaagcacatgtaaagaacaaaaacatcactgtttaaaggttagtaggagcattagtacttattttttaaaaaagataatacagtattagtactctaaatctaattaggagcacatagctttctgtactatagcaagggaagagtgagagtagcttccaagggagacataaaagagaggcagcaactaccaccaatacttctacttcctcaagaatctctcctcttcttttctatccaagaaccgctcaaaagctcgaaccttgcgcaatctttttaaatcctcccgaccatttcctccgggtttgattctgggcagagattgcgaggggaaagatacgagcttttcttggcttctttcccctgcattgggaaagatacgagctgttgctgttcttgggaagaacagcttgggacattcttgggttggggtttgattcccaggtaatggaactcttcttggtttctcttggattccgtgcagtatttctgctgtttttagtatataaatctgtggcaaattacgctgcgcctgtgttggctttggttgtggttgcttcatttggtttcagtttgttcgagccttcgaggatttgattctgtttaggtgcagttttggaggaagttgggttagcgtgttccatcagccagtttgagaagtttttgttaattcgatgttcagattctgctgggtttattttgggttttgctgaactttattctatgtcagagaaactttgatcttcagctttctcgaatttgagcagaaatggcgtgctcaggtcgatcgtttgcatgttgaaaaggattcctttcttcaagtttcagggtcctctttgcagtttgggatgattttgccaactgcagaatttcaccctgctcaactgataaactttcccctttcttcaatgaaatatcctttctttctttctttcttttttttttttgcattttgttgtttagtgctagttcatggatgatttcctcaaatgttaaaagaattatatttctctggatactgcatttggagatgcctaagttgctccaataattgagatagtaacatagttgtttacttgcatggaaacaaagtttaaactgttcgtttgtaattgatttgacctgttaaacatgtaaatataggacatatagaagatgatgatagggcaggtgtcactttcatccatgttgataaaattaaaacttaaggccttctccttagtccttaccaactagtagttgccttatttaattagcacaataaatctgagacatttctggttgtcttttgggttgggtggacaacaccatttgcaggggaagaaagcatgaggctatggtttctcatacctcttcttctctgtttccctacattgattc

SEQ ID NO: 16012 - DNA, 1501 bp, Oryza sativa
cgtatggagtaggtgtaacttcaacctcgaagatttcaatagactcctaggctccggagggatcaggagtaagcattttagcggaagatacaccaagagttacaaaatttagctcgacttataccggaatatgctgtttgcacttaattttcttagagtgctcttcagtggtcatggcatctgtactaaggcctatctgaattaagcaaaaaggaaattaagaagaagaagtaaagtgtacagaagtgattacaaaattgacaaaatgagccaacgggagctttagacatctatccaatccatcaatccagcagttagtacttttctcgaaggagaagaagctcaaaatgtcaattttactcatgttcattgtatgtacttttctcgaaggagaagaagctcaaaatgtcaattttactcatgttcattgtatcttctgtcccctttgatattcccctcaccgccacgtcatcatcagtcataccacaatctcgctaccggcttgtgctcatccaagctagccacatgcatgaagtatgcgcaggcgatctagcctaatccaagatacacttcggcattgtcccattgcatcctctagctgacatattcgtggcatgttagtgcacagcccgacccaacaaccgtgggccactcaagtcacattgggtctgcttcaccacagactcaaccggagccacaacttttagatcctgggactatacaacccaaaagattagtctgatgggtaatgactgcccccaccttttaagtcatgtacccgatcatcaattaccgatgtgggagtaaaccgaacaatatcctctgtgacacatcaggcgtaacagtctcccccgtcacatcaacccatgtggttccgaagacttgttacatggcctctccaccatgtgagctatggaaatcgttccggatttcgaaactgggctctgataccacttgttagagtgcgcagctcggcccaccaaccgtgggccacccaaatcacattgggcctgctccaccataggcccaaccgaagccacaaactttaggtcctaggcctatacaactcaaaagactagtctcatgggtgaggactactcccaccatcgaagtcattctcccccatcatcaattaccaactgggactaaacccaacacggcatgcctcaagatcagtgttaatgactacctccatgtaaccagaagaacggatctggatatattatgctaagatcgacaaccaattatcaagttggtgtgctagaagactaactgatgcagcagggtaggaaaatatggtttcgatcaacgcaggttcaatagcgtttgagaataattttctagcatgcatgttgctaaagcaacaagcatagcctggttagaaatgttgatctgcaggcatttacagactgaaaaccacatttgttttcctttgtttctagttgatcaaattaccttaaactgtgcctatatggggaggacgagtagaggacggctaggg

SEQ ID NO: 16013 - DNA, 1342 bp, Oryza sativa
ataaatacatttgatctcagatctattagaaaatactttaggtattgtatttttaattaaactacttaaattgttctaatttaagtgtatattattaatcagaaggtttaaaaatctatatgatttttttcttaaaaatgtatggattggatcagtgaacaatagctagtccatagattatatatgacccaaagtaatgattatttagattttactaaataatctaatggtgtgcaccaataaaaagtttgctatatgatttagataatataattgtttaaaatttatcataaaatattttttccatctaactaaatgaggaaaataggagataaaggatataggtggggaggtacatacgcacaaccagatgttttgattattctcataatttttattatttttctaatttaacaaaatgtcacgtggcagcgtagaagtgtttgtagaagtactacatggcggcttgagagcgtttacataatgtttaatgggcaaatagctaaatttgcttccatgtgataattttcaaatgaaaatatagttaatatcaaatatagtcgtagtattttccctatatacatctaattctgataagtttattagggtcgggtggatgtttcttgtatgtataaaaattcgaggagggaagaattgtccgtagtatgtacatacccaggagattttatttttctcagtcgtggatagtagcacgtattatacatgtgagaattttttcattttttttgctgagcattacgtatgcacggttctctcgttgcaattaggtgggaccgtggcatggccaatccttcttcttttttttcaatcataattatgtattttgttcctttttttggtgagtagcaaaatacggaagtacatatatgtacgtatatgtcacgccccgatttttgtttgggattaaaaatcattaaataatgcatttctagaaatttatattaaaatttaaatcaatttaatcaagtaaattattgagggtatttaaaatttgctttaaaaatcatggccaggaatattttataatattctatgtgccctaatatattctctggaatttcctgcgaatttttggagctcgagaagtaatttcaacaatataaagttcatttaaccaattaaataaaaagaaaaactaataaaaaatctcctctctccctttgggcctcttccggcccaaggtcccttgttcctccctcgcagcccgctcggcctccctcttccctccttacagtcgggccggcctctccccctcggcccgaccctttgccaagtctatttcgcctcctcccatcacctctgttcctccctcgccgacagg

SEQ ID NO: 16014 - DNA, 1501 bp, Oryza sativa
ttccatgtcgccaaacttgacttctttagttaacaaccataaaatctattaattgatttgtagatgcccttacctccattcctagcacttgtcgtaattatgggcaataccagagcattatgttttaaatttaggagagaacattccgaaaataataaccataatatcctatgaaattctcgaataaaattgcatctaaaattagacatttggcaaaaattaatgtatttggtgttgtatgtattatttattgtgttgcttcattaggtcaatatagtgaaacaaaacaagcatgtccgccgcaagtttctcgtcatttggatcattttgcatgacatccaaacggataccaattacttaagcaaaaagtaacaatataggttgtgttatcatatatcactttataaaaatttataacaaaattagacacacaacataaaaaataaagcttgcgcgattttgttctttacggttaaattaacagtttaatcccatgtcgacttactttattttataaaaaacgaaggctattttctatcatattcttactcatgcaagtcatccaaggccatctccacacccaaggtcatctttgctggtgttctgaattttaatgaaattaattgagacattgaaaacaagataaggttttcttaaaaaaaaatcaaaccaacaccttgaaaatgcaccagtcaagcacaagtggcagccaatagctagcatgtggtctggcaacgagcaacttgccaacgatgcaaaagctcagtgacgactcatggcttagcacatcctggcgaagcattatatggcagcaggagaacaaccagcgatgtacatagtgtagatggatggccaaagggtgctcaccagcaaccatcgcacatgaaaaaacgctataggaccgaaattatcttcaatattagaagctctaactgctcgatcggaaggatgaagaaatctatcagcggaggcattgtatttggttgtgacagcattgtttatattgggaggaaaagtgcttgatggatatttttttattatgaacaaggggatcagtccttcctagatcttgcacttgttggaattaatgaatgggccttagcccactcgaagattaattctttggaaaatcacaaaagtccacctcatgggatggcatgcatgtggagtttagtatcccccttgcttattctaggagagggggacctccttaaaagggagaatgccctcctagccacttgaagcatgtgtagtagagagaagagggggaacacgcgcgcgcttgctcgcctcgcctcgcctgcgatcggggccacctcgatacgtgttcaatatgttgcacatatttgatctgttcttgttatactgtgtagatctaatgatgtgttcatgctagtcttcatctgtaatgtcatgatttatttatggaatagattaaatcattatatgcctataatctcaacaatccaaaaaccttattataggcactgtgattctacta

SEQ ID NO: 16015 - DNA, 1501 bp, Oryza sativa
ggacatcgacgtgcagcggatcacctcggccgcctccgctgtgctgcaagcctggttcctgctgtcgccggcgtaggaggaggtggaggccgacgacgtcgacggggagaaccgcttgtgcgggtcttggaacgagacgcggagctccctggaggcgttcatggacgtgggcgcgcgcggcggcctcctcatctcctccatctccaggtcagggtcgagcgccagctcgccgccggccgccgcctgcttgcgcaagaagctgccaatgagacgcgtgggcgggtcgtcgctgccctccccgccgacgctcatcgccggagacgcgggcgactgcggcggccggttcttgaagctgaacgactcgccgttgcccccaccgcctggcgaggacgacgcgctcgacaccgacccggaccccgggaccacgccccccaccgccacgccgccagcgcccggcgcgttggcggcgtggctgccgccggcgtggaggtccaccggcacgtgggcctcgggctcgatcttgacgacgacctcgcggcggtgggcgtcgtcgtggcggcggtcgcggtccgggtcctggtcgtgctcgaagtcgaacgagcccgaccgcgacgacttgtccgacgcatgcgacgtgatgctgcccttcccccgcggatccatcgcgcggcgggaaggcgagaccgatcaatcgatcgagaccgggcaaatctaatcagcgcccccgaaactcgccgacgaggctcgccggctggcgtgggtggacgcgccggagggacacaggcatcgatcgatcgcgcgcgtcgacgcacgcacgcaccagcggcggcgagaggtgtgctatttcgaggaggaaggctttttggctcggcggggagggcggcgcgagagcaacggggtgatgagcagtggtcgtctaagctacccgggcgcgggagcgtcgcgggcgaggattatatatgcgtgggggggagcggggcatgcatgcgccgggccggagactgctcggaactcggaaggagggaagtgatctccgcgaccagcggcggcgcactgtgctggtcattttgggcctctcgctcgatctcttcattacggcttgaaaagaaaaggaaaagggaaaaaagaaaaagggagaggggctttcgttcttccattgatgtgcttcgcgggatctcacgtgcgtttgacccacttctggggcagagatcctccggaaacccgttgctgatagcaaaatgtgtcgaaaatttgactccatatgtccagttttaagtgtatttgtgattttttacgtccaacgtttaactatacgttttatttaaaattttatcatgaatattatttttattgtttttacatgataaagcatgaataatactttatacctaacttatttttttaatttttttaataagacgaacagtcatacattggacacggtgtcaggattacggataaactataccctctacctttggatgtacgctatacggtaata

SEQ ID NO: 16016 - DNA, 1501 bp, Oryza sativa
cctagcagagctcctcgcccccgagcagagccacgcgaaaccaagccaaaacgagggcacgagaaggagaggaagaagcgaggtgcgcgcactgtggggtgtggttcttggccgcgccgtccccttgcgccgcatcaagtgaagaaaaccccaatttgcccacgattcttcccgccaccgaaacaccccaagcaagaacgcagaaaaaattacacgatccgtcccaagaaacagaagaggaatcaccaagaaacaacacatctcacatgcaaaaaaaaacaacaatcaataatctcgccaccacgcgccagcttcctcctcaccgcggcttcccgtcggcgtcgcgccgtccgcttccgccgcggccaccacatccgccgccacgacccgcaaatccggtggcgaatccggggccccgcgttgacgaccgccaccacaactcggatccgggcgagccaagtaccggcggccggcgtctgcgtgccgccaagaaccggcgtccgcgtgctgccaaaaaccggcgtccgcgtgccgccaagaactggcggcggcggcggcggctgccgcactccccgcgccgccggtgccgcgtggctcctccatgggcgcttgcggctccgccgatgccaagccgctgcagctgcgacgcggtgaagtaagggagtgggagagggagaggggaggtgcggcggatagatccaccgccaccgctgtcgccacgacgaccggcgaacccgctcctcctcctcgcggcggcggtggcggctgctcgggatctccctcggtgaggtcgccgcggtggaggcgtctcgccgccgcagcagtcggagaaggaggcgcgacgagggaggcgacgaggacgacgggaggcgaggaggacgccggagcagcagcctttcccctcctcctccgccgcccccactgctcccaccgtcgggagaggcacggcggcggaccaggaggaggcgcagcggcgaaccggcgcagcggcggacttggaggggaacggcgtgggaggctaggaggcgaggagcggcgtgggaggcgaggaggacgacgggaacaagggtaggtgaaggaatagatttccttcactcgcccgtgtctttaaaaccgggtcacgcgcgttgtggggtttattcccttgcacagtatctccatccagttaggtcacgcaaaataggatacatgcactatgggaatgagtgtctttggggctttcttttggactaagctacttggtccggtgtttgcactgtgaatggcctaagtcaattcgatccgacgagacttgatgaggtcaagcaaacaaacaaaaacaaacgccaaaatcaccctgtttttgggaatttccacgaaaccacacttgtttgtgccataaaatggacgtgacatttgccttgggcgtcttgtgtttgtgggtgaggtagccagctgccagccatggatcacttgccactggccgccgcggcggcggcggcgtcggcgccgtcgccggctg

SEQ ID NO: 16017 - DNA, 326 bp, Oryza sativa
cctatctcaattgggccataattaaagcccgtcaccgatagttttgacccagacgatcagtcaaactatagcctgtcacggatgacctatctcaatcaggcctaaactatagcccgtcacagatgacccttatctgtgacgggcattaactatacccgtcacagatgagtcatctcaatcgggtctaagttaatgcccgtcacagatgagtcatctcaatcgggcctaagttaatgcccgtcacagatgagtcatctcaatcgggcctaagttaatgccagtcacagatgagtataatcccaaaaaaaataaattttatttttagg

SEQ ID NO: 16018 - DNA, 1501 bp, Oryza sativa
ataaccttgtgaccgatgcatttgtacttatctattgtaatgaatgaagtattttgttttattgcaaagacttgatatgtgtagtcattaatatggctaattttgttttattacaaatgtccaaaataaaagttgtagatcctgatgagaggatcaactttgttggtgaccatatttcaatttgaaatcatttagtatttacaaatgctgttaattagatttgtcatattgtcaaaatcaatttcaagctgttgggaaaaaattatatagaaaaatgaccaaaataaaagttgtagatcttgaaaggctctacaattttgttgttgaccatatttcgatttgaaatcatttactatccgaaaatgtattatgactaataaaatgaattattatacatcagctatatattttgtactcacaaatataaagacttgtttggaaaaatggaaaaatagtcatcggtggcgggccttagttaaagcctgatagagattaatctatctctatcgggcattatcttagggcccgtcacagatgactcatccgtgacgggcctgaatgtcatttcaatcgggcattagtatggagcccgtcaccgatgagtcatctgtgacgggccctacggtaaagcccgattgagatgactcatcactctactataactagggtttctcagatcggatcgaaaatttttctaagtcccgctacagtttcccgtctccttagaaccctagcgccaccgtcgtcctccctcgccaagcccgccgccgttgccaccgagcccaccgccgccgccgtcgtcctccctcactgagtctgccgctgtcaccaccgacgccgaggccgaggccgaggccgccgcctccctcgctgagcccgcggccgccaccaccgagcctcctcggccctccatttggacctccgccgcctcctcaccgacgacccccccgagcccgccgccaccgccaccgagcctctacaccgaccggaccggtgtcggccttcctcgtcgtcgccgcccgcgtcctcaccgacacacgtcgccgacgcccaccgagcccaacgccgcccgcccggcgccgacctgcccgaccggcgccgccctccaccgagcccagcgccgccgccgcgaactcctccttcgccgagcccgccgccgccgccaccgagaccgctgcctccatcgagcccggcgctgcctccactgaccggcgacgccctccaccgagccccaccggtcatcctcaggtgagtcctccatcgtgccgccctctgctaactgtgaatgacatgtcattgaaatgtggatgtagatgatatgtgattgaactatgagtgagacatgtcgatgttgggatgaaatgtggtgcatttatgaattttgtgatagatgattgtagtgattgatgaaatgtggttcatttaactttatttatatgcaatgtggttcatgttgggatgaaatgtggtttattcatgttgggatgaaatgttgtgcatt

SEQ ID NO: 16019 - DNA, 1501 bp, Oryza sativa
agcgacgcctccgcggtggcgtaccgggtcgccttccaccggtcgatcatgccgctcggcgccgccaccgcggcgccctcctcctcctcctcgagctgctcggccttgggagccgagagcttcgtcccctcctcatcctccttcttgggacgcttggcgacgccatggccacggacacggccacggccgcgcttcctcctcctcttcttcttcttctcctccgacgtggtgcgcaccgccaccttgtgttcgacgtcgtcgtcttcttctgccgccgccgcctcctccttcgggctctcgttcttggccttggcggagctcgcctcgtcgtcgtcccgcgcggcgtccacggcgcgttcgggagcgtggtggcgcgcgaggtggtggtgcctcccgacgtacctgacccgcttcctgaccccccacccgacgccgctgcactgcagcgtgaggaggcacggcgccaccgactccgccgcgggggacggcggcgacgccgggacgggcgcgggcgacggcggcgccggcaagaacggcttctgctcctgctgggagaagtcgtagaggcgcggggcgccaccggcccagaagtcgccgtcgcccaggtcctcgccggcggcgcggcggcgcatgacgcgcgaggcgttgacggcggcggcggtcatggctcacaggcgacggcgagagagagagagagagagagagagagctgagaggaggaggagaggtggttggtggtggcagctttgctgctgctgcagtgcaggagacagcaatgcaaagggaagaagaagaggaagaagaagacgagagatgagacaaaacagagctggatttttttattttgaatcaagaaaaagaagaatctttggtgagagagtgagttgttgttttgtagtactactggaggagtactccactagtatcttctttgactgcaaggaatggcttggttaattaggatcaagctaatccttaactgttaaacaaagaccattttgcatgcagatgctttctgtactttgggctctggcattgataatctgtttatccagaaggttgatcaccatcattacttctgaccacaatcaacttcattagtacccctccgtcccaaaataagtgcagccatgattttccgcgtccaactttgatcattcgtcttatttgaaaaaaaaataaaaacataagtcacaagtaaagtactattcatattttatcatcttataacaacaaaaatgctaattataaaaaaatttcaaataagacggacgattaaagttgggtgcagaaactcatggctgcacttattttgggacggaggtaatactacttccgtcttattttaagcgcagttgtagatttctgtatccaatgtttgaccatccgtcttatttaaaaaaattatgaaaaaaattagtcatattttattatccgataacaataaaaatactagtaataaaatatttttaaataaaacggacggttgatataaatagat

SEQ ID NO: 16020 - DNA, 1501 bp, Oryza sativa
catgatatgctaattatatatgattattagattttttattaattttaaatcatgcatgtggtatttacatatgttaattagatatttcaacaatttaacatcatgatatgctaattatatatgattattagaatttttattaattttaaatcatgcatgtggtatttacatatgttaattagaattttcaacaatttaatatcatgatatgctaattatatatgattattagaatttttattaattttaaatcatgcatgtgctatttacatatgttaattagagtttttaacaatttaatatcatgcatgcatgccctacgccgccgggcccccaagccgccgccgcgcccgcacgtcgccggaccggccaacggcgccccgacgccgccgcgagacgccgccgccacgccactgccgcgcgcgcccaacatcgccgaacgtgaacgaacgtgattgaaacgtgaccgaacgcgaacgaacgtgaacgaacgtggacgaacgcgaacgaacgtgaatgatacgtggacgaccgtgaacgaacgcttaacgaacgtgaacgaacgcgaatgaacgtgaacgaaacgttaacgaatgcgaacgaacgtgaacgaaatgcttacgaacgtgaacgaaacgttaacgaacgcgaacgagcgtgaacgaacgtgaacgaaacgcttacgaacgtgaatgcgcttgtactaaaagtgtgagaacgaacgcgtttagactaatacattttcctggtaatacatacaagattttatatatatatatatatatatatatatatatatatatatatatatatatatatatattaccaagatttcctggtaatgttgcagagaagacgtcgccgtcgtccctcaagccgaagtggtagctagccatcaaaggaattcgcgcaggcaagtgatgtaaagaagtgattgttagagatttaatataagattgttagacttagcatatatgattattacaattttaatataagatttgtagcgatttaatataagtttgttagacttagcatatttgattattacatttttaatataagatcagtagcgatttaatataagattgttagagatttaatataagattgttaggcttagcatatatacatgattattacaattttaatataagattagtatgatttaatatgagattagtagagatttaatataaaattagtagcgatttaatataagattgttatacttagcatatatatatgattattacaattttaatatgagattagtagcgatttaatataagattgttagacttagcatatatgattattacaattttaacataagattattagagatttaatataagattgttagacttagcatatatatatgattattacaattttaatataagattattagatatttaatataagattagtagagttttaatattacggttagcaaatatgacctatagacctaacaaatattttttgtatgcacaga

SEQ ID NO: 16021 - DNA, 613 bp, Oryza sativa
aggtcgactaccctacgatgggtactctgtggtgccgtcgtgtcacaccccgaagttctcctcccaagccaaaaatttaatttataagcgaccctaagaaaataccggtgcaaagcaagagtaaacccttttaaatcaatgcaaataataatcggaagtggcatgtggaatttttcttgagttctacatgtcgaaatccactaacaggatttttcgtggaattttcagagccctacaaataattttaaccaactaaaattgagcaagcaatattttaattccaggaaaatccttttctcctttttctttttctttttccctccctttttcgaatgggccgctggcccattctctccttctctctccctcctccctgctgggccggccgcaggccgaggcccagccaagtcgcccctccctctctccccgggacgccgacaggtgggccccacttgtcggacacgtccccttcctccagccggcgccgccgcgcccgcaaccgccgccgcgcccacgcctccgccttctccgggccacgtcagccacgtccgcgcgtgcgccgcatctcccgcgcccactcccctctctctcccgcccgcgcccgcgcccgaga

SEQ ID NO: 16022 - DNA, 1345 bp, Oryza sativa
ttctgtttatatatattcaaacgcaatgtacaatatatgcccgcgcgaatacgcgggctaccttcctagttattctaatataaagttagttgtcgaacttttaaaaagctcaccaaattttatcataaatgatagatatttctgaagggagggagaagcaaatattttaggggagcactacattttttttttctcgatggtgcggtaacactgggaatacaccacaccaatacaggcgtttttttttcttacagggaaagggaattgtattactcagctaataattactcacggtccaatgtaacaaactaaagcattgtactatttctccattttaataaaattcaggtagggaaactgtcccaagtgatcagtctgaaaaaaagacccggtaaagattcggaccaggctttatttgctagggtgtgacttatactattgctgcttttgtgcatagcgattacggagtacatgtgtatccttatacagtatttatctctaaaatgattttcatcattaagatgatgtcaacaatacagggaaaaacaaaactcatgcgtctagcaagtctagggtaaattaccttaaaagaacaatatttgattacctaactatattgttatcgtagattttttgcaccatttttaaagaacatattttttttttcaaaattgtcttctatgaaactagttagagcactttttctaaaatattccttccgtttcacaatgcaagactttctagtattgcccacactcataaggccacactcatccttataagtgtgggcaatgctagaaagtcttgcattgtgaaacagatatttgtttagtttatttcttaaaatagttggtttatccgagataatcgatggtaataatttagcggacaatatgtttcaaacagggtaataggattacgacgagagtgtacggcagtgcaattgttgacaaaacaataatttgtgagtaatagataaaactaccactagcaaaacaaagatatttagtacatcccggttttggggataaagcctgaagataacaacaacttgtagaaactaaatgctttccaacacaaacctacaaaaataaatgcaatggtattattaataatcgataaaagggaaaatagtaaacgtgaatagtcacgtgtaacatgtataaacagagggaaaaaaaaaccacacaaactcgggaattcatagcacaaaaatagcgtcctccggagaggaaaaacaaacaaacaagtcaaaaaaaagggaaaaaaagagcgaaaagaaattaaaacaggagcccgtgtgcgtcgcgaagcattcgccattcggcaccccgcgaagcgacca

SEQ ID NO: 16023 - DNA, 606 bp, Oryza sativa
tggcagttgagcactgtcgctgttgattttcgtatatgaaattttgagtatttttatgtctaaataaatttggcatggatacccgtgctttgctgcagaatatatgaatgaatatgtgttatatgttataggaataatatatgtatatctttaaataatgtgaaaatgatgtaaagataataatttgacattgtttgtatattgagttctaaaaatagaacaaaattgtaaatgatatgtcatatttgcgtgatacttaaaatactctagataataattgctagtgagtaatgatatggcttactcacatgttaagttttacaagttattaataagcatcaattttatagtaagatgggatacaggctccctctgttacataaagtcctaatcatatcttaatttttaccactcctatagtcctattctgtaacgctccgcttttcgtgagacgttaaaaactaattcggcaaaatcctaattgcgaaaatttcgttctttgagtgttgagtctaagctgtgccaaagatctcaatctaaatccctcccttgtctcgataccctgttgcaaagatcgtctcctcaaaatttccatcccaatatagt

SEQ ID NO: 16024 - DNA, 1501 bp, Oryza sativa
aaatccattttcgaaatctcttttatgacccctcgaccggagagccgccgccaccattgccgccgccgaccgcctcgggagctcgtcgccacgccacctcggaccgcctccgcccaaaaagaacgcggggtaagccaccacatagtccctaggtgcttccctgtcctttaatcgagtcgccgttcgccatagccgccggccgccatcataccgaaccactgccgccgcttgccatggccagccgcctctagccacccccggccacgccaccgccactaggagatgcacgtgaacctcctctagccacccctgcctctgccctagccagccccgcggccgctcgccgccggccagcccatccggagccgccctcgtgctcccctctgtctgttgcgaacggaggaagaagacaggacctgttcgtaaataagaaaaactctagggctcttgatacaaagcgccaatacacttacatgttggaccgagacctagatctcaatagccgcaagattagggtctgttctgtgaaacatcgagacacttacatgtggaccccactgtttaaagtggatgcgcgctaccgtaatacgttttgcatgtaggaaagcgtactctatatagtacgcttcagccttttgtaaagagaaattaataaatctaagaaaatggtttcggttaattatttatgcactataaaatgctgaaactttgtaaaatcatagaaaattcattttaactccgattgaggtgaaccaaatttcgttagattcataataatgttgtctttaatactgtacactcaaattatcaccactgttgtgaaaattttcactaatttaaatttgaatagtaaacttcgtatttaccgtactttaaatattagaaacacgataacttgcacatacaacatcaggtttaggcgattctttctcatttatattaaatcactctctttacactgaacatgttcatgcaccatgcatcatattttatcttggagttttattggatgttcatttgaatgtacgtttaaatttaattagaggacgaatcgattgttgccgttggcgagagtgtgcaggaccaagagttatttgaggaaccaactgagcaaggcaagtcctattcaattcctacttcgatcatgttgaatcctatatcttcgcaaatgctttattattttataaattgcatgcgatgttttataaagaaaatggggtattggtagaaataacctaattgctgcattacctaccttgatatattgattatcgttgaagccctaggctgagaatatgtgtgtgttgtacatgcacaatgtgggtatattcgagctgctactatagctacttgcttagccatgcttagaaaatttccaatggttatatatgacatggtaatcattctttacaaatggaatatttttatagaggagttgcctttgttgtttatgaagattggaaactgaaaataatgattttagacttgggcggcaagtggt

SEQ ID NO: 16025 - DNA, 1501 bp, Oryza sativa
aacatgcaaaagattaatttagtattaagtattaaaaatatgaaaaatgattttatttgttttttagatggatttctatatagctttttttttaaaaaaacaccgtttaaggtaaacgaggaagttggaaaagccaactgcaggctagaacgcaccctcagtcaataaaaagaaagaactcattaatttggtctgtggatccatgtttaattctgtgacatttgacaaggtaggcaaacacatgatgactcgcaattttggaactaccgaaagtatacttgagtatcagtactagtactgtatttcagtcagttgtcgacaacagatttttggtaagagatgttcaacggatttcttttttcctattggaaacacatgtgagcaatgatcttgacacgctgttgagagtattaattgtcaggtagtgctaattgtttttactccatgttgttgttgttgttgctacacagtgtgattattcttatactagtataaaattgacacaatgtggcactagtaatagtagtagcttgtcttctcctattaattttcccctagttttatcttgtgtttgtccatctttctttcagtagcagtcagttcagtttcctggctggccctgaacccaagaaaatgaacagtaagctaaatagaaaaaaataatcaatccactcccagtgaatgaatcatcagatgctgctgagcctaactctaactgtagttgttctagcgattctagcactagtacactagtgcaatttacccttcactttcaccttatcaaggaaaatacttaaaaagcgatgttaaagggaaaaagaggaaaaatctctgttaactacattgaacagccttgaaattttttgtaaagctgcaataaaggctttggatgaaaggagagatattttagcagcgattttatcatgctgcatttagtagcagcagattatttgttatttgaaaactcaaaattccaaccaagagattgatttgtacttatccataatctggtattaaaccccacctttaatcaggtgattagaattgccttgatgagcatggatattgtcactgcatttaccttcagacttttttccccttgaaaactcaaaatcccaaccaagagttcaatatgtacctatccataatttggtagtagtaaacccacttttaatcaggtgattaggatttaccaggtgcacacatactgtcgcagggactagttagttaatgggaggtgaaagaaagaacatgagtgagagagagagagagagagagagagaggggggggggggggaatgctgctactctagtagtaggagtagctaacaaccaagaagatgccatgtccttgttgcaggggcagtggtggtaaggtaagaaatgcagcagtataagcagtaagcactccactcactcaccaaaagcagaaaaagaaagaaagaaagaaagaaagaaaagggacaaggagattaactaagacacaccccacctacacact

SEQ ID NO: 16026 - DNA, 1501 bp, Oryza sativa
acaacaaggttggggtgctatattaaagcaaagacctactaaattttccgctaaatcagaagaaaaaatatgtaggtatgcttctggaagttataaattaaaaactgtcaataatacagatagagagatcatggcaattatcaatgcaattaatgcctttaggttatacctagggtttaaagaattcacggttagaactgattgtgaagccatctgtagatattataaccagcttaatagcaagaaaagctcaactagaagatggattttatttgaagatattattacaggaaatggttatagagttatatttgaacatattaaggggaaagataatagtttacctgacatgctttctcgtttaaccatatttcaggtatgaaaagatcaatgaattacgccggagtcgagtgcttcacatttggagatgacaacaaactcagaatattcccaccaaattcatataaatttaagccaaaggaccatataatcctagatgaagttcaagagtgcatcttggataatttctggtaccaatacaataataaaagggaagaaaaagggtatttgttatcaatattgaatagcctctctgaatattttcacctaataaatgggtcattaatgcctgccaatgaagatcatgaagtaatccaacaaaagcctatatatgtagtatttgatggaaagctccctggggtctacatttcttttgaagaaattgtggctcaaaaatagatgctaaattaatgggaggaatatcttggaagaaatataaggatattgatgaagcattaagccaagctagaaaaatattaggaataaattattatctagagcctgctgcaaaagaatatattcaaaaatgcaaaaaagctaaaggaaagaagacttcagaaatacccattaagatgactataaaagaagaagggttttttaaaaaacccacatacaaggaatgcttaacaaaaggagtggatccattagatggggaatatattgattggaagataatagaaaaatttgaagaagcctccccacagttaaagaaggaattgaaggaagaaatacttaaagaattaaaacaagaaatggatcagaaatttgagcaaataaaaaaggcagtagatgagaaattagaagtttctttttctgatttggacacaatggatcttggtggccatgggcaaccagatgaataaattaatataagctaaatatgtttttcaatatatattgataatagaatatcaacaatttgggcgtggaagaagaataaaagaatgaagaataaaagaataaaagaaattcagaagattacccaagaaagaatccagaaggacaccctataaaggataaggggacaatatagggtgcggtgaatgacatatcactgtgaagagtaaaactttcggtggaaaggcctcgactttagccagctcccgtgaagatacagtagcgaagagataagcaggaggcacaggcgacgccatccctggcc

SEQ ID NO: 16027 - DNA, 1501 bp, Oryza sativa
tcgccgccgcctccgcctcttccgccgccaccgcatctctggggtgagagccgccgccgtctctcccttcatcgatctccgatctcgatctctctctccgtcgcgccgcccgccacgagacgccgcgccacgacgacgccgcgccacgccgccgccggcacaccacgccgccgccgccacgccaagccgccgccttcgccgccacgcaacgccgccgccgccgccgtcgccacgccgccgccgccgccgccacgctgccgcgccaagcgccggcccgatgccgccacaccgccgttaacgaacacgtgaacgagaacgaacacgtcaacgtacgttgccgcgagaacgtgaacgagaatgagaacgatcgaaggaacgagagcgagaacgagaacgatcgaacgaattaacgtgaacgagaacgaacgtgaatgagaacgagcgaacgaacgtgaacgagctagggaacgtgaacgagcgaacgaacgtgaacgaacgtgaacgtgaaatgcaatatatatatatatgttacttcgcatttatcctaatacatattttttgtatcttgcagaaaagacgtgttgtcggagtcgtccctcaagccggagtggaagagctagccctagaaggaattcgtgcaggcaagtgacgtaataatataaatgattgttatatttgtaatgcaattaagaatattagacttgtaattagacttagcatataagattgtgtagtgttctaatattatttgagttttaatataagattattttattgcaaattagacttagtatgtaattattgactacggaattggtgcgactcctagcaattgactattgtagtcttaattagacttagcatatacgcacgaaacacttagcatacatgactattttagtcttagcatgtaatattatttgagttttaatataagattattttatttataattagacttactatataattattaactacggaattggtgcgactcctagcaattgacaattttagtcttaattagacttagcatatacgacagttacacttagcatacatgactctttcagtcttagcatgtaatattatttgagttttaatataagattactttatttgtaattagacttagtatgtaattattgactacggaattggtgcgactcctagcaattgactattgtagtcttaattagacttagcatatacgcacgaaacacttagcatacatgactattttagtcttagcatgtaatattatttgagttttaatataagattattttatttgtaattagacttagtatataattatttactagctatggttgtataatatacgtcacctagacttagcttatatcacgatttgtaattagacttagcacgtaaggttgtgtagggttctaatgtacgacatttacacttagcatacatgacttagattgttaaaacataaatgtctcgtaacttagcagatgtttcttgtatcaacaga

SEQ ID NO: 16028 - DNA, 1501 bp, Oryza sativa
ttgcctgcacgaattccttctagggctagctcttccactccggcttgagggacgactccgacaacacgtcttttctgcaagatacaaaaaatatgtattaggataaatgcgaagtaacatatatatatatattgcatttcacgttcacgttcgttcacgttcgttcgctcgttcacgttccctagctcgttcacgttcgttcgctcgttctcattcacgttcgttctcgttcacgttaattcgttcgatcgttctcgttctcgctctcgttccttcgatcgttctcattctcgttcacgttctcgcggcaacgtacgttgacgtgttcgttctcgttcacgtgttcgttaacggcggtgtggcggcatcgggccggcgcttggcgcggcagcgtggcggcggcggcggcggcgtggcgacggcggcggcggcggcgttgcgtggcggcgaaggcggcggcttggcgtggcggcggcggcgtggtgtgccggcggcggcgtggcgcggcgtcgtcgtggcgcggcgtctcgtggcgggcggcgcgacggagagagagatcgagatcggagatcgatgaagggagagacggcggcggctctcaccccagagatgcggtggcggcggaagaggcggaggcggcggcgaggacgacgagctcgagacgacggcgagatacggcggcgtcggcgcggggatttgccctagacagtggcagcgaaggagagaggccgagagagatcgatcggccgaaaacgttaagtgttggtggagaagacgagggcgcacggggaaaatatatacccccggatctttactcccggttggatctttactcccggttgttctcatcaaccgggagtaaagatcttttcccgctatttccaaattctttttaaaccaggttaggttaagaactgggactaaagattatagcactgcatattattttcgcttacatatgtgtttctaaaatagaagttaatgcattaacattatttaaagtacaaagattaatgacaattacttcgaaaaattatttttgtctgtaataaattaagtggataaatcgtaataagcaaatgtatgacttaaaattaataaaaattccaataatcatatatacttagcatatgaatgatattattaaattggtaaaaactctaattaagatatgtatgtacaaactgcatgatttaaaattaataaaaattgtaatcattatatatacttagcgtaggaattatattaaattaaatgttaaaaactctaattaacatatgtaaatgccacatgcatgatttaaaccttttaaaaattcgaatagtcatatataagtagcatatgaaagatagtaaattaaattgtgaaaaactctaattaacatctgtaaatgccacatgaatgatttaatacttttaaaaattctctagtcaattataattagcatatgaatgatggtcaattaaattgtagcatatgaatgatagaaaattatgccgta

SEQ ID NO: 16029 - DNA, 501 bp, Oryza sativa
caagggacgaaggccgaggagacaacatgggcgaaggccacatggcgaaagccgtggcatgaagtacacaagcttcgccggggatggacctcatcggagagccattcggccgaagactacgaggcgaaagccttgccacgaagggcatgggtttcgccaactaccaaacttcaccaagaaaaggcccagcgggccaacatgccttccggaggcttcgccaacaattgggccgagctacttggcccattaggagcccatgcaagcaaaagacactgtatgcccataataatgtccctatcataaaagcaaccatgtaaattcccctgtaaagcctaaaccctagaggaggaatctgtaatagggttataagtagcccatgtaacaggggatctgaaaaatttttactaagcaatacaattgtctctttttccaaccactgttgagagaaccacttgaagcagttgtcgaatcgaaaccactgagagtgaacgaaaccactga

SEQ ID NO: 16030 - DNA, 1501 bp, Oryza sativa
atttccctatcacaattggcgaagaacatattgctccatttgcatttcctgaacaattcacaagcctttttttttttgttcttgctcaaatgctgattggtttggtttcctagagatccatgtacatccggtacgcatccctgcgtggagcgtagtagccgacgacggtggcgtcgacctggaacccggccttgcggtagagcgccaccgccgccgccctcgccgggtcgacgtggagggacacccgctggacccgcctcctccggcagccctcgacggcggccatcagcagcgcctcgccgtggccctgcctcctccggctctccttcactgcatcagcaaccacagccacggaatcagcccccaagagattgagagggtttaggggggagaggagtgtttgttgttgtgtgccgcaccggcgagcttggtgatggaggcgcagagggaggtggcgcacgtgtacatggcgtacccgacgacctcctcctcctcgtcggaggcggcggcggcgtctccagtggtggggatggtggcggccgcggctgagtagatcagggtggtgttccggcgcttgagctcgtcgtggaaggtccgcgccagggactcgtgcttcgggaagatccgcttctccgtacgcacgatgtcgtcgatgacgcggccggcgcgcgggtgcgcggggtccagctcgagtatcctcgctgccgtcgccgccgccgccgccgccgccatgatgcttcgatggagaacgcaggagcgagcttgttttgcgttttgcaccccgcgcttcttcggttttgggtttgaaggatcaaaggaacccacttttgttcttctcggctctcgccaatttgtttgggcgtaatttgctactaccccgttttgacattttttcatgtaacactggatcattcgttttatttaaaaaattagtgtaaatataaaaaaaataaattatacttaaagtactttttataataaaacaagtcacaaacaaaataaataataattttataattttataaataaggcgaatgatcgaacgttatgaaaaaaactcaaaacgacaagtattttggaatggaggtagtagtaatttgcatgtaaccattcgtatacgaattggttatttagtttatcacaatgaaattattattgtacgtttgtgtcatattgttacaattgcatagaggaaatggaaacatgatattccgtttataaaatttatgcgatcttcggagaactgattttagttctcccaaaatcaaatgttgtacctctggtcattgatatatgacgctttgataaacacatgaactatctatttatacaaaagttgtttatcctaacaacagatattaaagattggagggaatattttctttaacaaatggattaaatttacatgatttataatttgaagatattttgtaaacaaaattgatatcagtaaaaaattcattattcaacacagagcaggtgagcaaaatgatgagtctgc

SEQ ID NO: 16031 - DNA, 1501 bp, Oryza sativa
ttccttttagttgggggagattatctcttttgtttccctcctactgtgtgcagcgcaacacataaattgggtgggccctttgtttatctcgtgcatacaagttcagtctccttgcttttcggtttctttgtttcagtagttaatctccgtaattaccttggtgtatttcctttgtttagccatgcatgcaagttccatacatgcacgtgatcttctctcccagtaatagctagcagctgcttgtatttgtgcatgcgcgcgcacgcacttgccacttgttaaagcaaaaaaaaaaggcaaaaaaaaaggtgcaaaaaaaagagccgcacaaaaaaaatcagaaaaaaaagagaaaagagcaaacaaatcagaaaaaaaaaagaaagtgtggaaatttgttttgttggaatcttggagagacttgcttactatgtgataaagtcgagttgtttctagtccgagtgttgatcatttgcttgcttgaacaaggattgagtctagactaggccagcaactttgactagtactttggactattattcaatttcacaaatctatttgatttttgctattccttgtgatatagttaggtctaccaagatccacatactactaacctttataggtccggctttacaatcgcttcactcatcaagcgtgtcattgtgccatgaaccagccatggtgattgacctgtttttgcattctttgagaacattataagaattggtatatgcttgagtgttgagtgccttcaaaagctccaaatatctataaattgttaggaactaacactttcttgtgagtttcttttggttactaacaatgacaggagcgtacaaagagaacgggattgaacatataaaacattggctttcacatcaagaagaggtacatgatgaggtttgtaaaaataagatatcgttgcctccatttgttggtaagtttaatactaagaactatattgattgggagttagaagtggaagatgaacttgaatattatgaatggtctgaggaataaaagattaaagttgccaccagttcttttacttttgcatctctttggtggagtgatatttgtctcgtcagtaagaaaccgggttcttggaatgacttaaaaacaatgatgagagctagatttgtacccgattattatattcgtgatttacaaaagaaattacaaaatttgaaacaagggaatagaaccgtgaaagagtaccaccgggagtttaaaatttatatgttttacggtggtacaggggagtctagagaagatacaattacaaggtttttacatgggcttgatttaaaaattcagaataggcttgaaaataaaacacatagccatctttttcagttacttttgcttgcttgcgatattgaaagtcagattgagaaagaaacaaaaatgcctatgataaatgagaatatttttgtgccttctattgtatctaacatcgtgcaggaaggtaaaaacaattttgaagaaaaggagaatg

SEQ ID NO: 16032 - DNA, 1501 bp, Oryza sativa
atactatccagattcgtagtacgtcacataccatactagattaaaaaatcgtcccataaaaattaaacataacacatgatatgatacgtctcagtactatgaatttgaatagaatactatccagattcgtagtacgtcacataccatactagattaaaaaatcgtcccataaaaattaaacataacacatgatatgatacgtctcagtactatgaatttgaatagaatactatccagattcgtagtacgtcacataccatactagattttttttaatgaagagagtaatactattatgttactgtcatcctgcttaaaatgtatgtgccgttgcatataaattacatcctccgtttaaaaaaaccaacttcaaaaaacacaaactaaatatgcttattatctcaagaaatttggtttttttttgacagagaaaatgtctgtacggattgacttgtaaatcacgccctctgtctaaacaaattgagagcatgaatctagaaagatggaattataaaggtttggtttaggacggagggttttttttaaagatagagggagtaaactagataacttattaatcagtgcttactcagtggactaggtaggtcgatctcaaatgttattatttactttctacggtctttttaattccttataattcagaacatgggcataggtctatggtcccgttcttagtagctcattgatttccccgcacaattttatacgtgttagttaaattagatttgttatacaactcttagcttatactatacgccgttaacttttaacatgattttgatcattcatcttattaaaaaaatatcatttatttttttacttattttatcattaaagaaactataatctcaacatattcttttcacatattcatttatattaaactttttatactaccccaggagtttggcctcacagttttttattttttttcatattcacttaaatgtgggccctacttctaatttgtgattaggctagcgcatcagcacaagtggaccaaatcaatgtgccacatcagcaaaaaccactcttaaaactgttaatggagccaaattgcatcgattttaatatcacgattaggagatacaaataatatatacctatattatttgggggagtaaatgtggacttagtccttccagcattgatctgctaacagcccacatgattgcggagaccggtatgggagacgaaaccgcgtgatctggtctgagggttcgactgttcgagtcggttcgaggcccaggagcattggtagtagtactacgtataagcaacgtcagtgaatgcgtcagtacctcaaggtggataagctataagaagtagtcgaagacgaaattaagtactactactacaattaatacattttgtgtaacatttgtacatgtacaatggtttatgtatatataaagtaaagctagatatgtatatatacatgtgtagaaagaaccaaacatttgcaatatccaatagctag

SEQ ID NO: 16033 - DNA, 1501 bp, Oryza sativa
acgcgggaggccgcgtcgccgccgccgccggcccagtcccggccgtccgggtcgcacggcgggccgccgtcgtagttgatcttgatcaggcccgggagctccagcgacggcgtgccgtacacgtgcgggtcgccgtggctggagaacgtcgggaagccggcctccgccgcgagctcgcgctcgcggccgggcttgaccttccagtacaggacgagcgcgtgcagcggctggatggggaggtccacgccggcgacggacttgaccagcttgctcgtccaggcgcccaccgtcacgacgcacttggcgccgtggaactcctcgccgccgctcgtcctcacgaagactccggcctcaccgtccttcttgacgacgccgacgacctccgcgttgtccctgacgacggcgccccccttgacggcgagcgcctggaacatggccaccgccttggtcgcgttcagcacgccgccgccgagctcgctgacggcagccacccacccgtccgggacgccgcggaacgcgccgccccacctcccggcgaggtcgtcctcgtccacccggcgcgcgccggagttcccgacggcggcgagcagcgaggcatcgccgggcgggcccacggtgagctgcggcgccggggtgagcacgcggtagccggactcggcctcggcgtcggcccagaggcggcgggcgaggcgcaccatgggcgggtagtgcgccttggcgtaggcgtcgcggatggtgcgcgacgcgccgtgcgaggagccgaggtggtggagcaggtcgaagcgctccaggagcagggcgcgcgcgccgcgggacgccgccgcgtgcgccgcgcagctgcccatgatgcccgcgcccaccacgatgacgtcgaagtcgaaccggccgccggcggcggcggcatcatcggacgctgcggctgcggctgcggccatggcgcggtcgaacactactcgatgtgcaggatggagtgagtagccagccacagtgaacatcacatcacaccagcacagtctattatagaggcgagcttgtgactggcgaactagtagtagtaatttgcaacttgtgctcttataaaattgtttcattggaattcactttaattttattttttaaactcgtgccaagtcatcgcagaaaatcgtaaaaattcgaaaacgcaaaggattgggttggtgtagggatgaaaacggtcggaaacggtcggaaaaaccctctaccatttccattttcattttattttctcgaaaatggaatcggaacgtatactcggaaacggtaaggatatcggttatatcggtatctcggaaacggaaccgtcggaacgagaatataccgatatcggacggaagtcgaaaattcatgtcggaaacagcgaactgtggtatcatcccgcatttaactatgtatgaagataaccttataatttcacctttgcatcattatgctgccacacaacaccgttatatgatgattaataagttgacaataagattga

SEQ ID NO: 16034 - DNA, 1501 bp, Oryza sativa
accaggcaaataatgcaagaattcccgtggaagtgaaacaaaataaaactaggaagcaatgtccagcctaggctcaaaagagaaaccagtaaacagctgcagaggaaacctcttcgtcacagggctcttcagtgaccatttccacagcttctggtttaattcaaatgtgaggagggccggtgacccatagctctgaatatagataaggtcatccgccccacagcttgcaaaaacatcatcgaactcgccaaatccttggaaaaacttgtgaggcattcgagcaacctcatgccactccttgttccggagctcccagatgccaattcccttgatgataccaggcctatcttgcttgccaatgcccccaaccaagacaagcctctcattgaggttcatcaaacggccacatgtaagagggcacggcactggtatagccatgctcatcaaagaagtgtgagtaggcctggtagataggtcatacatgagaagacaatggcgatgctcgttgttattcaccaaaactcctgttgagtacaccagatagtagaggaccccatcacagatcacgcactcatcacctcctcgccatccaatcaatagttcagtgaagggagacacccatgtatttatctctgactcgtacaaatggatggtgaactcccattgataatactctgatggcacctggttgcaccttgcaacagccaccatgtactgatgagaggtcctggtcacagaaatggcgagagcactgtaatcagccgacttgccaccaggagcatcaacaagcctcttccagtccttagttattgggttgcacacgatgatgcggctcctatcctcactgtccatcagacacaccaacccggacgatgaggaaatcgaccaggtggtcttctcaatgcaagggaagtcgaatccataccacttacgcaggctcgggtcataggtgaaccccgagaccgcttcctcgctgcaggtaaacatgaagtaccaaggcttctgaggcaccattttgctccatgtctgcctccgggcatgcacaatctcatgccatctcttgcaaacagatccagatcttatgacacttgcaacaggcaagaaggagaggaccttttctaaaagatcatcagggagaacggcgtccatcgacacggccaagtctccactctgatcatcatccatgtctccagaaacatgcccataatctatgacctgagcaccaatgaaggaagatggatacaactcccactcctctgaccccattgccagcatccagcgaacagcacagtaactaacgcaagatcctgcatgtgcaagtgatgaaattaaatgttcatgcatcagccacatggtaacatctaatctagataccagagttactcaatattcaacacaacatcaatttttcagagcgttgagtatatatacatcttatacattgcctccatgagctcaaggaagcagaatgtaaatgccagataggtgaaagggatagcct

SEQ ID NO: 16035 - DNA, 1501 bp, Oryza sativa
attcaaattgcaacaatgatagaaatgaattttgaattatggtatctatgcagtataatattgcagccctattgatcctttgatggcatatttgctactttttatcctcttgaatttgttaggacctgctaatattccccttcctcgtataaagctgtaagctttggtatgcatgattggaattttaagcacacatttctgtagcagaatatatgctctatcactgtcttcttgaaagttttgcttcttttttatttgagctgtgccaaatctctttgtttttttggaatataggagtgttggatactaaaatttagctactccccccccccccccccaaattgtagtgatagaatcatagccgttacagatgactagcagtgttctaagagtgtcttttaggtatataaaagtgacagattcccctacttgttgccatgctattgctagttaggccacattactgggtgggtttcaccgaataattacagctgtggtgaccatatgggtgattggataaatgttggttatctatattagaacttgattactagtatttacttatttggttgctcacatagtcacaatccatgttgatcagtctctaatattgacttctattttcagtttgctgagcacagttgctgaattttagggttatctgcttcaagcataagtgggccattgcttctggcttttactggtaataaacataggcttcaacttcaagttactctatcttaaggaattaatagttcatatataagtgcattatcgagcttgaattggcctgttatcattgccgtaacaaaggatcagggtattttttttgtttgtagctatttcacttcaattgatgaaattttactttagatttgttgatgcaaccagacttcctatattttgttaatacacttgctatacagtaagtttgaatcctgtttttatcatctgaattttagacaaaattttggagtactctcttttttaagagtacaacgaaaagccacacaaacatatgcccctcaaatgcatgagaggcatgtagagatcctgctatcatatgaacttttgtatcttctcttcatgtgtgtagcagcatataacatcctaattttctttatatgtgtttgttgtcctcttttttttttgtgtgtatgagttgtattatcatgatcattgatcatatctttgtccttttgttatctgcagaacgtaactcacttggccaaatgaaatccatggtagttggttattctgaagcatagaattgttactgctttgtgaacgaataacatctatctatctagagcactggaagatggatcatagagatacttctgggtttgtcagtggaggttgcaaagaatcaacgaactgcatcaccctaggatttctaactttttagctttgttaaccattatttaatctggaagtgaggttatctggtacttggcaaaaaaattggctgtgttttgtctcctgagaaattctctagcaa

SEQ ID NO: 16036 - DNA, 1056 bp, Oryza sativa
cgttacaatcaaaaactcaaaatcccttatattatgggacagagggagtatatattaaagactactccctccgtttcaaaatgtttgacaccgttgactttttagcacatgtttgaccgtttgtcttaataaaaaaattgtgaaatacgtaaaactatatgggtacatgaaagtatatttaacaatgaatcaaatgatataaaaagaataaataattaacaatgaatcaaacattttgaaacggacggagtattatctatccatgcgtataaatacgtaactttgcagtgaagaaaagaagacctttttgttaacatgttctgaatatatcatgccattacatacagaaaataaaccttccccccaaatttttcttctgatactgaactgaatttcttctgaatctgaaccaaaatttgagctgagagagggaaaaaaaattctgctgtaactgaactaaatttctgttgaagctgacccaaaatttgtgcggagattgaactaaaagttgtgcagaaacagggaaggaaaaaaaattctgctgtaactgaaaatttcttgtattgcatatagctgtaacttaacactttactacatataagggcatgtttagatctcacactaaaattttataccatatcatagcaatgtaacaagctaaaattttacctctaagatataaacaccatataattgtaggtgtggaatctagttaataccgtagcctgatcgagcccactggttactgctcactggttgctgccacgccgcttgttttctctctgctggtcaacaaagtcaaagctactggataagtctggacaccacctgcagcaactgcaagcatcctgtgagaccatttgtgtcgactgtcgacacgtacctacccaacgaccaacacactgctgcgtctgcgtggctgctttatctgcataattaatcatctacctatatatgtattgcatattcagtagaagctgttgcaattaaccagcaagatcagtcatcagtgtgcgagtgtgtgattggtttctttgaattgaccgtgattcttga

SEQ ID NO: 16037 - DNA, 1501 bp, Oryza sativa
aaatgattctcaatatatttttttcgacaatcaagctaggagtaaaaagaaaaaaataataaaacatcaagatttatcaacacttattatgaaacaaacaaatgatacccgcactttaatgtaaaacttattaataattatatgttaaatattataaaaatgatagatagatttgttaaaatattgtgcaaataatgtgaggggtgatgattggatatacttacatatttatttgtataattaaatagggaccattgctctatgcccccacttctaatcccaacttctattttacccccattttttagggtttgaaattttaccccaactttttaaaaacgaaccagccgtttgcccctacttgtaacgcctgtttgatgggtcccacgtttgtgtgttaaaaaaatacaaatggaaattaaaaaaagatttatgaaatatcaattttaccattctaccctaagcgaatggatatgggtggaatccctctcctccccaccaagtgtggttgtgcctatgaacatccagaccaccctagacctagaggcggcggcggaggtgcaggcgtgcgcgaggcggtggcgagcgtgcgatggcactccggtaaggcggcagccaggcggcgcccgtgcggcggcagcaaggtgggggggttctggcatgcgcagtgagcagcagccacgcggcgatgacgagcaacagccacgcggcggcggcgagcaggcgcagcaagaagcagacaagcggcggcgttctagcttgcacggcgacggcaagtcgacggcaggtctctgacggggcgggtgatggccgcgcaggctcgtagtcacagctcttcactcgcccatcgccatcagtgctgccgccgcgtgagcgccaccgcgcaccgcgccaagccgcctgcgccaacccccatcgccgttggcgccaccacccaccacgccaagctgccaccgcgtgagcgctgccactgccaggaactcaggcagtcaggccgccactttctgccgccaccgccgccactctccacgccgccgccacccgccatctcgccatccacgccgcttcttactaccatggaggaggcgcctcaaccaccaagcgtggaatcccagagcaaatgcgcaagcgcgaggccaatctcgtcggcagctacaggtgaaggtgcagcggcacgtacacgctccgcacggattgctgaaaccaacgttggctgtagtcgaggatcggcaaggaccgcaatcgcaagtggggcaattggatcgccgtcaccagcatcagcatcacgagctaatgtctccacgaccgtggaatgtatctaaattccacaatcactttcctttttggtttattcaattatcttgaatatgtatttgtgcagtacaaatgtactgatatagacatgtagtcatgtgaaattgtgaagtcgatctaaaattatttagctttgaatatgtaccactgtgaattttgcatttagctttgaatgaatcactatacc

SEQ ID NO: 16038 - DNA, 1501 bp, Oryza sativa
tacagccaacgttggtttcagcaatccgtgcggagcgtgtacgtgccgctgcaccttcacctgtagctgccgacgagattggcctcgcgcttgcgcatttgctctgggattccacgcttggtggttgaggcgcctcctccatggtagtaagaagcggcgtggatggcgagatggcgggtggcggcggcgtggagagtggcggcggtggcggcagaaagtggcggcctgactgcctgagttcctggcagtggcagcgctcacgcggtggcagcttggcgtggtgggtggtggcgccaacggcgatgggggttggcgcaggcggcttggcgcggtgcgcggtggcgctcacgcggcggcagcactgatggcgatgggcgagtgaagagctgtgactacgagcctgcgcggccatcacccgccccgtcagagacctgccgtcgacttgccgtcgccgtgcaagctagaacgccgccgcttgtctgcttcttgctgcgcctgctcgccgccgccgcgtggctgttgctcgtcatcgccgcgtggctgctgctcactgcgcatgccagaacccccccaccttgctgccgccgcacgggcgccgcctggctgccgccttaccggagtgccatcgcacgctcgccaccgcctcgcgcacgcctgcacctccgccgccgcctctaggtctagggtggtctggatgttcataggcacaaccacacttggtggggaggagagggattccacccatatccattcgcttagggtagaatggtaaaattgatatttcataaatctttttttaatttccatttgtatttttttaacacacaaacgtgggacccatcaaacaggcgttacaagtaggggcaaacggctggttcgtttttaaaaagttggggtaaaatttcaaaccctaaaaaatgggggtaaaatagaagttgggattagaagtgggggcatagagcaatggtccctatttaattatacaaataaatatgtaagtatatccaatcatcacccctcacattatttgcacaatattttaacaaatctatctatcatttttataatatttaacatataattattaataagttttacattaaagtgcgggtatcatttgtttgtttcataataagtgttgataaatcttgatgttttattatttttttctttttactcctagcttgattgtcgaaaaaaatatattgagaatcatttagtaattcctgcagcaaagcgttggaaatcaccatacaataaccggttagcatgcagagccggtcatccaactaaataaatttagaaaatagtttgttggtttattaaattgtttgattagcgcaattaatcaagccacgtaatcgggaaatggctttcccaacttcatgattagcgggctacatgcaaaacagaatttcaaacttagtgggaaaggaatatggtgaccgatttattttttcgtctcatccgctatagaacaattcagttattttattgcgaa

SEQ ID NO: 16039 - DNA, 1428 bp, Oryza sativa
ctaacttaacctctgacgttcagcaacttgatgtttcagcaggattcaaagtatagaatttccatatactttgtatccctatgcgaaaattctgaaagctaaatattttctatggacgcatcattgatgaagcaaatacatgaatcatgaagggtctgagactctgagtgactgctgtatttcacgagaagccataccaaccagctaggcactcgctgaaaatcatcattagacaagaacatctacagaactaaaaataatactcccctgtttttttaatacataatgctgcaccgttgacttttaacacgatgtttgaccaatcctcctactattaaaaaaatttatataaatggcatttattttgttgtgatatgttttatcattaaaaaaaacttcaagaatgacttacacttcagcaaatttacactaattttttttaataaaacgaataatcaaacaaaaaagtcaatagcatcatctattttaaaaacagagatagtataggttgagaaatcgttacaaattcacattttaacttgtttcatctcttgatttaatcaaatatagaactattgaccaggaaacactcaaccaaaatcaccaagaggtttcgaaacagttgttcttttatacgaacaaagatcattgaatttatatttgtaaagatcaataaagctacgaagatgcaacatacagaaataggatatatactaatcgagctcatatgccaagtacataattcatgaatgcataaccaacagagtgacccggttttttcaggactttgtaatggtaatccttgtttcaacactcagccatgttttatttgagtttcagtcagctcatgatatttctttcacaaggttgctgtgcatacaaaaattgaactacatgtttgagcaaacaacttaatgtacaaccacaagacatcaataatgtagaagagtagaattatacttagataaaaagagcatttgactatgactatatagtatcacaggactgaagagatcagttgttcccttgaaaaaaacaacctgatcaaaggggcatataacgcaaacaccaacaaggccacaacaaaagacacatctatctatctatctatctatctatctatctatctatctatctatctatctattatctattatattatatatactaaaagtccattacattaaactccctataaacgctctcaagccgccacgtgagcctcctaaaatccctcctaagctgccacgccgcacttttataatttcatggtgtagcaggtgtgggcccccaaggagcaagcccaaactgccatcgctcttctgccgctagcggcgtgcgtatagtagacgaggaggttgcgaagcgatcgcctgttcccaaatccaagggatacgcgagattgtcgccgtgacctagcagtctaga

SEQ ID NO: 16040 - DNA, 1501 bp, Oryza sativa
cataagccacaaagtaaaactgatccaccaactatatataagcccgtctcatcaatcacaaaagtttaagcaatcgccttaactcttattctctctgtttgaattttgtcccttaaaaaatcaacttccaccatcctacctaactcttacattatctaaaaaaaaactttttaaaccagaagaaatataaaatggttttaatcctaagtagtacagtacataagctgttaatctaattgggtaacagtactcctgattagtacaaatggttctgaatttgcaaatgcttgattgataaattgcctgactcatgagctgaactgccggcgttgtcagaattctgaagcacaactgttttcaggttgcattcttcatactggcgactctgggaattcagtagcaagtgacaaactctgcagaaccaatagataaaagagcaaagcacacatataatttttgaatggaacaaaagcacgcatcctagcatgtgtcttcaacaattctgctgaaactgtatgcatttcagaacattagaatgcacaaaattaagacatccccacttgcacgttgctctattggctcaacgatttggtaatactgccacttttcgcacggttatgaaacggtgttgaacaagaaacataccaacacaaatttctgcataatgcaactttttttaatagataatagaaatgaggattacatttttggcctctgcccgtgggcatagttaaaaaatctcaaaagtaaataggaaggaattttaaaaaaaggcatgatgggacatactcctaacttctgccaataaaatgatttattaaaataacgttttcaaaatcacatacattttataacaaaattatgtagataccatgccatccaaactagaacaaaagttctttggctaccaatttcaatcgtattgtgtcagggttatggataccacatacccaatagtaatcgactaagcacggcggggtccaccacataccatgtcttatatgggaacaaacctcgtatatagaaggagttccggataaggaatgacgagtagagttctatatggaaacgacaaggactacttggatcgtatccatatttatctccctagttctacttggacaagagggcatctatgggtataaatacaagcccccctaggaggagaggggacacagccaacatgcaacacagacgccacaaatccacaagccaatacgccaccagatctcgacatcagagattagcctagccataacccatccggttcctacggaagtcggcaagagggatctagcgccatctctgatctcaccgagtacagattcgaggaggaagactgccctgtcatcaactacgagctggttatctagccgccaagttgacgatagttagataggttatcccaaatattgtatttgtgtaatccagatgaataaagagcaacaccggctttggccaacaggatgtagggctattacctgttagataaagggcccga

SEQ ID NO: 16041 - DNA, 1501 bp, Oryza sativa
ttagttgtaggcaacgtacccgtcgacagcgatgcacttgtagcttcgtcaatctctccagaatttgccggcccagtcttcctgtagtgacttcgtcaatctctccaggatttgccggcgttgtgcttttaattgtaggcgacgtacccgttgacagcgatgcacctgtagctttgtcaatctctccaggagtagtgacttcgtcaatctctccaggatttgccggcgttgtgcttttagttgtaggcgacgtacccgtcgacagcgatgcacctgtagcttcgtcaatctctccaggatttgccggcccagtcttcctgtagtgacttcgtcaatctctccataatttgtcggcccagtcttcaaagatgctcataggggtgagtgtgcgtgagttgcgtcaatctctccaggatttaccggcccagtctttaaagatgttcataggggtgagtgcgcgtgagttgtgagtgtctgcagtacgtagcgtttagtttatatcaggacaaattcttttttttttcttatgccggagcggttggccgtttggaaaaacgatatttgaccgttggaaaaccgttttttcagtagtacgttagacgtataacttagtggattatacggaatataagacaattactaatgtttttgatgatgaagatacttatttgagttgtacactaagataaaattaatattagtggtaaatgttgtgttaaaaaaaaaaccatgataccatatgtagatgtccaaaacaacatattttaacaagggaatagattctcaattgtatttgactccgaatcccagaggctatcattgataaaaatacataatatataaaaccctgtttcatggatctttgtcatactcatgtaaaagttgaatcatcaatgtatacttgcaacagttctagagaattttcactttgttgcgggtggatagaacctctatctaaaattctgagctcccttatcacatataaatagttgatgtttagttatgacaagatttggtcaaacttttaaatatttcacaatcaatagcctttcaaatgactagttttttaaaaatgatatgcgcaatttttcctttaaaagtactacaattattgaaaaattactttagcatacgaaattgactgaaaattcccttggaccgaatcttgttaaaagtgtcaaatatctttcgactagagagagcaaacttagttaaaaaagtatacatcggtaaatatactggcagttaaaaaacttgcgaatgtaactataatgtaaatataatatactaaataataactacagtataatttagtttataacttttaaatagttaacttatgtactccctccatttcagattataagacgttttgaatttggtcaaagtcaaactactttaagtttgatcaacttcgtagaaaaaagtagtaatattttcaacccaagacaaatttattatgaaaatatattcaattattgatttgatgaaactaatttag

SEQ ID NO: 16042 - DNA, 1501 bp, Oryza sativa
aacgatgacaaaaaaaaagagatattgaagtgaaccaatgttatcggtaacgctattccgcgctgtattagttcgagtgccgcacagcgtcctctgtttttcccttttttaccacctcatctttcctatgcatcccaccttttctcagttcgtttttttcattttttaccacttcaccttccgtgtttcttcttttccatctcattctttcttcatcaatgggcccaataaaatatcaaccatccagatttttctatttttcgttccttctatatagtttttctgttttcgcggttttagtaccgtctagtttttctttctgagttttctgttttttatctccgcacgtttcagaataacaaatttactcgtttttcatttactcccagcctcccacatttcctcattcagaagtaacaaatttattctcattcagaagtaacaaatttaatcgcatggatacctccacatcgtatgacgccatgtcgtaaaaaaaatactattaccttacaacactagtaattcttttaccaatattataaatattgtttagatttcgtggtctgtaagtaaaacaattactaccttcctctcgatatagcgcatgatctcgtagccaccgtgtagtattatgtttactgatgtgttcaatacataatataagagtaaaaactgagatttcgtggtctgcgaataaaacaattaccaccttcctctcgatatagccatgatctcgtagtcaccgtgtaataatatgtttactgatgtgttcaatacacaatataagagttaaaattgatactaagagtattgttgatctgtatcacaaaatagtcatatgaatgaaaaaattacaggctcaatcacacacaatcaataaaattactcacaggtgaatcaaactagaaaaaaaaatgattcagtcaaaaatccatttggtggctttattggatcttgctataaagatgaagagcacagtctgtgtcttgtgattggtagtggagagggcaactaggtggcaagcagtagtcggccatggaattatggaaggatgtagtggtgtggtatagagatgagctcgacgttgcacagtattagccatccatcatctagcaagcacgaaaaaaaatacaaaaacattctcgttcatgtcaatagagatgacgagtaaaacaaaaatagtaaacaacatccatcaccggcggactccaccctatcctctgcgcccagccacatggagcacgatgtgcaaatgtaggacctgtgcagcccatcaattgagatcaggtaacattggagattgcacgttaatttgatttgcaaaaaagaaaaaaaaatttgggcttcatgcgtgaagttgaaggagagtatgcagatgcaaatcagagtgtcattttcttacttgcttgttctatcaatgttggcgatgtggagcagccgctggttgttgctattggcctaggtaaacacctccttgctggttaaggtgctgcccagcgtc

SEQ ID NO: 16043 - DNA, 1501 bp, Oryza sativa
gtcgcgttggtgctacgcagtgtttgacccggggtgggtggttgggtcgggttgggcgggtcggggtcgccgcgcgcgtcggggatcgcgtcgcattggtttggcccaccactactattgctttccctgcccagcccaaatgcaaaatgatgattggcctggccctcgtcgcgtctcgcctgtcagccgcgaaaatattggctcactccgtcccaaaataaatcacagataacatattattatattttattattatataataaaataaatattaagcataaatattattggatgttcaaacgttggacatataaaccacaactacacaacatagtactatttttaggtccccatcgtttcgcttttttttctggcttattaggaaataaaaataaatttgtaggtaaaatttttatatatgtgttcttgatgacttaaaagccaatgctgaaaaagaaagtacgttgaaaatatctcaaaatcaatctcaaaattaagtttgaatatttaaaatttggctttttctttggcttattaggccatccgatgggagccttagtgtatttttttcacgttttaaattgatcttgctgtcaattttactatgcataaaggttgacatatattcctagatataggtacaaatattaggattcaaaatttgtatacaatttaaatgtaaatatacttatagttattatttgagaacacgttgcataaaaaaaagtatagtacgatactcactccttcgaaaaaatctaagacctattttatttttggtttctgtaaaaatctgagtcatatttgtagtcaacatgtgctaaattaaattgttgatcggaaaccaagaaacaattctagtacttattgattgcatgttcattggttttgccatatagtgagtgagttaattgcttcttggttttaatgaaaaagaaatagatctcatatttttggaaggatccatctacttttgatagtcatatttccaaatctgaaaattttatttttgataggcatattttaattcaacaacctatcctcttaatgaatttctcggatttaatgcatgactctccattcttctacacaaaattggctatatgggcatcgagaaatgtaaatattaatgaatcgcttgtttacgagaaatgactattagcatgtttaaatggatgataaatagaataacttattcttaatctatatgccaagatgaaatattactatcaaaagtagatagaaggagtactacgttctagcgctacgagtttgttttttttttatcatacgagttgtacttttatacccaaaaaagtcactctgtcctgtcctgttgaagattacagtactggtgggttgatcttctagaaacagaaaatatactttacaatggattagtagtatggtttggaaattatggagtggtgacgagtagtctgttgaagcagaaatcgctggcaatcaaaagtagattagaaacagtggatttggggcgtga

SEQ ID NO: 16044 - DNA, 1501 bp, Oryza sativa
gaacagccatctagtaggaaatcgtccatctatgacgttttgctcatgacgttgtataatttcgtcattgaatacaacatatctatgacgaaatttcatgtttcgtcatggatcactcatggcggagggtagacatcgaaactccatgacgaaatttaaaatggtgtcataaaacaatagataatttcgtcacaaaatggtgcgcaccattcatgtaacacacttatgacgctcctttattaatacaatatgctgaaatatatttcgtcagttgtaagtaaatctctattctgctgttgttggtcccaccttgcatatgtggctatctaggttgtcactggaccccacattgtatacgtggctatccagattgttattggaccccacattgtatatgcagcacaggtgcgttttcgggccagcagatgctttgtgcagtccacgtgaatttgtgcagcccatgtgtcaatctgtgcagcccatgtgaacttttttttcgcagcccaaatttgtgcagtccttggaccccacattgtatatgcagcacaggtgcgttttcgggccagcagatgctttgtgcagtccacgtgaatttgtgcagcccatgtgtcaatctgtgcagcccatgtgaacttttttttcgcagcccaaatttgtgcagtccgtgaatttgtgcagcccatgtgtgaatctgtgcagcccatgtgaactcttttttctaaaaaaaatgctgcagcacttgggggtcgaacccacgacttgtgactaaccataattctagcttaaccactacgctgcaaggagctttcatgctgatgatgttttacttttagttttcctttcaattctcgaacacaagaatgattgaatgctttatgcgggcgacctagtggtttggtcaaggagggaggggggcggtggcgcagggtttggtcatagccagggagggagggtggcggcggcgcaggcggagctcagtggggacggatcctagccaccgggacggtgcagaggaggaggtttcttatcccaccggtgcagggaagggcggctccacaggctggccggcatcgtgatgtggagcatcgtggtgggtggcggcgcggtgaagtgatcttggtcggtggggctgcagagggatcccggtcggcgcgggggatcctcgacgactgagacggatcggctgctcctcgcccaccgtcttatcctagcacctcctctctcaatcctgtcgtcagcgcgcacagcccatcaccaacgccgttcagtagatataaggtatgattttccataagtacattactctgagtatgaaatgcaagttcagctatgaaagattatgctttgtgttgtatgaatagagaaacaagtcagagtgttatgaacaaatcaacatggtttaagtcatgtagcaaccagctgttccatctaatgttttagaaaatattctgtcctaaaaaatggattagctttgtttgcctaattgctttttttaacatgc

SEQ ID NO: 16045 - DNA, 1501 bp, Oryza sativa
aaacatgggaagaactcaaagtcagtcagaaagcagaagctgacctgaatgggcgcagacggtggagagctagctagcttgaggttgggtaatggaatcaatcgatccacctgaaatgcattataattagttgggaaggaagccgcttatatacgtaggagagaagaggagagctagctaggagagagagcgtgttcaaacacgcagccgctgcggctgctgcgagagaagggagaagatgaggcctacaccgcatccacccccggggagccagccaactcagccagcatccgtccttgtcatctctctgtcccagtcgtcatcagtgatcgatcgtcttcgccgctgcatgttgcaattgcaaatgcaaatgctgctgtttccttcctaattccgcgcgccctgtcgctaccctgtacaatttgcacgagccatcattgattgattgattggcccttgtaattttctactccatgcaagcagccatccttaagttttattattacctcttctcttatctctctataactctattgaccacgcatgttcctatcggtatatccctttttctaccttttccttccttttggcaccgtggtgacgtggaggtctctgaatgggatactctactggcactgctgctctgattatccttttactgtttcatctcatcaagggggtacatttgtcgacagattcatctgatacgtaggtctatgcggcgacgagtttaagtcaggacctgatgataatcctgggcgttcaacgtagacaaattggacttttgactcaaagctcgccttcgatcgagaagaaagagatcaactcagactgctcttgcaaaccacttgtataactactacttgtcagccatgtgcatgtatgcacgctaattgcgatgttgatagtttctagctaggttaacaaaatctactataattaatctctatttttcacacgcacgcacctggcggatgatcaaatgcagcgttgatcgatcgatcatccatcagcagcaaagagtattcactctccatttctatgcgctgctaggaagactccttcgaatttacactcaagattcacgcacgttttcacctggcagatggtcatcgatcgacaatgccaatgtacgccagtacactgcaataatccgagaaacgtaaagagatcttccggctagcttcacaaggtgatgggtagtcgatccggattcaagtctcactcctaattatttgatattaggtcattccctaatacatgtatttacactgcaataatcccttcaatttcaaaactgtgcagctgtgcagacagctgcagcagcctgtggccatccgaacctgtctctcagatcgctacatttctggagggaacgcacgagaccacacattgatatatcgcagctgcaataatgcaccaacaagatccaataatgcgtgatagatcaggggttggttcaacaggacggaatcatcaaccacatgtgtatagtaggagt

SEQ ID NO: 16046 - DNA, 1501 bp, Oryza sativa
agatgcttattttctcacaacatttattaactttgcttgctttacatctattctttcctcccaggaaccaccaaggagatgtcaatacagagaatggatagacaccagaagggttctaactccacctagccgtgttgtgtagcttgaactaccagagcaatacagggttactaaagtgcggtttgagagaggagagggatcctcactgacggagcgtggggctcctcaccgggagaccgcgcaggcccccctttgccggttcggccgggggcgctaagtgaggttcttcgccctcgatctgaggaacgtcagcgagagaggaaatgcacaagacacgggcgacgtagacaggttcgggccactgagaagcgtaacaccctactcctgtgttctggtggatctgtgcgtgaaggaatacagagaggcggagagcgagagagagttcaggctctagaaaccattcgccagagtcccaatccccctctcccctaggcctgggcctcctttttatctggttaggggtcaccacatgggcctctcgctgcctaagaagggaaacatgctttttacaatgagggctagtctatagccggaagtgacctctgacaagcagagcacacgcctcctgccccactcgcccgcttttccggtggacgcccatttcaaccttcatttaatggccagcgacttccttgccatacttgcgttgaagcctggaatggatctgaccgggactgacataccaactccaggagttagcacgccggctccggctagggacgagagccaggaagctctcatcattccgacgggacggggcgaggcgtgtgacaggccgcctattgccacctaacccgcgatctgaccggtctgtgaccggtcacacaccgcgaccggtcacggatcggataagcatgcgctgcgccgcattaaatgcggcgtggtgcacttcgtccaacctgctataaatgcggttaggtgagccccgctgtgctcacctaacccacacacgtggcgccaaaaccacagggggtcggggcaccccagccctcggggccgaaacgggagcggcccgacccctcggggagacagagggaggggtggccacgtcaccttcgggcccgacccccccgaggaggtcaggccacgtgggtgaccgcggctacccaagcctctagtcacgatacccccggccccatgtcaccgacactcacgtaggggttagctattattggacaacttggcatattgaaatttctactgtcatgcttccttgtcccattactacatcgtcgttgtgttcaactattgcactacctccctcctagttcgaatctaatatcatctatgtaaccgcaatgcaaatagtcatatcatgttcaaattgtactactatttcttcatgttacataattctccttgtttaagtccatataatgtttctacgacccagactgcgataggcctatataaattatccgagtactaatacgtcgaataa

SEQ ID NO: 16047 - DNA, 339 bp, Oryza sativa
cactacggattagagtgttgacattaatttgtagcgttccagtactatgaacatcacacaattagcgtgcgtagtgtacgtacgcacatggctgtaaaatgataagtactataacacatgttggcaatagcagtctgatcgagagttgaattctttcccgatccaaggcaagtttgagcgtccaaacgccgtttttttttttacggagtatacgtacttgtaaacgattagctacctaggattaaggccgagttagtgcgcgtcacatgaataatgtacgtacctgataattaaaaactagtactaaaaggcaatcatgctatgcatgttgataccgga

SEQ ID NO: 16048 - DNA, 1501 bp, Oryza sativa
tgccgggagccgtatgtggggtagtctctcctcaaatttaggttttggaattcggttatgcccctgatggcaatggcacgcccaagttttaccacgtgacgttccctgtaccaaaattattataggtcgtgctctgttagtgcaaaggtaaagatttggaaaatttttggacatatattttttgacagaaaatgatcttgttgtgtgcaaacgtttgtaaactgttcataaaaacttacatgtcacgggttatgagttcaattgaatgaactatcttgttgatacacacccttccaatcaaagttaggattgatggactgatagacttaatatttcattgcttcttgtatctagatgctatatgcctgccagttggtatttagaaccttgattgctatgtttctgtatttctggcaatgttgatgatagtgcagatttttttagtgaagtcatggtattgcaaatctgcaattatgctgaagaattttctagaagttctggttgctggcaactttacatcaccatcagtgttttctgtgcatatatgggcctgtttattttgatgtcattttcaaccataccatttttttttggcaaagttgccaaaaaatgtctacgtttagtttgttgccaaatttggtcaatacataagaaatcctgctaaaatttattttggcaatattgccatcttgccaaaattttggaattgctaaaacttggtaaggtttattttggctacaaactgaacaggccctatgatttcggacataccgttatctcttgatgggagggtttgcccacatcttataattggtctggctgttgaaataccacttgttttgcagtaccaatgacaagcatcaaagctatccattttctttgccattaggatcatcataatttgttttttttaatctttgtggttgaaaaagaaaaccatgtatctctggcataaacagatcaattatctctgatattatgtccagttgtctgtttgatctgactgtttccatctggtgtccagtaggaattgtgctaaattaaatcaaaggttcaaagtttagcagtaacttttgttcccatagaatttgtcatcaccatatgatgaatttgtcaatgagtgaatattgaacgcatgatttatgtgatgggtcgattagctagaatcagactgcattgtttccaatgcacactgataaaactgtagcagcagttgacatcaagcatgtgatttgttatcttttgaccgtcgagcaggcttataatgtattcatttttagagataaggagagtgaacaaggaaattatctgaagtagagtcggctaatggatacaaatgtattgaccccctccggaccaacttcagatcaatatacagttagataagccccttttgtttttttaattctgtgatgtggacagtatgaaattatgtaattatcttttgacggactcaaaatcttatattctgaatgtatgcatcttgcagctattaccaaga

SEQ ID NO: 16049 - DNA, 1501 bp, Oryza sativa
caatggccaacactaggtaatctgctgccctgatttatgctccatgcctactgttctgaatgtgtgtgcgtgtgcaggggggatcgtggatgctgcgccggtgctgctgcttagaatttgcctcacgcctctagggtgctcccccagccacgcttccacgccgtcttcctctcgaatttcgcaggcgtggccctcaccaatctaccccataatttcctgcctatttatcgatgttagttccaattgttatatctgtgatgtataatgtactctagattatgcattgttctccacaaacaatgttaacattcaatctatgtattttatgtctacttaatccatcactggttttcctcataacctgaatgctatagctagtggtgctacagccaatccactgaataggctcttcagggcctccttatttattttcctcatttacacagcaagggcgccgcgaagcgcgccgtaggttctagtttcgtgaacgacatgagccctcaccggcttggttctgtccttcgtcagattaattaacaaacatacattcgatccgttcctcggtgcacgccatcctcagcctgcgcgttcagcaaaacagcacatccagataggctcattagatgccttcacacacaaaactaaacccaaattctccaaagatggcgccgctccgtgttgacatgatcagcacaaaagtactttggtagagtagtagcttacctctgacgacgtgcgactggtgctcgtcggcgtggccatggccatggccgtggtgttcgtgcagcttcaccctgttcttcttgagctgctccctgacgaacttgtcgtagatgaacgacgcccccctgaactgaggcagcaccagccacgccacgaacaggaccttcgcctcgtaccataacggtatcctgcaagacgacaattaatgtggtctagttctgcaatctgcatacccgtttgcagagcagatagaggcggtgccacgaatttaattaccagtacaagactttatggagtgccatttccatgagggtgatgagggagtacagtatccagtacaccagccattgctcgtcgtccaccttggacgtgctctccatcgcgcagatcgacgcgtacctgatccaattcaacactcttttatactcatccaactacaaaccaacagtctgaaaattcacaggcagcgatgtaaagtaaaatcagcagcctaacagagtaacagactagcagtgttcacttacagagggtatattagtgtcagggttggcctgcatgtgaagcatcgcaaattagccaaataaatgatcacaaaacgaaatgaattagaatttgcaattctcgtacatacccggcaaaagcatggaggtggctaatgagtgcccatgttttacccatctctttccttccgatatccaaccaaatcactcaacgaaggttgattttggagtttgatgggctaggagatgggacgcgaagagatccagtagcataggcc

SEQ ID NO: 16050 - DNA, 1501 bp, Oryza sativa
tgttgggagaattcttttatgcctttccaacttgttaacgttaatttttctatttcttttaatctttcattctacaaagttgtataacctaattccggatcttcagctataataatgttagatataacatttgcaaaattatgcggattgctaccagctcttttcaattcttcataattattaggattcttttcaaccaattgttcccatagaaccttagcagattcacctaaaaatgtttctaagtaggttatcatatcttcaactttacttcctatattgtgctggttttgtatatatttttgaactattaaacatttccaaatattaataatattaggccaatcaatagggtcatgtgcggctaaatttaatatagcaccatcactcctctggttttgaaatttaacaggcttctcaaagtctcttctcttagtacccatgtgcctatattgtcctggtatatagttatatgaaaattcttctctatcaggggggcattttcctgctgccctagctggtctttctctttctccttcgtttttcacagtaccttctccatatctttttctctttcctgttcctaagtccactaggattaatagaatatatatatatatatatatatatatatatatatatatatatatatatgtatatctatgtatacatacatacatacatatacatacacacacgcgtatacgtatatatgtatatacgtatacgtatatatatatacatatatagcggatgagatttgagcatataaacaaatgaatgaagtgtatattcaacgtttgagagaccttttgtaccctgcgtctatacttaacttgcctgttgcagcaagaaaagaattcagcctgctgtaacgcatacagttcataaccatgcgtgttaatttaatctctacagctaagctacatatatattatttcctttgggaagaaaatttttttagccaactgtatatatacatgccaaaaacaaccaacaaaaaggaaaaatggatgaacgaatcaacgattgagttgttcgatcaactcaaacctaatcaatctttaattaattgtctgttgtatgcatgtaatatacctgtagcgcgctaataatgaagcatcatcatcgatctcctaatcgcgcacgatcgatcaacgggctgcttggagctgactctcgccggcggcggcgaaccaccgccgcgtgacgtcccggagcagcgtgtcgttcacctcgcagaacttggcggcccaaccggccggttggaccgggtcgaagcccagaccgggcgtccggtcctttgactggaggttgacccggtgggtccagtctgccacgtaggcagagacccggcggcggaacttgaggcggaactcgtcccacgcctggaacttgtagtggttcacccgcgcccgccgattccactcgccgcgcttcccctcccggagctcgaagtggtgcaccgagttcaccagcgacctctccgccgcctccagcc

SEQ ID NO: 16051 - DNA, 1501 bp, Oryza sativa
attcatggatatagttcttgatttgtaattgccaatggtgaagaatttttttgaaatagagtaagctaaattcaaatttgagggcaaaaccaaaaatggtttacaaattgaaaaaggaagaggataatgagccttaagtatcctacatattcttccaattattctcaatttctagttttctacacatattcaaccatatttttgatttttttaccctatttattttacatttacatgatttcagctacacagcccgcgataaccgtgcgaatatcgcggttatcgtggcaaaccgtgcgattatcgcggtgaaaccgcgaaaccgtcgagttttgaattcaaatttttagatgtgatttttgtgcgattttagacgattatcacgcgattatcgcggttatcgcgctaccgtggggtggcgataaccccggcccaaacgataaggtaaaccctgatggtgatatgcattcttacgcagaggcacacataaatcgaaatcgattgttttttttcctcctctcatgtgtttgttcccctattatgtgtttcttctcttctgttactttcgatgcaaccctcaaaatctgatgttttatgttttcctttttggcaaattcttgatggaatgagaatatgtaaacacggatgtaaatttatgtaaacacggatgtaaatttatccattaaccagtaatacgtactacgtaaattgaaacaaatatcacatcaaggtcgttgctctctaagaaattgaggaaaacacctgtgaattaatacggacgcatttgtacaggagacccatgatttgggtgaataactggagagctcttcgttttgaaaataaaatcggcacgaacaccaacggtggtttctggtttgtattgaatggtctaacaaacctagaaaaagtagaccatatgggatcattgtactaaactccatctaattaactactactccctccggtttaattttaattgacgttttggacaatgacacggtctacaagatatatctttaactttatttttctattataatatatataataaataaatgtatgtttacttttattatagtgctttaaaagacaaatttatatatgttgttctagtttctttaaactaaatatttttaaagttgttgatggtcaaagttataaaagtttaaccttaaccttatccaaaatgtcaattaatatggaaccgaagggagtatgtgggaagagaaagtttgaaaggaaatcacaaactggaagagagttttaaaggaaatcgcaaacaagaaaaactgatactctagtttggaaggaaattctgtttgcctcatcagttgcaaaccacacatcaagattacaggttgaagagttgcatcttctgttcagcttcagtacttccaagcaactgcgacagtgagccaaatgcacaaagcgtaacatgacgaaaaagagattctacataattgaataaacaccttgatctgatggaaaagacaccagattc

SEQ ID NO: 16052 - DNA, 1501 bp, Oryza sativa
cttataagttagctataagcttatgttgaggagagagataatagaaaatgaaggttttggctctcatactagagctagttctacacgtgcttcaagataaatacattgaatgcattagtaagagaaagagagaggaataggaaaaaaatgaaggcaaaacttatagcaaatatattatatactatgttgattttttttttcggggaatatactatgttgattttaagatagactacagtaaactataccattaaactttctaaccgaggatgtgcttgctcggtccttaaaaagaaaaaagatatcaccgatttatttcatgcttagagcgggtttaatagtatcgtcgattgctagctataattgtgtgccacgtcatctaaaagcaacttagggtgtgtttgcaagagcaagtttccaacactcccccctcattttccacgtgcacgctttttaaactgctaaatggtgcgtttttttgcaaaaattttctatacaaaagttgttaaaaaaattcatattgatctatttttgaaaaaaattagctaatacttaattaatcacgtgttaatggaccgctccgttttccgtgtatgagagatgggttcccaacacccacctccaaacataatagttggagagtataataagcacggtaaacaagtaaaagctttattatttttgaaccacatcaatcactttctctgcggtgctttggtgctattttctctttggtgctattttctctcttttctcttgcaacagtgacaaagtattgtgatgccttggagcaagtgcgccgcttgcaccatcttttctcctttctcatccagattatcacttagtatgatttggatttcatatcacccgctgaatataagctttattatacttgctcttatataatactccatacgtctaaaaatataagagattttagagaatgtactcctattattacgaatctagacagtactagaagatacatccttcaaaatcccttatactctattttgggatggagaaagtattactcctccgttctataatataggggattgtcggggtaacgggtcaggcataccctttaccccacgatacacgccacataccgataaggtatatccacgtgtacacggataaatcctttggcatttaaggaaactcttcgtaaagacaacagataaggagagaccttctcggacaagaattgagttacctacgtatcgtgtcaggtctggtatatcggagtcctactcagataacatccaatctgcggtataaaagggaccccctggggagaccacaaggcatcgaatctcagagccccgacaaccaacacagcctacaaagtcagagcctacaaggagccaagttgacgagagctagtcggatcatctcgactacaaccttgtcgaatctcccgagttccgtcttttcctttgtaatctgtgttttctaccatataatcccatatcaactggattagggctattacctg

SEQ ID NO: 16053 - DNA, 1501 bp, Oryza sativa
ttaattaactgggaaaggttcaccacccgatgacattcgaaaacaatgcatagttgaaataaaatgatagctttaaacggaatcaacatgctcaaagggttgtttgggatctgtgtgacttgccttgggcttccacaaacacttcagaaccttcctcaacggaaacgctctcctccggaacgtcggaaactaaagcaaataaacaaaatcaacaaaacagtacaaaaacaagcataaacagtacatgtggatatttttaacatgtagatcttgattttagaaaaatttagaaacttgaaccacctaaaacggatctacggttatttagttatgattttccgaagttttaatctatttgaaaaccgagaaaaaggaaaaagagagagatatgacgtcagccctggccctgatgacgtcagccctagggttgacgtcatgctgacgtcagcacgacggccggctcgggacgacgagctcgccggcgctagggacatcggcggcggaaacggagaccacctacgcgtagaggacaacgagacgaacccgttggtactcaccacgtagtcaaaggatgtacgacggcggccggcgacgagaaggaaggcggcggcggttcggctcaacggcgacgagggtgctccggtggtcggcggcgaaaatggaggggcggccgagcttcctcgcacgacggcgcacctaacggtggtggcggcgagcggtggcgacggcggagacggcgcggcgacgttgccgaagacggccggcggcggcggcggacttgcgacgcgtcgcggcggcgctagggggcacgggagagctcgagagagggggcaaacgagagaggacgacgaggggaacctttatatgagctcggattgaagagatcaagccgcaaacgaaaggaatcgagtcgggaagatctcggactcggtttttagggataaaaacaaacgaattcgattcggatccaaaccgcaacgatttgttttgattctggggggaaaagaaagaggagaacgagaggaacaaaacccctcaatcaatcgaaggaattgggctcggatttgggcggaatcgatggcgcaaaacggcgctagggttcgggctcggcggcggccggccggaggtggaagacggccctgacatgtgggccccacatgtcagtggctggggagaggggcgcgggcggcagcggcttgggccggcgtgggccgcgcgcggggagagagagaaagagagagtattgggccgaattcggcccaatgaccaaagagaaagatttttgaacttttttgaataaaacaatttgtgaaatgatgtttcaattattaaaaatacttcccttgctcaaataattcccagaaaaatctagaaaatagaggagcaagcatagtatttaataaaattttatctagcttatttttatgttgaaaattttcctagaaaattagggtttagcttgtaggcttttaaaataatttctaaaaattccaattaaaca

SEQ ID NO: 16054 - DNA, 1501 bp, Oryza sativa
aattgaggatatctaaggagcaactcgatttggaaaatcaaaatgtagtgagcaaaggaacaatgaaaaaaaagaaaaaaataggaaaaaaaatagtgaccaactgagtctgctgctaccatcactaagatggatttttagtcccgattatttcacccgggactaaagacgggtatctaaccgggactaaagggggttgtgaaccgtgggtaaaaaccctttctccagcagtgtttactcattttatgcatgcttatttataatttagttgcactataataattatagttataacgcgattgtagtgtactccccctcaaaatctaaggcagttttttacattaagacacagaaaaattaactcatctctatataacaaaaccaagaaactatatgtatacatgcattattaagatgattgattagatttcgatcaaaaatttaatttagtacatggacacaacaaatatgaccatctcatttagaaaaacaaaaaataaaatgtacttaaaactattggactaagggagtatgtaaatatatatgatgtaactatagtcattataattccattatagttatactaacaaagtacccctgctttgttactgtaaaatgttcatactaattatttgaatatatgttatacatttgatttaaaaaatattagactattatataatatcagaaaatatcaggtgctaatttgaaaattgtgaaaattgtagtaatagtgagctggtgacagaaccagcaacattactattatcttatacattagtatagactatagattataatttcatcttagttacagtgcacgtaaggatctgattgaatctcgaacttgatttagttcttctgcggcatgtacaacgagttgagccattaacacttgaataattgaatattaataattacaaaattttaaaatgggtttatttgatttttaaagaaacttttgtataatttcttttgcaaaaaattcaccatctaacaatttaaaaagcatgctaatgaaaaacggggaaattatagtttggggttgatcgaaaaaagaactcgcctaagtaggatgtaactatggcatataaactagtagtatatataatttgtctgtttccccccacttcatgttaaacaaaatgaatcaactgggggttcactgcattgggcagagagaaacgactatcctttgctaattgctagtaggcctaaaatctgagggatcaagtggcccaataatcggtctgtatactgctggatatgttcattaagcagtctgtatcccacgttactcctgtataaatctcgaagatgatagagtggcctaaaaatcgactcaaactaggcaaagaaaaatgttgatagaattttagcaaaactgtaaagcttttgtcaacttttctctaaaatctcaattgaattgttcattctatatgaatttcaaaggaaacgacactggtggagaaagaggctttactcccggttggaaacccct

SEQ ID NO: 16055 - DNA, 1501 bp, Oryza sativa
aaacgcatgcaggtgcagagcagttaaaaaaaggaagtaacaacacaggtcccggtgaaagtaatgttgggttggagttcttgtcaaagcattttgcaccgtgagagaaatggatttaatatgcatttgtcctatgtggtatatgagataactcaaatgaggttcttgcactgctacagccctgagaaacggagatttttgggcgagcggtggcgccgcaaacattggggcgatagcttgtcctaacttggaggctttggaagtttggagtgaggtcggccacgctttccgctggatatcttcgggtcccgggcacttctcatgtacctggcaatctgtagatgcatgatatgataaagctaaaatcaagcatgctgtatctgtgatgggagcttgttttccttttcctttccagtcccggggtatgcagtaaacgtgagttaatcatagctgctgcgttagtaactaaccttggaggccacacgccccagatcctgataggactgcgcatgtgcttgtgggacacgtcgcttttggaaggcatcattcttttgaggggaactgcactatgtaagaccactattctacgatgcagggcacacacagttgacatattttcgtgggggagtaactctggatatttcacgttacttgctgcctggatttctccctgtttgctccctgacggagagtgaaggctgaagagttaaggccggaagaggataagcaaagtgagtggctgagagcaggtcatggtaaatgagagggattatcagatttggccagaccgcacagggaacattagcctgaggtcgtgtgcacaaatgcacaattattccgagacagctaagccagtactgatagcgggttagcactgttgatcctgcatgattatcttcggctgctgatgtgatgttctaactccgtttccttgaacttgattgtgcccgtacaggaacggaacagcaagaacggatctatgtaggtgatgcatcagtctgtctcgttccgtgaattgcagagtgcatccatgtgtagtgtgttggctgcatcgctgcctcgctggggtgtacagtgttctgtagtaggtctttggctttttctcggtcttcgaagtggtattccgatgatctcacgcggccacgctcccactaggactaacgacgaacgaggtcgtgagcacctgcgcaggagccaagtgaattcgacagccacggtgaatttgactgggctgctcgcaacagcccgcgcgtcccagtgttactgggccgataagcccagaacacatggcgcggctagcgcgttccgtgaacagcccaacgacatatttcggcttctctgggcccacgataaatcccggcccacaaggccgtgattcccctcttgctcgggcggcggcggtcaccggcacaccgctagaagcgccgttgagcacttccgcttccggccaccgcggggtcgccggatatggcccaggcaccagcgcgcgccgcttccgtcg

SEQ ID NO: 16056 - DNA, 1501 bp, Oryza sativa
ggtcctgcaggtggcagtgcgcgtcgaagagccgcacgacggaagcggcgcgcgctggtgcctgggccatatccggcgaccccgcggtggccggaagcggaagtgctcaacggcgcttctagcggtgtgccggtgaccgccgccgcccgagcaagaggggaatcacggccttgtgggccgggatttatcgtgggcccagagaagccgaaatatgtcgttgggctgttcacggaacgcgctagccgcgccatgtgttctgggcttatcggcccagtaacactgggacgcgcgggctgttgcgagcagcccagtcaaattcaccgtggctgtcgaattcacttggctcctgcgcaggtgctcacgacctcgttcgtcgttagtcctagtgggagcgtggccgcgtgagatcatcggaataccacttcgaagaccgagaaaaagccaaagacctactacagaacactgtacaccccagcgaggcagcgatgcagccaacacactacacatggatgcactctgcaattcacggaacgagacagactgatgcatcacctacatagatccgttcttgctgttccgttcctgtacgggcacaatcaagttcaaggaaacggagttagaacatcacatcagcagccgaagataatcatgcaggatcaacagtgctaacccgctatcagtactggcttagctgtctcggaataattgtgcatttgtgcacacgacctcaggctaatgttccctgtgcggtctggccaaatctgataatccctctcatttaccatgacctgctctcagccactcactttgcttatcctcttccggccttaactcttcagccttcactctccgtcagggagcaaacagggagaaatccaggcagcaagtaacgtgaaatatccagagttactcccccacgaaaatatgtcaactgtgtgtgccctgcatcgtagaatagtggtcttacatagtgcagttcccctcaaaagaatgatgccttccaaaagcgacgtgtcccacaagcacatgcgcagtcctatcaggatctggggcgtgtggcctccaaggttagttactaacgcagcagctatgattaactcacgtttactgcataccccgggactggaaaggaaaaggaaaacaagctcccatcacagatacagcatgcttgattttagctttatcatatcatgcatctacagattgccaggtacatgagaagtgcccgggacccgaagatatccagcggaaagcgtggccgacctcactccaaacttccaaagcctccaagttaggacaagctatcgccccaatgtttgcggcgccaccgctcgcccaaaaatctccgtttctcagggctgtagcagtgcaagaacctcatttgagttatctcatataccacataggacaaatgcatattaaatccatttctctcacggtgcaaaatgctttgacaagaactccaacccaacattactttcaccgggacctgtgttgttac

SEQ ID NO: 16057 - DNA, 1501 bp, Oryza sativa
actttgaaaaagtctagcactatatatactaaattacacgggtaaatcttctattacctccaatcccccattcagcaaattaaaggatgtcgttttagcccgtattgcacataccaatgcaagtgttaaatgcagcaaaatggcctctttgcgcctttaggcatcattaattctagctccaatcaccctgttcggcactgcatgcaaaatatattttcgcgggttgctacgcagagccatgagcttaattaagcgccaactggatttgtttaggggcaacatgagaaaattttgcctacaaaacataaaatgacatctatttgagaaaaacaaaatgctaaaacgacatctatttgggagtagaggtaattttcgggctagtttggtttggttctaaaatgtgccctaccaattcactgtcaattttcaatagtatttcttgtcgtttaggttggtgccaaattttaacaacacatcttttagatagtaaaaattttacccatctaaatttggtagtgtcaaaagttgcccaaactttggcactaccaagattttggtatggaagcaaaccaaattggcccttcgtacagatagctcaacctgtcatccatcgaaaaaattgctcgacactaacgactctcatgctcttgttattctactaagacagttttaaattattgctcatcccgacctcaaaattcttttctttaatgaagtccgacactccgatcgacctcaaattcttaaagcaatccaaccaaagatttgttgagtgtttcatttagctttcatcctttacctgcctttgacaaagcctctgcagacttagcgggcgacacgcacgcataagagcactgataagtcggtcgaacgctcttctcgcgcgcacagtattttatcctctggctcatgtgcttgcgccactgcctacgtcaaatgcaccagctgatgaatcgcgtgcgctgatgcacaaacccagcacgatgacacctcgctgcaagcaaaaaacttatactaacaaagcagcagcagcacgcgctgcattattacttgtatattaaacgaaagttagttcctcttagatttgggaaaacccggatgctgtgcggcgttcatcagcgaaccaaatgatagaggcttaatcttctaggctacagctttcaaatggccacgtcactttcttccacgattgctccggggaatcaagccttctcacgtacagtggaattttaattttctgaaactcccatcaaaatcgtagcgcggatcaaagaaaaacgcagtgtgatagtggcaaaatcgcggtggtgatagaggaacagcccaatgccaatccgagatcagtaggctggaggcccatacaaatatagcccaataccaatcgctgtggtaattgtcctgggccgaccacggctatactggagcccatgtgctcaggtaaggccatgacgcttctagcatattcttccggaaatttctggagatctcgaccatctcccac

SEQ ID NO: 16058 - DNA, 742 bp, Oryza sativa
  unsure (1)..(742): unsure at all n locations
agttggtgggcccatgaaagggaatcggtaaccactactccatccgctgctcccgaccgttgatgcgctcgcctgtcgccggcctcccaagctcgttgaagaagagtgcagcccgtcgccgctccgctaccgcactcgtgcaccgctgctctgctcacagcccgccgcgctcgcccaccgtcgcccccgtctattaacgcctcaacggcgcacatgtggggcccatagagcgccaagtcagtaaaaccgggcaaaaattgagtcgatactgccatgggacttcttttgaacgttttgtgtgagtttaggggtacacatttctggttttgcgttgaagggnnnnnnnnnnnnnnnnnnnnnnnnttgaggaacctctagtgaacttattctggaataatttgtcaacgaatccgatttttgtccttcaaccagaaaaccagatataacgagtccctcaactgtcaaaccaatgcaatataggtcccatggcggtttgcacggtggttttagctgacgtggcgcctacgtggctaaattgattcggtcttcatctgacgtggcattgatgtggcattgacgtggcaatttgatttagaaaataataaaaactttgaccccacatgtcagttacaccaaaagaatgaattaaaaaatggtgcggcccacgtgggcccacatgtcattctcacccttcttactcctctctccatctctcttccctctcctctctccatcctccagg

SEQ ID NO: 16059 - DNA, 382 bp, Oryza sativa
tctatattaagtataaaaaggaggagttctccgatttcaatcctaccggtgaaatcaacagttgaaatcttaccgtccatccgcggcactttcagcctccctaccgtccaccgcaaagacagaagtggctggctaagtctttgcgatgcgacggtgaaatcaccgaatccccatccgtaccaagtggacgcacgattccatcgcaataacaccgtgcgcttacctcgccgccgcaagctccgctccgccataagagcaatggtctttattagcggtctctcttcattgtcatgcaagtatatttggtgacgtggaagagagagaaagaaggaaagagaaagatagttgctatggagacgtggaagagagagaaagaaggaaa

SEQ ID NO: 16060 - DNA, 966 bp, Oryza sativa
ttgttgtattaggaaatgccccatccagtcctagatttatattttgggatagagggagtacttgttttcgttgagcatgtttgctaaacagctaaacaatatattttgttaatatttaatttattacattatatactattgtcctatttttcgtgccaacataagtttaggccttattcgagttgtaggaattttaacccatagaaataggaaaagtggaggaataggaatgtatgcatacaccaatccatataatttttttcaagaggtttagaatgaatgaaaaaatttctatgttttctctgtacaacttgtagaaaaggaaaagttattttgattttcctatacttcattcttacagtccgaatggtattcatagaaattaatccatatgaatgcaaatcagctgcgttttttccatccgaataagccctcagttctttccaccatcccgaacgcaataagaggtttctcggtatctcatatgcaagaaactttgaaccgggaaatgaactaactcacctgtgttcaccgaacgtatgtatctaataaaaaaaactacagtatgacttcaagatagtactccaatgtttctagcagggaagtgatgggatccaacgtgtggtctcaagcctatggttctagcctctaactaggctcggatgccacggcggaggttcgagaggagctttatttgtgtcagagtcacctgcagatgtcatagtggtttgctgggaaaagcagtgattataggagaaaaaaagtggtccaagcttcgatcggcaaccatcctttagggtcaacgccaaatactgtagcgctgaggtttgccggctcagcggtttggccgcgagcaactaagtcccaaagctcagggccaattgctctggtactaacattagtggcttggcgctgagcccctgccacatagactaggggatcggctcggctgccacgttggtggga

SEQ ID NO: 16061 - DNA, 1501 bp, Oryza sativa
catcccgccgtccccgcgtgcaataaagtggggggaaatactccccgtgattccctcttcctttccccccatttttccctctctctctcggtttcaaacggacggatttgcccccgcaaatctcgccggcgccattgatggcggccggacctcccgcgccggtttcctacctccccggccactctctcccccttccaaccctatttaaaccctccccgcacctcctccgtccgtttccacctctcgccgcccttcctcctcgccggattcgagctcgcgacgtcgctttctctctccgccgtcgccgccgagctcttgtacgccgccatcgtcgccccggaccgcctcccacctcggcgccgcctcctttggcttcgccgcatcctcgccgacctcgtccacctctccgtttcggtcgccgaccgccggagcgccgccgaccccatcaacccgagccgcgccaccgcctccctccgctccggccgcctccctcatcgccgccgtcgccccggggtgagccgtggaccgtcgcctcctttcccccttccctcccctctctcggccgccgctccgccgcgctggtggtcgccggcggcgaccaacggggcacgggggcgccgcctcccgccgaccgcgccggcttagccgcactcgggcgcgccgagtgggccaccgtggaccgtggaccgtgaggctgccgcgtgggccccactcccatggacccggtccgcgcgccctctcccctcggctgacgcaataaaccatttttaaattaaaatttaaatgaagaaattcgtaaatattcatttaaagagcatatgaacttcaaatggccataacttggccatttgaactcggaattggaccgttcaagtctctaatttttccttaagaagttaagaacccatttttgtgctttgttcctgcttgttatatggagtttattagagtaaaagccttttttctttccgttgatcgtgcagacgctacagcttcggaagatccgctctacgtggaggttgaagccgacgtttgggaaagcgagcaaggcaagtcacatcatccttgaacatattgaatcccagtttataaaattattttgatttaaattattgcattatcgctttatttatattcccgcgttatcactgttttatttagccatgcctttttacctttgttatgaccttattatttttgttattgttattattaccttgttcaccctagaataaataaaaccccaactagtggatactctatccatggtaccactagtatgaatttaggtagatgcttcgctgcttaattaggcaacattaggtggttttacaactctaaactttgggaatattcttatcacctggacactatggaatggttggattattgtggaattggattcacacctcctcctcttctcaaaatcctcaaaatggttttaggctgggctcggggtgcatggttttgatagtagcacctcggccatataaggaccggt

SEQ ID NO: 16062 - DNA, 1501 bp, Oryza sativa
tcatgagtgagcctctcttaatgtagtggacattatgtggcgaggctcagtggcagagatgaagctgttttctagttcttgtcgaagacatggaacatctccctctggtcctcctctcagtccttgcccttcacctaatcatctagcgtgctattaggcccatgaacttgtggaagtctatgttgccgctgccgtcgatgtccacctcgctaataatgtcttgtagctccgccttcatcgggttcaggcccagagtatgcatcatagtttcaagtttcttggtagtgattgaacttggacattagactcacatatttgaattccttagtcattttcaaagtgctattttgctcaaatatttgtagtcagaacaacagcattgtctaacttttatatagtaaatataggcattatggttcttgaattatgtatttaattataaataacacaatagatcaaataaattgagaaaagtacatgtaacttgagagtcatgatcatttagctattattttttatatattatgtgttagctaaaataggagatgagagttgcatcctataggagagtcggacggtggagggagtacattcacacgtgcatgctcacatacggtagcggtggaggtgggggtaacagatttatttatgtgcaatgtagtagttataattattgggttcatctattcaaaggaaaatcaatggttcgattttttttatcataatttctattttttagtttatttgagcgtcatatggcatcttaggagtatttgtagaacaccatgttatagtttgagagtgtttgtaggaagtttaatggacttttaatatatagcattttttattgtttacgtattgagctgctggctatagaagatatggataagaaagtgagtaggagacatgatatatgttattttttaaatattttattactatttagttgtgatataaaggagattatgtcaaatgatatatttcttatatatgtacgcgcaaatatatgtaaatatagttcacattaaaatagaatatattataagatattctaattatttagttacgttgtttttatatataaaaattttgctactgtaaatggaaaggaagaagagaggggtggggagacgtacttaatttggatgaacgtacgtatgaggagaggtgggagaggtatggatgtacgtgacatttttgtttaacatatatagatctaatggtgtaaaatgatgggtccaccatattaagtgaaaatcaatggtaggatgttttcgtttttttttcttggaatatcttatatttctctaatttatcagagtgccacgtgacggcttaggagagtttgtaggagccacgtgatggcctgagaacgtttgtaggaagtttaatggacctgcaatatacgcgggcaccttgtttaatgtttgcttgaatttttgaaaaattctttgacttcattttagacatgttttgggtaataactgacacggaggacttc

SEQ ID NO: 16063 - DNA, 1501 bp, Oryza sativa
tgttttagggtgtgaaatatatcatttcacaaatataaaacactaatttaaatctacatatgtaaaaccaatcaaaaaaacacaatttttttcatgtagatttgattttcaaagtttttttgttggattttttataacaatttgattgcatttgagaagtgagcaacatagacgtgtaaatattatcaaaatattttcaaccaatgaacttgctataatagagccccttaatccatcgtgagatttatggctatacatgtatgtattttctctttgccaaatagttttgataacaaataaacaatcacataacatgtgcaattaaatacttatcatgtatgtttttatagttgaggaagtcctccgtgtcagttattacccaaaacatgtctaaaatgaagtcaaagaatttttcaaaaattcaagcaaacattaaacaaggtgcccgcgtatattgcaggtccattaaacttcctacaaacgttctcaggccatcacgtggctcctacaaactctcctaagccgtcacgtggcactctgataaattagagaaatataagatattccaagaaaaaaaaacgaaaacatcctaccattgattttcacttaatatggtggacccatcattttacaccattagatctatatatgttaaacaaaaatgtcacgtacatccatacctctcccacctctcctcatacgtacgttcatccaaattaagtacgtctccccacccctctcttcttcctttccatttacagtagcaaaatttttatatataaaaacaacgtaactaaataattagaatatcttataatatattctattttaatgtgaactatatttacatatatttgcgcgtacatatataagaaatatatcatttgacataatctcctttatatcacaactaaatagtaataaaatatttaaaaaataacatatatcatgtctcctactcactttcttatccatatcttctatagccagcagctcaatacgtaaacaataaaaaatgctatatattaaaagtccattaaacttcctacaaacactctcaaactataacatggtgttctacaaatactcctaagatgccatatgacgctcaaataaactaaaaaatagaaattatgataaaaaaaatcgaaccattgattttcctttgaatagatgaacccaataattataactactacattgcacataaataaatctgttacccccacctccaccgctaccgtatgtgagcatgcacgtgtgaatgtactccctccaccgtccgactctcctataggatgcaactctcatctcctattttagctaacacataatatataaaaaataatagctaaatgatcatgactctcaagttacatgtacttttctcaatttatttgatctattgtgttatttataattaaatacataattcaagaaccataatgcctatatttactatataaaagttagacaatgctgttgttctgactacaaatat

SEQ ID NO: 16064 - DNA, 1501 bp, Oryza sativa
agtcggccacgtcatccagccaacatcgggctggagtctctggatcggggacgacgggcgggtgacgcaagagcgcgcccgcagcttggagcgcgccctggggcgtgctgccatcgccgtagacgaggaggcgacgctccccgtctctccgtccttctccatcgctcgtgggtggcgaagtcgcggatctttcgaccccctcgagcacctcctcccgcctaagacttcggcgagaggggggcggtggagtacgagctcgacggcgcgggttctgctccccgtcgtcaccgctagcgctcggagagaggttgtgcgccactgcccgttcggccattgggctgagcgggagaagcttggcgcacacaaaagaggacgagggcttagaaaaacacacgcgccccctacctggcgcgccagatgacggagcgtggggctcctcaccgggagaccgcgcgggcccccctttgccggttcggccgggggcgctaggtgaggttctaagcactcgatctgtggaatgtttcgcgagagagcaaatgcgcaagacacgggcgatgtagacaggttcgggccgctgagaagcgtaataccctactcctgtgttctggtggatctgtgtatgaaggagttacaaagagctggagagcaagagagttcaaactctagaaaccctcttcctctttctctcctctacgagctcaggtcttctcccccctctttccccagctcctcccttcttaagtgggcaaggtcctccttttatatctcaaggggatcccacatgcaccacttctacctactcttcttttgggtggggactcaccctatcttcccaaaaaagaaaaaactggcttgcgccttcgcctggaagctaaatcacagcttgtttttgagtgaggcccagcgtcatcactcgcctgacaccggggatctccctgttactccctcattaatgggcggagatttgccatggctgttgtccgaatgaccctctgatgggatgggccatacctacctccactccgccggaagcaggcgcaacgtgggagcacggttgtctgccgatgacgtgaccggcgtcaaaccagtcacaaaccggtcattcttgtctaccacgcgtcagtttagcatgccacacgtcagcccttcttcataaaatgacttccttgtaatggttgcgatgaagcctggtatgaatctagccgggactgacgtgctaactccaggagtcagcacgccggctccggctagggacgagtgcctagaggctctcatcattccgacgggacggggcgaggcgtgcgaaaggccgcctgttgccacctaacccgcgatctgaccggtctgtgaccggtcacacactgtgacctgtcacggaccgaacgagtgtgttgcgctgcattaaatgcggcgtggggcgctcgtccaacccgcaataaacgcggttaggtgagcgccgctgtgctcacctaacccacacacgtggcgccaaacccacagg

SEQ ID NO: 16065 - DNA, 1501 bp, Oryza sativa
ttattattattttccttttattagaaacacggtataaaagtagatgctaacaatacacgtacgctcgtatctatgaacacgcacacgcgcatcctacttctataagcacctccaaaaaactggactgacatatattttgaggttgacaaaatcaccatgggcacctcgttggtgatgagtacgtcgcctaccactaaaaaaataattagtcgtaaatatgagcatccgtgttaactctagaacttaaattcggacgaactggttccgctataagaaacttggctagttgcttagttgtctgaccaaacttgagacaacaacttaggacataaatagaattagaatttttatactttactactccctccgttccattataagtgcagccataagttttcgtgcccaacatttgactatccgtcttatttgataattttatgaaaaaaatttaaaagttaagtcatgcataaagtcctatttatattttatcatctaataacaataaaaatactaattataaaaatatttcaaataagatgaatggtcaaagttggaattaaaacttacaactgtgcttattatgggacggagggagtagaaccaagtgtgtattcactataacaaccacatcccgtgaatcccgtggcaaggtcaacatcgctacatggccgcatagtttgttttcttgccgcacggtttggatgcacggctgcataagaaaggtcagagctgagcaaattaagcttaggacgccagtgacttgtgattaccggtaagcgtgctctgaccgtttccatttcttttcctttcactttgtttttcttttcttatcttacggagcttatttaatggttgtggcgtgaaagaaagtttttactgttagtaattaatgagaattatagaagcagtccaaagaggagacttttatttttgtctcaccccagagcatattaagtcatgccgatctgaactatcatatttttttagacttttattattaactaactgtgacttgctttttaaaccctgaatacttctacctagctaccacattttcagccgaggtatatacgatgatgtgtcctatacatcttaaattattaacaaaactgacatgactgaccaactctattgtgataaaattgaccaactctattgtgataaaattcagatttccaaatgtattagtcatttgattatagagcagattattaccacaaattgtgtatttgatcatagggataaattaaacattatgagaaacaaacttaataaatagttaaaaataagttatctaagcagttaatactgcagaagaatgcttttagagagcaaataatctgtttttaataatccgacgaataatctgaaaaaaaaatagggatgcctttagagatgtgattatggtgaatgtgcttttggaaagaatgatgaactaactgtcctcaaataatcatgtcagctggattaattggagtacttttagtgtactccattgtac

SEQ ID NO: 16066 - DNA, 1501 bp, Oryza sativa
gacatgtcccggagccctgatttgctccgcgcccccaccagcgccacgcaacgcacacgcttccaaaatccggatccgggtaaattaggcggcgtttttactgctctcggatacgataaaagctgtgtagtaaaataattctaatattggcctcgtgtcgcgcgtgattgctgacgcggcgctggatcgagctcgtttgcgttgcggcagtggtgacgtggcactgttgaactccgccacgtttcaccgggtggtcccgatcggatggctactgtttttctttttctttttttcaaatcgatgactgttttttttgctgcgacttattttaaacttgtcgatcacgagaatgtgttcacgttcacggtcatatagataagagacacattttattgtttcgagagacatttatagtcacagatggcagatccggcgatgggcgaatttatttcgcatcccacctcaaaattttacaccatatcacatcaaacgtttaaacacatatgtccacgagtgatactcgtagaccgaatatagagggtattggggtacgttggtacaaggatctacgtaatacgacatcaagcaaacagagaacgaggattatactggttcagaccccttgatagataatagccctaatccagttgatatgggattatatgatggaaaagacaggttataaagggaacgatggaactcgatgaaaccgacgggatcgtaatcgagttggttcgactagatctcccggcgatttggctcctgcaggctccgacttcgtaggctgtgggggttgtgttggctccgagattcgatgccttaggtcctccagggggtcccttttatatcgcaggtcaggcggtttccaagtagaactcggagacatcggaccctacacgatacattgacgacccagtctgtccgagtaggattctttccatctgtaaactccgtgaaggatttacttagttatgcgcagaatgtccatatacgcgcagacatgccatatcgatatgtgacgtatatcgaagggtaaagggtatacctaacccgtaaccttgacagtagcccccgacttctgcttaaatgaactcgtgtaaccaatcgcgacttctggtgtcgaggctgttgttgttctcggtgtgagaactgtggagacaggacatagccgagaacaccatgtgaagcccaacggtcatgagcgaatttaaactgaagtgagaaagactgccgcgcgtaacggaccaagaaatttccggcggtcatctctctcctttccttgaaatttgcaccgtcggaagtgcgtttatttaagagagttttggggatccattttgaagtctgcctgttgtgaagaaaccctccaacctccaagcgcttctcgtcttttccgctcccgcaaaaccctagctcatcaatctcagtcctttctccggcgatctccagtcagcgatggatctcggcaagtcctcctccaccagcgcgtcgctgaataagctac

SEQ ID NO: 16067 - DNA, 1501 bp, Oryza sativa; identical to SEQ ID NO: 15733

SEQ ID NO: 16068 - DNA, 1501 bp, Oryza sativa; identical to SEQ ID NO: 15734

SEQ ID NO: 16069 - DNA, 1501 bp, Oryza sativa
ggctcatcgtctcgcggcgccgcctccgtcatcatcatcgctgcggcgtgttccacgccgtcctcgtccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcgttcgtcaagcgagccgctgcagccccgtcctcgtcttcgtcctcggctccgcgtcgtcaagcctcgtgccggccgcgtctcgccttcgtccaaggatcgccgccgaagccgtcccctcgctgttcgtctccgttgcgcccgtctgtctccgccgcgcccgttcgtcgttgtcgtccccacgcctcgtcgcgtggtggtaaggatccctctccctcgctgccccgtcctcgtcctttcggtgtcgcccgtgctcgttgtgcggttgtcggccccggtagccgtgtaccggtgtcggtagtcgttcacgcgtgcgggtggtgaccgtgtagtgtccgcgttagtgtgcccgctcggtagccgcgtggtttccacgtgtgcaggccgtgtggtgtctagtggagtccgtttgtcggccactcgcctcggttgacacacggggtccgcttccgtcgacccgtggaccgtctctgtgtacccggtctaccgcggtcctttaggttgacatgtggggtccgcatgtcaacggcgcagccttcctgtcttttccaggctagcgcttgcacatgttttatagttgcaaagcttaattataataatccgcaaatccccatataacagcattaaacttcggatgatcatatcttggtcatacgaactccgaatcgacccgttcaagtctcttaatgtttgttataacctaaagaaccgtgtgcttcctttttatgtattgttattgcttctttataggcttgtagctttgcttgtgtgcctcgcgtagcttcgtcgttctggaggttcccgaagcgtggttcgcggtcgtcgccgaaggttcggaaggccgttctctctaagcaaggcaagtcacatcatccttgaacatgttgaatcccagttcataaaattattttgatttaaattattgcattatcgctttatttaaattcccgcgtgatcactgttttatttagccatgcctatttacctttgttataaccttaatattattgttattgatattattaccttgttcaccctagattaagcaaaaccccaactagtgggtactctattcatggttccactagtatgaatttaggtagatgcttcgcggattaattaggcaacattaggtggttttataactctagaccttgggaatactcatatcacctggacactatggaattgttggattatggtggaattggacatacacctctcttcctctttcaaaacccctaaaacctgttttccggtggggtttgggtgcatgccagttgtgggaagtagcaccccgg

SEQ ID NO: 16070 - DNA, 1409 bp, Oryza sativa
tggtatgatttgctgagtacagtgggtagtatacagtcttgctctcttttcccccacactagagctgaagatcttcctagttggagttgcctcgttgaagttggtttcgtcgctgccgtcaaggaatgcctgtggagtggagtcgccccactgctgaagtcaaggcccgtcaccgatgactatttttccatttttccaaacaagtctttatatttgtgcgtacaaaatatatagctgctgtataataatttattttattagtcataatacattttcggatactaaatgatttcaaatcgaaatatggtcaacaacaaagttgtagaggttatcaagatctacagcttttattttggtcacttgtctatataactttgttcccaatagcttgaaattgattttgataaaatttcaaatctaaacagcatttgtaaatactaaatgatttcaaatggaaatatggtcagcaacaaagttgatcctctcatcaagatttacaacttttattttggtcatttgtctatataactttgtttccagcagcttgaaattgatttcgacaatatgacaaatctaaacagcatttgtaaatactaaatgatttcaaatggaaaagccataaacaacaaagttgtacaacttatcaagatctacaacttttattttggtcacttcttcatccgataaagtgatagtactaatgtttacataattgacatatatgtgttgatgtttacaaaccagatgagagaaatgtgatttttgtgaataatataactatcactttgtcggatgaagaattgaccaaaagaaaagttgtagatcttgatgagaggaccaactttgttgttgaccatatttccatttgaaatcatttagtatttacaaatgctgtttagatttaaaattttatcaaaatcaatttcaagctgttgggaacaaagttatatagacaaatgaccaaaataaaagttgtagatcttgaaaggatctacaacttggttgttaaccatatttcgatttgaaatcatttagtatcctaaaatatattatgactaataaaatgaattattatacaacagctatatattttgtacgcacaaatataaagacttgttcggaaaaatggaaaaatagtcatcggtgacgggccttagttaaagcccgatagagattaatctatctctatcgggcattatcttagggcccgtcacagatgagtcatctgtgacgggcctgaatatcatctcaatcgggcattagtatggagcccgtcaccgatgagtcatctgtgacgggccctatggcaaagcccgattgagatgactcattactctcctataactagggtttctcagatcggatcgaaaatttttctaagtcccgctacaatttcccgcctccttaga

SEQ ID NO: 16071 - DNA, 1501 bp, Oryza sativa
atgtcgctggacgacacgaggcggtgccaagaggatcatcagttcaccgactcgccatggaaccttgagctccgagtccggaacaacgcacggaagcggaggccggagccgcagccgctcgacggcgccggcgaccggcggttgaaaccgcgcaaagactcgcctccgcttcaccttgacctgaacctgtccatgtgcgaggatcacaccgacgacgacgacagcggcggcgaggaatcccggaactcgtccagtgacctaacggtggagcacgagcaggagtacggccaacccgccgctgccgccgccaagttctcggctccgtcgagcttctccgagctcaccaaagccgtggatgcaacggtggtgttcaagcccgtcgacttcgggccgctcaaacggagcgtctccgacgtggtctcggcgaagctcggggacgccgccggcgccggcgccggtttgtccgtacacgtcgacgacggcgtgctggacaggctggccggcgcggcgtggacggcgggagagtcagccacgtcgttggaggcgtgggccgacgaggtgctgtgccctaccatacggcagctgaaacgtagcttgagcgccaacgatgtcgacggcgcgacgacggtgagcttgtcggcggtggaaggcagcggcggccgccggaggaaggacggcgaggtgttcccgacgtcggtgaccgtcgccgtcgacggaaactgatgacgcagtccacctggcatgcatgcacgtgtttactctttttttttgggttaaattggtcatcaatatgatcatcatcattttgtacattagtacatgtaaatgttcagctgtcagaagttagagatgtacggggctaggaaggagtagttgttttgataatcacattttggattcatttcaacaagacaagcatgcatgggtcccttaatatttgccggtccttattatcattgacctaccaactatgcatgcatggaccaaagagtgtcatcttgtagctagcagtcgttcgtgacgtttagtcagcaacctaatgaattggaacaaagacgtttcggcgtgcatttttggtgatttcttaactagttaaatgatggaggatacatcaatatatatatatatatatatatgcaatatttcaaggttaaggatttgataagtactgttatattggggtaatggcatgtatatgtagggggcatgtagtaacgaccctaacgtattacacgtcactctaggtttggttattcacagcgttttgccatcttttgcaattttttcttgcacaaaccaccttaaccacctgcaaactgacacgacatttcatgttaaaaacctatccagatactgcatatcagtagagcccaagtcccatgcatgcaatgtacagtcatatactggctagtatttgatgattgcctgtacgaatgcaggcaatgctaacagagctcttacacataaggttcacaacccatacagtcccatgtacgaacta

SEQ ID NO: 16072 - DNA, 1501 bp, Oryza sativa
gaggcgcgggcccgggctgtcagtgttgagatggaggaaaaaggacgtggggccggcttgtcagtggctggagggggaagtcttcttcctcctctcgctgcttgctcggctcggcctgggacggcgacgctccgcgggaccgcggtggctcagcgtctggcggccgaggggagcggcggcggcacttgaaggcgaggcgcggtaactccaggcggcggcacagagagaagaacgagagggagtgagagaggagagagatggtgatggtgtggaggacaacgggagagttcgagctccttttataggcgggcgacgcggtgtcgagctggcggtctagacgcggagctttggggtagctggctagcgactagggcgggattccggggtggagaggatggcgacgcgacggagttgcgtcacgcaccggtggccactcgatggcgaaacgacggcgacgcgacacgaagtgacgcgtggagagcgggattggcggcgagacgtgggtgacgcgcagccgacggcggctacggccgggatttggggcggtagggctggagagggatgatgcgagcgacgctggcgacgcgacgcgagagagagggagggatgctgctcggcggtttcatggaaggaggcgagcgacaagatgaagcgagagagaggtgaggcttagcggctaagctccttcctctcgaagcaagcgaacggataagcaaaggcgatcggataaggggatgactcggcctagggttaggggtgacgaagggtgaggtggcggccgttatccgttggtgtcgatgcgacgggcgatgggatggtgacgggacaatggatgacgcgaggccgtgtctcccggagagaaaccggagcgtgggagtgggttttgcggcttggcgcgacccgggcttgacgcggcacagcctcggcttggtgcggggtggcgcgacgtggccctggcacgatgcggggcgcacgggagggtggcttggtgcaatgcggctcagacacgaggcgaaagtggtgcgacgctgggtgagacatttcgtcgtaacatcttgcgtgcgtgagctggctggcctgaggaggaacatgatgaatagtggctgggctgggttgggctggcctggtcggggaggtgaagagaggagggagtggaggggagttgggctggggagagagaagggaaggaggcccaaaatgaacagtgaactttcacctttttccagagatttgtagagttgaattttgaagatatttttggagggatttgaatttgaattttgacctagggtttcatggaatttgaaatgaattctaggagaggatttgagatctctattggcacaaaaacaaataagaaccaaattaactccaatttttaaatgacaaacttttaaataaatccaaacaaaattaagtgtgctacaaactccgttaccaaatatcgtgtctcggtgtcgacatcatgtttggatctcctatggcgtttcttccccgttta

SEQ ID NO: 16073 - DNA, 1084 bp, Oryza sativa
gcgtcagcggagggtagggggcgcgcggccggggtccacggggagtggggccccggcgggcaacctcaaggtccacggtggaccgggggcacgcggctcacagtggccggcgccatgggtcgccacgcgtcagccgcacccgcgggcgcggacggctgacggccgggccccacctggcagccgcggggcgcgcccgaaggcggcctcgccggcacggccgacgggaggcggcgcgcccgcgccccgatggtcaccgccggcgaccaccggcgcggcggggtggcgcccgagagagaggagagaagagggaagcgaagcggcggtcctcggctcaccccgggtcgacggcggcgacaaaaacggcgaccgaagcggcgagaggcggcggtgcggttcggatcgacgaggacggcggcgctccgacggtcggcaggcgaaacgaaggggtggacgaggttgacggggacgcggcgaagccgaaggaggtgacgccgagacgggaggagatccggggcgacgacggcggcgaatcggagctcggcggcgacggcggagagagaggacaacggcgcgagctcgaatccgacggggagagaaagtggcgagtggcggaaacggaggagggaggcacggggagcgtttaaatagcgttgggagtgagagagggcggccggaggggaaggaaaccggcgcggcgatctcgggctccattgatgcgccggcgaagttcgcgggagtaaatccgaacgaatccgagggagagagagagggaaaagtgggggaaagagggagggaatcacggggagtgatttccccctctttatggcgcgcggggacggcgggatgcggcggattcggcggcggcggcggcgctagggcacgggcgggcggcgggtgcggcgcgaggtaggggatgacgggtgggccccacccgtcagcgagggtggcgggcgggccctcccgtcagcggcgcgcgcgcgggggaaggccgatgggccgcgggggagaggagagagagggagggagctgggccgagccggcccaagaagggaaggggggaaaagaagactttttagggtttttc

SEQ ID NO: 16074 - DNA, 1052 bp, Oryza sativa
ttgtgcggttgataagtgggtcccacgtcgatttttacacggtgttggcattagggatgaaaacggtcggaaacggtcggaaaaaccctctaccatttccattttcattttttttctcgaaaatggaatcggatcggtatactcggaaacggtaacgatatcggttatatcggtatctcggaaacggaaccgtcggaacgggaatataccgatatcggacggaagtcgaaaattcatgtcggaaacagcgagcttgtggtatcatcccgcatttaactatgtatgaagataaccttataatttcacccttgcatcatgcagctcctaccatacgctgttatatgatgattaataagtggacaattagattgatggataatataaataaagttcaatgatacttcaacatcaatgtggctaaagcatacaatgtggcttacatgataggattacagcataactaatattgtccgactttttttaggatatagatttgaagtcttcgagaacaccaagctcacaagctggcatggcttcagctgatcagctccttgtcaaacatcattcattatttcatcatcaattgacatagctatatcgtcgtcctacagtggcacattgcataagaacttttatgttgacactgtataactactgttgtaattaagtttcatgctaaactagactttttggtatttccaggtcgatcacagagaggagtcaagatggtggggcccgccagtggatcccacagtctttcttttcctctctttcttttattttttctctctctctcttatccttcccttctctcggttccttttcctgctctctcgatttcttctctgttttctctctcgttctcttctctgcctttggctccttcacgcgcgcccgagaggagagaggcgccggagatggcggcctggcgcagggcggcggtgggggaaggagagaggagaaaggggcggcatcggtggggaggaggaggctggggcggtgcggcggcgctcggtgcttggctcggtggcacggaagccggcgatggagca

SEQ ID NO: 16075 - DNA, 1501 bp, Oryza sativa
aataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggtcgtagaaacattatatggacttaaacaaggagaattatgtaacatgaagaaatagtagtacaatttgaacatgatacaactatttacattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgcacaacacggctaggtggagttaggacccttctggtgtctatccattctctgtattgacatctccttggtggttcatgggaggaaagaataggtgtaaagcaagcaaagtaagtaaatgttgtgagaaaataaggattcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccaacgaccttcttgtaaacaagtggttaggtcgagaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgccagtttggatcctcaacacctcggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtgggtgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcgg

SEQ ID NO: 16076 - DNA, 1501 bp, Oryza sativa
gcaatgggagacatcccggccgaagctctcttcttcccgaagctctgccaatgccctcaccagctgcgggcaccaccttgctcctcccatgggataccctccgcacgtgttccaccgttgccaactaacggggtgacgaggtcttgccagtggctgatttagtcatgcagagggaggggaaaaggaagggaggagagggatggcgtggttgccgtcggcgtcttgttgcttggggcctcggccttgctgagctcccatcattgcctagcgagagagatatggagaaggagagatagggagggggtggtgaggaagaaaatgaaatgaggaggaagtcattgatatatgggccccacctgttgaatgagcgagtcaaccagtaatatccgtagaaaccacttcctaaaccaccggaagagtcaatttgcactggtttttaaagataggggtgatgttatacctagttttatggttaagggaggtaagggtgggtagaataagactgaaccaaagaaccgaaccgaaaagaccgagaccgagaaattcagttagtaattcggtctcagcctgtcaaagaccgaaatttgttcgggtaattcggtcattgggctcgattaaccgaattaactgagaaaaccgaattgtgccccaataggtacaggaggctcaataagtccaatacaccactgaaccttagaggtcacccgctccaacccacatccccatccatcctcatcgcgccgccctccacatccccatccatcccgcgccgcctccgcctctgcctccgcctccatcgcgccacgctgctgcctccacctccatcgcgctgcgccgctgcctccgccctccgccctccaccctccacatccccatccatcccgcggcgcctccacctccgtctccattgcgccgcgccgccgcctccgccccggccaccggcctccgcccttcgcctccatctcaccggcgccgtctccaccttccgcctccatcgtgccacacagcctcgccggtcgcaccggccaccggatccatcctccacctccaccatgacgcgtcggcaccaccgtactcccaccgaccaccgccgcatcagcgtgtgccgcttccagccgaccccaccttggcgcctccgtctccagccagcgcacctccacctcggctcatccaaattcggtcagaccaagaccgagaacgaaaaagccaagaccgaatttaccggtcctgactttttttggatgaaattcgatcctgacttttcaaaaactgaaatgaccgaaagaccaaaaaccgagaccgaaattttcggttagaccgaacgcccacccctaaagggaggcaattcaatctggagcaagatatgagggacgcaaaatagacttattccaaatagaaaagcagaatgactaatgtactgggctggttcacaatgctgggctatactgtacggactatggtggatgcagactgagcttggaaaaaaaaaacgcaccaattt

SEQ ID NO: 16077 - DNA, 1019 bp, Oryza sativa
tattaaattcgaagaaatccaaactattcattatatgatgcgtcgaactgtacaaaactatatagattttgagaaaactccatatgtacatgtgtacctcttaaactatgttcaatcccttctatatccctaagttttgctcatttccttgtataacccgaattttaatttggttcacttccatgtatcttctatatccctaagttttgctcatttccttgtataacccgaattttaatttggatcacttccatgtattttccattagttgatcgtttatttcttatgaaaaatacatataaatttacagagtatattattgaagtatataaatttgttctatgagacttttatatttatgagttatgcgatatattatttacgataaaaacttatttttatatatgatataaaaattaatggttatttaattattaaaaattgtacatgtaaaatattttttaagagtacaacatgtttctgtatatgacaaatctatttatactatacataaacaattttcaataactaataaacaaatattaactttttgtgatatctacaaagaaattctatcataatttcacataacaaactcttaaatataatagccccatgaaataaatttttacccttcaataataaaacttataaatttttatgcttttctaccaaatggcaaaatgaacttattataggaatttaacgatcaactaacactaacaaaaagagtatgaaaggtccaaactaaaattcagaagtatataaaggaatgaggagaattaagggatatagcaaggattaggtaaaaatttacagatacatatggaattttcaattttcttgacgtgttaaacaaagcatcattctttctaaaagaaaatatatgtccttcatccacctccggcatgcgtggtctatgcttgagcagatcaactccaggcaatcaatatggaccacttcgaaactccaatcatcgcatgttggcactgccgcaacatctcctcccccccctaagc

SEQ ID NO: 16078 - DNA, 1501 bp, Oryza sativa
  unsure (1)..(1501): unsure at all n locations
gggcggtggctgctgggccactacgggtgtggcggtggtgcagcgagcggtgggcgtggcagagaggcgggtggtggccaggagaccactgttgtgccctcatccgggtcctctgttgtcggcctccctcgcccaagccgtcgccgccattngcagcgccatccttccggtgcccaggtggagggcaggcctgccctctgccgacaccatcctctgctctccacctgggatcacgtgagctcctcgtcaatggtgccatcgacccccgcctccgtcaccagccaccggatcctctccacctcgccgccatggaccaatctccaccaccaccacactgctccctgcgccgccattctaggccgccgcctccaccgtttgctctgcgcaccttcacgactgcccatcgtcggcgacttggttgacactcccgacaacgcccttgagagagaggggaagaggggatagagagagaggagagagagtctgacaagtgggtctcaccaattttttttaaagaaaattgttggttgcgtacatcacttatgacaaaacagctccggattaggtcgagggggttattcatccattatagatagtttagggatttaaatgtccggttttatggttaagggataattcataatgtcgtaatagtttagcaaggtaagtcgtaatttttcctaaaatatttagagagaacaactatgcataatactagcagctaggattagcaaaaccaatcaggcttcaaatatataccaatcctcgactaatcaccaacaacctcctggttattgcgtttatctcacaaattctgtcatattttaccggtttgcacccatcaataaccgcttaacccgtgttgttttcattgcttttacaaacacaactagcacacgatgtaccgatcaagttcttgtgttccgattaagcatgtcctagcagactgcaacagctcttcaagctacatagctaatggcatattagcttgtcttctccgtccccttgtcgtacgaaaacttagcaatagtaatattttttttgtcttgtggtgctttaaatagacttattacaatcataggtttgttgtagtactggtacagtgtacaagctaacagtgagcatattattacaaaaaaaaaaaagcgcgtccgatgccctaataactaattaggttaattttagctggtcggttcaagatctgaaccaaattaagagcgtaataccattcccagtagatgtcatttttatgttttcaacggtaccatataagcaacaaaacatttaattaattaattaatgattgaaataacacatgcaatgcatagtttcatttttgttatttcatagtaggtaatattttcttttcaaacgcgtaaaatgatcgtacgtcaatatagtagaaagaaaagagttctattacacaacgtaatcggacagaccggcctataccaagggaagaaaaaaaacaaaacaaaaaccaaagctaggaaagtactac

SEQ ID NO: 16079 - DNA, 968 bp, Oryza sativa
cccttggtcccaatccaatttcatcaatcagcagcccaattaacacacaaagcatgtatataatactccctccatattttaacgtacgacgccgttgactttttaaccaacgtttaaccactcgccttattcaaaaattttatgcaaatataaaaatacttatgtcgtgcttaaagaacatttgatgataaatcaagtcacaataaaataaattataattacataaattttttttgaataagacgaaagttcaagcgtttgtcaaaaagtcaacggcgtcatacattaaaatacggagggagtatttgcacgctgtctcgcgatcagagacgctattcagacgttgatctatgatcatctcgtcgttgtcgatatacctaaggtgtttaatctgatggatgactaattaattaatcgatcaaattgtgcgtctcctgatgctacacatatacatgcatatcagtatatcactcgtagtatatacttaattaatttcctttgaaaattgatcgatttacagacagattaagcagcaatcaggacaaattagccacaggttaactaataatacaaatgataagttcatcaattaattgggcagctagcatggagtcaaaaactaaaacttaaatgcaggtgatgacgaggccagcatcgatcgatctatccatatcacttaccaactacacatctctccttgatcataatttttcccgtcatgctgcgagaccattaattaagtagaccatccatcactgaattagcagcaacagtacgtatcgattgatgatgcacatttctaatatgtatatgtatatatatatggtcacgtgcactgatcgagatttgattcacctagacttattcatttaatttctgtgtgattatcatcaggtctcaataaggccaataagatgaaacggagatgaattattttgctccttcaaaagagcgatttgaatgtccaa

SEQ ID NO: 16080 - DNA, 1501 bp, Oryza sativa
ggacacgaatgaaaaaactaatctcataactcgcctgaaaactgcgatgtgaatcttttgagtctaattaatccgtcattagaatatgtgggttagtgtagcacttatggctaatcatggattagactcaaaagattcatctcgcgatttacatgcaaactgtgtaattaatttttctttttatttatatttaatactacatacatatattccaagatttgatctgatgttttttgaaaagttttaggcgaactaaataggcccttatatatattttaacagattcaaagagtgagggattaattaatttggggttcctttctagcgctgcggctcatgcactcatggtgcagtgttgcctttcctttttactctcgcttcaacaattaatttgcgtcagctcatcattgcagatcggcgcgtagctgcggcgaatcagtgatccgtgtgcactgaactcaaccatgagttaatgttttttagtcgtcagaacttttggcattcaatggcgtgagatcttttgcggcaattttggtccaagtgcgacccgtcaaatctttagtttcgtgatttgatctgaacagtagtacgtcacttcatccgtagtagcactacctccgtattcaataggctactacctccgtattcaacgaggtaatattcaatatttgattgtccatcttattcgaaaaacttataaacaagtttttaaaaagtagtcacacataatgtactttcaccgtcctaaaatatacgtatttttttatcctgacatggcctccgagatactactctgaccaacaatacctataaaaataaaatatcttaaataaaaagaattacatattataatagtttttttaatgataaatcttgtaatatcaaatttatatgattgatcttttttatatttctgctattagtggtcaaacttaaaaatgtttaacttatcactatgataaaaatgcttatattggatggagggagtactattcatgtttatcattttataacaataaaaatactatttataaaactttttaaaataagacgaacgatcaaatgttggatataaatagtgtaaaattgcaatctttctaggatggaggtagtaaaatggtactccctccgtcccaaaattgtcctaggatgtacagatacattgttctaagatgagtctcatcccatattaggttgctatattttgggatggatggactatttgacacatccttaaataacaaaactaaaagagagtaaagcaacatgcaaagaattagtaataaacctcaaatcttatagttctctgcatacagaaaaaaacaagagataagtagtgtcatattttggctgaaagcattagctctataaattcttctgaatatctgatcccctccatccaagaatttaattttagattcttgtatcaactgaacttgcctcctttctttccctcaatgtgaagagaatttacatgttagttagcaagaaaaacacacag

SEQ ID NO: 16081 - DNA, 1501 bp, Oryza sativa
cggcaacaggaagattcaaacgtgtaagatgtaccctcaatatattttatacattctgaatttcttttcttcgttcggatctgatcatactagactattttcttgtcagattctactattgtttattagtctacccgtcttgtaaattgtagttttttatggaacgaatataaagtctcctgatgccaggatataaaattcatcttccattatttttgctttagtataaaagtgccaatagtctttatctaattcaagctatgaggctaggcggctatgagcagaccttgaggaaccgttgaaaaacaatattatcttttagaatgacaatcatggaaagatccaatgatatatattttaaacggtggattgtacttacgatatcaataacatattttactatttccatgggagaatgaaaatgactgcaaaaactctagaaaggaatgaaactatcccattctcacagctaatggtgttttggtcagaagcaaaccgaagaatttataaataattcagtaaatgtcacacggataacgcattcaaaaggttgtaaatatattccaatgaaggaggacaagattacgtcttactagctcccctcccaaaatgtatgatactgttgactttttgcaaaacgtttgattatccatcttatttaaaaattaaaaatttagtattaatatgtaaaggtatgagttaagattgtggtttctttgatgataaaacaagtcaactaaaaagtaatatttatatatatattttgactaggactaatgatcaaacgttatgcaaaaagttaacagtatcatataacttcaaacagaggtagaagtagaaccagatagtttctaaacaattaaccacaccatgcaagacaaatttggctgcatcttataattctgtatttttaaacagaggacaagtatgtcgttgaacttcgcagtcactattgactatggcccttcatccaatttgacattgacattgtgtgtgatcctacatagttgaatctcagatacttggctcaaagtatgtccaagtggctcttgtaggatttaaattaattttcgtttcttatataaaaaaactgcatttgctgcaatatgcatttcaccagttagcgaataatgatccaattcatgttgaagcttggttcgaaaaaaaaccaaactacatttgccgacgcaacaagaattatagtttctgacttgttccgtttagcattggtatttgatagccaatcccaattgatagctgatagatacagcataaacaatggatattacagggggagaatagcaatagccaaaaaaacgtacgtcaccaggataagatcgtggttatcccaaatcaaagttggacaaatggaaacaattgcagacattaattaaccaattaaaacaagtcagatttctaatatatgtgatcattttagatagccaagtaggcaattcaagggattgatttgctcacaacacgatacatggccacagcatag

SEQ ID NO: 16082 - DNA, 425 bp, Oryza sativa
aattttatagagtgtaacataaatggtcattttgcatttttaaatggtagcacaaataagtagtggggatgacaccaccataccatatagctattctacagatggacacaactttgcaagtgactaaattttaaaagacaaatatatcttctagatggatattcgaaaccccgtgtatatgccatgttgaaatgatgtcactgttcccaataagacaaatatcaaatggccaattcttatcttcaaagcggcacccaaaaatctcattcatggtttgttgttcgtgactcgaatttctttaatcatcaaggtggcatggcatcttctttgcaattgatgtataattggtatattctactgaatgttctgagaatacactttctttgatgaagtgtgtggtagtttatgataaatatttacaacca

SEQ ID NO: 16083 - DNA, 1501 bp, Oryza sativa
acgacggaacgggcgctacaactgcgcccgtcccggcttggtagtgccaccctccgttctctcttttcgctcgccctctccctccctagctcgcgtggtagctcggccagcccccccgaacacgcatggacaccgccccaggtctcgccgccgcccgccataggcttgccgccgttgccgcccgctcccggaggccgccgccatcgccagccctcctcggcagtcctccgccccatccggtgccggaaatgagttccccgcgccccggagatgctccctcctccttgaatcgacctatcgtcgccccgccgcgattccccctcttgatcgccgccggccgccaccgtcgaaatccgtcgccatcgaatccccttcggcaaatccgatccggtggctcactccctctcgtccttcccattgttccggtgtactccctctctctcgaatcgtcgcgacgagctccggtgaacttggccgccgtccgccgtccatctcggcctccccttcttcctcctcccgccggcccgcgtggctgccacgtaggcgccacgtcggcgccacctcggctttgaccgggccaagccagtcagccgccccctccctccgtcttccctcccgtgcgcgcggtccacggcaagccgtgtggctgcacgtgggcccgccgccatccatccacccggtgcaccgctcctaagccactcgcacccgaaaccctagcgccgcacctcgcgtgcgcccatcccaccgtgggccatgtcaccgacaagcgggccccacctggaacccgcgaggtgcactcagtccaccggaccgctccctctcccttccgcgcgccctaatggaccgcctttcccgcgcccgcgccggcctaaatggctcggccgagcctccttcaacccttaggccgcgcccttgccgcccgaaaaagtctaatatacatccctcgtccatttccttttccataaatcaattccttattccaaaattccatgaatcatttcccttggtcccgcacgtccgtgactgtcaataatattcttgagaatattatttctataaattgacaataatattcttgagaatattatttctataaatttcataaatcaatttccccttgttccacaaatatcttcctttgcccaaaaattccaattaaacttccaaaattcatatctctcaatccgtagctctgattgattccgttcaacttccagtatttccataaaattgagatctatttaatcgcactattatttagtctaaatagggtctttttcttggtcttttgttttggtttttgtttgtttgcgtatagttgcggttatcggattttcgccgatcgcgggttttctcgaagattcgtgaagctccgtgaagaccttgagcaaggcaagtcaccctttgatcaattgctcctataattagaaaatcattattattttgtttacaacttgcattattagagtcacacacataacttacttggcctcggtttgcg

SEQ ID NO: 16084 - DNA, 1501 bp, Oryza sativa
atatttcctgttcatgcttcaggcaggcatcaaatgtagagcaatcggcgcacgatctggcctaccatggcaatccgatccacgcctgactaagtacctgtgttagaccttgtcgaaattgcgagggacaaaaaaaagattgtcattgaataaatgatccatgtttctactttcaaaaaaaaaaaagatccatgcttcagctattgttcaaaagtcgacaggttgggacatggtgatctctttgtaacatagagtcatagactaccaggtcaaggattggacttgtgatttcttcccttggagctatcatttgaagttctagagcattatgtttggtttaacaaaaccaatcagaaacaaaagtcttcagctccctgctgaatttaaggactttcagttgaatgaatgggttgaataaccgttgtcaaagttcagatttttcatagcaagggttaacaactacaaaaatcgagaaaattggcataataccatcgtcaaaacaggtttcgcccaaataccactatgcagttgggattcgccaaaatatcattctcaattgaggggcttcgccgaaacaccattttcttccaattctctctttcctttcatctttgctgaccaaaatgcccctagttgaattaattcaagtaaagcaaatatgtagattacagacaaagtacatatcgtccaaatatcttgacatgcaatatatttttttctttacaccaaattacagagtataagacactatctccacagcataaataaaaaaataattacgtattttttatgagagtttccgttgatagtgtctttttttttatgttatggatataatacgatgcatactgtgtaagaaaaaaatagcatgtaaaaatattttagcgtatttactttataatctacgtattttgatatacttaaattgattcaactagggccattttggtcaataatgatgagaggaaagagagaattggaagaaaatggcatatgggtgaagcccctcaattgagaatggtattttggtgaatcccaattgcatagtggtatttgggcgaaacccctttttgatgatggtaaaatgtcaattttctcgttttttttaatgtatgacattgttgacttttgacgtaatgtttaaccatttgtcttactaaaaattatatgaatgttatttattttgttagcacatattttatcatcaaataaaatataatcttaacttatacttttatatatttatactaaattttcaaataaaacaaatggccaaatgctatgcgaaaaatcaacggcatcagcatcatacacatttatttatgcccagtgctgcgtcgccacgtcatcagccagctggcagccggtcaacgtggctgaccaagcgccacctgcaggctgcggccgacatgtcctctgccaccgccgccgccggcggccgctgccgacatgtcgaggtgcggtccacgacagcagcaagtcgtcggaaagtatgctacta

SEQ ID NO: 16085 - DNA, 1501 bp, Oryza sativa
ggtatatggtatctataaccctgacatctgttagggcatattttgacatcaaaccaaaatgtcctccgtcttcattctatctctcaatttatcccaatataaatttagtttatagtagttgttgcatcgtagtttgtaaaagtagataataattatattaaataagataatgaactcacctaactattacggctaaatagtaaatgtacaagattgtaagtataggttcctttatggctattggattttgctcaaagtatattcgagaagtactaattcgcgcgtacgcgcatgatatcttaccagcgcacggacacatgtcactcgtgaagcgtaggagcgcacggtgctataggataaaatcggaaacaaaaaatgattagtacggttgtcgacgtttgttgtcgtgattccgatatttgcatagtatgagaatcgttggtactaggatatatgcgagattgtagtaaaagagatggggacgaggatttttatataggttcgggcccctaaattgtcaggtaataaccctactcctgttggccgaagccggtcattgctcttattcaccataatcacaccagtataatatttggggtagcctatctaattgttgtcgacttggtgtatgttgtcttgtatgttgatcttgtgtcttgatctattattttgtgtcccctctcctcctagggtgtcttgtatttatacccataggtgtccccttgtccaagtagaactagggaaaatcaatatggatacaatctgagtagtccttgtcgtttccatgtataactccggttgtctttccttatccaaaactccctccatatccgaggtcagtttccgtataagacatgatatgtggtgggtcctgccgagatttaatcaactactattagatatgtggtatccataaccctgacaacggtgattagaacgattagtacggcgattaggggattattgtgattagttcagatctttttgtttcttttcgaataattataccgtattcagcgttgcttctttttaacttttcaaatataagttagatctttcaaataaaattttgaaaaactctacccaaaatttaagacatcatatcccaaatttaaaactttcaactcatatttgaaaacattcaattaaattttttttttcaacatatacttttcatctcaaatttgaaaaactttcaactcaaatttaaaacttttagttcagatttgaaaactttcaacccagattggaaaactttcaagtcaaatttgaaaactttcaactcaaatttaaaaacttttaactcaaaatttgaaaacttttaactcaaatttgaaactttctaacacaaaatttgaatcctttcaagtcaagatttgaaatcttttaagtcaaaattaaaaactttcaattgtatatttgtaaagagttgtgcgaaagattgaaaaaaattggaaagaagcggcacctgcccttttttatccaatgtggaatcgacgac

SEQ ID NO: 16086 - DNA, 1501 bp, Oryza sativa; identical to SEQ ID NO: 15585

SEQ ID NO: 16087 - DNA, 859 bp, Oryza sativa
gagtcccccacagcacccacgctggatccacccctggttgccatcataataactagtaagagtagcaaaactatgctatgcggttgcagctctgtggctgcgttcggcagaaaaaagagagagagtaactattgtcgacgtttgatggcgcgattccggtatttgcaaagtatggggatcgttggtactagggtatatgcgagactgaggtaaaagagatggagacgaggatttttatacaggttcgggcccttgaattgtcaggtaataaccctacatcctgttggccaaagccggtattgctcttattcaccataatcacaccaatacaatatttggggtagcctatctaactgttgtcgacatggcggtctgaaggtttgactcgtagtcgacaacagggcagtcttcctcctcgagttcgtgtccggcgagatcagagacaacgctagatccctacgaccagcctctgtaggtaccggatagggtcgatccaggcgtatctctgatgtcgatatccgatggcttgtcttggcgtttgttggcttgtattggcttgtggctttgtggcgtctatgttgtctgtgtcccctctcctcctagggggccttgtatttatacccataggtgtcctcttgtccaagtagaattagggaaactaatatggatacattccgagtagtccttgtcgtttccatgtagaactctagtcatccttccttatgcgaaacttctcctatatccgaaggttgtatccgtataagacatggtatgtggtgggtcctgtcgagatttagtcaactactattaggtatgtggtatccataaccctgacagtagcccccgacttcgatgcaaa

SEQ ID NO: 16088 - DNA, 1501 bp, Oryza sativa
ggtcagggtgcagaaggtccgcctacaattaagaatgaaattttagtacaaaacactcatccggtcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaagacctgccgcacgcaacctgtatagagcaaacttcaaacataagtacgacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatactaaacaagagtacaaacaaacaaaagtgtttagtccgaacactcatcaccaggtggtcacctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctaaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagatatcacgcctgctcctatcaacacacattatttcataccgatgcacttgtgtgccttgagcaacaactcgatgtctccgtgcctttttgattttatcttccatgtactttgtcactacgttgccaaacactatgttgttatcagccatggacggaccaattttcttgtatcgatccctaaagtacgcttgcgt

SEQ ID NO: 16089 - DNA, 1464 bp, Oryza sativa
ccagcaacagttaagagaatgaagttactctctgtaggacaaaataaagaaggaacatttaatgacacatttttttgaacggtacatttaatgacatattgcatcctggatgtagaggctggggatgtaatttaccttccttatctaaaaaacttatcaatttttttttgaacactcaaaatctttgcacgtcaatatattagaaatctataagaatgaccatatattacagtatctcaaaatctttgcacgtcaatatattataaatctaaaagaatgaccatatattacagtatcttaatatactgacctgaaaaccaatggacagtagtccttccaccggaaatcacatgactggtgaggaggagtatgctttgatccttcaggaggaaatcttgtccacaccttctctttcggatcaaatgctgatgatttaagatccaatgaagcaggagctgactgccttcctacagcatgtctgtatccccaaataatatgaacagcaaatgtcaatgcatcgaatttagaagaccaatgcatcagcattcagaaaacaccaatgacagaataattaactatttgtcattcttacaagtgattcttgctattggactcacatgtcatagacaacaaattgcaaattcttaattaccatatcttaaaagtgtcaattagtcaacatgtgtaataacattagtggacatgaagcaaatcatctcacctgatacccagctgcaagttgagcatcagttcgtagttcttgtggcccttggagatggtctccccctgcttcttccccggcttcggcagcgtgggcgcgcgcatacacgacggtgtccgcacccatgacctgtcgttgcgagtctcctcgccgccgtcctccccctcaaccaggctgtcaatgtcggacgacatgctgttcctcctgctcgacctcctcccttggtcagctccgacctccggcggccgccacatcccttggtcagcggcgacctccggcggccgccacaccggcttcttcgtcacgggctccaccccgggccatgtcagcaccttctgcgacggcagcagcgacaccgtcttcccctcggacatctccagctcctcgagcagcttcgtgatcacctccttgggttcccggggcaacggcaccgccgggccaccggacggcgggtagtacacgcccttgccctgcgtctcgccggactcctggcaccacaggccgatgtacatcccgccgtcggaccaccggaacgtgccctgccccttgggcttggcgtcctcccacgcgccgtcgtaccggtcgccgtccgcccatatcaccgtcccgcggccgtgcatctcgccggccttccacgtcccgatgtactcgtggccgccgcgccagatgtaccggccgtgcccatcctgcagcccgtcgcgccagtggccgtcgtacacgtcgccgttgacgtacgcctgcgt

SEQ ID NO: 16090 - DNA, 1274 bp, Oryza sativa
ggccggccttctccgctcgccgggaccgtctcccgccccggcgtcgcctcctccggcttcgccgcaccgccgtcgaccccgtccacccccttgccgagttcgccgaccgccggaacgtcgtcgaccccgtcgacccgagccgcgccgccgccttcctccgctccggccgcctttttcgtcgtcgccgtcgacctagggtgagccgtggaccgccgcctcttttcccccttcccttcccctctctcggccgccgctccgccgtgcctatggccgccgtcggtgacaataggggcgcgggcaccgcctcccgccggccgcgccgagtggccgccttcgggcgggccgagtggctgccgcgtggggcccggtcatcagccgcccgcgccctcgggtgcggctgatgcgtgttacccacgacgccggccggtgtgagcccgggtgcacctggtccaccgtggaccgtgaggctgccgcatgggccccactcctgtggacccggtccgcgtgccccttcccctcggctgacgcaataaacccctttttaaattaaattttaaatgaagaaattcgcaaatattcatttaaagagcatataaactttaaatggccataacttggccatttgaactcggaattggaccgttcaagtctctaatttttccttaagaagtcaagaacccatttttgtgctttgttcctacttgttatatggagtttattagagtaaaaacccttttcatttctgttggtcgtatagacgctgcagcttcggaagatccgctcttcgtggaggttgaagccgacgtttgggaaagcgagcaaggcaagtcacatcatccttgaacatattgaatcccagtttataaaattattttgatttaaattattgcattatcgctttatttaaattcccgcgttatcactgttttatttagccatgcctatttacctttgttatgaccttattattattgttattgttattattaccttgttcaccctagaataaacaaaaccccaactagtggacactctactcatggtaccactagtatgaatttaggtagatgcttcgctggttaattaggcaacattaggtggttttacaactctagactttgggaatattctcatcacctggacactatggaatggatggattattgggaattggattcacacctccccctctattcaaaaccctcaaaatggttttaggctgggctcggggtgcatggttttgatagtagcacctcggccataaaaggaccagt

SEQ ID NO: 16091 - DNA, 1501 bp, Oryza sativa
tcgtcggctcgtcgccccgctgcaccaccaccttcaccaacatcgcagcggcgtgttccacgccgtcctcgtctccgtgcagccgctgccggctgccctcgtcgcctcctcgccggccccggtcgtcgccgtcgtcatcctctcgtcgttcccggtcgtcgtggcgttcgtccctccgtcgagccgttctcgtccgtcgtccgcgttcgtcaagcgagccgctgcagccccgtcctcgtcttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccacgcctcgtcgcgtggtggtaaggatccgtcctctcgctgccccgtcctcgtcctttcagtgtcgcccgtgctcgttgtgcggttgtcggccccggtacccgtgcaccggtgtcggtagtcgtccatgtgtgcgtgtggtgaccgtgttagtgtgcccgctcggtagccacgtggtttccacgtgtgtaacccgtgtggtgtctagtggagtccgtttgtcggccactcgcctcggttgacacacgggatccgcttccatcgacccgtggaccgtctctgtgtactcggactaccgcggtcctttttgttgacatgtggggtccgcatgtcaacggcgcagccttcctgtcttttccaggctagcgcttacacctgttttatagttgcaaagcttaattataataatccgcaaatctccatataacagcattaaacttcggatgatcatatcttggtcatacgagctccgaatcgacccgttcaagtctcttaatgtttgttataacctaaagaaccctgtgttttctttttatgtattgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgaacatattgaatcccagtttataaaattatgttgctttaaattattgcattatcgctttatttaaattcccgcgttatcactgttttatttaaccatgcctatctacctttgttatggccttattattattgttattgttattattaccttgttcaccctagattaaacaaaaccccaactagtggacactctactcatagtaccactagtataattttaggtagatgcttcgctgattaattaggtaacattaggtggttttacaactctagactttgggatattcatatcacctggacactttggaattgttggtttattgtggaattggattcacactgccccctctattcaaaatccccaaaatggttttaggctgggctcggggtgcatggttttgatagtagcacctcggccatataaggaccggt

SEQ ID NO: 16092 - DNA, 1501 bp, Oryza sativa
gtgacatcaaaactcgtatatataaagtggtatatgtcagggttatggataccacatacctaatagtagttgactaaatctcggtaggacccaccacataccatgtcttatatggaaacaaccttcggatataggaagagttccgcgtaaggaaggatgaatagagttctacatggaaacgacaaggactactcggattgtatccatattagtttccctagttctacttggacaaggagacacctatgggtataaatacaaggccccctaggaggagagaggacacggagcaatagatcaacatacaagccaacatacgccaagacatgccgccggatatcgactttagagataagcatggctagtcccctacggtgtctacagatgctgtcaggagagacatagcgctgtctttgatctcgccgggcacggattcgaggaggaagactactctgttatcgactacgggatggttttatggctgtcaagtcggcaacagttagataggctaccccaaatattgtactggtgtgatcatggtgaataagagcaacgactggcttcgaccgacaagagtagggttattacctaacaattcaggggcctgaatctgtataaaaatcctcatccccatttcttttattacaatttcgcatatatcctagtaccaacgatccctatactatgcaaataccggaatcacgacatcaaataccggaatcgcgacatcaaacgtcgacagtatagtcatattgttcctaagtttaggaatgatggatatggatatatgtggggttaaggtgataatgcaaataataggagtttgtctaacaagtttaacaaaattttaatttattactgtacaattgacatgcaagatttgcaaacattttcaataacctccaaaacataggttcaaagtgattaaagagagggaggtgggacttgccttgcaactggaaaatgtcagcacctaaatcacttcttcaccgtctaagcaatcatctatacaaagtacatgttatgcaattaaacaccgaaatatgcgaaaaatccaaaatgctttaaaatgcatgatttgtgcacagtggataggtattggtctaagatgaatttaggtgaaagaatttctattttatctctttttatttgggagttatgaattttagaaatttgcgtggtataatataggatttacttaggtactattatgaaatgctattgtaaggtgattcttattaagtttatatttgctggggtgaagatatgtgttttctaggactaacatatttggtttcataatttttagagttaatatgaattctttatgtattttacaagttataacatgttataggtgtatagtgttatataggttcatggctttagaggtttaggtccagaacttgcctcatctagccagtgatgtataaaatgagtattttagttaactaatctaatcttagttcataattttagagtttatattattttactacac

SEQ ID NO: 16093 - DNA, 344 bp, Oryza sativa
tcggtccaccaagaccaccttcacggcgaccgaacgcgagacgagcacgtagcaccaccgctcgccgtgccgcgaccacgtgtggcgcccgctgcctccgcgacccaacccaaacaagaaacaaaaacgaaaccaaaccaaaccccctcaaaaatctcgacgcgtgagccataagcccaggcgaccaccgagaccgaccgacccatccaaccaacccgagaccgagaggcgagcagcaaaaaaaaaaaaaaaaacaaaaaaaacaagacggccgcagcagcttcctctctcgccatgcccccacacctctcctcctccctcttctcctcctcccctctccccac

SEQ ID NO: 16094 - DNA, 1501 bp, Oryza sativa
tttcagggctagggatgccagctaaaattaaaggatacaaaagacctgcacatcagagttttgcagaccaaagaatctaacaacaacaggacctcacaggagaaacaataaggacaacacacacacacgaagacccagtctcctgaaaacactacatggtcaaatgtatatcaaatattgtgcaatctcaaacaggattaacttcttgtattaacttgtataaatggggagtgattctccctcccacaaaactctaaataaatttgttttcctgctctatcaatacacaaggcatagttcttgctttcttagaaaacattctcagtcaggatcgctttggagaatttgcatgaaaatgtttggcgtatcagtcgctatcgctactaaattcctcaagttttgctctatcctccatctgcaatagcacactcttaagactgaaaaaaggcatttcaataccgcactcgaagactgaaaaaagaagataaccttaaaaaaaagagagatcaactcagtttgcttaggattttttttgttcaattaattaccgttttattgcgagtttggcgagtaagtccactgtaaaattttacagaagaacttcacatcagtgaataactggggccacggcccacacccacccttcaacagttaagaaaggaagtcctctttctatgtatgtttcaattttgaagatgtatcacaaccaagcatgtctaaaagagatccagcgtcatattcaaagaacacagagtggtttaatattgtagcagcatgaagatgaggtacagcaaacgccaatctcatatcgcggtttccattgaattggaacttgaaagttgaaaatatgacaaaaacatcattgtgggaagaaaaaagagaataaacagtaatcatctcgaaggaaaacataaattggttgacagttccaaacagaaattggtgatgcggatctacttagctgctggtagaacccttggcatcccgcgtcgccgctccatccatcaccgccgcccgccggcgtcatccccggtctcggcgccgcgcttcttcggcccatccatccgccgtcgctcctcatccccaatcttccctcttcatccttccatctgcttttcaaccattgacatatcgtcgaacccatagtctgaatcagccgtaataaacaattgacgcatacagttgacgaacaagtcaatcaagtgttttgtagcgcaaatttgccagaaattccactcaactcgatattaccaaaactgcttgtccatcggttgaacgcgttcgctccctgcgcgcgcttaaccaccactccatccgtcccgccccacacaacctggggccgcatagttttgaattaaaaagaacagctacatcgtttttggccggtgccagtaggagaggcagtgttcaatacgtcagaggatatcgttgcgttgagagtgacacgcgagacgacgggactcaccttgtactctcgcggtggtctctctcgacagcacca

SEQ ID NO: 16095 - DNA, 1501 bp, Oryza sativa
gagacaggacgagtgtttttgccgtcagctgcatccgttgcctatcatttattattatattttgtaacctagaaaaaaaaacttttatgtaatgttggtatgtacttcctctgagaaaactttattaaggaaaaaaactaaaaatatcccttgttaatgctccctccgtccaaaaatataaacatttctagttgcttatccagatttataactaaaatttattatattttggacataaagatagtaagtactactggtaccatttacacgtgaatattaaaggattaaacttcttgaattgtgaatgcggacatcaatgtccgaattcatatgtttcggatgattttaagccccttaataaattggatttttatggattaattttaaatgtgttatagcgtgtttctacgagcataactattatcaatagtctaaaagttaatataaaaaatagactacatttccttaaaagaattaataaaagacaacgatgacaaacactaaagggtgtgctcgaaactgctctttcaccacaaattttagctgcatgcaaaacgagatgaattattagtttatattaattaattgagtattaaatataaaatgcatttgtaaaaacacatcgtttagtagtttaaaaagcgtcctcacgataaatgagggagaaatagattcacactcatgtctgaactcagtctaacttttaaaatttaaattttggccgtggccaataaactaacaaatagattaggaaaagtacgaattacccccaccccgaactatcgcggtcgtccgaattaccccctgaaccacagaaccaaacattctttacctccaactatgcaaaccggacgaattaccccccctcaaaccaattcagagcggttttgtccaacgtggtgcacatgtggcaatccagtcagtgtttttttaataaaaattgtgggacccgcttgccatactcttctcttcttccctccctctctctcttctctctctatctctcgcatggcatcggccgccttcccctcttccctctcttcactctctctctctcacagagtcactgggtggcgcagggcagtcgaaggatggtgcggccgacgacggcagcttctggggcggcgcgtgggctcagggcagcgcgagctcgccggcctccctgcccccctcatgcaggtcggcggggggtggcgacgcagcagcggcaggcgcggaggtggaagcatatggatgcggcgccggcgagcttagggcagagggagagagtgtaggatcaagatgtcgactagaggagggtgaataggcgatttaaaactaaatgacacctaatcaaaactaacctaagttgctaggcttggtgagggtcaactctaactaagcaactaagttatgttttgcaaacctagggtgatagtagctcaattatatctctaggaaagtaaatcacactcctatgtcaatgtttagcactcctagggtgatatgatctcaagtatgt

SEQ ID NO: 16096 - DNA, 1080 bp, Oryza sativa
ccacgtaagcccgtcaacccggttagaggtcatttggacctaaatgagtcacttaaataagatcagggaccctaatgttgattttttttcaagatcatggatctaagtgacacctcactccaactttaaggaccggctgtgtattttactcttttgactatattggttcggttgaagttttacttacaagtgtttgctcaatatttgtaagtatcaaccatcatatcattctctctcttttaatatggtatttttatttctccaaagtattgatacaaagtcccgtagcaacgcgtggggtttcaactagttagtatgggcacatttatagtaatctctagcacgaatcataagacagatcaaatggtatgaagaattctttttttgaaaaaaaaaattctgccgacacaatatagccactccaagatatttaactatttgccacttataaatgggggcaaataactattgctattagacccacatgtcatagacacatgtgggtccacatgtcattgagataggggtggcaaataattaaatgccaaatctacaagtggcaaatagtcaattccagggtttcctgacccggtgacctagtcgtgagttcgcccgccgccgccgccatcccccatccatcccgcgagcgggcatgggcgccgtcgttcgtcctgctgcttccgcggcatcctggtgggcacatcctctgcctccaccgccgtctgcgccgatccccatccatcccgcgagcgagcaggggcgctgttgttcgtcctgctgcttccgccgcatcctggtgagcacatcctcggccgccgccgccgcctgcgccgatccccatccatcccgcgagcgagcagggacgccgtcgttcgccctgctgctgcttccgccgcatcctggtgagcacatcctctttcccatctctctgtacccgcgcactttttgtcgaatttgcgttaaccctagcttctgccttaaccttaatactaataacagtttggttgttcccaaaaagtttaggggttcccatgttagatccgcccctgatagacatagacatactttggtttgcagcgt

SEQ ID NO: 16097 - DNA, 1501 bp, Oryza sativa
cgattatattcgatcgagctgctctgtgttattgtcaccaatcgatgcaatgcatctgtcgatctatagctacttaattagtagtagcaaattaatcgaaataaacaaagttgagcaagcaaattaaagaatgcagccagatgtgtgtgcactgatggacccggcatgtcgtgtcgtctatatatcgatcgaatataacggtacgacgacttccggcaaacgacgatcgatatatatgatgatcaattcgatcgtcgatggttattaaaaaaaaaagaaaaaaaatcgtcgatcgatggatcgtgatggcgccatgtatgtcgacacccccttgatcgctgattcgttggttcgttgttggtcgttggttagtccgggcggagcggggcctcgagatgcgtgccaccgcgcgaggaacgcgggatgagcacatggctgtcctcatccactgctgctgggccccaccaggtactgtgtgcatgcatacgctaattaacggcatgtctagtccaaaacaaaaatttgcacgctttcaccttgaatgtttgaaacattgtagtattaaatatagaaaacaaattaattacatagttcgccatgaaacatataagccagctataaacatattttaaggaaataaatgatgagagagaaggacagcgggctacagattgtagccagctgtagcacagactcagtgtgtgtatgacaggtgggactaaatattaatagtgtaatatgtaactattgtatgaatgagctattagattagctatagatgaattggagctaatagttggctatactatcgaacttgctcttacagtaaacattactaattatggattaattaagcttaataaattcatctcgcagttttctaacagaatctgtaatttattttattattagattatattttatactttaaatatgtatccgtatttccgatgtgacatgctggttaattatttttttcaactaaacaaagcctaaagccaatgtctgtctgcttaattctcgccgacacgccgtcgatgaacttccgaccatatatattttgccaatgatcgtcacatgataagctatagtaagttcatcacgcgtggttcccgtttagcgacaaattaaagagacataaaattattctacataaatatttaaaacatattttattgaattttgtttagatactccgcgggaaactcgtacgaattttagaggagaaatatcattagactaattgagcagatagataaagacatggtgcctccgatttcttaaaggaatttaaaccatgcatgagatttgagatcatgctaaaaatccaccaaaaaagtgaaggaaaagaaggattcccgtagaattttttcaacaaaatcttatttgccaaattttaaattgcttgggttttcctcctaattaagaacctaattgactgaaatgtttgaattcccgtatatcagaaccagtatcgcgtataaaatttgaattataaaaa

SEQ ID NO: 16098 - DNA, 1501 bp, Oryza sativa
tggcaaaatatatatggtcggaagttcatcgacggcgtgtcggcgagaattaagcagacagacattggctttaggctttgtttagttgaaaaaaataattaaccagcatgtcacatcggaaatacggatacatatttaaagtataaaatataatctaataataaaataaattacagattctgttagaaaactgcgagatgaatttattaagcttaattaatccataattagtaatgtttactgtaagagcaagttcgatagtatagccaactattagctccaattcatctatagctaatctaatagctcattcatacaatagttacatattacactattaatatttagtcccacctgtcatacacacactgagtctgtgctacagctggctacaatctgtagcccgctgtccttctctctcatcatttatttccttaaaatatgtttatagctggcttatatgtttcatggcgaactatgtaattaatttgttttctatatttaatactacaatgtttcaaacattcaaggtgaaagcgtgcaaatttttgttttggactagacatgccgttaattagcgtatgcatgcacacagtacctggtggggcccagcagcagtggatgaggacagccatgtgctcatcccgcgttcctcgcgcggtggcacgcatctcgaggccccgctccgcccggactaaccaacgaccaacaacgaaccaacgaatcagcgatcaagggggtgtcgacatacatggcgccatcacgatccatcgatcgacgattttttttcttttttttttaataaccatcgacgatcgaattgatcatcatatatatcgatcgtcgtttgccggaagtcgtcgtaccgttatattcgatcgatatatagacgacacgacatgccgggtccatcagtgcacacacatctggctgcattctttaatttgcttgctcaactttgtttatttcgattaatttgctactactaattaagtagctatagatcgacagatgcattgcatcgattggtgacaataacacagagcagctcgatcgaatataatcgtcgttagtttaataaatcttgtgagacaaaatgaaggtatatatcctctcatcatctcagtgatcaccagccagttagtggcagacctatgctttagctccatggctgcagatagatacagtatatgatactccaaatcaccggtaggcaatggatgaacagtaaatatactgctgctgtttttatataggtagatctgtatagcttagggtcagctagccgccatgtgaaattattcccttcatcattgtacgtgcactaccttcgatcgatcgatagatatgatattccattcatcatgtgtgtgcatgcctatatatttcaatatatgcatacgtccatctcagtaccatgaccaagtagctcaatcggttaattaatctctgctacttataattataattaattgattattagtcacaatccagttatatc

SEQ ID NO: 16099 - DNA, 1066 bp, Oryza sativa
cctccatggctacgtctcgagctcaagtggtgacgtgtccatgtcgtccctgcatgaggtgcacgtggccatacacgtatatggctctgcacagttgatccagcaggtttattttattgatttctttttcgttcattagcagagttgatcagatttcgttatctgatcaagtgctcgagttcatttcatgggctagtgaccctggaagattatggcattgggataatcatgagagatcagcgagcaggtttcattgcatttgcagttcatgacagtttcagataaattaagctctcatgtcagacagtcagcggctgaagctttgtgaacggttaaacgggtactgaagactgcgaatctgcaactagataaacaaaggaagaacatgtgtagcctactaatttatgccattttgttgtggctcttcgtgatatgatggagctgacgcatcagtttcagaaactgttgcgtcaaaagaaaaggtttcagacactggtgtatctgcattctgttgtgctgacgctcaatactatttctcactggaatgttatatacttctggaatattctgttgtgctgacgctcaatattatttctcactggaatgttatatacttctggaattttggtctagttttaatttccctctacagaagatatgatgcttattagtattagcagtatctgtaaaagtttcaacttagaacaaaacgggtccttctgtccaacggggacgtctccgaaactaatcataaatcctgatgacggtagtactcaaaactagtagtgcctaataacgagagtcgtaaatcaacaaaactccaaatgcaattcatacattgtcactggatatattggattcaatgccgatccgggtgtgagagcccacagaggcatcgtgatcgatcataattcgtaatgaactctgatatttaaccaagatcatatggacgctgcagatgcacctccttgacgcaaatatctctccctccctcatcgatcgatccatcgccggcgaagagctaccttagctattagtatcatcgatcatctccggcgagaagaca

SEQ ID NO: 16100 - DNA, 1501 bp, Oryza sativa
caaagtggttttaatcttacgtgacacaatattttaaaaatcggtgagctcatgctcacacccaaacagatattttctcacccaatactaaaaaatcattttcgctgacggctaaaatggattttcactagcggccaacggcaccgccaatgaccaaaggccagtgaaaataatgtttttttactagcggccagctagctgctagcgaaaatcgagtttaacaggaggcatgctaagataaccgcggcaagataaagacaaccgccagtgaaaacattttttggattaaaaaaaatagaaatcggatccagattttgaaaaagaaatgaaaatcgagctccacgaagccattgtcgtgtccatcctccatcgccggcgggagggtggacggaggtcgacgaagaggtgggtcgccaactctagatcccgtgggccgttgccgtcgagcctggccacgaatggaattggaatttgtgtgcggtttcattccatgttcaatccccaacacgcttgcaatttattcttaaaaaatgtagggacgcctctaccttcaattttttttaattagaattcgagcctttgagaatgcatccttatttgttgtacggatgtgatctaaatattggatttataggtgtgatcatatttacggctaattattttgtaagtggtagacttggatctgtcgactatgagatacttgttgtcagagttatggataccacatacctaatagtagttgactaaatctcggcaggacccaccacgtaccatgtcctatacggaaacaacctgcggatataggatgagttccggataaagaaagacaaccagagttctacatgaaaacgacaaagactactcggattgtatccatattggtttccctacttctacttggacaagaggacatttatgggtataaatacaaggcccctaggaagaaaaggggaagccccaatacaatcaacacccaccccaatctacggacaacatagatgccacaaagccgtaagccaatacaagcctacatacgccaagacaagacgctggatatcgacttcagagataggcacggctagtctcctatggtgtcttcggatactgtcaggagagacgaaagcactatctctgatctcgtcgggcacgaactcgaggaggaagactaccctgttgtcgactacgagtcagaccttcagaccgccatgtcgacaacagttagataggctacctcaaatattgtacttgtgtgattatggtgaataagagcaacgaccggcttcggccaacaggatatagggttattacctgacaattcagtggcccgaacatgtataaaaatcctcgcctccgtctcttttacctcagtctcgcgtatatcctagtaccaacgatccccatactatgcaaataccggaattgcgacatcaaacgtcgacagtggcgtgccaggtagggggattttggtgcttcaggattttgacaagatgggttcaaaaga

SEQ ID NO: 16101 - DNA, 1501 bp, Oryza sativa
cccttcgatcgaaccccgccggtgttcgtcgtcatcgttccttctcgccggctcgtcgtctcgcggcgctgcctccgtcgtcggcatcgcagcggcacgttccacggcatcctcgcctccgtgcagccactgccggctgccctcgtcgtctcctcgccggccccggtcgtcgttgtctcgccggctcgtcgtctcctcgcgctgcagcccccgtcatcgtcttcgtcctcgcctccgcgtcgtcaagtctcgtgccggccgcgtctcgccttcgtccaaggatcgccgccgaagtcgtcccctccccgttcgtctccatagttcccggccgcctccgccgcgcccggtcgtcgttgttgttcccacgcctcgtcgcgtggtggtaaggatctctcctctcgctgccccgtcctcgtcctttcggtgtcgccccgtacccgttgtgcggtcgtcgaccccggtacccgtgtaccggtgtcgatagtcgttcacgtgtgcgggtggtgaccgtgtagtgtccgtgttagtgtgcccgctcggtagccacgtggtttccacgtgtgcagcccgtgtggtgtctagtggagtccgtttgtcggccactcgcctcggttgacacacgggatctgcttccgtcgacccgtggaccgtctctgtgtactcggtctaccgcggtcctttttgttgacatgtggggtccgcatgtcaacagcgcagccttcctgtcttttccaggctagcgcttacacatgttttatagttgcaaaacctaattacaataatccgcaaatctccatgtaacagcattaaacttcggatgatcatatcttggtcatacgaactctgaatcgacccgttcaagtctcctaatgtttgttaaaacctaaagaaccctgtgctttgtttttatgtatggttattgcttctttataggcttgtagctttgcttgtgtgcttcgcgtagctttcgtcgttccggaggttcccgaagcgtggttcgtggtcgtcgccgaaggttcgaaaggccgttctctctgagcaaggcaagtcacatcatccttgaacatattgaatcccagtttataaaattatgctgatttaaattattgcattatcgctttatttaaattcccgcgttatcactgttttatttagccatgcctatttacctttgttatgaccttattattattgctattgttattattaccttgttcaccctaggttaaacaaaaccccaactagtgggtactctatttatggttccactagtatgaacttaggtagaggcttcgctggttaattaggcaacattaggtggttttataactttagactttgggaaatctcatatcatttggacattatggaattgttggattatggtggaattggacatacccctctcttcctctttcaaagcccctaaaacctgtttttcggtggggtttgggtgcatgccagttgtgggaagtagcaccccggccactataaggattaa

SEQ ID NO: 16102 - DNA, 1240 bp, Oryza sativa
tgcctggattagctaggattaattaggaggacattgcgtagtggcttagctatctctcaaaagcttaattgggagttgtgttcatatcccaattccgttaattaccgaactataataaattgattttactgtctatatatagtatatctatatatcttcttctgagttctgaccatatacaaacctttcatataatatatatgcaagcttttaggccattgtagcacttgcatctatatacttctccgtcctaaaatgtagtcctaaaatataggggattttagccggatgtgacatattctagtactacaaatttgaacaaacagtatattcatatttgtactattagaatatattacatccggttgaaattccttatattttagacggagagagtaaatactaactactatgaaagaagaggaatcaattaatactaaatttttaggcattgcattccattccatttgaaagatagctgcatctgcaagggaaagatgttcataaatgttgtctctcttggatataaagatgcaggggaaagaaccctaccaaccggcagtaaaagtaatgttgctaactgctatacactgtattaatcagattgacaagttgggtgtgtgttcgattcaccaacctgcatccagatagcttaactagatcgatccaaaaccttagatgataagttggtgaggtgttctcctttttggatgcattgcatttacagattgcccaaccaagattcgaattgaaagggctaattcgtgaatattcaccgtggtaagaactggcgcgaacgcccgacacacacttttatcttttctgttttcaccgtgtttttatgtttctggtaattaaatttgttccaagttcgatttggaatcgaaagtttatatgatctatttcaattcaaaatcaaagtttgttatgaataatgtttctctacaaaagcgcgcaataggaccgacgagtacgtacgcgaggaggaccgaatgcgcgatgcgaacattcacaagttagacctatccaacaccaaaatttgtttcataaaatttgtaaaaaaaaattgtttcatttaatttaatataatcactagcagtcgcaggtcaattagggagacatttccatcaactatagtatacgtgcatttgtgttttaatcaagaaaacaaacaattatttagcacaagtggcgtgtgtcatatatatggacaagtacaatggtcctgcttagtttccac

SEQ ID NO: 16103 - DNA, 1433 bp, Oryza sativa
ttatgtttttagggacagcctattcaccccccctctaggcgtcatcagcgcgttcaagaggcgcggccgatgggggaggccgggttggcgcgagaggcgcgtcttggtggaggaggccggcttggcacgagaggcgtggccggcagtggaggaggcgacctaggtgtgaggaggagctgccggtgggtgtggtgtggtcttcggcgcacgaaggctggccagcgggggatgccggtgcaggggtcccacatgtcggcagagcttgtgtggtggtggagcatcggtgcgtcagccgtggattcgcaggtggtgagtggcaggtgaaaacctagtccggcctcggccggattgacaacgatggttcattccccctcctgagggcgttgtcgtgctctctcacccctcgagggtggttgccgggcgaaagtccagtcttggctcctttgagtcccgacggacgatggcggcagtttttctgtcacttctcttcttaaagacgtcgttttggcatccctaggaggtgatcttgtctgtgtcccctagtggcggtcggtcatgcttagcagcggccggtctggtgctagtcttatcctgggcttgtgtgttggcgatgtcggtgtgtgggtcgtggtatattttttcctttttcctggttacgaccctccagggttgtaatcttgtaattttttcctgctctatcaatggaacttcgcaccttctcgtgcgagtcgttcagaaaaaaatgtttaacaattgcttgcgatgaaagtacgaggctggtcgcttttgctggggactagctaagcgtgagtaaggtttctgagtaattgagataatagtgaaatgtagtattttggtcaagtctccttagatatgcaacacatttgtttgccaccttcgaattgtttgacaagcatgtattaggttgaagttgacagacaagctattccatcgaatgtctctcttactcaccatgcggcatcgtggttagtatattgaaaggtgtcaaccgtgattgtggatacactgaggatgagtgaaaaagatatttggcagatggttgcatgcctccccctgtgcgacgcaaccacatggcgccacggaacgctgcggtgacgacacgtggcgttttttttccctttttttgttttcttggtttctttcagtttttccttggtttttgttcttttttttacggtttttttttcagtttttaatatacgtgtatacaaattttgtataagtatatatacaaagtttgtatacgtgttttcttgttttattccaatttttttaaatatgtacatatatattgtacacatacgtatacaaactttatgtacgtgtatattattatacataaaaaatacatataaaaattatacatatatattgtatattgttggtgaaattacaaccagggtacccatttc

SEQ ID NO: 16104 - DNA, 1501 bp, Oryza sativa
tcaatttttccagttaaaaatcgattgttccttgtcgtattgctcgtatatcttaaaccctaataatatagtcacattatggatatatggggatggttgaatatatagctattgtctatatagtatagatgatcgttgctttgacgtgatacccgaaaagatatttgtaaccgatagtggtcgtatccatctaggtacgtattcgtctcatatttgtgcccgatattatccgtgcttgtatccgtattcgatactatccgtatccaacccgattccgattataaaatgtgggttaggatatgggaagagtgagatctgaccgaacccgacccgatttcacccctaacgggaggggatttgattgggggggtgttgcatggggggtggggaggggtgggggtagggtgtgagggggtagggtgtgtggggaagggtgggggtatactgatctaaagcagtcttcaagaaacccactaagatttgaaacctgcattaccccgggtacctgggcttctgtccgagacagctgggtcacgccagctagcccttggtggaactcgggctgcctgaaatagcggcacggttctgcttttgcccgtttagctaaatcaggtggagcgggcatgtttgacactcgtccaagacggcaccggtggtaatgactcagcgctagaatggttggggctccccataaacctgtttcatttataaaagagaggactgcttcacaacagcctgtgtagcacgcccatcaccccaactggccctgaggtcgcgccctcgcgctttttgtcatgattcatctattctcagacgagcttctcgaagatgtctttgatgagtagataatgtagttattttgtatgtttcgacactcttctttgtagaagaatgcaaaaactacaaggactaaggcgtgcctggattccaggacgaggctggaatcgaggaagaccttggtttataccttctaatcatatgcctccaccctccactccttgcaaaaagtgtgacttatgaggactaaggtgagctcgggatctagaatatggtcgagtctgaggcagaccttagtctacttcttaagatgtagatcttatatgtctctacgcttctcttactgagtagcgtaggtcttataaggactaaggtgagcccgggacccaggacaagaccgggtccagggcagaccttatgttacattcttaagacatagattttatatatctcaacactcctcttcacaaagcagtgtgtaactagacgagctaactaagctcgagacccagagcaatgccaggttcgaggcggaccttgtgctacatacttatcccataagaagatgaaggtgggcacggtacccaccaagataggacccctagccgcactagtctgggtgtagctttttatttttaagaatggtttgagcatgccatttattttatttgtaattgttttgccggggaaatgggtatagttggccataaggccggaggcccga

SEQ ID NO: 16105 - DNA, 656 bp, Oryza sativa
ccgggactaaagatattttcccgctatttccaaattctttttaaacccggttagggttaagaaccgggactactgataaatccactgaatattaatttccattacatatgtgtttctaaaatagaaaataatgcgttaaaattatttaaagtagaaaaattaatgacaattacttcgaaaaattattgttgtctgtaataaattaagtggataaaacgtaataagaaaatatatgatttaaaattaataaaaattctaataataatatatacttagcatatgaatgatattaaattgttaaaaactctaattaacatatgtatatacatacgccatgcatgatttaaaattaataaaaattgtaataatcatatataattagcatatgaatgatattaaattaattgttaaaaactctaattaacatatgtaaatgccacatgcatgatttaaaatttttaaaaattcgaatagtcatatataattagcatataaatgatagtaaattaattgttaaaaactctaattaacatatgaaaatgccacctgcgtgatttaaaacttttaaaaattataattatcgcatataactatcatatacatgatttaaaattgttaaaatctctaataatcgtgtgtaattaacatatgccata

SEQ ID NO: 16106 - DNA, 1501 bp, Oryza sativa
ctaataagccgttacaacttatagttagcttttggacaaccaacgaggccatacataatactcttttattacaagattagtcctcagtttacataacaagatttataaaaaaataagcttaattttttttatggatcggggcagtgtttcatacctgggtccttattatacttcagatactagttgtacgactgaagggatacaattgtgttagttgcactagttccctctttcaatgctttcataattacatgaactatttccgtctttcagatattattcttcatgggtttcgccatgttcgtccttgagacgttgctgagcatatgggtcatgcaggtaagcgcacacacacgcattaattaactttgcctacatatataaacccagtgatataacttccttcaagacagaatgttaatcatgggaaaacctctgcttctacttgcagaaagtatattggtatttccgcgggaaagggaaggaggccgagatgaggcctgatgctgcagcaggcggctcacggttctgacgacatagcaaccctgaacctgaagctgcagctaaggatagacaagatcaagcttgaaattgttgtgaagttgtaagtggatttgttggattgttgtggacttgtggttgatggaagtgcaagaactgatgatgtacttatagatcagaattgtttcacttgtcactcacatagatattttgtttgctcaacttactttccttgtctgatagtctgaaactacagttcctagaaaagaaagtagaagcccaatctgtgccttgttcagatgctagctagtagtagctgctacagagaaaatctttcggcaagcatatactactccatccaaaaaaaaaaacatttctagcaacgaactatatccaggttcataggtaagatagtttttttttagggagggggtatgttgttgcatcacgcatatatatactttctgtctttcttgacatcatgtcgcaatccaatggaaagaacagatacggggaaggccgttctcgcaaaatttcagctatgaactcgcgaaatcttgcaacatggatgaaattttgcgaatatctagtaaagtgtgtaatgtagaaacgtacgcggtcgctgtcagggtgggtaagggggcggcaaagtgagagaaaaacattaggccgagtctgagtcgttgcaaggctgaggtgtttgacggcaacaaaaaaagtaaacacgacgggctgagcctgagcctgccaaatccacgcggagtccgctaaaatttttccactggttctagatgatcgccatcgatgatgcaacgaccaactgcttcctctgcggaatagctgaataaattcagagttcaggtccatctaggctgctgctgctgctcttcgtctttgctgacctcggcacaggcagagagagaagccaagaaaagggaaaagagaggaagaagagagggaagaggagaagggagacgcgcggtgatcggaggttgatcca

SEQ ID NO: 16107 - DNA, 1501 bp, Oryza sativa
ggcttctccttcgccgccactgcctagggcatccccgtgctgacaccgccgccgtatctcgctgtcgtctcgcgctcgtcgtcatcgccgccatctccgccgccgccgcctccctctcatcagctatctctctccctctcggttgccgccggccgcctcgttgcagacgccgacgccgacctcgtcacgacacgacgtcgcgccacaacgacgccacggcggcacgacacgacgagacgccacgacgccgccgcggcacggcaccggcgccgcgccgccacgccaccgccgcgcaacgccggcgtcgtgccgcgcgcttcgccgccgccgggccgccccgccgctgctccgctgccgccacaccgccgtcccgctgccgccccaccgccgtgaacgaacatgaacgagaacgtgaacgagcgaaagaaacgtgaacgagaacgagaacgagcgaacgaacgtgaacgagaacgagcgaacgaacgtgaacgagcgaacgaacgtgaacgagaattgaacgtgaaagaacaaacgaacgtgaactaacgagcgtgaacgaacgtcaacgaacgttaacgtgaacgaacgtaaactaacgaacgtgaacgtgcacgatcgtgaacaatagtgaacgaacgtgaacgtgaaatgcaatataggcaggtgaatgaacgtgaacgaacaaacgtaggtgaatgaaacgtgaccttaacgagaacgcgaacgtgaacgatatcgtgaacgaaacgtgaacgtcaaatgcaatatatgttacttcgcgtttatcctaatacatctttttgtatcttgcagaaaagacgttgtcggagtcgtccctcaagccgaagtggtagctagccctcgaaggaattcgcgcagacaagtgacataattatatatatgattgttatatttgtaatgctaataagactattagatttaatatacgacacttagacttagcatatatcactatttgagttttagtataagattattagatttgtaattagacttagcatataagattgtgtagggttctaatatacgacagttacacttagcatacatgactattttagttttagtataagattatttgagttttaatataagattattatatttgtaattagacttagtatataattattgactagctagggtcctataatatacgtcacctagacttagcatatatcactatttgagttttagtataagattattagatttgtaattagacttagcatataagattgtgtagggttctaatatacgatagttacacttagcatacataactattttagttttagtataagattatttgagttttaatataagattattatatttgtaattagacttagtatataattattgactagctagggtcctataatatacgtcacctagacttagcatatgattgttagcatataagattgttaaaacataaatgtctcatgacttagcagatgtttcctgtatgaacaga

SEQ ID NO: 16108 - DNA, 867 bp, Oryza sativa
catcaaccgggactaaagatatttttccgctatttccaaattctttttaaacctggttagggttaagaactgggactactgataagcgcactgaatattattttccattacatatgtgtttctaaaatagaagataatgcattaaaattatttaaagtacaaagattaatgacaattacttcgaaaaattattgttgtgtgtaattaagtggataaaatgtaataagcaaatatatgatttaaaattaataaaaattctaataatcatatatacttagcatatgaatgatattaaattggtaaaaactctaattaacatatgtatatacagacggcatgatttaaaattaagaaaaattgtaatcatcatatatacttagcataggaattatatcaaattaattgttaaaaactctagttaacatatgtaaatgctacatgcatgatttaaaaattttaaaaattcgaatagtcatatataattagcatatgaatgatagtaaattaaattgtgaaaaactctaattaacatatgtaaatgccacatgcatgatttaaaacttttaaaaatttgaatagttatatataatttgcatatgaatgatagtaaattaaattgtgaaaaactctaattaacatatgtaaatgccacatgcatgatttaaaacttttaaaaattctctagtcaattataattagcatatgaatgatagtaaattaaatgttaaaaactctaattaacatatgaaattgccacctgcgtgatttaaaacttttaaaaattgtaagtatcgcatataactagcatatacatgatttaaacttgttaaaacctctaataattgtgcgtaattaacatatgccata

SEQ ID NO: 16109 - DNA, 1501 bp, Oryza sativa
gctcgggatctgtccgcagcccaacatgactgtacctctactctataataaagagacctctgttgctgtgatattctgtcttcctgtgataccagcactatttcctgggactggtatcggttaacaggttaatttggagcgtcacgggctagttccgatcggtactagttcggggcgtgacaagagatggtatcagagcacaagcttggccctaggacgaaacccgacgcctaggacgaccctaaggatactaagttccaaactacttgcgaaaagctaaggtttcttttgttttctttattttcaatagtttgtttctaaaaatggttactgatcctttctccctttttcaaaattgtagatggcagtgagcgccagcttcagctcccacggttttggtgagggtcaccacgtcgcttagcttcgtgacctcgcccgtttccttggcttctcgtgtcccgagtacacggggtactccgtggaccgtgttccccctcactgtgagctctctgtgtacctttacccccgtggaggtatacacggagctggccctcgtccacaccacttcaccgtggccaggcccactctccagatcgagtaccaggacctctcctggactgcgcttcgtcgcctggcccatgactacagccaccgtcttgggggctccgcctttcggcagcttccacgccttccagtggcccgcgctcccccagctcgcgtgcgccgtactcaccagtgtactccccctacccacacccagttagcccttcctacacccccggacacaccccagttgcttccacccgccgtggcccacgctttatccgcactgcgcggaagcgtgttgttggttcttccactgtgttccgtttccactacccagctcccccaccgccagcggcccgtgctgctgccagccctcgacaggttccgccggtcccttcgcgtcagccgatcgacgtttcttcgactgaggagccgaccacaggaggcagccaggccgacgaggagtagaggaggcagtcttcagcagccgtccgtgtgttaggcccttttgttccgccgccaactcttttggagtcgtggcgaggtagtgcgtgcgtgtgtttgttgtgggtgttgtttggtagtctggttttcttagggggggcgcgcgcagtcaagctcggggtagttttgtgatttgtccccacccgttgtattaggtgtttctatgatttgaaaaatccagtttatgcctagtgtgtgctatctgagttgctatttactttgctccttgccctcctaagtgctatctgactattaccccgccctcttctgggagtttagatggctagccgcccccgccgtgcagctcgtgcaccagcccgctttggttttgaagatggtagagttgagccagaagaaaatcatgagtcagctaatgagcagtctcaccacagcaaccgttcgcaccgtactgcttcccgcaacgcagaagttgagcaaccccgccgcagca

SEQ ID NO: 16110 - DNA, 1501 bp, Oryza sativa
tcgccatggtttgctccgtcgctcgccgctgtcgaccgccgtccgttccggccggcgtcgtcgtctacctcccgccggcccgcgtggcagccacgtaggcgccacgtcggcgccagctcagcctagaccgggtcgagccgaccccggtcagtccctccccgtgcgcgcgttccaccgcgagccgtgaggctgcgcgtgggcccgccgcatccgcgtccaccgcgaaccgcgcgcatgcaccgcgtcccttccccaccctagcgccgcaccgcgtgctccctccgcacggtgagccgagccgctgacaagcgggtcccacccgggaccgcgcacggtgagcccggtccaccggccctctctctcctttcctcccgcgcgcgcgcacttgggccgccttcttgggtggccgtttgaaaagctgttggccgggtgccaaccttgtttcaattctaaagactgatacatactccgaccggacgagacgctctgtctcatccgagtcgtttgagaagcactcacttagttgttttcagaaaagagttcaaataaaatcaattgcaaaaacaacagccttcccttgaagcctgcattaaacacttaattcccttggcttgctgagtactcccgtactcacccttgctctatataaataattcccccccagttgctgaagaagatgaagcggatccggctgatgaggagttcttccaggagcaagccggctacgttgagttttagggtttcggcctagttcccaagtcgcgcctgtgatgtttggtctaagccctggcttccgtttcccttttgtaatgcagttgtgagctcgggatctgtccgcagcccaacatgactgtacctctactctataataaagagacctctgttgctgtgatattctgtcttcctgtgataccagcactatttcctgggactggtatcggttaacaggttaatttggagcgtcacgggctagttccgatcggtactagttcggggcgtgacaagagatggtatcagagcacaagcttggccctaggacgaaacccgacgcctaggacgaccctaaggatactaagttccaaactacttgcgaaaagctaaggtttcttttgttttctttattttcaatagtttgtttctaaaaatggttactgatcctttctccctttttcaaaattgtagatggcagtgagcgccagcttcagctcccacggttttggtgagggtcaccacgtcgcttagcttcgtgacctcgcccgtttccttggcttctcgtgtcccgagtacacggggtactccgtggaccgtgttccccctcactgtgagctctctgtgtacctttacccccgtggaggtatacacggagctggccctcgtccacaccacttcaccgtggccaggcccactctccagatcgagtaccaggacctctcctggactgcgcttcgtcgcctggcccatgactacagccaccgtcttgggggctccgcctttcggcagc

SEQ ID NO: 16111 - DNA, 1501 bp, Oryza sativa
ctacctcgccacgactccaaaagagttggcggcggaacaaaagggcctaacacacggacggctgctgaagactgcctcctctactcctcgtcggcctggctgcctcctgtggtcggctcctcagtcgaagaaacgtcgatcggctgacgcgaagggaccggcggaacctgtcgagggctggcagcagcacgggccgctggcggtgggggagctgggtagtggaaacggaacacagtggaagaaccaacaacacgcttccgcgcagtgcggataaagcgtgggccacggcgggtggaagcaactggggtgtgtccgggggtgtaggaagggctaactgggtgtgggtagggggagtacactggtgagtacggcgcacgcgagctgggggagcgcgggccactggaaggcgtggaagctgccgaaaggcggagcccccaagacggtggctgtagtcatgggccaggcgacgaagcgcagtccaggagaggtcctggtactcgatctggagagtgggcctggccacggtgaagtggtgtggacgagggccagctccgtgtatacctccacgggggtaaaggtacacagagagctcacagtgagggggaacacggtccacggagtaccccgtgtactcgggacacgagaagccaaggaaacgggcgaggtcacgaagctaagcgacgtggtgaccctcaccaaaaccgtgggagctgaagctggcgctcactgccatctacaattttgaaaaagggagaaaggatcagtaaccatttttagaaacaaactattgaaaataaagaaaacaaaagaaaccttagcttttcgcaagtagtttggaacttagtatccttagggtcgtcctaggcgtcgggtttcgtcctagggccaagcttgtgctctgataccatctcttgtcacgccccgaactagtaccgatcggaactagcccgtgacgctccaaattaacctgttaaccgataccagtcccaggaaatagtgctggtatcacaggaagacagaatatcacagcaacagaggtctctttattatagagtagaggtacagtcatgttgggctgcggacagatcccgagctcacaactgcattacaaaagggaaacggaagccagggcttagaccaaacatcacaggcgcgacttgggaactaggccgaaaccctaaaactcaacgtagccggcttgctcctggaagaactcctcatcagccggatccgcttcatcttcttcagcaactgggggggaattatttatatagagcaagggtgagtacgggagtactcagcaagccaagggaattaagtgtttaatgcaggcttcaagggaaggctgttgtttttgcaattgattttatttgaactcttttctgaaaacaactaagtgagtgcttctcaaacgactcggatgagacagagcgtctcgtccggtcggagtatgtatcagtctttagaattgaaacaaggttggcacccggccaacagcttt

SEQ ID NO: 16112 - DNA, 437 bp, Oryza sativa
ttccggctgtttgatctctaattaccaaatcaccgtgctgatttttttcaccatagtggaacaaattgtcaaattgagtatttgagttgtttctacgattgtcatgtgcgttatggttctcactcactgaaattcatctcagataaacaaaaggaataagtccattttacctctctcatctcttgcgcttgcgtgaataacatccctcagccggaaaaccgggtataacgcctccttcttctctaaaaaccagagcaaatcacctctctcggtggtttcggaggcggttttgtcctacgtggcacttacgtggcggttgacttcccatgtggcatcgacgtggcgcttacgtggcactaaaataaaacaaacctaaataggacccacatgtcagtgagtaaaacaataaaaataaatgaactcggcggcgagcgaga

SEQ ID NO: 16113 - DNA, 1501 bp, Oryza sativa
cgatggtggtgtgcggagcgacgtcatggctcctcctgcgatggcggaggaggcgaaggtgtcgtgcctgccgctcgcgagggaggtcggccgcagggcggcggcggcaggcggcggccaggggcgcaacttcatcgtctcgccgctgtccttccacgcggcgctcgcgctggtggccgacggcgcgcggggcgagacgcagcgcgagctcctgggcttcctcggctcgccgtcgctcgccgagcttcaccgctcgccgacgacgcggctcgtcgcgaggctccgccacctgccgaacacgtccttcgcctgcggcgtgtgggtggaccgcggccgcgcgctcacgccggagttcgcggacgccgccgcgtcgcgctacgccgccgtcgccgagcccgccgacttcgccacccagcccgagcaggcgcgggagcgagtcaacgccttcgtgtccgacgcgacggaggggctcatccgcgacgtcctccctcccaactccgtcgactcctccacggtggtcgtcctcgccaacgcggtccacttcaaggggacgtggtcgctgccgttccacccgtcggcgaccttccacgcgccgttccacctcctcgacggcggcgccgtgcgcgcgccgttcatgacgacggagatccccttcgagcgccacgtcgccgccttccccggcttcacggcgctcaagctcccctacaagaacgtcggcggcggcggcggtggcgacggcgtgccccgagccgcattctacatgctcctgctcctccccgacggcgacggcgcgctcaagctcgccgatctctacgatatggccgtgaccacgccggagttcatcaagaagcacacgccggcggcggaggctccggtgaggcggctcatggtccccaagttcaagttctcgttcaagttcgaggcgaagtccgacatgcggaagctgggcgtgacccgagctttcgccggcggcgacttctccggcatggtgaccggcggggacggtctcttcatcgccgaagtgtatcatcaggccaccatcgaggtggacgagctcggcaccgtggccgccgcctccaccgccgtggttatgatgcaaaaggggagctcactgccgccggtggacttcgtcgccgaccggccgttcttgttcgccgtcgtcgaggagctcaccggcgccgtactgtttcttgggcatgtggtcaatcctctcgctgaataaataagggatttaggaacaaaattatttgcccagttgtgatttgtgaatctgtatttgccgaaataatttcagtttgtaactctcatgcaaactttgtactatttgtttgtaatcagtgatttggtaaattcgatagatggttcaaatgatctgtacaattcagtttttagcccttgttggacgaatggatttcacactaaggaaataattcaaaacggaagacaatatgaacttttgttccacaggggcctcaggttggtttaacattagccattagga

SEQ ID NO: 16114 - DNA, 1450 bp, Oryza sativa
aattaaaaattagttttaaaagattgtcaactttaattatgctttatattataggatgaaaagtgtacatagttaattaactatcagtactccgattaattgctatagacgttgtcaatcattcgagtctcgtgaagtactccctccgtactcataaagaaagtcgtttaggacagcgacacggtctccaaaacacaactttaacttcttgtttctataaaaatatttattaaaaagtgatatatgtatacttttatgaaaatatttttcaagacaaatctattcatataatttttatatttttaaacttaacaacttaagagttattcatgatttatatttccaatgtttgacttaaacattgtcctaaacgactttctttataagtacggagggaccaaaagaaacaaaagttaatggtgagcttctacttcacaggttgtcattaaaaatgtattcacttattccctccgtctcaaaaagagccaacttaaaaggagatgtctgaacaaacagatggacgtgtaatgttgtggaaatcaaaatttaagcctttgtagctcgagtatcacttttatagctcatgtgcttcctgtagatgaatcttgtagtcgcgattccaagcaactgcgcgtagctagtcaacttgtagtcaactctctccaagtcaaagcgtgacctggtcgttgacttgagagccaagctttgttcactagctcacgaaaccactaatttttttaaaaaaatataagatagattaatatgtaatatatcactttgcaaatatacaagttcaaattcgatttctacatgttgtaacaaaaataacaaataaaactctaactagtgtacgtatattcacagtcaaatttattatttttgttataatttgtagaagtcgaatttgaatttgcatatttgtgaagtgatatattacatattaacctatcatgttagtttttttgaaaattttttataaccatttagatgacatacaagaaacgagtggacatctacccaagtgtttaaaacagtttcccttaaagcttgtttcacttccatcgccgccttctcatgggccacgacgccgcagctcaccgccgtgacggccacgaccggcgccaccacccttaccgtggcgcggaggccggagccgcacgcgcaggcgcggcgagcctcctcgtcggcagcggcgagcagggcgccggtcaggtcctgagcttccgttccggcggccggccttggctcgggctcgcgttcgcggcgccgcacccatgggcgaaccgggacgagcatgtggtgcagcgccacgacgcgccagagtttgcgccaccgcctcctcctcgtcctttctcctcctgggaccgcgtgcccatggcggcgctcgccgccggtgagccgttctctggtcgagcgacgggaggcgatggtggtgtgcggagcgacgtca

SEQ ID NO: 16115 - DNA, 1501 bp, Oryza sativa
gaaaagctaaggtttcttttgttttctttattttcaatagtttgtttctaaaatggttactgatctttctccctctttcaaaattgtagatggcagtgagcgccagcttcagttcccacggttttggtgagggtcaccacgtcgctcagcttcgtgacctcgcctgtttccttggcttctcgtgtcccgagtacacggggtactccgtggaccgtgttccccctcactgtgagctctctgtgtacctttacccccgtggaggtatacacggagccggccttcgtccacaccacttcaccgtggccaggcccactctccagatcgcgtaccaggacctctcctggactgcgcttcatcgcctggcccacgactacaaccaccgtctcggaggctccgccttccggcagcttccacgccttccttctggccactcagacgccaggtacccttgtccgtacagcgagtctcagctagtgctgactcgcatggttgagctttcggaggctcaggccactcagcacgacctactccttgaggcttaccgctcccttgcccgccgctacgccgccttggaggcccgtctggccgaggagggtgtcacctcagttgacactatctcctgggactcaggccgcctctgccacgccagccacctgtcctcccacagctcccgcggctctgcccgcactcccagtggcccgcgctcccccagctcgcgtgcgccgtactcaccagtgtactccccctacccacacccagttagcccttcctacacccccggacacaccccagttgcttcctcccgccgtggcccacgctttatccgcactgcgcggaagcgtgttgttggttcttccaccatgttccgtttccgccacccagctcccccaccgccagcggcccgtgctgctgccggccctcgacaggttccgccggtcccttcgcgccagccgatcgacgtttcttcgactgaggagccgactacaggaggcagccaggccgacgaggagtagaggaggcagtcttcagcagccgtccgtgtgttaggccccttttgttccgccgccaactctattggagtcgtggcgaggtagtgcgtgcgtgtgttgttgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgtgtgctatctgagttgctatttactttgctccttgccctcctaagtgcttgtctgactcttacctcgccctcttctgggagtttagatggctagccgcccccgccatgcagcccgtgcaccagcccgctttggttttgaagatggtagagttgagccagaagaaaatcatgagtcggctaatgagcagtcacaccacagcaaccgtttgcaccgtactgtttcccgcaacgcagaggttgagcaaccccgccgcagca

SEQ ID NO: 16116 - DNA, 786 bp, Oryza sativa
attttcccatttttgtatttttgttttgattttttttgaattttttgatttttttgggtggtgttttgaattttctgcaattttgttcgtgacaatttaaaatttatgtaatgaaatctttaaaccttagtccaaataaatcaatcccaccaatcccttacctgtccaaacaaaccaaatgataatcccgtggtgaaagggattgggtggtgggaggggatcaacccaatcccctccggtgaccgttttacctggttataattatcccttgcggtctgtatggttggagggagtttctaggaggattaggagtttagagagatgaggctattaactgttttgtttggttgggggaaatgggaattttggtgggatgggatggggaattgaggaatgaactccctccttttcaatacctgggtaggggcaggtaattgggagggaattcctcctttacttcgcctaaacaaatctcagccatccgttttcattaatgatctaatctccaactaaactccctatcaattttcaccacctctaccaaacaagagactgagatgaaaaatcaaattctcatcttaatctcaccattaatttcctcgtgtaaatttccaatccccttccctcagttgccaaacaagctgttggtgccgaccgaggcctaaatttattccacggagtgccaagcccataggatactgaggccctctaaagaaaggcatcgactccagcttgaatttaaatagctgcaagcatgatgagtctcatacatcttatcttcttagg

SEQ ID NO: 16117 - DNA, 1501 bp, Oryza sativa
gaaaacatggctaaaaaataaaggtaaaagaactattcgataagagctaaagtcgggggttagaatcaaatcaaccatatatagctcttataaaggagaaggtcttctttccaagggccttcttcacatcccattaggcttagggatcaatttggactaaaaaaatctcggacccaagcaagaaaattaattggacttagagttggactatgccggtctgatcggtcacatgctgccggacagactagcactatggcgattggccagatcggcttcacgtggcaagctgagtccttttaaaatttggccatatttttctattttcacattaggtgctaaatttaagtgttaaccgccatcaccttactaaacttccaaggcgttactaaaccactatcagaacatcacttctgggcatatcggtctaaaccccacaaacacgacaccacttttacaggcttcaaacgggcatgaggtgttacaatgaatttctcagttccaacattgccctaatccaagtagtgcccaaatgcaaattgatcaacttgagaatccagccggccgccggcctcacacatgcatgtccaatcctacatcaaccctcccttttgttcatcgtcatgagacgatctttccaaccggcaagaatctaggaatacgcacacacaaaacagctcatgtcatggtcgggggctcgcagtccaaatcaaacacacccggatcaatcgaatactccactgtgaactttaaattatggagccagtgtgggggcaaacgatttatatgtgcaaattgagattgatgatgcatatggaaaaatttaatgacagagattgatagaaagaagatatatagttatgtatatatatggatgatcgatccgacaggaatgagaagcggatggagcagaatgaaagatttgattcccatgatcgatcacacacacgacgcaatgtatggtgatgacatttatgccaacgcccactgcacatcacacacacacagtgcagcgaattgatcggattaaacccgggaaatgcctgcagctatagctaatgcttgctgtagccgcccggtgacactgacagagatatatagatgtgtccatgcgtccatccatcggcagcagctgatcaatcgatcgatgtagctgggcaactaggctggactgaaaacgatatcgatccctcatggcggcgtttgccgatcgatcgaataatggcgagagctggcggctgagcttgcctttttgtgtgcgtgtgtgtgtgtgagcagtgctagcctagccactccctccgtttaatattataagtcgttttgctctagtcaaactcttttacgcttgactaaattcatagaaaaacatagtagcatttttaatatagaataaattgcattggtggtatataaacttgttaggtgggtgcaatttagtacatgaacttgtaaaatactcgttttgatacacgaacacgaacttatctaatccatgcgaactagg

SEQ ID NO: 16118 - DNA, 1308 bp, Oryza sativa
ccactagaagtaaatgtacgagagatcgctacaattgactggttgagaaccaatgagtaggtgtctctcgatcatttgaagtcgtggtgtgaggaccgctgcgttattgatgtagtcgtacctcaaccatctgaggttgcggtgcgagagattgctacgtactggttcgaggactagcgaacgtgtagaatcatctctcgaacaccaatggaagttgcggtgtgagagattgctacgtactggttcgaggaccagcgaatgtgtagaattatctctcgaacaccaatggaggttgcggtgcgagagattgctacgtactggttcgaggaccagcgaacgtgtagaattatctctcgaacaccaatgggggtgctagagttggtttattacatgtgcgtctcatgtggccagcatgactcacgcacccaacttatagcatatccggatgtccgttcacaatcatgtcgggtgatcaagtcgatgacgttcgcgagaattatccgttaatgaccttttctcgagtagtagtccagccatggccggtgctatgagataggtcgtcggccttcgttggtaggttgggcgcgacgactctacatttgtcgagaccgttctcgataatgcggtgtacttgaccacaacctactcgagtgctcaattgttcctgaaaaatattttctagaagacgagacatatagcagagaatatcgagtatgtactcaaaaaactgcatggatcttctagcattatcaggatataacgagcagaaaatgtcagacattatgtagactgtaaacaagcatgatttatacagaagaagacagagcgagctcccagcgttagatcgtagtcgatataacatcggggacacctgcgcaacagatattgtataaaaaacatgctctgggtaaacataataaattattgatctgacaatgctgtatgatctgaatagatacgataaattgcatataaaatattgcgtacctttgtagatacatgccggatgtatctacgaaattagtagatcaatttgaaaaaccaatctaccaattaccttattgcgtactcgtttgacgtcatatgatctgacatcctttggtacgtcgcgtatcttgaagcttggatgatctcgatagaccaagttgtcgatgacgatgatggttccgatctagtcggaagatgtacttggacaggttggatctccccacagccaaagtcatcgagtagcttattgttggagaatccctcttgaacccatctcgtcgaaatcctgaagcaccaaaatgcccctacctggcacgccac

SEQ ID NO: 16119 - DNA, 1501 bp, Oryza sativa
tcatttatttattaatgtaattttaacaattaggaagctgtgatgtgtcttgatacattattttaatcaataatatatagatatatcttttcctatatattattggcttgaaaatctatttagaaggaatacagatgggtgcctgagtaaatattcatgactaattgaattgaagcaaatcttcaaatagtagtattcacattttattgaattattccatagaatctgacgaaaacttttttttaccaaaacgaagaaagctattttccaacgaaaaagaatacagaagtacggcaaaaagaacgtagtaaagggatacctgcgaaaatggtttttaaagtagttcaattgcacattacacaacctggcgtatagagagaacaaaatgcttgtttatgttcagaaaaactataaatcgatatgtaagttgcctgcttcaaaattattatgaaacaacttaatctttggtgaactaataaatttttactgtcagtcgaccgtgataaaataactctatcgatacgccaaagatcgtaataatttcaaacaaaattaaaaatatgttccagaaaatatatgtatacagtgacattaacagatcagaaccaaagggaataagctgtatttttcttaccctgtatgattgcactgctgttgacagttccatcatcccacatacatgttgccttgttcctcatctactcagttgttaatttttattcggaattaaaataaattgaaaagtgaagaacttgttagtaccatggatgaagccccggccaggagcggtcgaacctggaaatcatgaatatgatggggctgaccgtcttgccggacgattccatcgaatggtcgctcctcacgacgatgcctcggttgcatatcgtgctgcctaatccgccattaattccgatcggcatcagctaggctacgtacgtacgtggttaacacagcccgatctattgacataactggagataggatacgtccagatatattaacagattggatatccatatcaatgtaggtagttaacaatacgtataatagagggactctctatacacgttggattcgcttaaaaaagcccatgataacacagatttcaatgtacggccatgattttacaatccatctaatcaatggttagatgtttctggttaacgtgagagctccaaaaaagtgcccgattagtataggtatagatagatagatatgataatagcttaaatgtatgcattatatgcaccataaccaccctgagaggtcctgctcggaggatatctgacattttcatcctggttccgatgatttctggtggtaacaaatactccaaaaaatagaataaatgcctaacacagagactattcaagataagataccatcggaaaagcaatcatgcttaaagaatacagaaatgaagtaaagattgaggacacaattccatttttatattaaataaagattcattatgttaagattgttcttcgcagacaacaaa

SEQ ID NO: 16120 - DNA, 1501 bp, Oryza sativa
acattgcaccacatcattctacatggcttgtaatctatacggatcgatgaccttctgcgaaattgcgttcatgaaagcacatagctttgttattgttgcccggacattgtctgggaggataccccttattacaactagtaacaggtgtgtcatcaacacgtgatagtcatgagactttagatttgtgaacttcttctccttcgtgcttgttattcgctttatattcgtggagtatccagacggtaccttgatgctctccaaacattcaaacatactttccttctttgccttgctaagagtgtagctggctggactcaagtaatggcttcctttctcctttggttccgggtgaaggtcaccgcgttgttccatatgcttcagatcattaagtgcttccagtgtatctttcgactttccatatacacctaggaagccaagaaggtttacacaaaggttcttagtgaggtgcatcacgtcgattgcgtggcggacgtccaagaattcccaatagggtatgtaacaccctaaaaattcgacgacaaaatctaaactctaaaaatacggaccttcaaaaactttttaaataaagttgcatcatgccgattttgttcgattattttaatgaattttgatttcggagtttataaatcgcgaataatggataattagttaggagtaaaccctaaaaagtaaattgaccaagtaaataattaaagtgcaatttaaaataatatttagtgaggatagaaatgagtaaaatattattacgactatatttgtatcaattaaattgaaaagtgtcggaataagaattaactctaattaaattcaagaaaattatataaaaataaaatatgggttaaattaatcaaggatggacccattggttggaataacacaaatattgagtgaacttcatttgtacaaaattaaggtttatagaatcaattttaaataaataaataggcttaaatcgggtaaatagaaaacggcactattcatcggccgccaggtgttcgacgaggtcccctagcctaaccctgcgccgctgccgcaccgacgccgcgcccgcgccccacgcctcgcgccgcgcaccgccgctaccgccgtcgccttcggccgtcgccgtcgccgctcgcccgtcatgtcgccttgcgccccgtgccgccgctgccgcgctgtcgccgtcgccgtcgcgacccgcctcgcgccgcgcgccaccgctgccgccctgtcaccacccgtcccgtcgcgcgcgcatcccatcacccgccgctgcgccgtgcactgtcgccgtcgccgtcgccgtcgccacgtgccgttgccgtcgccgcctcgagccctacaccgccgtcgccatcgccgtcgcgccgcgccgcgccgtcccatcgccgcgcgtgtcccgtcgccgcacgcgtcgcatcgccgcctcgcgccccgcgctgccgcgccgccgtcgcatcacccccccttcaccgccccctctctctcctctctctca

SEQ ID NO: 16121 - DNA, 471 bp, Oryza sativa
tatgttggtttcggatgtttttttacaaaatagatcaaaccatccaaaataatgggtctaccaattcaagtaaaaatagatggttggatttctttttatttattagagtgccacttgacaacttgagagcgtttatagggtgccacttggcggtttgagagtgtttataggaagtttaatagacttttagtatataatagatagatagatagattgcttcatgatttgacaatatagtgttacagtaaacatttgctaattacagattaattatacttaataaattcgtctcttggtttaccgacgaattctgtaattagttttttttattattgtccaaacacccaaacacgtcgtaactttacacctctagatctaaatcccatagctatagtaggactagctatacatttatcacaaatttaatccgcccgcgctaactacccgagaagccactgctgctgtcttagc

SEQ ID NO: 16122 - DNA, 1501 bp, Oryza sativa
ctactcctccctcacggtcacgccggctctctcccctcttctgtccgcaggcgctggctcccctcctccctccgccggcaccagctctcctctcctccggcgaaggacggcgacgaactcggcgaagaacagggagactaagcaggagactacaccttattaacttattaactcagtaggcagagcatcaaagcatgcattcatcggccattggactgtcgaccttttgggaactccaagagtataatattatccttcctcaattcatatccatgcaaacaacaaagatctcaattcttcagttcatatccatgcaaacaacaaagatcgcaattttaatgaaatggttagctgcttgctcaccttgttactgcaaatgtttacgaagttcatcccattatgtccggggagaggcattagaaaatatacaaaatgtacttcaaggtattgctttagatcgattgaagcactaaaacacataaaactgatgttgcttcaatgacaacagtggtgcaatattagacagtactgatgctccctgtctataccaaagaagctccctgtgtcatccattgaattaggatgcagagaactcgttcgcgaaaaaaaaacgtccgcgatgcagagaacagaagattgacctaaattgcaattaagatgatcgtgctcaagaaaatagaggtgggaaaggggtagtaaagggtgcttgggaaaatcacagaaatgcacacgttgaaacaaaaacagctatcaagtgagtgtcagaataatcacagcatatatatcaatgtaaatattagacatctaaatatctaaaccccataacaaatgttggtaattcagcatcaagaaaaattgagtgcacataagaaatccacttgcaaagacaaatcttcttggggaataagaatgactaaccagcattgcatcaaacaccctcttggaccggagtattaatgatcattttgtccctagtaatcctcaaaatagattgactgggaggcactaggcatgtaaattgatcggctcgtaactcgatgtcttgcttctgttctggatcaggatgaaactacgaaacaaaaagggacaaaacagatccacattatttgcactccacattcagaaattgacttcaggaaaggggataaattgattttgtaccttcactgctgagagagaggagagatcgaccagccccatcggcggcgacagcggcggatggggccgaggtcagctccaaccgcggcggtggggaagaagcaggctccggcggcggcagaagaagatgtcggcgtgggcagcggctctagcgaggatgtggcggcagtccacgtggagaaggggaggactccgtcatcgccgccgccgtgccggcgcagggccaggtggtggccgcctccgcctccgattcattagggttcgcggcgtgggaggattgggaaagtttttcttttttcctccgaggtggtgttcggcggcggcatcgcggcagggaggtgag

SEQ ID NO: 16123 - DNA, 1501 bp, Oryza sativa
acttcgtattttaaccgaagaaacaaactaccggctcgttagtcattactaatcacgattaagcatgtaatttggcatgtaattagccatgaggaagaagagatgaaacggcagtcggaacattcgtgcgatactactagatgctaatcacgtgcatgcatatatatgcagcggagaagcgataagagtccgttcgcttgtcgcgaacgctcgcgaatcagactcacccgaaaattaatgcattttgtatcatcttgcaagaaaccgataccataatgaaatacattacatattgtttcgtacagtacacactctacgtactcgtccatgtatagaaactaattggactgcgatgagttcccacgataattaaagaagaaaaatatcaattgggatgggactgaaatataatattttggattaaaagtagaagagttcacattgggcacaacttttgtaaaactaattttgaatttaaaactgttaaatcaagaagaaactaataaaattaagacatgaagataaatatctatcggtacttttcatttaagattttcaaaattatttgatagaaaaaaatggttatatgttgagaaaagcaattttactgtactaacaactgaatcaaaaataaatttactgaccaaccaaatatatgccaaattaaactctgagattatatatatcttattttcttttttctatgaaggaggtgggtttctgttgttccgaactaaaaaaaaataaccaccaagatatgttgtagcattaaagaacgtgacgatagcaatagtagtgcaacttgtatttcgcttgcatgtacatacgaaaagtatacgtaacaaaaggctgcgagcctatctctctttgttagaacaaggtttaatattttataatttattttaatttccatcttcaatattttttatatctatctctcctttcctagtctgttggacttgagattgccctttgctatttacttctacgtgcataggtagccttttgcacatccggtacatttttttttaacaaagattaagttttaaaccagattgatggcactcttgatttaatatgctctgataattctctcaaaatagtttgggcaaaacatagaaaatttaactacacatatattaactctaaaatgttctgactatatgtacatcttcttattttcatgttcgtattacttgcaagagagaattcattctatgctactgagtttaatttagttcaacgatttgtaatcgttattgattttgtctcactctataatatgctactaactttgtcaattttttctacaatatgctatttatttggttggatactttttaaaaaatgcctataaaatatccttcaaaacttactagagttgataattgattgatctactggaagtttcaaaaacatatgaaattttttatatagccaccttatataatatagaagtgtgtatatttgaagaatttcattttgcatgcattaacttttt

SEQ ID NO: 16124 - DNA, 1371 bp, Oryza sativa
tatcttgggaggttgatacatggcaagggtacgatatcaatggatacacagtttataccgtcacacaagatgtgagagcacagtgcaaaacagtggagtccatctagatgcatatcaggatcaggctggatcgagcacatactatggccgcatagagcagatatgggagctgaactatctgaacttaaaagtccctttatttcgttgcagttgggtgaatatccgcacaggtgtcaaggtcgacaaggaaggcttcacattagtggacctggccaaggttggatacgcagactaaccattcgtactaggaagcaggccgaacagattttctacataaaagaccctgcaaacaagaagatgcacgttgttagggatggcaagcgaagaattgtgggggtggacaacgtcgtcgatgaagaagaatacaacaagaatcttcatgtcagacctcagatcgaccttgacgatgatcccaaagactaagtggcttacgttcgttcacaccatttggaaggcatatcactgtgaatgatgtatttaatttgtattggagccttaatgaatgaattgcatatgtttcatgccattccagttaaaactatttgaagaaatggatttgttaattatgtggttttaaaaaattatacttgttattttaaactatatgtgagatagccaatttttaattatatgaatttaaaaaaagtaatatgaattttaactatatgtgagaaaggcaattgtcaattatatgaatttaaaatattaataggaattttaaactatgtaaataagacatttgttaattatatgtgataacaaatgtaatagcaattttaaatctggtagaagataattataaatgatttttataacttaaaaatattttaataagtcatctgtgacgggctttagtactatgcccgatagagattattccatctctatcgggcttagttctaatgcccgtcacggataggtatcacctgtatcgggcataatactaacgcccgtcacggatgagtgccatccgcatcgggtatagtagtctgcccgatagagatgaggattgactagggtttacttagtcaatcctcatccacgggtccttatccgccgccgacgccgcctctcactctctcactctcccagatccaccgcctcctccatgcccaagaccgccaccgccggcttcatcgaccgccgccgcctcctcgtcctcaacgctgtcgcctcctcctccctcgaagatccacgggtccttcaccgaccacggccgcctcacatcctcctctccagatctacgcccggcggccgtcgacctcctccacgccgctacctcctccgggcccgctcaagatccggcctccc

SEQ ID NO: 16125 - DNA, 1501 bp, Oryza sativa
atttgatctattagaaaaaaggaaaaaggaaaaggaaaaagggatgatgacgtcagccctggaaacaatgacgtcagccctaaggttgacgtcagcatgacgtcagcgacggcggccggctcgggacgacgagctcgccggcgctagggacatcggcggcggaaacggagaccacctacgcgtagagggcaacgaggcgaacccattggtactcaccccgacccaaaatgatgcacgacggcggccggcgacgaagaagaaggcggcggcggctcgggttagcggcgacggcggcgctccggtggtcaacggcgaaaacggaggggcggccgagcttcttctcctcacggcgcacctaacggtggtgacggcgaccgacggcgacgacggagacggcggcgcgacgatgccgaagatggccggcggcggcggcggacttggagctcgtcgcgacggcgctaggaggcacgggaggactcgggaaagggggcaaacgaaagaggagatcatggggaaggtttatatgagctcgaatcgaacagatcaagtcgcaaacgagaggaatcgaatcgggaagaactcggactcgttttttagagataaaacaaaacgagttcgattcggatcgaatcctcaaccatttgctttgattcttgggggaaaagaaagaggagaccgagaggaacaaaacccctcaatcaattggaagagatggggtcggattcggccggaaacggcggcgcaaaaacggctagggttcgggcttcggcggcgcggcggccggaggttgaagacggccctgacatgtgggccccacatgtcagcggctggagagaggaggagcgggcggctcggctgggccggcgtgggccgcgcgcgggaagagagagaaagagagaggagttgggccggattcggcccaacggcctaggaggagattttaaaaactttttcaattaaaaataatttgtgaaatgatgtttcatttattaaaaatacttcctttgctcaaataattcccagaaaaatctagaaaatagaggaacaagcaaagtatttaacaaaattttatctagctcatttttatgttgagatttagcaaattaaaagaaaagatcttctcttttaaacttttaaaatcatttctaataattccttttaaacaacaatttataatttaaggattttaaacaagaaaatcacttaacaattataattagatcattacctgattaatttgatatttaaataattgctgaacttttctttgtatgattaaaattaacaattgagctccgaaaaatccgagaaaattccagagagtataattaatcatggaggacttaataaaaattaaatccatctatgcttttttttatttaggaaattttatttcccacatttaacttcacttgtaaattaaagaacatttaatataaattctattaataatttattaaataatttataaatcctgaaacgaaaatcaggatgtgacaga

SEQ ID NO: 16126 - DNA, 1501 bp, Oryza sativa
tatcttcatgtttatatgaagagctaggtagtacactctcaatgaaaactgctcaatgttgagtaaaatattactcttttaagtagttaaaaaggaaccgctcaacttttgagtaaactaaactcagcttgtgttgagtaaaaactctgctcatctattgagtagaaatagtactcaataaaagactaaatatctactcagtttgaatgagtcaacctttactcaatatatattcctttgttgagcggttccctttgttactcagcatttgggtagaaacgtacacaactcacgtcgagtaagaaactgctcatgagttgagccaaatcttacttaattaacgagtacatattttgactcaatttattttgactcaatttgtttgagcaattttttgctcaaatattgagtatcatgttttctgggtaacgcttagttgagtagatttttttgctcaatcaataatgagtaaaaacatgtactaagctatttaatacatgttattagtacatgtttttactcaatactgattaacacaaaggtggattcaaccagggttgtaactttttgactaaggggttaactaaaccgctgattaatattgttctttttttaacagctgttaagtaaccttttttttttaatagagaaaataaaccataattttgcctgatttctaaatttagcattgatttgaagttcttcactcacacactatgcaaatcacataaaattcacgacattttaaattaaataacataatatgtggactttaatttcccaaatcagtttgaatcacagtaaaaactcagagttctcccatcatacatgatattaaaaagtatgtagtttaacaatttcaattttaaaacaatgttactttacatcgcatcatcataatcagcatttaagtttttggcatcaattctgaatgttaaatatcagtaacataatttgtggactttaatttccaaaatcagtttgaatcacagtgaaaactctcatcatacatgatattaaaaaagtatgttgtttaaaaattgtttaaaaccttcaattttaaagcagtgttactttacatcgcatcatcataatcagcattcaagtttttggtatcaattctgaatgctaaatatcgcactcatcttgttatgattaacgccatcaatgaaagtcaggtaaacaaaaattaatacatgaatctcctgattacagagttacaaatttaaagatttaaaagccgtggtgccgtggtgctgagtgggcttttcccaattatcccggcgtttttatctgaccgttaggccgtagaaagcccgtaaagggcccgaatggcacctaatgggtcccgcgcgggctccagacggtgcccggatgccccctcacgatttttgggggccaattctcatgaaaaatcttcacgggcgccttgcgatgctcaagaactccatacgtgtaccctaatgctccctcacgggcccctcaagagccccttgtgata

SEQ ID NO: 16127 - DNA, 160 bp, Oryza sativa
cggggggcgggagtgcgcacgtatttatttttaattttttgttggccggggggcacgtccctgtttgccagtacatttttggcgcaatttggggctgatttcaagattattttttttgcacgtgccccctgtgccccccccccggatccgccactgtaga

SEQ ID NO: 16128 - DNA, 176 bp, Oryza sativa
gcggattgggttgaggggggtaattcgtccggtttacatggttaggggtgaagaatgttcggttttgtggttcaggaggggtaattcgatcgaccacggtagttcgggggggtaattcgtactttttcctatattataaatcacatactgcatctccattctatgcgccaaatagg

SEQ ID NO: 16129 - DNA, 1501 bp, Oryza sativa
gtcaccccacctcctccactctcctcccccacttttccccccctccaaaaccggcaccgaaccaccccactcgcccacgtcgccggcgcctcttcccccttcaaatccgcctctcccggccacgttctccccctccgggacctatataaacgactcacgtgcctcccttcatccgttttcccctctccccgagcaccccgcgccccctagacacctccccaccgtgctccctctagccgccgctcgccggcgatctccagccgcccgccaccgccgctcccgtcgctgccgcgctgcgccgcagccacctatagcatcacagcgccccaccgcaccccggcattcactccatctccctcctccaccgccggaaccaccctcccatcgcgaggccgagccactaccgccacacaccgccttcagccggccgttgccgccgcgttagtcgtcgctgcacctcgccgcttgcgccgtcggcaacgccgtgccaagctctaccccggcctccgctccgttttcccaaatcgccaccgtaaccacccctcccccgtcaacccgagccaccaccaccactggccgactccagccgcgtcgccccgctgctacagtcattgccgacccacgccgttgcctccctcggctccacaaggacgaggagaacctcggccatctcttcccatcgccggaaactcactggacgtccagattcccgtgcgccggtgagcccttcctcccttcccttcctctccagccggccatgtcgccgctccgtcctccctaacacctcccctcccatcctagggtgcagctgccgctcatccgcctcttcccgagcgccgcccgtcgtcggagcgtcgttgtttccgtccgtcccgagctctgccgtcaccgcctcgcgttgccatctcgccgccggccacctccttccgtcgtatgctactcggtgagctccccctcccttttcccgccgcactccgccgctccccggtcggccggtcggcgagccggctcgcgcccgcctgaggccgcccgattcacctcgagtgaatctgggccatccacgtggccgttcggcgccgcccgcgtcggtgccgtcgtggcgccacgtcggcgccacctctgccgcatgtccgccgtggccgccacgtggccgtccacgtggtgcgcccgcgcctgtgccgcggtggaccgagtccaccgtgggccgcccccttggctcgctgacgtgtggggcccgcctgtcggcgccggccctttgctgacgtcagcacttgtcatttcctttgagaaattaattattaattgcgcaataattcggtttaattctagaaattcatttaaatggctcaaaatttctaaaatccatatctaattcattcgaactccgaattgagccattcaacttgcaaaattcatctaaaattgagctctacatgtttgtttagtttttatgtcctgtttccttggtttttattagagttttttctcgttttgcatgcca

SEQ ID NO: 16130 - DNA, 1501 bp, Oryza sativa
gcttgaagttagatcatgatcatttatcctgggttcatgaattatgatgagttcatggattatgaagattggctttcaaatgaaaatggttaatttgaagagagctggactgtgttgctttgcaatccaatccatactaatgaaagacagacaattaaggaaattgtgaaaaatgaatccatactaatgaaagacagacaattaaggaaattgtgaaaattgggatgaatcattttgcttgaagttatgatcgtgaatcatttaacttagtacatgaattactatgagtgcatggattatttagattggcttaaaaaggtagagttggactgtgttgcttcgcaatccaatccatactaatgaaacaaattcaagaaaattatgaacaatccatagtaatgaaagacaattaaaattatttttgatttcaaattggtaggggccgcgcggacgcgtaccccctctgccacaaattatgacgtccactctcccgcttggggagatggtaaaccaacccacccacaaagtgcaatgtgaggcattgatctaggccatgagcctttcttgatcgcccattgaccccgtccaggtaagtatgttccaacgttgccccgtgggatgcttaaatagggataaccacttcgtaacgatacctgagtccccgatacggtactaaacttgatttacttcgcataacatactcccacggattggccggagcgttgaaactaggcctacccactaaggcccaaataggcccactgctcgatggtaattttcggaaggatccctgtagtccggatattttctaaaaacaccctgtacatgaccgttaccacttgctcgcggtctaaagttttgtaaaaacacccctttccggacagttatcatgagtaaaattattaattacattggcagcgacacatatttttacaaaaaagacactaatggatttttgcgattagcccccaagcatttttgcaaaacttgtttggaactttggccaccgccgccggcgccgcgacgcgacgacgggaaggcgccggccgccggcggccagcggcgctggcggtgaagccgatcgaggaggcgtcctccaccgctcggcgaccaaccgccgacggcgacggcgatggcgacagcgcgcaccatgcagggggccccactctgtttactcccccgcgtccgcgaccgcgaagtctccggtctccgccgcgcccgcgtcgcctcgccctgaccaccaccagtccaccgccgcggcccacacggcacagcctctcacaagggaggaagggggaagtgagcccccgcgccacggccacgcgccgcgggcttcctcctcctcctcctcctcctcctccccgagccgcacgccgatcgatggccgcgcggcggcgcctcctcctgctcctcgtcctcctgctgtgccgcctcgccgccgtcctccccacctccgaaggtacgcacgcgctccctcgctcccgcccaccccctgttcgat

SEQ ID NO: 16131 - DNA, 1501 bp, Oryza sativa
tggatgggcaaatagatggacggatacgatggatgggattggacggaaggctgtactcgggccccgcggcccagcggtaacttgacaggtgcagcctttatactgtacagtagtagtggaggtgtatttgcagctgcggcatcagagagagactactgtccagcaacatgtgctagctcgagaacatcaactgcatgcaaacagtacaacagcatgttgttttccaatcgatcaaaaatatttttcttttcaggtcgtgccatgcttgtacagtatacgtacataactgctctctgctcctcctctcttttaccgctcctgcaatccacatactgccaagtaatttttctcacaaccctactacagtagctctgacgagtactccatggaggaggagtagtatttgtttttctttggcccaagtccaaaaaaggtcccatgggccgactattccctagtcggctaaggtgtgtttagttcatgtcacattgaaagtttttttgaaattgaaaccatgtgatagaaaagttggaagttggtgtatgtaagaaagttttgatgtgatggaaaaattgttaatttgaagaaaaagttgggacgtactctccgcagcctaagaagaatactttgattttatatatatatatatatatatatatatatatatatatatatatagaaaaagagagagagagagaaaggagaagtcgtcccttgtaataaggtaacctccacacaaattttaagtaactagagagaagaaaagaagtgcattgggtagaaaatgtagtcaaagataatacattgatctctaggttaactttaaatttgtgagtagatgacgcgaataaaattagatgtaaccatcacctttaccgtaaaacttgctctaattcatcactctcctattatcattcacttatagaagttctataagtgccaccttgctgcttcgcttgagctcctctgtcgcattgttgttcttggcagggtctagtgtagacgaaaagaggtgtattttgttcaggaacataatgatggatcctagaaccccatagtacactattgaagtacagttggaatattcgagaatgaaaaataaaactatatatactcgatcgatggatcgatctccacttggtatatgtggcactacagagatatatgaccgtactatgcatatgggactttttctttttcacaattaccaagagagattgatgagatcaggcagcaagacttgcatccgtgtacgttagtggccggatatccatgcaaagtgttacaaaagtaaggcaggctgtggctgctagctagcttcctctcaagctcatgcatgcatgagaagcggacaaatcgagcagattctgcagcatatataagcatcgcatctacatatatatacgtacgtgtacatgtgccgctagttcgatctcactagctagctagtggccagtgttgtacgtatatactctctccgtttcaaaatgtttgacaccgt

SEQ ID NO: 16132 - DNA, 1501 bp, Oryza sativa; identical to SEQ ID NO: 15764

SEQ ID NO: 16133 - DNA, 1501 bp, Oryza sativa
gacgtgtttggttggtacgggacgcactcgagtgcagcggatgtgacaccaccaccaccaccacaaccaaaatctccctgtgtgagcccctctcccgcttgtacaccaagctttggttatttagatagcgtgcgtgctcctcttgtgtgatcgatcatggatacgatgccaaacagccatcaatcatgtgtgcgcgctcggaataaatgaagctaaccaacagtgtgcgttcgtccgtcagatctatccacatatatatatatatatatatatatatatatatatatatatatatatatatatatatatatatatatatatatatacacacacacacacacacctgacgaatgatcgatcggacccgttcgtcacgtgatcgacggttcgcatggataatcgattatccagtgcggaccacgtaacacggttgggccacccgcacataaaaatgttgattttcgcagacacctggcgcagatggactggacctccgcacgggaaaatccattttgaccgaacggaaaaatcgaatatgtagtagtggtggtatgatgcagttagaaaggagtaccttagagtaactttagataaacatttcacaatactacaataatagcaaactattttttttaaaaaaaaacataaccttatctcacttatgtgatatgtgtttgacatgtaaggggctcatgttatacacttgtgagtatttacatgcgcgttcaaggatggacccaacttatgcaaacttgtgagtatttacaatgtttaagaatggacctaacctatccaacaaagtgtgcagttctcttataaaattattagctatcattatacgttcttttgcccaatatgcgctaaagttataacaaattgacagttttgaagaaatatatgcagttttatgaattttacctcataataaaaaaataactttgaaaaggtgttgaaaaatgaagttgtaattgaacttatccggcctaaacatgaggaaataggtacttacggagggagcagttaggctagcggcgtgtgtagtcgtactctacgtacgtacgttcgtggttgggtgaatgcatgcgcgggcgggcgggcgggcggtagcgggggggggagatgagggggacgtggttgacacagcggcagcgccttgccgcggcagggggacacacgcaggcgacacgggaggggacaaccccgtgctcgctgaaagcgatgctcttatagctctttgacaccgacgacccagccacatcgtcttctcatttttttttcctcgccgcactcacgcacatcgtccatctcgcgatcgcgatcgcgatcgcgttttccgctacggccagctatataacgcgagggtgcagtacgggcgtacgtcgtgtcattcagggtactactactagtactagtagtagactagaagccacactagccaccccccgggtgatggacgatagattgatctgatgtgcatgcccgttccagcacgtaaccgcga

SEQ ID NO: 16134 - DNA, 985 bp, Oryza sativa
agccaagatggggaagggaatgacgaggaggaggacttccttgtcgggtctgcccggggcgccgccgccttcttctctggcgcagtgctcggtgctggggagccccctaaatccgatgccatcgacgccgcatccgtgtcgccgccgccgaccacccggacgccctcctctcgccgccgcttcctcctctctcgccgccaacgccaccacacgccgctccctcttctcccgccggcggccatcagggaggagggtggcggacggctaggcgagcggcgcaagagagagatgaccgccgccgcccgccgtactttacaccacccagcaagaggagggagcagagagatggggagagctggagagaggaggagagaggaggaagaagaggattggatttgatcatttgagaatgacatatggggcttacgtgggccccaccattttttttagctgacatgtgggacccatcatttttaaattattttttctgtggttgagatgtgggcctatgatttttattatttttccgagatataattgctacgtcagcgtcacatcaatgccacgtgggacgtagaactagtcaaacaagccacgtaagcgccacgtcagctaaaactgccgagggatctcgtttgcttgttttcgaaagttaggggatgggtcgtacccggttttgtagtcaaggatgaaaatcggattacgtgacgaatagagggacccaaagtgaatcccagccaaaccgtgtcacatctaatcctactcccaactcgacataagttatcagaaaatgagagatgggccgggccctaatgagctatacgagcaggccgataaacggtccgtaagtgggccgaggttacaaaatatgcgggcccgaacggaattccctcctctctcgttcttttccggttccttcttttccccgacgcagcgcccgcgtggggtggtgacatgggcggcggcggcgacgaaaggggagagt

SEQ ID NO: 16135 - DNA, 1501 bp, Oryza sativa
gacatgttgtctgtttccccagctgtcttttgcttgtaagttgtaacctatcaacaatttgcttggaaactgtaactgtaagaaagccaactcggatgtaatgtcgtgagaatatagcatattcgagaagttgtgtatccaaaatgagcggaatcattaactatagtgattttgcaatgtattcaaatgagcataatcattaactgtagtggggtgctggtgccccaaatgtcttgcaataagccgcacgtccgaattccaattataacgccggtctgtctagggatggacgagactacaaacttgtccagacagtctagaagatgccttaattgtagctaattgctacaattaaggttgatctagacaaggtcacgaacaagttgctgagcaagagaaattatcggtttgtctgttgccattgctatatggagtatatgttggtagtatactgctatcggtcaagcaagccagtgggtgtaaccgtgtaagaaagtgactgttcctaaccttaattttgatttggatgatggtaattcaagaacgctaattaggccggttgaggtagcagcatcgtgcggcagtgttgggaaatgatttgccttagcatatattggttggctgttcagtcacagttgagacttgagccaggtgaggatttcattttcaggctttagtgtcttgcttactcttcactactataacagtttagtctttttttgagtgtcctgttagaaatatcactctcttgttacagttcttgcgttcacctttttctaggtgatagctaacaaaatgaagatttcactttctaggtttattttacttgatggcacatggtctaagcaagcactgtactctctgcaagctaccaacatactcctacacagcaagcagctcaagttgttctctgagaaacgcctgaaatctgattgaaatcaagttggcacttaactggccaagaaaccggtcatgatagttggagtagtaccattgcttagtttctgtcacacaattgtctgaaaagctttctcctttttggaaggaaatgaaagggaaaaaaaaaagaagtcttgtctgaaagtgtgtgagaatcaggccgtcctgaagccatcactttcagagcatctgggacttgaagaatttggcaagtgaaaaaggatgtagagggatgtggattttcatccctcgaggggatatcccctcattatttacatgtcatttaaatttaaatagttatcaaaaaattttaaaaacaattaacaacatagattaatacgaaatatatcactccacaaacatgcaagaccaaattcaacttatacaagttgtaacaaaaataacaaattaactgaaaatagttatcgcacattcgcaattatattgttatttttgttacaacttatagaagttatatatttcatattaatctatgttgccaattttttcatattttttattgactatttaggtggcatgcacgaaacgagcagatatccca

SEQ ID NO: 16136 - DNA, 1501 bp, Oryza sativa
ctactttttgcactcatatcccgcagcaacgcgcagggtattttctagttaaatatatgtgtgtgtgtgtgttagcgccagtaaaatttaatgggagagctgctagtgtggagccacgtggccatcctagctcgtttaatttctgtatatcccaacataacatgctcacatactgcacaaagaacaaccgaacaagatattgtaatgatcatggacccagttatgtcatttggtgcaaactaagtggtgtttgaatttcttgaaaataaagatggagataaagattaagtgtttcacggaaaacaaggtgataataacgtgtgattaattgggttttaattattataaacttaaaaaatggattaatctgatattttagaacaactttcatatagaaagttttcacacaaaacgttccgtttagcagtttgaaaagcgtgtcataagtatccaaaaatttgtccaacttttttttttgagaaaagaaaatgtaacattactgacaacctccgaaatttgaacaggtaacattactgacatcctccgaaattttacagctgtagcacacaataataatgctaatgtattgtacgcattcattgcatacacacatgcatatcttctagtgcaccaacatactcctacctcttaaaaagtcaagttcatttctagtttcagaatcgtagccattagcaatgttaatgctttatatatcattaatttgctagctataggaggttaccttgtcgtacatgtacagaagggccaaaaacaagcacaaagcttagttattccgtgttccaattctgattcatacattctcctataatttggacacatgaagatcatactagagcttactgttcctaattctaactctgaatcatacattcacctacaaatcggacactagaaaagcttagttatacccagttctaactctgaatcatacattcacctataaagtataaaccacacccagcctcttgtgcccaaatagcacaaagaggcaaataggaaccgtctggttataatcactgcaagcctgctctgtaaactcgccggatcacacatcggccggtttctcatctaaaacagagatattagacgtggagacataacaactttgaattggcagccaacaatcaaatgcttcgggaacactagaatggacattctagcacatatgctccctccattttcataaaggaagtcgtttagaacagcgacacggtctctaaaacacaactttgacttcttgtttctataaaaatatttattaaaaagtgatatatgtatacttttatgaaagtatttttcaagacaaatctattcatataatttttacattttcaaattcaacaactagacagttatttatgatttatatttccaaggtttgacttaaatattgttctaaacaactttctttatgagtacggagagagtatagtgagacacatgcgtgtcatccgtcattctactagacatgggaaccatt

SEQ ID NO: 16137 - DNA, 1501 bp, Oryza sativa
gcccggctcgtcgtctcgcggcgccgcctccgtcatcgtcatcgcagcggcgtgttccacgtcgtccccgtctccgtgcagccactgccggctgccctcgtcgcttcctcgccggccccggtcgtcgtcgtcgtcgtcctctcgtcgttcccggtcgtcgtggcgttcgtccctccgtcgagccgttctcgtccgtcgtccgcgttcgtcaagcgagccgctgcagccccgtcgtcgtcttcgtcctcggctccgcgtcgtcaagccttgtgccggccacgtctcgccttcgtccaaggatcgccgccgaagccgtcccctcgccgttcgtctccgttgtgcccgtctgtctccgccgcgcccgttcgtcgttgtcgttcccacgcctcgtcgcgtggtggtaaggatccgtcctctcgctgccccgtcctcgtcctttcggtgtcgccccgtacccgttgtgcggttgtcgaccccggtacccgtgtaccggtgtcggtagtcgttcgcttgtgcgtgtggtgactgtgttagtgtgtccgctcggtagccgcgtggtttccacgtgtgcagcccgtgtggtgtctagtggagtccgtttgtcggctactcgcctcggttgacacacggagtccgcttccgtcgacccgtggaccgtctctgtgtacccggtctaccgcggtcctttaggttgacatgtggggtccgcatgtcaacggcgcagccttcctgtcttttccaggctagcgcttacacatgttttatggttgcaaagcctaattataataatccgcaaatctccatataacagcattaaacttcggatgatcatatcttggtcatacgaactctgaatcgacccgttcaagtctcctaatgtttgttataacctaaagaaccctgtgttttctctttatgtattgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcatatcatccttgagcatattgaatcccagtttataaaattattttgatttaaattaatgcattatcgctttatttaaattcctgctttagcactgttttatttagccatgcctatttacctttgttatgaccttattattattgctattgttattattaccttgttcaccctagaataaacaaaaccccagctagtgggtactctattcatggttccactagtatgaatttaggtagatgcttcgctgattaactaggtaacattaggtgattttacagctctagactttgggatattcatatcacctggacactttggaattgtttgtttattgtggaattggattcacacggccccctctattcaaaatccccaaaatggttttaggctgggctcggggtgcatggttttgatagtagcacctcggccatataaggaccggt

SEQ ID NO: 16138 - DNA, 1501 bp, Oryza sativa
gcggtgccgcctccgtcgtcggattcgcagcggcgcgttccacgtcgtccccgtctccgtgcagctgccgccggctgccctcatcgtctcctcgccggccccagtcgtcgtcgtcgtcgtcctctcgtcgttctcggtcgtcgtggcgttcgtccctccgtcgagccgttctcgttcgtcgtcagcgttcgtcaagcgagccgcggcagccccgtcctcgtcttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcacgtggtggtaaggatccctctccctcgctgccctgtcctcgtcctttcggtgtcgcccgtgctcgttgtgcggtcatcaaccccggtacccgtgtaccggtgtcggtagtcgttcacgtgtgcggatggtgaccgtgtagtgtccgtgttagtgtgcccgctcggtagccgcgtggtttccacgtgtgcaacccgtgtggtgtctagtggagtccgtttgtcggctactcgcctcggttgacacacggagtccgcttccgtcgacccgtggaccgtctctgtgtacccggtctaccgcggtcctttaggttgacatgtggggtccgcatgtcaacggcgcagccttcctgtcttttccaggctagcgcttacacatgttttatggttgcaaagcctaattataataatccgcaaatctccatataacagcactaaacttcggatgatcatatcttggtcatacgaactccgaatcgacccgttcaagtctcttaatgtttgttataacctaaagaaccctgtgctttctttttatgtattgttattgcttctttataggcttgtagctttgcttgtgtgcttcgcgtagcttctgtcattccggaggttcccgaagcgtggtttgcggtcgtcgccgaaggttcggaaggccgttctctctgagcaaggcaagtcacatcatccttgaacatattgaatcccagtttataaaattattttgatttaaattattgcattaacgctttatttaaattcccgcgtgatcactgttttatttagccatgcctatttacctttgttatgaccttaatattattgttattgatattattaccttgttcaccctagattaaacaaaaccccaactagtggacactctattcatggttccacaagtatgaatttaggtagatgcttcgctgattaattaggcaatattaggtggttttataactttagactttgggaattctcatatcacctggacactatggaattgttggtttatggtggaattggacatacacctctcttcctctttcaaaacccctaaaacctgttttcggtggggtttgggtgcatgccagttgtgggaagtagcaccccggccactataaggattaa

SEQ ID NO: 16139 - DNA, 1501 bp, Oryza sativa
atggtatcgcgcatggctggggcttgtgtgagtaagtcctccttgtccgggtacgtagtagatagatgatttgactaagtcctccttgtccgggtacgtagtagatagttgatttgatttgactaagtcctccttgtccgggtacgtatccttgtctggtagttgatttgactaagtccagttgatttgggtgtagagatagttgatttgactaagtcctccttgtccaggtagatagttgatttgactaagtccagttgatttgactaagtcctccttgtccaggtatgtagtagatagttgatttgggtgtacaggtttccgatgtttgcttcgtatcccacagtaggtgtatagttgatttgggtgtagaggtttccttgtccgggtacgtagtagatagttggatgtttgcttcgtatcccacagtaggtgtccagttgatttgggtgtagagatagttgatttgactaagtcctccttgtccaggtagatagttgatttgactaagtccagttgatttgactaagtcctccttgtccaggtatgtagtagatagttgatttgggtgtacaggtttccgatgtttgcttcgtatcccacagtaggtgtatagttgatttgggtgtagaggtttccttgtccgggtacgtagtagatagttggatgtttgcttcgtatcccacagtaggtgtatagttgatttgactaagtcctccttgtccgggtacatagtagatagttgatttgggtgtagagatttccggtgtttgcttggtatcccagtttccggtgtttgcttggtatcctacacagtaggtgtatagttgatttgactaagtcctccttgtccgttgatttgggtgtagaggttgtccgggtacatagtagatagttgatttgggtgtagaggtttccggtgtttgcttggtatcccagtttccggtgtttgcttggtatcccacacagtaggtgtatagttgatttgactaagtcctccttgtccgttgatttgggtgtagaggtttccggtgtttgcttggtatcccagtttccggtgtttgcttggtatcccacacagtaggtgtatagttgatttgactaagttctccttgtccgggtacgtagtagatagttgatttgggtgtagaggtttgactaagtcctccttgtccgggtatgtagtagatagttgatttgggtgtagaggtttccggtgtttgcttcgtatcccacagtaggtgtgaggtgactaagtcctccttgtccgggtactagtagatagttgatttgggtgtagaggtttccggtgtgaggtgactaagtcctccttgtccaggtacgtagtagatagttgatttgggtgtagaggtttccggtgtttgcttcgtatcccacagtaggtgtatacttgatttggctaagtccttcttgtccgggtacgtagtagatagttgatttgggtgtagaggtttccggtgtttgcttcgtatcccacagt

SEQ ID NO: 16140 - DNA, 1406 bp, Oryza sativa
tatatcggatagtccgatattttttagccaacactcagacaaagatagagggcaaagttctaagaaatttcggatagtctgagcatcggatagtctgatcaggatcggatagtctgacaggaataaaataggaacagtccaaataaaggattttgagaactagtgttctaccaattatatgcatgtggtatccctcttaatagtacggcatcctaatacaaaacacaagatatacatggaatagaagacaattaccagaaaatatgccgcaaagcttgtaaattcaagttccactcctttttatccttgcatccatctcaacaaagagcattagtgaacctctaattgtgttgtcataaacaccaaaataaatgaggggtcctagatgcactttcaatctccccctttttggtgattgatgacaacacaattagaaataataaaagattaggatttaggtggagctccccctaaagataagctagaaaagaatatgagagctcccccttaatctatgcaaaagattagaaatcacaatataacctcatgcatatgcatatgacaagatacatcactcatttaagcatggataagagataatttcatataacatgcacataacatcatccaagtctgcgaggttcaacaagacataaacatgcataataaagactttaaacatgacacaaaagcccaatgttcaactagccaccacgaaaacgagatagattttttttaaaagttttgataggtaggttggttctccccctttggcatcaaggcactaaaagggaaaagagagtggatcactcatcctcatcaaaatccttgtcctcctcacttgactcctcatcattgtcatcttcctcctcttcttcttcttcttcttccataggagccttgccacgatctgcacgagaggagcttgcctcagctgcaaaggggtcctcaaatacatcctccccactgtcctcaacctcaaacccatcgggagaacacagctgtcggtgacatggggccgggggtatcgtgactagaggcttgggtagccgcggtcacccacgtggcctgaccccctcgggggggtcgggcccgagggtgacgtggccacccctccctctgtctccccgaggggtcgggccactcccgtttcggccccgagggctggggcgccccgaccccctgtggttttggcgccacgtgtgtgggttaggtgagcccaccgggctcacctaaccgcatttatagcaggttggacgagcgcgccacgccgcatttaatgcggcgcagtgcacgcttatccggtccgtgaccggtcacggtgtgtgaccggtcacagaccggtcagatcgcaggttaggtggcaataggcggcctgtcacacacctcgccccgtcccgtcggaa

SEQ ID NO: 16141 - DNA, 1501 bp, Oryza sativa
agagccggagagcgagagagagttcaggctctagaacccattcgccagagtcccaacccctttctcttttctctcctccttttttttccctctaggcctgggcctcctttttatctggtccggggtcaccacacgggcctcctgctgcctaagaaaagaaacatgctttttacaatgagggctagtctacatccggaagtgacctctgacaagcagagcacacgcctcctgccccgctcgcccgcttttccggtggacgcccatttcaaccttcatttaatggccagcgacttccttgccatacttgcgctgaagcctggaatggatctgaccgggactgacataccaactccaggagttagcacgccggctccggctagggaagagagccaggaagctctcatcattccgacgggacggggcgaggtgtgtgacaggccgcctgttgccacctaacccgcgatctgaccggtctgtgaccggtcacacaccgtgaccggtcacggaccggataagcgtgcactgcgccgcattaaatgcggcgtggcgcgctcgtccaacctgctataaatgcggttaggtgagcccggtgggcccacctaacccacacacgtggcgccaaaaccacagggggtcggggcgccccagccctcggggccgaaacgggagtggcccgacccctcggggagacagagggaggggtggccacgtcaccctcgggcccgacccccccgagggggtcaggccacgtgggtgaccgcggctacccaagcctctagtcacgatacccccggccccatgtcaccgacagctgtgttctcccgatgggtttgaggttgaggacagtggggaggatgtatttgaggacccctttgcagctgaggcaagctcctctcgtgcagatcgtggcaaggctcctatggaagaagaagaagaagaagaggaggaagatgacaatgatgaggagtcaagtgaggaggacaaggattttgatgaggatgagtgatccactctcttttcccttttagtgccttgatgccaaagggggagaaccaacctacctatcaaaacttttaaaaaaaatctatctcgttttcgtggtggctagttgaacattgggcttttgtgtcatgtttaaagtctttattatgcatgtttatgtcttgttgaacctcgcagacttggatgatgttatgtgcatgttatatgaaattatctcttatccatgcttaaatgagtgatgtatcttgtcatatgcatatgcatgaggttatattgtgatttctaatcttttgcatagattaagggggagctctcatattcttttctagcttatctttagggggagctccacctaaatcctaatcttttattatttctaattgtgttgtcatcaatcaccaaaaagggggagattgaaagtgcatctaggacccctcatttattttggtgtttatgacaacacaattagaggttcactaatgctctttgttgagatgga

SEQ ID NO: 16142 - DNA, 1501 bp, Oryza sativa
cagcatcaatcgtgtaaggaaaccgaacagcgaatccacctctcattattttgacgacatcctcgcagcttggattctcttctagcactcttgtgtcgttgccgtgcaaaggagtaatggccaggtgcccacactaaggctcaagattatcaatataacaagagtatatgctgccaattagcacgtaaacgaaggaacggctggtattattcaggcaagcgacaggcctgtacttctcattgttgtttatttcctgcgaacaattcacaaaggctgaccacctacttgaagcaggctccagctcgatatggatggtgtggcaaccagtattcagggttgtagttggataaggtggaacaatcctctgaggaagtgtgttaggtgaatccgagatgttggcatcgacaacccagaaggtagaatcactgtagttgatgcccgtcacagagtacgttccctcgtagatctgaatcgtagccttgtcatcggtgcaagtcagctcgtaggatgtaaaaccgcatccagatgggtcacctcgccggcggaaaggagacgacacgttgctaagacggccgcaggtgaacggaaggcagtcatgccgatgatgctgatgccgcccacctgcatctgggacgacaactgcaagcacaaacaatacagagatgactcgcagggcggttgagcgatggaacgaaccaggaataatgatcgccatgctggaggcagaaggagatgaatgagagtggctagagatgaacttattttaagacgacatgagagaggctagagatgaacttatttggacagagtgaggtaggagtaatactaaagcaatatattcactgtgggctcctcgatagttaaccgtcgatgaacaactttcttgtaaacttttttctctccatcttaattatattggatgacctccttcagtcatcccgacaaaatattcaccgtgggcctacacgactgtgatgctgttgacttggaggcacttattaacgtagacaggttacatccagaccatcaccagtcactcagctaccccaggcaagccttatcgactatcgtataacagagcaatttgtatggatacatcatacatatggtactctaccaagttagcttcacgagttgattccagttacaacaaaagagagttccaatgacaacaaaagataaatgagtttcatgtagttacacgtctactggtttattggatatgcagtacacgtctactggtttacatgtagttacacgtctagcagaaatatatacacgttgtagaatctacgaacggtctccgaaggtcacatactcacatacctttctaagcaatacaacacggcagaagtttcagtggcagttggaattcctgctcacagacgcagcaatcgtgacaaacacaggataaatcctcactggagatcatagcaataggtgatcctttttctatagccacggccttctcttcatctgccttcctcgccattacactcca

SEQ ID NO: 16143 - DNA, 1501 bp, Oryza sativa
attcacatcgttggcaaatactagtaatgttactagagtaccacatgaatactgtctcaccatcgttgatgactctatttgctgtttccttgaagtttgaggtgtcccagtttattctcccttttttatcataactatagggcattgggatgcctttagaaataactgtgcagtccaagggaagaacagacatgtatgtatagggatctgccaaataccagaactggttattatggccgaggcaagatattgggccaactatgtcgtattgatttgcaggtatgggatctcttgaacaaactacaagggtagctccctgcgattgaggaccttgaggtttgtacacagaagttgattggtttttcgacatgagcttctgaagtgggcagtgaggtgaggaatctacaggtgggatgacgttcatggtagcataactgtaacttatctcggttactttgcagggaccaagaactgggtgattgaggatggtgtcctgtccagagcatgacaagtgcatgccgggtgcgccgcatgatggaggttgtgtcgagagccggaaagggaacctgatctctggtccatgcttgctgcacctgtgtgatgagcaagtcttgaagaaatcttcatcatcccatgctgtggcggaagaggattcgtagttgagaagagagagtatgagtactgtgaagagaagttttggcaagtccatggagtgtaatggcgaggaaggcagatgaagagaaggccgtggctatagaaaaaggatcacctattgctatgatctccagtgaggatttatcctgtgtttgtcacgattgctgcgtctgtgagcaggaattccaactgccactgaaacttctgccgtgttgtattgcttagaaaggtatgtgagtatgtgaccttcggagaccgttcgtagattctacaacgtgtatatatttctgctagacgtgtaactacatgtaaaccagtagacgtgtactgcatatccaataaaccagtagacgtgtaactacatgaaactcatttatcttttgttgtcattggaactctcttttgttgtaactggaatcaactcgtgaagctaacttggtagagtaccatatgtatgatgtatccatacaaattgctctgttatacgatagtcgataaggcttgcctggggtagctgagtgactggtgatggtctggatgtaacctgtctacgttaataagtgcctccaagtcaacagcatcacagtcgtgtaggcccacggtgaatattttgtcgggatgactgaaggaggtcatccaatataattaagatggagagaaaaaagtttacaagaaagttgttcatcgacggttaactatcgaggagcccacagtgaatatattgctttagtattactcctacctcactctgtccaaataagttcatctctagcctctctcatgtcgtcttaaaataagttcatctctagccactctcattcatctccttctgcctccagcatggcga

SEQ ID NO: 16144 - DNA, 1501 bp, Oryza sativa
tgattgtatggtgcaaattagcaagtatctcgcaaaaagaagaaaaactcaaccgagtattccagttgtacgagggaaaaaaaagatagaagaaattccgatacatcaacgcaattttgtggaattttaccaacaacatatttaaactacgtaaaataagcatgaatgtatggtcgatatatatggtaagagatactcacataggtaaggtgtgcgtctgtacgggtaaatgtgcttgcgtgcattcataggatgaatatatccacattatgaacgtctgcattcatactgtgtatttttaaaaatatgtccacttgagaatccaagttcaagtttaaaatcttttttagataatggtaaaaattcaggtttaaaatctgacatgggttactcatatttatggttaaattatctttttagtgattaaagacatacagtacctgtcaagaaccagatgtatgtggtgattgaaggtgttcatagtggtaaatgtgcacacatatataagcgtctcgctttgtaactttcttttatggaaaaaaaacatatgcggactttgttaaaaaaaatagtacaaatgcacaatctaccaatcttaatatatggactttgtacacaaacaacagtagtacaaatatacaatctactaatattaattaatcagtttgcagtgtgcctactaatttctatgcgaaagctaaagttatcggcgaaaaccaagggcaagacggcgactccgaccctcgcccatccgtcctcaccttacacagcatcaccctgtcagggatgtggtaggtagcgtgcaccgggtaggtgtcctcgtcgaagatcttcacgtcgacgtcgagctccagcgcgcccgatcgacgagcgccgccattccgacgccatgcgcgcgcggaggcgatccgacagccccactccctggccccgcgccaccacctccacgtccctctccaagcgccccgccgcgcagtcgcgcggctccgcgcgcgcccaacccagcgccacgcccgagtacagcacggtcacggccgcgcggtccacgcacgcgccgttcgccgtcccgagcgtcaccctgaactccggcgacaccgtggcggccggcctgcccaggtcgatgccctcgtagccggcgaggcgcacggagaaggcgtcgaggtcgtggtcgcggaacatgctgttccactgcccgtacgccatgagcgataataagagagtggcgaggaaggtcgcgagtagaaagtaccgtagacatgggcgcctgtccaggcaatcgccgtggccgtcgtcatctaacgctatgccggcgcccatgatctagccgctaagacgtactaggatgcagcgagaaaaaagtcaggacctgtcctggatttggtacgttacttataagactctgtgggacatggtgatcacgttcggtagtgttgccgttttgtgattggattcaacgaccctattatatttgatccattggagatcttgtcgaacgtaacta

SEQ ID NO: 16145 - DNA, 1501 bp, Oryza sativa
ataccaatggaaactcgtcgaatcgcaacacgattcctgatttactctgaacgatggactaataaaaactaagggagattcagattatagaggacctatgccactataccagtggaaactcatactgatttactctgaatgaacgatggatataataatagtaaaaacaaaagggagattgagatggtagatgagaggacctggtcgtactgcttgaggagggcgatctcctcgtgggtcttgttcttgagcttggcgcggtactggcagaagctctggaactggtagacgaactcgtcgaccatgtcccagagccactggttggggagctgcatgttgacgacgccctggaggacgacgctgaagagggagcagtagttgtcccacgactcggcgcgctgcgccggggtgaggccctggacgcgggcgtgggcgtggcggaaccagagctcccggtagaggaggaggaaaacgtggtcgccgtcgcagtgcgccgccacggcctccgccggcggccacggcgtgtcgcggaagtggcggtcggagaggcgggtgaacccgccctcgtacatctggtgcgtctcgtacacgttgcggtcgcggatgtggcggtagaggtgcgacacgaacgtcttcaccgagtccggcacgtagctcgggtcgtacgccgccatggcgccgcctcccccggggccggacgacggcggcgccgcgtcctccctgtcgcggtagaaggcggcggcggcggaggaggccatatggcgatctagggtttcgaggtttcggggggtttttgcgtgagctggtcgaggaatggtgatgaccaagcctatctcactatctggtcggcctgaaagtgggcccatccacctaatgggccggcccaatttcgaacgggccggtccaagcccaactcgagctggctaaatttagagatttagggttaaaacgataaggctccatcctcgctagttgtggcgagccccaaaaccaactcccaatccgcatctccctccgctgcgccggcgccgccgcccgccgccgccgtggcccggccgtcggctcgcctccgcctccatcctcgggcaccggacgtcgtccccgccgcccggaggccgacccctttgcctccttaggccttctgccctagttccggcggcctggctctaaattcggccgcagccggcgcaggtcgatcaccgcccgcgcgccattggaagcggaggtaatcccccgcccagctgccaagatgaattggctctttatttattgatatgtgctcccggctgccaagatgaaatgtttatttattgataaatttgatatgctgagttgggaatttttgtatgtgcttgtgcactggatcagttgatctgattgaaactaatgctgattttaggtggagaaaggaagctggcattggtgcgtgattgaaatgctgacctgattttttttagtacattgaggatgtgcgttctctgaactttttactgaaatgact

SEQ ID NO: 16146 - DNA, 1007 bp, Oryza sativa
ggatgaagaagtgaccaacataaaagttgtagatcttgatgagaggatcaactttattgttgttgcctttttcatttgaaatcatttactatttacaaatgctgttttaatttgtcatattttcaaaatcaatttcaagctgttgggaacaaagttatatatacaaatgaccaaaatgaaagttgtagatcttgataagctctacaattttgttgttgaccatattttgatttgaaatcatttactatccaaaaatgtattatgtctaataaattgaattattatatagtagctatatattttgcactcacaaatataaagacttgatgggaaaaatagaaaaatagtcatcggtgacgggccttagtttaagcccgatagagattagtctatctctatcgggcattatcttagggcccgtcacagatgagtcatccgtgacgggcctgaatgtcatctcaatcgggcattagtatggagcccgtcaccggtgagtcatctgtgacgggccctacggcaatgcccgtttgagatgactcatcactctactataactagggtttctcagatcggatcaaaaatttttctaagtcccgctacagtttcccacctccttagaaccctagcgccgctgtcgtcctccatcgccgagcccgccgccgtcgccaccagcccgcagtcgccgccaccgagcctcctccgccctccattcggaccgtgtcacgcccgaaaattcactagtaatttccgaacttatttgtgcataaaatcctcgtccaggaatcagccgaggtacacaaactgacaatttaatatacagattcatccaattaactaaaacgataaatacttacttaagaggcacttagtcctcaccatgaagaaaactgcagcggaaaataaaatctagcgaagctccggctccactcccacaggcagctcaactggggtataagccaaacgtcttctccttctagatcctttttcttcaactgaggttgattgat

SEQ ID NO: 16147 - DNA, 1077 bp, Oryza sativa
ttttcacacgcaaatagtagtaaccttctgccaactacgcattgcatttcgtgtaggcagtcatttacaatcttacatgttttcagctttaaaaaaaaactgtcatctgataggccccttcattgattaaactatacataatagtatgccaactaatcatactactccgtagtagtagtagtatgctagtttgagtatgccaaccatttcatttcatctcgtatttggcaatttgagtatatgccaacttaaaacatacgagtattaccagtttgagtatgccaaccatcctatttcgtatttggcaattttaagtataccaactcaacatactagtattatcattttgagtataccaaacatttcatttcgtatttggcaatttgagtaggccaactcaatacactagtattgccaatttgagtatgccaaacatttcatttcatatttgacaatttgagtatgccaacctaacatattacttcatcatactttttaagctaccaggcctaatatatagctaataaaattaaagccacactttaactatatattagcgattctaatcaactgattcctaagattgatagatgagcacggtctcgatcgactctcgacagcacacgacacgcacatggtgctgaactaagtgtgtaggtattatcttcttctgcctaccatgttgctcctatatatataaggcggacatccatagtggccacacgtctccaaaagactcgggagaagagatctaacagtcaactcgtaaaatactccctacgtttcatattttaaattatttgactttttttagttaaacttgttaaagcctatgtttataaaaaatatattagtattttaacataaaataaacatattataaaaatatgtttgagagtagaaacagccggcgaagcgtgacgatggacgctcgacggcggcggctgtccccggtggtggtcgtagcggcttttcttttcttccccctgttcttcggtaaggctgcgatttccatctctctcttcttcttttctttttccctttttttacattttttgtttggttatgtcctgaaag

SEQ ID NO: 16148 - DNA, 601 bp, Oryza sativa
agagagagaaagagtgagagagagaagagagagaaagagtaggcaggtgggtcccacatctttttataaatagaatgctaactggactgccacgcgtacgtcacgtaaaccaaaaccaccgcggattagtcgacgggggtaatttgtccggtttgtatagtttggagtcaagaatgtccggttttatggttcagggggtaattcggccgaccgcgatagttcgggggaggggtaattggtactttttcctttagttatagatgtagtactattacacaagattagtgtgtatacatggtttttatatgggcgaaggaatctccagtactccttccgtttcatattgtaagttgtttgacttttttctaagttaaactttagtttacagaaaaatatagcagtattttttaacacaaaacaaacatattatgaaaatatattcaatgttagatttagttaaactaatttaatattttatatattgctaaatttttctataaatttgatcaaacataacaaagtttgactagaaaaaagttaaaagatttataatatgaaacacaggggtagatgattacatacattaaactttcttggcagg

SEQ ID NO: 16149 - DNA, 1425 bp, Oryza sativa
ccgtcacaggtgagtttgcctacagcaattttattttattttatttcacttagttcttttaatttccttaacatatttccacatacactacatatttttgttatacttaattattttatttcactaacagtagtaattgcacttcattattatactaattttattattttatttccaatggttatacttgcttagttattttatttcacttctagtgggtgcttcacttaattattttatttgactatttcataagcaatatactattgatcattgcgaacatattagagtcatacagataacagacatgtagacataaactacatacataaattacaaaaataatccttgctcatggtcgacacgtgcatattgaacttcatcttcttcttcctcctcttctagaggtatttcttgacctatgccgtggacgtgctggttgtaatcatcctcgtctgcaatattgtccaatccaacaattctccttttcccttcacgaacaacatgtagtttcttgttacacgggtcaactatgtagaacacttgaacaacttgtttggcgagaacaaacagttcatccttgtacgcgttgttagccaagttgacagtggtgaaaccttctgtcacgaccggaaataacccaacgggcgttccttacgtgcgtgtattattccttgtcccaggaggcaaggtacaccaaaagttgatacaagtcagagtctaacaagcggaagcgtaaatagttaatttattacatgggcagcgaaggcccagcacacacagagacaaacgagaaacagcgaaagactagggcgacgaccacaggcgcttgacggcaggcacgagctagacaccaaagccttcatcttctaggggctcctcttctggggttaggaaaaattgagcaagactgagtacaaccaccgtactcaacaagacacacccacaagtgcagaataaatgcaagggagtacaaaggagttatactataaagggttagggtttgcagtaaacagcaattaaaggtacttagttgctcaaagctattttgtaaacacgattctagaactataccatattatttaacaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattttactctgatcagaggtgtacatctttacccacaagacacattttcctcacgtgtagccacgtgccacataccaccacggtatacagaaggaagacatgacatagtttccaacccatcctagcc

SEQ ID NO: 16150 - DNA, 1501 bp, Oryza sativa
atggtggtttctgaaattcagagaagttcagcaatattcagaaagcaaagcaaaacaagaactctagttagcagatagcatcaaacatgccagaaacagagctataaaggtaaagaaaaccaaactcgcaaagtaataactgcttccaaacacacgagatcacccagggttagtgatcagaaccaagaaagatcatgttaaataagaaaattaagtgttcgatgaaaacagagagtagattggtagaagagtaaactgaaccatgaggtgaaggatccaatcagcttaggacacacctggaaagaaaactcgatgacgatctagaaggccggtggtgaaccatttttggtgccgacagtagggagtagaggaggttagaggtggcggagcggtgctgggagaggacgattggggcagcaacaccggcggtggtggagaggactggcggaggaagccgatggagtcacctgtagaaagccaacgaggccggcgagggcgaccagcaaccagcagcaccgcccgacgatgatggcggcggagtggagcaacggccctgtctgccctagcaactactcgagtactcatttcttcagttttggggccaatccatgtggtcaacccatggatttagtccatgaatcaacatttttagtcagtctgcatccactccaatccaacccacatttgttgagagtccaatccactccaatccaagatggaatctcagcccatcatatcccataccaaccaaaacgatccaaaccaaaagttagattgggtacttggaagcatttgtatactagacatatggagtatcaaagatgctttcgtctcagcaatgctgcaaggcaacaaacatgtgtcgatcctcatattcggacggcaatttttttatcatatttttatttaaattttttagataatgaaatagaaaaccatcttgatctttgcttaagctagttacaatcaattattacactaaatcactcaaaatgagtgcaactcaaagaaaatgtggagattatgattaccccatatctacatggcggttatattccagccggatatacggtaccaaatatagatagaatatctttacgaggactcgggttagattctaaacttgtatgtcaagaaactacccgggatcctagtcagttacgattgtattttatctgtaatcccatattctgttaggatatggattgtactttgtattacagatccctttccctatataaggaggggtccgtgttcctctcgggacgattcttttttcccaatcatacaatcaattacatactcggcggaatcatccccggacaggagtaggatattacttcttgaataagaaggcctgaacctgtataaaattccttgtctccaaacccatccactttcctagcttgatagccacccccttttattattgccgaaatcttgtttcaacagttggcgcgccaggtaggggcgacgtcaagttcttgccgactaagtgcga

SEQ ID NO: 16151 - DNA, 1501 bp, Oryza sativa
ctttgagttgcactcattttgagtgatttagtgtaataattgattgtaactagcttaagcaaagatcaagatggttttctatttcattatctaaaaaatttaaataaaaatatgataaaaaaattgccgtccgaatatgaggatcgacacatgtttgttgccttgcagcattgctgagacgaaagcatctttgatactccatatgtctagtatacaaatgcttccaagtacccaatctaacttttggtttggatcgttttggttggtatgggatatgatgggctgagattccatcttggattggagtggattggactctcaacaaatgtgggttggattggagtggatgcagactgactaaaaatgttgattcatggactaaatccatgggttgaccacatggattggccccaaaactgaagaaatgagtactcgagtagttgctagggcagacagggccgttgctccactccgccgccatcatcgtcgggcggtgctgctggttgctggtcgccctcgccggcctcgttggctttctacaggtgactccatcggcttcctccgccagtcctctccaccaccgccggtgttgctgccccaatcgtcctctcccagcaccgctccgccacctctaacctcctctactccctactgtcggcaccaaaaatggttcaccaccggccttctagatcgtcatcgagttttctttccaggtgtgtcctaagctgattggatccttcacctcatggttcagtttactcttctaccaatctactctctgttttcatcgaacacttaattttcttatttaacatgatctttcttggttctgatcactaaccctgggtgatctcgtgtgtttggaagcagttattactttgcgagtttggttttctttacctttatagctctgtttctggcatgtttgatgctatctgctaactagagttcttgttttgctttgctttctgaatattgctgaacttctctgaatttcagaaaccaccatttgcatcatcataattaattattttgcttaccttctcaagaaagtgtgactgagaattggaaggaattttgattctcttagaaggtgatctaaagatggagacacaaataactgttgatgttctgttatttttcatggtgttgaatggcatgtttaggtagctttgctgaagatgtgaagtgttgagcctgtaatctgtagttattagtaacactataatttttagtaatgttgtaatccctggttagtagctgtaacctttggttagtaatttctaataaaattctgggattttcaagtctgctagtaggctgcatgtattgatgcatggtggtgttaggctgttttagctcacctgttttgcccctgcagcttctgcattcccctccgtgtggaggcaaaccagttcataatccatggattagctgtggtctgtgtcagagttacggataaggtataccatctatcctggatatacgatgagtaccgata

SEQ ID NO: 16152 - DNA, 1501 bp, Oryza sativa
tttttaatttttaatttgctttctgaattcaacaactaatactccctcctcctattatgacgttagttcatggaaggagggagtacttcgtagttcgcttttgagttctataactgataactataactttgcagaatctatataactttgcagaatctaaaaaaattcaaattcatggaaggagggagtacttcgtagtttggaaggagggagtacttcgtagttcgcttttgagttccataactgataactataactttgcagaatctaaaaaaaatttgaattgtttgggagaagttttgatttaagaagttgtagttattttctcaatcctgaaatttggggattttcgttcaaaaacccagtccaacagaatccctagccaagctcccactggttggaattcccaagcccggattcttcgttctccacaagtggggagaggcgctagctcccaatctccctctcccgagcgaattcccgcgccacatgaaattttctcacctggggttcgccgcgaggtcattcgtcgcctcatcgtggtgtcctgcaggcagccccatctcacccgcgggccgcggccggctagaaatcatacgccgctccccaaagcttttccggtgttggcagcttgtgctttggcagcggcagcggccccatctgcactgcagccggtgaacttcctcgtctatcccccaaccaccatcgctgcctccatttgagccaccgcctcgatacgacgcaaattagcccgcctgcatcggctcccatcatcatgactcggccggagttgctcattccttttgctgggattggtctctcatgaagatgagttcatccgtcgaagcagtttaccgttggtgattcattcagcgatgcaagtgaatgatcccaatctctgctcttgcaccattgctcaaacttgtgccatgttttttatttaccaaggagtttcaatcggtcagtcacttgtgattctttttacagattacctttgttgcacttgctgaagattaaggtatctgttgctgcttgctggttctcgtgctattgttctctactgtttttcctaaattttgcagctggtgctgctattgatgtgctgttgtcgaggccgcgattaggagttcgcgagagtgatctcacatagggagagacggaaataaatttcagttagtggttttgtagagggcccaccttttagttttaggaagtcaatttcagacaatctcttggagggatcaatattttagcacatcaaattttgtttagaattcctataaaaatagttttgagaatagttttgagaatgaaatattgggattctcttggtgatgctctaaagcttttcaaacgggctttcaataagcctctggaatttgctgttcacgaagcgagcaaataaaacagaaaaaaagctgaaaattcaccgtggcgaaaaatccgggattttttttttcgaaaaatcacttcattttaatattcgcagtaactgagcgca

SEQ ID NO: 16153 - DNA, 1501 bp, Oryza sativa
agacaaaagtcatgatattcaaaatcctaataacaaaaattatgatagtttaaataagatgcccgcgcaactgcgcgggctaccttcctagttggataaaaaatggtcgaagctgaaattttagtaacaaaagttgatccaaaccataattcactatatatatatatttaaataaggggtattatttatacttctttgaaacagaggagtggtggtggtttcgccacccccaacctcaccaactgcctactatttgctatactatttttaaatgttggtaatagtggtgacactgaatctatcaccatcacgtgtttcacctttgtatggaccctataatgttggtgaaacttttttgcttctcctatgattaatcaaacagaaatagctctatgcctctactctagctaattcagtaagcatcaaaaactcatggtgaagtatagcttgataggtagatagttttaggatttaaaaatgaatgcaaaagtttattttctaaaaattcagtagtaacgcacgagcaaatcagctagtaacatacggggttagagagcttacatgtggtgaaattgtgggtaataaacagaatgcatcacatcgtggagatggttaacaactagcaaatataaacttactaccatgtattagcactttatgtctggtcccatctattttttaattgtagcatgactcatgtttgaagaatttttcagatgggtcccaccttattatctactttacacatatatatattgtggtgcctcttcatcctactattaccacatggcacgagtctaccttactacctagtttacaataaacattgaggatgtctaaagaaaaaaaaagtcatgggaccaaagaatcgacatgtcagtaataaatatatataaaaagaaaataatggcaacaacatactaacattacttctcttttacataaaattttgttgcaaaacacagtgacacggataaaaaggagtacaccataagtatataacctaacatagagttactttctccgtttcacaatgtaagttattttagcatttcctacattcgtattgatgttaatgaatctagatagatatatatgtctaaatttattaacattagcatgaatgtgggaaatgctagaatgacttacattgtgaaacggagggagtattagctagtcatcatttgttctcttcaccgaccgaccggttgggtcaacctttctatgtacgctcttatacacgatgtcgtcattatgtgattaacacaagaacgcttgttcgtccctcgcctacaatgaaaacagaaactacaggacgcaggtgactagctctgcgtgtcgccatggtcgcgacaccatgttattttcattaccacagaacaagcatttatatgcatatatatgcccgcattttgccattcatcctccacctctcgccgccaagcagcttcaacaacagcagaagggcagacgtgagaacgatatatacatatatccaaca

SEQ ID NO: 16154 - DNA, 1501 bp, Oryza sativa
tacttgcagcaaccataacaaaactccactcattcctacttggcgagacgggaaaaaacttaacccagaggggtttcaacgtagggggtattgtgcagtttataagagagggcacgtcctgttgtcgttttggtaaccatcggggtccgacgtttatgtaactccacggccctcgttgtgtgcgtcacctagggtggctcgagcgccatcggcggagtcggctcgaggctgaactcggggggatccacctccacggcgccggacgagcgcgcggaggtcggaaggtgaggctggtcggtggacatgcaggagaggacggatggatccctcgcgcgatcgccgggggtgggggtcgccggaaccctaaccctaggtggcgtggatggcgtcgcgcgcggtggtcgccaccgcgaagggaggaggaggcgcgcgtgcgtgcgtgcgttgcggtggtggatcagacgacgggagaaacaaagcgagaaaaaaagagaaggaatgaggaatagaatacgagacagtgggtgtgggtacaagtaaactgcagattatgtcgttgtttttttttcccgattcggtccccgtagttgcacgaattgtgtttttttcattcttaatctttgtctaacagcatactagtgattgtactttgtgctagtgagcatttgaattttgaagtagacgaaagatttcgaaaccgatatggggttgctgtttgcaatccttttttttacataaaatttgtggcagttgaatctcaactgttaatttgcaacgttgacatgtaaacaaagtagtgtgggaatattttctttacgaaaagtcaacttctttgttcgaatttaaaaagtgatccagactaaccttaggaattatttttcttaataatggaaatagtttaatctccggtttctggcaacttatgaattatttccaacagaaacattaaatgaacatagataaaattaacgggagacgtttggtttctacttatttgaaaacttttgtcgcattctgaaagtgtccttacataatcctgtatatgcaaactgataacgcataaccactctatcgacgtcaaaagcatatttattaagcagatataacaataatgaaatgtagatagagacatatagctcgaattggtaaataagtacatatgtatatacacatagccacataggacatggacacaacacatgataccctcttaaaaatagataatatgacatgatataacagctgaatatgacatgcactcgttgtcgcgttcaatttcttcgtaaccgtcgaacaacgcacacgcacacattcgttttcggatagattctcaatacttcgcatggaagtaacacggcacgcgtttacttggagtggttcgttggattagcgcgttaattaattacctcctttccctccttgtattaaccgacgcttctgccctctagttgtaaataggagagatcataggtagcatagtgcaaaagtaccagtggatctc

SEQ ID NO: 16155 - DNA, 1501 bp, Oryza sativa
aatgagtagctgatgcttgtgtgtcactctacccttggattatcttaacccctgcttagactttgattatcacaagtaacatataaattattaatcaagttctctctacatgatctttccacgggataaaataaatacgatacccttggaatactctcgggtgaaatgctacaatggtatatccgtgtgcttgcagatgaactctgtaaccataatataccaggagtatttctgcgtcgttgttgggaattatatttctagtattgtcgttaagaaataccaacaccacctaggacaaaaccactctgaattgggtcgaggggggtaattcgtctggtattgaaagttcaggctgagcgatgtttggtttttgggttggggggtaattcttaatttttccaaaaaagaataacctcattttatcaaattccagtgcaattattaatcactctatttactccaaatgtatttattcctactttcgtaagctctgatgcagtaattacttaatatttttttcttttgggacaaatagaggaactaaaaatcaacttattctaaggatggatggagtatgtctgacttaataataaaataagtcctcttttctaacataagttaactttttatagaatagagggataggaataaaccattttatttaccttcttatttaatgaaaaaattctactacatgtacaacaggagttaatttctagtgtttaaaatatgtcaaacaaaacaagttgaatttgaatttcgtacatactctcagccaaaactattaaatgagttttatttgttgtacccttactgaactacctgacaatattgtttttacagtttagtctttttcccctcgtcactaattttttatatagaaccgcaccaaaaaaagaagtattttataacaagaaaggtataatacatgaacatcatgtgatgttgtcctttattcagagagaactactacgttttactatactccctccgttaaaaaaaatgcaaactctatcaatgtatttagacatgatgtatgtccagatacatagctagctaaattttgcctattcttgggatggagggagtattaagcaatgttcaagtgagcaacatagtgtgaaaatttcactttttctatgcgcatatttcctaaactgctaaatggtatttttctttttgaaaaaataatctatagggaagtttttttaaaaaatagattaatttatttttaagtttaaaataattaatacttaattaatcatgtgctaatgacccacttcgttatgtgtatcttaacaatcttttccgatccgctcctttaaatacaatccgtctattctgcttgaacaacttaggcccctaaactaactactccctctatcccaaatattatcccaaatataataacttgtattcaaaatataacaagttctctacgtatattatcttcttaaccaataaaaatataagaacttgagtgaaaaatataacaagttct

SEQ ID NO: 16156 - DNA, 1501 bp, Oryza sativa
cggcgccgcctccgtcatcatcatcgctgcggcgtgttccacgccgtcctcgtccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcattcgtcaagcgagccgctgcagccccgtcctcgtcttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcgcgtggtggtaaggatccctctccctcgctgccccgtcctcgtcctttcggtgtcgcccgtgctcgttgtgcggttctcggccccggtacccgtgtaccggtgtcggtagtcgttcacgcgtgcgggtggtgaccgtgtagtgtccgtgttagtgtgcccgctcggtagccgcgtggtttccacgtgtgcaggccgtgtggtgtttagtggagtccgtttgtcggccactcgcctcggttgacacacggggtctgcttccgtcgacccgaggaccgtctctgtgtacccggtctaccgcggtcctttaggttgacatgtggggtccgcatgtcaacggcgcagccttcctgtcttttccaggctagcgcttacacatgttttatagttgcaaagcttaattataataatccgcaaatctccatataacagcattaaacttcggatgatcatatcttggtcatacgagctccgaatcgacccgttcaagtctcttaatgtttgttataacctaaagaactgtgtgctttcttttttatgtgttgttattgcttctttataggcttgtagctttgcttgtgtgctccgcgtagctttcgtcgttccggaggttcgcgaagcgtggtttgcggtcgttgccgaaggttcggaaggccgttctctctgagcaaggcaagtcacatcatccttgagcatattgaatcccagtttataaaattattttgatttaaattaatgcatgatcgctttatttaaattcccgcgttatcactgttttatttagccatgcctatttacctttgttaagacattattattgctactgttattattaccttgttcaccctagaataaacaaaaccccaactagtggacactctattcatggttccactagtatgaatttaggtagatgcttcgctgattaattaggcaatattaggtggttttataactttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaa

SEQ ID NO: 16157 - DNA, 1501 bp, Oryza sativa
atcccctccccgagcgccaggacacggtggtgaactacggcggtgaggagggggtggaggagaaggcgctcgtgtgcaggacggtgtacgcgtggcgggagcccgtgtcgccgcacctggcggcggagagggaggggatgccggtggaggacgaggaggtcaggtggctcgtggaccggtggctggcggaggaggacgggggtggggaggtgtggaaggtgctcgagacggccggcggcgtcgccagccctggcccttctggcacgctccaatgtgatctctatcggtgcgcgcggttcagcttctgatttatgtcattcttcatttttggctagtcgtagtgaattcaagtacttgaatgtgtatgcgttcgttcaagtagaaattaaattgggtacatttgattactttagcatgttttgtttcgtgcatattattcattcaatgacatttgcttggtcgagctaattgatgtgatgcttgcgctgtatagttcctctacttaggagagctcaacgctagcaaatttcatctgcctcttacagatgtaagagagtaatgtgcacgttgtgaatgaacatattagctatgctaaattgtggcgagcaatcttgttgttttaatattttgtgaggttttatgttctgtacatgttaggatttttcatttgagtagttgatattcatgagctgagtaaatattcatgtcctacatcaatttctatgttcaatttacactactgtacacagtggcatatccatttgtcacttcttttaatatatgttttattcgttcagaagttatcacctgtggtgaactggcaatgccacctaatatttcttatcatgcattaaagtaccgtagataccttgaatttcttagaatgatttatggagaaccttgtaatatgtcaaagttaaactttggtatctctacatgctggtttgctttactttctggtgtaattgatcacatacaactcttaacaggtcctctaggttacctgcagttcttgttggagatggtcgtctaggtggtatttcatctactttatctgcctacgaaactctgttgctcagaggatatgatgtgggctcagttattttggaagatcgtggcttgtcgaatgacagattcctgctctcatacttgagaaagaggtgattaatgcctttctgttctttgtcaaatcactctgaaagtgtgcaggagcatagaagcatctcttttattttaattatattatcctgttaataataattatttcagtctttcatttggatatatgataaacctactgcaacttgcttgtattgtttctgtatttcaatgtatgactgatttgtgctatttctgttatttagggtacctgtgcatgtcctgccaccaattcctgaggatcccaaagacgacctaactgattggttttctgagtcatcctcagcttttagttcacttaaagatagtctgcaatcttttcattcacgaagagttcaaaggc

SEQ ID NO: 16158 - DNA, 1501 bp, Oryza sativa
acctccccacccccgtcctcctccgccagccaccggtccacgagccacctgacctcctcgtcctccaccggcatcccctccctctccgccgccaggtgcggcgacacgggctcccgccacgcgtacaccgtcctgcacacgagcgccttctcctccaccccctcctcaccgccgtagttcaccaccgtgtcctggcgctcggggaggggatccacggcgggggaagggaagagggtgtggttggacgcgacgaggcgggtggaggcgccgccgccggcgaggcggaggcggcggaggagcgcgggggcccggtcgaagacgaagcgcgcgtcggagtcatcggggaagccggtctggagcggcttgaggtaggcgacggtggaaggggaaggggagggggaggcgagaagggaggcgacgaggcccgcggaaacgagcgtcttgccgacgcccgtgttggcgccgaaaacggcgaaggccggcgaggtgagggcacggcggcggcggcggcggaggaggaggaggaggtggagtggcggcgagcgtggcggaggaggcggagcatggcggcgggggttgggtttttggacggggttaattgccggggtaatcggtttttggacggggttttggcacagtccgactggtgttgggtccgtggctccgtgccagcacgacctgatctttgagtcgtgcctgggccgctgcctcgacagtcgacacgatgtgctggtctggccggtccggtcggagttaaatagatgagagaactaaaatagacttattctagaagatattagataagcaaaatagatttttttcaagaaggagcacagtgggttttcgtgccttccggctgacccgagtcttactagaccatgcctagaccaatggtgcagcaagtggactggcacggcctggcacgtgtaggttgtgtcgtgtcggcccatctgatctcgccctgggcctggccatgtccgggccggacatttggctatccatactgttatctatacatttatcgataaatatatattaatataataataaagtaatttacatgtataactacagtgtggtaactaatatgtaacttttatctaattttaaaaccattagatttgctttaatgtttgtgcaagtggagaagaaaaaatcacaacatgcgcaagtgaggggatttagtctagtgacctccgctttgtaaaaatagcatgttatcgcaatattttcaaaagttacatgcaagttgtagttacatacatgtaagttataatgcaattatactacaattacattatatttacatctgacaatttttttaaagaaatttatcgacaaattatagcaaaactgattctagtttactccggacaacgtgggtaataaatcttgaacattgtatcatatttattaaaggaaaaagtacaaattaccccctgaactatcgcggtcatccgaattaccccataaaccagaaaaccaatcatcattcacccta

SEQ ID NO: 16159 - DNA, 642 bp, Oryza sativa
tttcctaactacaagaaacttgttaatccgtgacggattctcggtgacggatttacatatcatcactgacaaacatacaccgtgacgatattttgtttttcgtcacagatgagcccagtggatattcacagcccgctaactcgtgacatttttatcacgactgtcacaatgtatgattttaaattcatcatacgctagtttgcccaaaacaataaaaaaataaaacatatttagtgcaaagaaaaatgaaaaatgtgattgcaacaagaatcaaacccataagacaatttgttaaatttgaacaaaataattttgttaatatgttaaaaacaataaaaaataaacatatttagtgcaaagaaaaataaaaaatgtgattgcaagaagaatcaaacccaaaagacgatttgttcaatttgaataaaataattttgttaatatgttacatgtatatgatgcagaatatggcaaactaaaaaaatacggtgagcatgggtttttatctgcagcatatgggatttgaacccacacttagctaggagtaggaatgtgtcttaccacttgaaccacttgttctagatgtgtcaatgcacacttaaaatacacgttctagatcatgcgggatacttaggctagagttga

SEQ ID NO: 16160 - DNA, 1501 bp, Oryza sativa
ttctttctcctgatagataaggaggccgcgagtccgatccgacttcttcgcttctttcccggtgttagtttctccttctccgcgcctgagttgctctcgcttccccgcttctgatctcttgcgcgcacgagagattggaaggagcagtgcctccgaaaccacaccttcgcctgagatctgcaccgggtaggcgggtgatcaggtttttggggagtgcctcccgcacgactgctcatcgccatgtctggagttgctgccgccactgctggcggaggtggtacgccaccgccgacaggagctggatctggatccggagctggtgcgccaggaggaggtgccgtgaacgactacaacagcggaggcaattctgcctcaccatccagcggaaggccattctcggggtataatcttctcctcctgctactgctgttagcgctattcctgttcccattgttagcgctatactatgtgcgctatgttcttgttcctgttctacatgatgcctctagcatgttatcgcgttactggtatgttcctgttcctgacattcatgatgcgcatagtatgctactggttatgttaagatcaccctacactgcttatgccatgatcattgtttcattttcttagattaaaatataccgattaatgactatatttccaacaggaacctgatgcccgaccccaatttctaccgtacgccgcacgacctgcacctggtcggcaatggcggcaggctgatggttgtccaccgtagccgcagctaggtctcgcactcgcacggcggcggccgcaggagcagcaagtacagcgtgcactgggtgtatttcgattcgaagaggacggtgtccatggtcgtgactcgctttcgccggcaagccctgttcatcggcgcgtaccgtgcgatttcggttaatccagaggcgttccccggtatcagcccggacaccgtctacccaggctttgattgcgatgataaaccgagctcgcagcaagttggtggtggcttggatggatccaacgtggcatttccacatacagctgttgattgtttatccctatgtataagccagcctccgcgtcgctctcacgcgggtggctcggggcgaaaccctagccgcccgcgccgccaccttccccacccgctctagccgccctcgccgccgccggagcccgccgccggaaaccgcgcggccggccaggaaggcggcggcggggaaaaccagccggcgacgatcctccccctcggcgtgggaggtggagtggcgagcgtcaggcggaagacggcgtccgaagaggtccacagggcgaatccggccacgccggaggcggattcggccccctcggcggctgatctggcctccccgtggccggatcgggagctggcgactccggtggcggcggaactcgcggggcggtgcgtcgactggcagaggaggctgacgtcatcgccaagcacgtctctgaccggcggagctcgcagcgacggagatggtagcag

SEQ ID NO: 16161 - DNA, 1501 bp, Oryza sativa
tactgggccaacgtacttatttctggataagatggtgatattacttcattaactccagcatctgaccagcaagacagcaatgtactccctccattaaaaaaacaacttttatatatatgtacaaaagttttctgaatgcataacttgttcatggataaagatttccttttcctacgatgaagaaagcatgggcggatacagtgtattagcactggtacctcagggtattccagtcaactcatcctaatttatagcaagtgacaccaaaagattaagccttatgacacatgtcaatattgttttttttggctttggctacataagttgaatatagatagctacagcctacagcatcaggtgcatgtcttcctaactctttgccttccgcaagacaacgccaatgcaacgttcaactgtactccatgcttctaaaatagcgtttgtgagttattttttcttgccattaatagccaaagaaatagtcaatttccgatttgattttcatcttaattttgttctaacccatttaccaagttgtccacataattaatttcttcaaacactatgattaataaggtttttttatttgagaacaacaattacttaggctttggcctttcaagttctagagatttgagcatttgggattattctcatgacatatacttggatggcatttttttatcatttggttataagcgatgatacgttgccaagttctgtgggctgaagacttctattttgtccataatgttagcctgttaggttcttctaacaaactagtggtgctatttacttgtgcacgtgtacttttagtaactttagtttagttctttacaatttcgtttcaccaattagatcgataaatataaatatatggtgaaaatatgatatttttttaaaaaaatcaatttcatcttgttgcatagtactattctattacttttcatactcattataagtttgctagatgatgcaattgttgctatgagttaacagtgacaccctcgacctaaaatcctgaatccgctcttggaagagcgtgtatatctatatatatttatatatagatatatatatgtatacatatacatatatatctacatacatacatacatacatacatacatatgtatgtatgtatgtatgtatgtatgtatatatgtatgtatatatgtatgtatgtatatatgtatgtatatatatatatatgtatgtatatatgtatatatatatatatatatgtatgtatatatatatatatatatatatatatatatatatatatatatatatgtgtgtgtgtgtatgtgtatgtatgtatgtatgtatgcatgtatgtatgtacgtacgtacgtacgtatgtatgtatatgtacgtacgtacgtaagtatacatatgtatatgtatatatgtatgtatgtacatatgtatatgtatatatgtatgtatgtacatatatatatgtatatgtatgtatatgtatatatatatatatata

SEQ ID NO: 16162 - DNA, 1501 bp, Oryza sativa
agtcctatgtgatcggattgtctgaactgagatcagactatctgacctgcacaacaacaatacaaacaagagaacaacctaagagctctagattatacacaggcaaagaggtgagctcgaccaacaacaatatgagcatagcacaaagcaatggaacaagaaggtaaagagagtgaagatatcaccgaggtttacgcgccgatgtatttcccagagttcaaatccttgaggggattctagtctccgttgaggggctcgcaaagagccgggtctttttcaaccctatcctcatgaggttggacaaatgcactcctccttccactaagggtatctctttccttgcggaggcgcgatccggccttcacaaacttctcttgtccaaccacacgtagatcggtggccaagaatgacacctagccatctaggagtcctcaacctccaagagtaataaacaccacacaactcttggacaaatcctagtgctcaagatcaagaaacacacaccaggctcccaaactccaaatccacacacaaagatccaagtcactgttggcggctgataaatgccaatcccataccgccaacatctgcataaagtttagataataaaacatccaacatagtgataggttcttaatctctcatattccacaagtattggtgtatatttgtatgcagatgataaacgctgaagttgggaggaaaatcaaactaaagtgaggagaattatgcatccatacaaggaggggttgtgtacttcatcgaaacatcagtgaatcaacccaaaactccgagaaatggatagaggaaggtctagggagtccactgaacgaaggccaggccaggagggcccagcctaggttcggccgaacccccctgatcgcggttgatcctagggtttggcgtggacgctctagatgttctcccaatgacggttgcggagcagttcggacatttccccttctcacaaccgtcataactgccttatgaaaggacctcacttcatgcactctcacatacacttctaagcttgagctgaattataagaggatctattgtactatattgtatactagaataggaagagagtagagtagaatgagtcagaagaattccggagctatcggtaatcttctcctatttcttttattctgtttattactctgaatttaatataatattcttcttgagtaatttagatttatcttgtgataattatctcttggttagttcctgaatagcatacgggattattgttcactataatcaactaaaatatagtgattgcttttgtgagttataaacattggagtagatagtagttgcttagacgtggtgtttaggtaattgttatccagtaattgctgcgtatcccacagtacgtttgaggtggatgtagaggtggtgatagccctcgagattacttaagtcctccctgtccgggtacgtagtagagcgacatctgggaacaacgggttgccagagcctgtagtattgcatt

SEQ ID NO: 16163 - DNA, 1501 bp, Oryza sativa
atccatttcatatttattaaggagcattaaagtcttctctctttaaacatggtactccctccattccaaattgatctacatctagtttttttttgaggttattcttaaatgatctacatatttgtgttcatttattagagtctattcgttatttgtgcattggagtaaatggacattgatgcatgcatccatgcacacaagtatttataacccacatgcaatatcttgatttgctattggctagaaaatattggggatggtgcatgcattgagtttgttgctagagtaaatatagtatgagagagttattagcttttcttggtcttggtgtagctatgaaatatgtagatcaatttggaatggagggagtatgtgctaaaaacccttatgcacgatcttagagcaggtataatagtaggctattagctagctgtaaacatattttaatgagataaaagataagagagaagagcagcaggctataaatctgtagccagctgcaacacggactccaagacgcaatgtgtgtatgacaggtgggaccatatattaatagtatagtaagcaactattatatgaattggctattagattggctatagataaattagagctaataatgggctatactattaaactttgtcttatgcgcgttcatgaaaaaacagtgcaacagatggattacctcatgcaaaagaaggctactttcatgcatgtttaacaaacagtcacgtggattcaaaagctttaacgcatgcacaatacaaatacactcaactcatcttggaaaaaaaagcaaatagtaaaatagtaaaagacttttggatggagaaagtataaaattgaaaacctgatcatgatcaaattcgatattttttttcaaaaaatactaagacaacgagattactatttaataaaattcaaataaatttacgtgtaaaataatttagataatttcgtattggtactccctccatctacttttgatagtcatatttttaaatctaaaaaaattatttttgataggcatatttcaatccaacaatctatcattttaatgattttcttaaatttaatgcgtgactctctatttctccacacaagattggctacatggtatcgagaaatgtaaatattaatgaatcgtttgtttacgaggaatgactattagcatgtttaaatggatgataaatggaattacttatctttgatctatgtgccaatataaaatatgactatcaaaagtaaatggagggataattagctgaggcaattatacgtgccaccttaccagttgtaataatttgtacgagccaccggtgttggttcttgggcgtcgtcgctcactcgctctcgtccgggacgggtactgaaccttcatctcgcggaatcagtttcgcgaccgagacatggcccccctctcgttgacccatttaaaggcatcgttaacttgcaaaaccgaccgaagacattgtggcccatgaatgcctagttgccaaca

SEQ ID NO: 16164 - DNA, 1501 bp, Oryza sativa; identical to SEQ ID NO: 16066

SEQ ID NO: 16165 - DNA, 1501 bp, Oryza sativa; identical to SEQ ID NO: 16065

SEQ ID NO: 16166 - DNA, 1501 bp, Oryza sativa
atatccatcaaatttaggtcgtcagtagtcaaatgaaattagcctccatgcattctgcacaagcagaaaggaaaagattgtctgaattttcacatgcaagtgagattgtgagaactgacgaacttgtgttcaagaaacacagctattttgataaaacgctaggctttctgatctgaattatgaaaaatgttattgctcactaccccaccacaactattttggaatatgaagatactgcaaccgatagtagttggggcgttggggacataaaagcagcaatgtttctgaaattaatattgttccaatcactagtgctatacttcattaatcaccatcaatcttcttgcaactttgcaaagaatcgttctcataaactgaaaggaccaaccaaatggtccagagcaatggaccagcaaattcaggatattgtttttcgtctgatgtggccctagctacccagaacacgtggaagggaagctctccgtgccaaggagggcaggatgatgttgcttggctacacaagtagaagtactagtactattaaacaggtgtttagcaacctctgaaaacgaccattgttcagacaaaaccacttccgtacaaaaaaaatgaatcttgagtatttttgtactactagttgcaagtagcaaatgatatcaagattacctcttgctagcagttaccttaacttggtggttttcaattcaaggagtcagctgttactatcagatgattataatacaattagagagattccaatttcctaacttaagaggtaggagtgttcttatcagataattataatactattaatgaccatccagtttgttaactgaaaaaaggtataggagtatttcatcttggtgattttctcttcacagatacaactgttgttaggaggtaactacaatacaattaatgacatccaatttgttaagttgttaaccaaaaaggtagagtgttattttagcttggtgattttctcttgacagagagagctgttattatcagataattataatacaattaatgaacaaccaatttgttaactgaaaaggtagagggttattttaacttggtggttttctcttcatagtgacagctgttattatcagatgattacaatacaataaatgaccatccaattactccagttcattatcaaatcattataatacaattaataaatatccaatttgtttcctctaaccgaaaaaaaaaagtagaggaggagtatttgttaattgttccaattctctcatctactactactttgaggttttcagctggagccacccacctctgcacttctctacccactaccagtaaccagtagtcggccacgccattcaaccattttcaagcctactccaccaaagtgcaagaaagggggaggccccatcaccaaaagccactcctctcctctcattgcagactgcagagccaagaacacatccatcttctccttctcccattgctccagatcccatcagatcctcac

SEQ ID NO: 16167 - DNA, 1501 bp, Oryza sativa
gtaagggatctttgggtaaaacacttggcgatattgtgcacctgatatcaactctgttggagtagagataatgggagaatcgctacacctctggtcaagaaccaggtagtagtcgtaactcaaccactataagtaaatgtacgagagatcgttacgattgactggttgagaaccagtgagtaggtgtctctcgatcatttgaagtcgtggtacgaggaccgctgcgttattgctgtagtcgtacctcgaccatctgaggttgcggtgcgagagattgctacgtactgcttcgaggaccaacgaacgtgtagaatcatctctcgaacaccaatggaggttgcggtgcgggagattgctacgtaccggttcgagaaccaacgagcgagtagaatcatctctcgaacaccaatggaagttgcggtgcgggagattgctacgtactggttcgagaaccaacgagcgagtagaatcatctctcgaacaccaatgagggtggcggtgcaggagattgctacgtactagttcgagaaccagcgagcgagtagaatcatctctcgaacaccaatgggagcgctagagttggtttattacatgtgcatctcatgtggccagtatgactcacacacccaacttgtagcatatctggatgtccgttcgcaatcatgttgggtgatcaagccgatagcgttcgcgaggaattatccgttaccaaccttttctcgagtagtccagccatggccggtgctatgagataggtcgtcggtcttcgttggtaggttgggcgtgacgactctacatctgtcgagatcgttctcgataatgcggtgtacttgaccacaacctactcgagtgctcaattgtccctgaaaaatattttctagaagacaagacatatagcagataatatcgagtatgtactcaaaaaactgcatggatcttctagcattatcaggatataacgagcagattaaatatcagggcattatgtaaaccgtagacaagcatgatttatacggaaggaaataaagcaagcccccagcgttagaccgtagtcgatttaacatcggggacactcgcgcaatagatagtgtataaaaaacatgctctaggtaaacataataaatcatatatatgataatatcgtatggtctgaaaaataggtacggtaatttgtatataaattattgcgtacctttgtagatacatgccggatgtatctacggaattagtagatcaacttaaaaaaccaatctaccaattaccttgttgcgtactcgttcaacatcatacgatctgacatctttcggtacgccgcgaagcttgaggcttggatgatctcgatagaccaagttgtcgatgacgatgatggttctgatctggttaggttggatctccccctcagctgaagtcatcgagtagctcattgtcggagaatccatcccttaaacccatcttgtcgaaaccttgaagcaccaaaagatcccctacctggcgcgccact

SEQ ID NO: 16168 - DNA, 429 bp, Oryza sativa
acgtgtacacctggcatgtggggcccacgtgggtcccatgctgattcagctgccacgtgactaaaaccggggtcaaaaccaccaagggaccttgggtgaccggttttgtatagttggaggaccccgagtgtctggtattgcggttcaaggacgttttttaatctcggtgacaagttcagggacctccggtatacttttcccaatctgaaatccatccctaatcgcaatgccgggtatacctcatcctccaactcacagtaccatgtcaacgtggattatcatggccagttttaactgacgtggcaagtgagccccacacgggtcccacgtgtcgggcccaactcttctctcttccttctctatcggcaatggccgcccggcggagaggggctgttgccaacctccttccccttctcctctctccctaga

SEQ ID NO: 16169 - DNA, 466 bp, Oryza sativa
catcataagcaacagaacaccaaatctagacttgacctacctcccacaatcttctttttctttttctttttctaatagaaatagaaaacctcccacagtgttctcactgatttgacatttccccaggcctgactcaggaaagaacccaaatctcctcggacaaggttgaatctttaccaaaatgttgattgagtccagtgtagggctcaacatccacacaagaaaaccttcatgagtcatgacacagatacgcattgatccagcagttatagtatctcaggctcatggatgggacaatcgaacatcaactgatataaacgcactaatgtagtaatgctataacaagacaacgcgtgcacggaccaaatcaatcatttcggcgggacgaaattaacaatccccatcccaaaaatagaatcattatctaggtaggatcaaaagcgcgtagacgaggaaaaaaatgatt

SEQ ID NO: 16170 - DNA, 1314 bp, Oryza sativa
tcctgcagcccccgtttccgccacttgccgcaccttctccacgccggaatcgagctcgcgccgtcgctctctctatgcgccgtcgccgccgagctccggtccaccgccgccgtcgccccggaccgcctcccacctcggcgccgcatcctcgccgacctcgtccacctctccgtttcggtcgccgaccgccggaacgccgccgaccccgtcgacccgagccgcgccaccgcctccctctgctccggccgcctcctccgtcgccgccgtcgcctcggggtgagccgtggaccgtcgcctttttcccccttcccttcccctctctcggccgccgctccaccgtgcctatggctgtcgccggcgaccataggggcgcgggcgccgcctcccgccgagcggctgacgcgtggggcccggccgtcagccgccaaggccctcgggtgcggctgacgcgtggggcccaccgcgcccgccggtgtgagcccaggtgcacccggtccaccgtggactgtgaggctgccgcgtgggccccactcccgtggacccggtccgcgcgtccctctcccccggctgacgcaataaaccctttaaattaaaatttaaatgaagaaattcgtaaatattcatttaaagagcatataaacttcaaatggccataacttggccatttgaactcggaattggaccgttcaagtctctaatttttccttaagaagtcaagaacccatttttgtgctttgttcctgcttgttatgtggagtttattagagtaaaagcccttttcttttccattggtcgtgtagacgctgcagcttcggaagatccgctcttcgtggaggttgaagccgacgtttgggaaagcgagcaaggcaagtcacatcatctttgaacatattggatcccactttgcgaagttattttgatttaaattaatgcattatcgcttcatttaaattcccgcgttatcactgttttaattagccatgcctatttacctttgttatgaccttactgtcgtcattgttattattaccttgttcaccctagaataaacaaaaccccaactactgggcactctactcatggttccactagtctgaatttaggtagatgcttcgcttattatttaggcaacattaggtgattttataattctagactttggggtattcatatcacttgaacattatggaatggttggattattgtggaactggatgcacaccttcccctctattcaaaactctcaaaatggttttaggctaggcttggggtgcatggttttgatagtagcacctcggccacataaggaccggt

SEQ ID NO: 16171 - DNA, 1501 bp, Oryza sativa
tccactgtgcgcataacctgctcatgatatagttgcagcttgtaatgattttcctcaatgcaattctaaggttgtgattctatttcaaaatttgcgtacaaaaataaacaaagtaataaaaaattaaggtaagacctatattggtaataatggttcaaaagacaaaactgaaaaagtagaacataataattgaaaaaccctaaaaattaatttctagaattcaatttctgtaagtggcttacaaaccctttcttgaaatttatagatatggtaaccttgagaattttgataatttgactctttttttttaccaatttattttaatcgacacttgaggatgacatataagactatcttagtggataaaagtagaccacgttgaaaccaagattgctaattaacgatcggccatgcgcggcccccttgcacgtagttagtttctatatggtacggagtacttgttgtacatatatgtgtacgtgtatatacaaatttttatatatacgtacaaagtttgtacgtatatgaataaactctgtaagcatatgtataaagtttgtatgtatatatacaaagttttgtttatatatatataaaaattttatacattaaaagtatgcacttatacatatacgtataaacttgatatacatgtatacaaattatatacatagacacacggactaaaagccaacccctatcccctcgtgaaatagcgttaaattatcacattcagatattatttgtacatttagctattgtcaaattaaatatggtacgtttgcaatataattatattgtaactataatataacttgcacgtaattagtatgtaattttcgaaggtcacatatctctcccatatgcatttaagtagagttatcatctaatcacttcagtttatacagtgaaaagggaaaaaatatgtatgcaagaccctcacttggtcatcatcgagtccaatgccgcgtacgtaacgaaccgcacactacgcctttcgttagaaaaatcgatctaagaagaaaatttgacgtcagcaaaaccgtcaaaatagatgggccttgtgggcctgaggttacgtgggcttcctttcactgtagtacacgtttccaaagtcggttcgtccatcaaaccgacctgtctcccccacaaaataaatacccgcaaaaataaagaagaaaaaaaaaagatccccgcaaaatcagcgcgggtttcaacgccgtcttccctccaaaccaaaccctcctcctcccttctccgccgcgacgtacgacgagaagagaggagaatcgccgcgactcgacgcggcggcggcggcggcggcggcggacaactcggcgagaggtcgccggcttcgttcggctcgccctgccaaaggtaatccaccagccgatccatcgattcggccaaaaacctacccccaccgtctcggccgcgtggtgattcgattcggtttgtttttttttgacttttgattgactttgatctgcagccatggcca

SEQ ID NO: 16172 - DNA, 1501 bp, Oryza sativa
cgaaaggcgtagtgtgcggttcgttacgtacgcggcattggactcgatgatgaccaagtgagggtcttgcatacatattttttcccttttcactgtataaactgaagtgattagatgataactctacttaaatgcatatgggagagatatgtgaccttcgaaaattacatactaattacgtgcaagttatattatagttacaatataattatattgcaaacgtaccatatttaatttgacaatagctaaatgtacaaataatatctgaatgtgataatttaacgctatttcacgaggggataggggttggcttttagtccgtgtgtctatgtatataatttgtatacatgtatatcaagtttatacgtatatgtataagtgcatacttttaatgtataaaatttttatatatatataaacaaaactttgtatatatacatacaaactttatacatatgcttacagagtttattcatatacgtacaaactttgtacgtatatataaaaatttgtatatacacgtacacatatatgtacaacaagtactccgtaccatatagaaactaactacgtgcaagggggccgcgcatggccgatcgttaattagcaatcttggtttcaacgtggtctacttttatccactaagatagtcttatatgtcatcctcaagtgtcgattaaaataaattggtaaaaaaaaagagtcaaattatcaaaattctcaaggttaccatatctataaatttcaagaaagggtttgtaagccacttacagaaattgaattctagaaattaatttttagggtttttcaattattatgttctactttttcagttttgtcttttgaaccattattaccaatataggtcttaccttaattttttattactttgtttatttttgtacgcaaattttgaaatagaatcacaaccttagaattgcattgaggaaaatcattacaagctgcaactatatcatgagcaggttatgcgcacagtggaaacattgcgtccaatctgggaactagtggttgcacccgtatgatttcttactagcatactttcactcaatttttttttttgaagcgaaaatttcactcaaatatttttttttctgttcaacatttttcatcatgagcacaaatagtttggaaatggtcttctccccaagattggtcatcatcagtatcctcgaatgcacacgcgaacaaggtggccagcaatggtgcaaaatagtttgatctactgtatattcgccaaaactccatttttttcccctagagaagaaagggttcagacttctgaatttacctgctatgtttcatttttatctgaccatttgatagatgccaacataaggaaggaaaatgaaatattcaaggtccataagaaatgaaattttcagagaatgactaaggacagcatgaaagcttgttaacatgattcccaaaaaaaggaaaacaagtctgactatctctttagacgcccggtcgctctgcctcg

SEQ ID NO: 16173 - DNA, 1501 bp, Oryza sativa
gtataatttgtataatctgtgatgtatttaatttgtgtgtagttttttaggatctgtgatgtatttgatctgtgtgtagaatttgtggtgtatttaatctgtgtatacaagtaacttaatatttgggatgttgatttggggatgtgcatcccatttaattcgggagaaaatatagggattaaccctagccattagcaaatcaacaataaaataaaaaaagtatctcgaggaactgtcgcttcccaccaaccgggactaaagattccctctctttactcctccatcttatcgatttttagtcccggattcgtagtgaggttctaaaccgggagtaaaaaatattttttcaccagtgaacgcatcgtccgagacggcgaagcccacggcgcaccaccgcgtcggccaccgtccagcttcgtcgccctcgtcgcgacggtctggacgctcctcgtccggtccaagtccaagacatccgccgcggacgacgccgaggcgttcctcttcttcttcgccgacttccgcgagcggctcgaccctcccgtcgacgccaggtacttcggcacgtgcctcaccgggtgcttcgtggcgctcccagcgcgcgacctcctccacggcgacggcgcactggcggccgccgcgtcggcgatccaggaggagatccggaggatggcggatgacccgctggccttgtgggatttctttagcctgaacagcagggcggcctaagagaaggtggcgaccgtgtccggatcgccggggttctgcccgtacgacgtcgctgactttgggtgggggaagccgagatggacggtgccggcgaggatgaaccacgacggccagatggcgctggcccgcgccggcgacggccgcggggtgcaggtgtcggtgtcgttgctgcaaccgaaacagatggacgctttcaagtcgcgtttcctcgagctactgggataagatgaccgatagttcatgccatctaggcatctagtactagactcatattatgcatatcttattttcctctactgcatggactcaagacaatatttggctggctggctggctcaccctgtttgttatcctttcatggacgtagtataataatgagataatctcatgtttgccgatgtcttaagtatataatactacgtctgttttttaatatatgatgccgtcgattttttataaacatttggccattcgttttattcaatttttttacaaatataaaattaagtcatgattaaataacatttgacgataaatcaagtaaaaaaaagataattacataatttttttttgggaaattacataaatttttttaataacataaatggtcaaacgtataaaaaaatcaacggtatcatatattaaaaaaatgtaaagaatagtaatcagtaaacctgtttttcccggtgaatataagggcaaactactgtcacggttcgcacttcgcaggctggggaaatgcgaggaacgccgattggaaggccgcgtgaactac

SEQ ID NO: 16174 - DNA, 902 bp, Oryza sativa
ttcattagagttcacataaaaaagttatgaattatttttaaatatataaagtctttagaccgtcctatttgaccaatatgatattcaaatccaagtttagggaccggggtgacacaactgaacaatttggaggatctaaacgagtgatccacaagtttagggaccgggatgacacagttgaataagttgaggatctgaacggtcgatttaagagtttagggaccgggatgacacagcggtacaaatttagggaccggtgatggactttactctttttgaaacttctagtgtaatgcgatgaaggaaatgtagaaaactttagaaacgcagggaacatagaaatatagaaaatggaaaagaaactttgaaacttatagggtatacgattttgaaacttatagggtaatacgatgaaggaaatgtagaaaactttagaaacgcagggaacatagaaatatagaaaatggaaaagaaattttgaaacttacacgaggaacgaaatatagaaaattttagaaacgcaggaacatatagaaaaaaaattaaaaaggaaatccgcttggatcgggatattgaacccgacgtgaatcgaacacgcaaccttctgatctggagtcagacgcgctaccattgcgccacggatccaatggtgatatggttcaaaacaattgccaaaatatgttttaggtcttccgattaacgcaaaccaatactaagcaacaacctttgctaattgattagctcgggcctacgtgagttcgttgggtcgtcacggtcgatggaaccagctccccaactcacctaggaatagattaggaaaagcgaaacttcagtccaccgaatggtccgaaatcctggccctacaacgtcacactttagtcaccccccacttcctccgcaga

SEQ ID NO: 16175 - DNA, 506 bp, Oryza sativa
ttcattagagttcacataaaaaagttatgaattatttttaaatatataaagtctttagaccgtcctatttgaccaatatgatattcaaatccaagtttagggaccggggtgacacaactgaacaatttggaggatctaaacgagtgatccacaagtttagggaccgggatgacacagttgaataagttgaggatctgaacggtcgatttaagagtttagggaccgggatgacacagcggtacaaatttagggaccggtgatggactttactctttttgaaacttctagtgtaatgcgatgaaggaaatgtagaaaactttagaaacgcagggaacatagaaatatagaaaatggaaaagaaactttgaaacttatagggtatacgattttgaaacttatagggtaatacgatgaaggaaatgtagaaaactttagaaacgcagggaacatagaaatatagaaaatggaaaagaaattttgaaacttacacgaggaacgaaatatag

SEQ ID NO: 16176 - DNA, 1501 bp, Oryza sativa; identical to SEQ ID NO: 16125

SEQ ID NO: 16177 - DNA, 1501 bp, Oryza sativa
cgggagctgctgctggaggtgggtttctgggtgcaagctggatgcgcacgggtgccgtcgtcgtcttgcggggcgtggtgcggatccggactcctcctggcgctggaagaccctttagctgagcgttctccttcttcaggcgcgctatctcgtccttcaaagcgacgatcctcatgagcttcccatcgttcaaggccttggtcgccttgtgcaggtccgagtgcatcctgtccaatcccctcatcacagcacacatgtgaccgaaggtggtgtcgttctcgccagctgtcggacggaaggagctgacgccatcaccgttggctcgactggggtggtagcggtacgccgtgtcgtggaagatgtagttgtggcgctcccgtagtctggccatcatcaagtaggctgcctcctgacaggcgtgatctgctgtgcctccagatgcctcgaccgccatgttggcgaggcaagtctgtcacatcctgattttcgtttcaggatttataaattatttaataaattattaatagaatttatattaaatgttctttaatttacaagtgaagttaaatgtgggaaataaaatttcctaaataaaaaaaagcatagatggatttaatttttattaagtcctccatgattaattatactctctggaattttctcggatttttcggagctcaattgttaattttaatcatacaaagaaaagttcagcaattatttaaatatcaaattaatcaggtaatgatctaattataattgttaagtgattttcttgtttaaaatccttaaattataaattgttgtttaaaaggaattattagaaatgattttaaaagtttaaaagagaagatcttttcttttaatttgctaaatctcaacataaaaatgagctagataaaattttgttaaatactttgcttgttcctctattttctagatttttctgggaattatttgagcaaaggaagtatttttaataaatgaaacatcatttcacaaattatttttaattgaaaaagtttttaaaatctcctcctaggccgttgggccgaatccggcccaactcctctctctttctctctcttcccgcgcgcggcccacgccggcccagccgagccgcccgctcctcctctctccagccgctgacatgtggggcccacatgtcagggccgtcttcaacctccggccgccgcgccgccgaagcccgaaccctagccgtttttgcgccgccgtttccggccgaatccgaccccatctcttccaattgattgaggggttttgttcctctcggtctcctctttcttttcccccaagaatcaaagcaaatggttgaggattcgatccgaatcgaactcgttttgttttatctctaaaaaacgagtccgagttcttcccgattcgattcctctcgtttgcgacttgatctgttcgattcgagctcatataaaccttccccatgatctcctctttcgtttgccccctttcccgagtcctcccg

SEQ ID NO: 16178 - DNA, 1501 bp, Oryza sativa; identical to SEQ ID NO: 16153

SEQ ID NO: 16179 - DNA, 1501 bp, Oryza sativa
ggcgcataaatgctcctgatctcttccatttcaaggtgcacggtcgaacattgatagctgctcagcctgcagtcgaacattgcgtgcatctgacacgcacggccggcgtgggtgacggcggcttcgcagcggcgggcggcgcgcgacacatgcagcttcgacttcggggtcgcagcgcgtctaacgacaagtcaatgcatggcaacgggagtaccggagtagagactgccatgcgacaaacaaaactaacagtacgtacgtatgccatgcgactatgcgagacatggtctgatcgattgatatgagatttaccgttgcatggctcatccactagcttccgatagttggccagaagatatacaaacgctacgatttgggcttagattggttactctggtaggagaggaccgagcgtagcattgagcgtgtatggctcgctcgctggtctacgataacgcgagcaacaggcggtcaattcgatcccaggatcgtgtcatccggccgccggccccctcacttcctcaaaaggagtaaggagtttacatggagtatttttgtctaattaacggtattttttcagattttcgaattagttactttttaagtttctttaaaaaatcaaataaatcaatttttaagtttgtaatggctaatattcaattaatcatgtactaatgtgtatcctcattttgtataccatggaaaagctgagccgatcctcttccaacgaagcctaagacttgttcggttaatcccgaagagagagattgaggggaggataacaccacagcataacagatgtgaaatttgaggacttttacggtagaatatactagtagtatatatgggggtgaaaatgggtcgggttgggtcggatcccacccttcccatatgctaacacatattttacaatcggaatcaggtcagacacggatagtgccaaatacatatacaaactcggatattgtcgggcaaaaatacgaaacgaatacgtaccaaaatggatacgtacactatcggttacaaatacttattcggatatcaagtctaagcaacaatcatatatatcacatagacaataaccattcagcaattccatatatccataatacgattatatatgaccttaggaaataaatagggtgcaacacctcgcaattgaaaattatttcatatatgacatacatttaagaatattaggtcgttaaacacgatatatctcacagttgagtcacaatgccaatatatcaccccatacaagctatcggtaggcatcattcataggaccacagaggcatagactaatagatatcatttaaattatcaccaatagactaataggtactacgttcccgaacctgatctcatatccgccaaaaaagacctgtattcgacccgatatctatgaaaagtcccagatacccgaatttgtcctgaagtaatatcgtcgggccgagcgggcggaaaatacctgccccattttcacccctaagtatatatt

SEQ ID NO: 16180 - DNA, 957 bp, Oryza sativa
cacgcggagcaaaaacccacgaggggtcggggcgcctcggccctcggggccgaggggggtgcggcccgaccctctcggggggactaagaggagggcgaacgcatcaccctcgggcccgacgccccccgagggtgccaggccacgtgggcgattgtgtctgcctcaagcctctagtcatgctactcccggttccatgtcaccgacaaagtattttatgaatgcatgtatgatggtgattgaattcatctacacatatggagctagtggcagtagcaattgacgacagttacatgactaatatttattatggatatatgtttagtattcttttgggtgtatgtatggatagactgtaattattttagaccttagacatggtgatgaattagactaatggactacacagttatgaatttgcatgctaagtctatgtatgttgttatgaacttggttgttagatctatgcattaatgcgtattaaatggtattttggtggtgtgttgatgcttgtcatggttctctgatcattttacccatttttttaatgattgtttgaattttgcaccaaattcggtcaaatttcatctgaaatttccgagattcatccattttggtaggtcccgaaatttttacgctattgaatcccagaaccctgacctcggaagcttttacaacaagatcaatacgccattaatatggaggaggaccgagcagcatgtgctccatagcatgaaaagcaacatgtgaccttggctgctagttttgttggtgacaggagcatgagattttaacttcattttcattggaagctgtaggagaccaatttcgtcaacatcagtggcggcagagaggcacacgctcgacgacattagctcgatcgggctactgctccctctccatttgctactgtttgatctgattagcttgcttgctaggagattggacgagctcaggaga

SEQ ID NO: 16181 - DNA, 300 bp, Oryza sativa
agaggctcaattttagatgaattttgcaagttgaatggctcaattcggaattcgaatgaattagatatgaattttggaagttttgagccattttaatggatttctagaattattaccgatttattgcgcaatttaaatcaattatgacgtcatccgacgggggagaggtggcgccggcaagcgggccccacctgtcggtgactcacgggtggcgggcacaccgtggaccgagtccacgcacgcgctggtccgcgggcgcaccacgtggcagacacctggcggccacgacggacggctagc

SEQ ID NO: 16182 - DNA, 1249 bp, Oryza sativa
atatatacacggaggcgtgcgtgggtgggtttagttcctagcggtctagccaccccacccctcctcctccgcgatcggttttgaaaattgcggggatttcaaccgattttggtggaaatttccccgtgtttcgattcgattctactacgggttcggctccaccgccatactgtgtgttgtgttgtggtgtggtttcgctcgcagcgtgtgggtgggtggggttgggttgtttcggctttttggggcggcgcgcgtcgacgtgttgcgctcgtgtttgctttgggtatggtgtggtttgtggcggattggtacgctgcgggtgattatgctgattaggagggtgattggcctaggttgtgtttgttttgttctttacttccagcaaaaagatgacatgctgactatgatagtaggatctcacaaggcatctatttggttagttgtgtaggtttttgtgaaaagggagacggcgacaattaatcttttgtcaatgaaaggaataattgggcttctttgctaaggaagtaatcctttgttagggaaggattgaacttcattattaaggaaaaaaatcctttgttacaagttcagatacatgcagttgccataaaaaacgattcatcgggaataggacacatacgattatttgaaattacgcgataaatttaatgttcacgaatatttatatttatctttacctacttaaaatattgataatagtacttctttcctttggttgtgttagttgtcatttgttctccaatgatctggtttagtttcctatttagatatattcattgtttgactctacgaaaagtttttcctctttccttgagctgatttaggagggtgcctttggttggttttttgaccctgcttttggctttaaaagggctcaaaagccatagctgcatctacccaaaagctgcttttgctctagtacaaattgaaagcacctccaccccttactttcagctgcttttgggtcaaatatttatccgcctgccactggttacgtggagaaaataacgtttagcctcgttctattccgcatcgcgtccgctctgtcgcccccttcggcatcgcgtccgctgccactcgctacccgtcgtcgaggtcctccagacctgcccgagccagctaccggaccttcgttgccccaactccggcgagtccaggaccattgcggcgcgagattcttcacctcccctccccgtggcggcgtggctcccccatccccttggtccca

SEQ ID NO: 16183 - DNA, 1501 bp, Oryza sativa
gtacccaaattctagaccttaaaaatttcctatcaaaatagttggaagctaacttttccatttttgagagctaaaaatttccatttttaacctaggtgtggtcaatctaacttgaacctaagtaaaatttgggaacaaattaaaactttttcatttataacctaggacataaatgcaaacacgagtaaaagcatgcatacttgcataaaacatgttttgacttgagtccttcatgtgcatttgaatctttgatttgcatttcataataggtctcatgaatcttaactaagatctagataaacaagtaaaccattagggcctagtgctagctagaggaagttaaaatagaaaccatacaccttaaaatatatcaacatggctaatgtcaagcctcacaaaactaatttcaacatccatctaaagacatgtcatgaacatgaaagtgaacaaataaattatatcatatagggtatattctatcttaatcatctctataagcattctcttcatttaatactaaagtaaacttatgcataaataggtaaggagcttatgacatgtgtaaggtaaactgtaattctaacatatcaatatcacctcaggttaatgagagtccaaatataacttttataaacatttacatgcatttaggaaagggaaacacatataagacataagtcttgcgaattatctaaaataattcgtgtaagataaaatcgtgggaaaattcatgtaggctctacttaacatataaaactcactgtaattttggtataatttaataactaaatttcatacctcgaataaatcagtcaaaccagtcaaataatagactaattatagttcttaatcggttaaaaccatacctaactaaaatgtgcatttaactgcatgaaagtgtataggggaaataatttattcaaatactaggtcatttatcatgaataaatataattttatcagaatttatcttctctgtttaggtctcctaaaaattcaaactaatttccaaagggcccattttctcctaattactgtgagtaatctatccaaaattttttaagtgcaaccaaagaaaatggaatctaggtatcttcaactatcatcacaaaaattcacactaatttatcctggccacaaaataaactatcgagttacaaaggaagggtaagtgaattaatcctgaaaatttgtccaaaatcacttacacccaattatctacccatccctcacacccccacctagattacaccgacctggacccacctggcagccttcttggcttacccttcccctgtgcaacttctctagccgaccagaactgagagaaagaccgagccgacagccctcgggcgcgttcgacgcgtggcctcgacgtggcagcgccgaaccgaagcttcacctcacccagctgcgtcgccactcttcacccaccatcccagtgccgatccatccgagggaggaagctccaactttccctctccacctctctttcatcgtc

SEQ ID NO: 16184 - DNA, 1501 bp, Oryza sativa
ataaaagcgtaagggaccatcaagacatttttatctttgtgtgagagcattgctcatcccaagtatgtcgcttcctcgaccttcttttccttgtgcaatttcttgatatatgcttccttttcctcatatatcttatcctttagttctgggtaattctcatgaagctgtacaatattttgcgtcctgtgaaccctagttggatcaaatgaccaactggttgccttgttctttccgcttcccggaattgtaacctatattatgcaacttgaaaggaatggaagtttgtttcatacatttacgtaaaacatataagagtaaatacttgccggcaaaacacaacaacgagatcgaaaatgcccttgggcccacatgtcaggtcccctatctctcttctctctatatctcctcctcttcgctctctcatctcacttgtcagcgacgatggcggcaggcgaggtcccacggctgcgggagggctagggcggagcgacatgggagggagaagatagataggagagtgacatgtgggcccaagggcatttttgacatttcacatgatttctctctcctcttcaaccggaaattattattttaatgagtgcggtgtccaccagcaaatatccaacttttgggagtgttttcccccaaaagtcacttcgtgccttgtcctataggatatagctaaaccacgaagttacggtgtccagtagcaaaatttgcttaaaattaaaaggcttgttcgctacagttctaatgaactgattgtattgtacaacaccaccggactgatgaaatgtagttacaacaagcatgtatggtacaacgaaggaaagcaacattaattcacccaacaactagcttatactctctttgtcaactaaaattaacccatgtagtagagcggcggggtgagaagagccagcagccgcctcctctctgcgtgcagcaacgattggacacatgaatcaatcaatgaattgaatgaatcaatttagtactagtacttgtttatgggaaattatacatatataattgtctagaacaagctaatggatcaattagtagataatgaattgaattgaactgaacaatgtaagctaggtaaaaaaaatgaaactaagagagtaattaaggtatatacgaaccgcgagcggcgagcatgatttggaggcgggcgaggacgtgcctgccatggatgttgtggatgagcctgaagaagttgcggttgacaactgtgactatcaagtccaccacccactcatccgctatcgtctccaacatcttttgtatcacgtaatttccatgctcgtccatcatcatcatctgcatatatgtatgcccatcaacattagcatcaacataaacacacaagcacatatgtgtgtgtctgtgtgtgtacatgtgtttatgtgtgtgtctctttgtgtgtacatgtgtttgtgtgtgtgtatttgtgtgtctttgtgtgtgtgatcgatgacaaaatgtagtactgaccagg

SEQ ID NO: 16185 - DNA, 1501 bp, Oryza sativa
gccacgcgccgtcgcggttcttgtgacgtatgcgccacgcgaattagaaggctacgatggcgatcagtcgcgccaggatcaagatcctgtaaggatgaaggacgatgcccttgaccttgtacgtccggaacagcggcggccggccgccgctggcccctgacacgtccgcttcgtcgacggccacccaaacgtcgccgccgacgtcgtcgttcacccgtttggccgcgggcgaccggcgctcgttctgcccgtcggctctggccgcggtatcgccgttggtggcgtccacgcggagagcagcgttattccggcgagtcacggccgccgccgaggaaatcgtggatgccgcggtggccgccatgcacgcaacacaccttcgttagctcctccttgtccgtggcgaactgttgcacgccgagccggcttttatatagcgcggctaacgacatgagtcatgtcgtctcggtcaaagtactactactctgctactccctttgtctcataaataaaatttttaaccatattttaggacaataaatctctatccagatttactatcgtagaatatatcacatcacttaaaaatctattatattatgagatggatagagtccactcttattataaaattataacccactaattactaaaacttaacatgcaaagatgccatatcatcatccactgaccattattacatttaagcatcatgcaaccatgctatgttatctataatttaataatttattaaattttagaaatttgaaattaagcatgttaaatcatcctacattattcacataatatttcaatatatatctccatcattttttttataatatcctactccctccgtcccaaaaacatcaaactctaaggatgaatgtgggcacatatgtgtccagattcatccctagagtttgattcttttggggacagaggagtatatagctatatagttcatcctcacttaattcttgttatttttcttttctcccattaagtcatatcacattaattgtgattttagtccttagatgattaatctatggttcaaattctctctcatcttttcttctcttattaacccatgtcatctcaatttttttagctcttacatgtatagtttaaattatcttccttcttttgttctctcataaagacatatcatcttattttttatatttgaataatcattttacatactatttgaatttaaatcacatgtaaatttatgttcgtgtaagcttacgttatttaaactatcataaacattatttttatctattgttatcatagtaaattcgtgcaacaacacgcggggtttcacctagtacaaggagacgtcaccactgccgtgcaagctgagcattttcctttctgcatcgtactactccttccctccctcccattttaagcgtcagcaatgaattttcgtgtatgcccgtcttatttaaaatttattttgttttgttatataacaacaacaaaaaaactaatc

SEQ ID NO: 16186 - DNA, 428 bp, Oryza sativa
ctgtaatttattttattattagtttatatttaatacttcaaatgtgtgtccgtatacttcaaaaactttacacccaaaaatatgtgtccgtatacttaaaaactttacaccaaagaactaaacacatccatagtatatgaaagtgttcagctttcttgttcggttttcccgaataaaccgagaattggatacgcatggtacggaggtggcacaggccgcgtccgcacactgcacggcgacgtttaggctggctgccgtgggaattagagcatcaccaagatcaccaagagtatcccaatatttcattcccaaaactatttttatgggaatgctaaacaaaatttgatgtgctaaaatattgatccctccaggagattgtctaaaattgactttctaaaattaaaagtgggccctctacgaaaccacca

SEQ ID NO: 16187 - DNA, 1008 bp, Oryza sativa
atattacatgactttaaatgggaaagccataaatagctaacttgtacagctaatcaagatctacaacttttattttagtcacttcttcatccgacaaagtgatagtaccaatgtttacaaaattgacatatctgtgttaatatttataaaccagatgagagaaatgtgatttttgtgaataatataactatcactttgtcggatgaagaagtaaccaaaataaaaattgtagatcttgatgagaggatcaactttgttgttgaccatatttccatttgaaatcatttagtatttacaaatgttgattatatttgtcatattgtgaaaatcaatttcaagctgttagaaacaaagttatatagataaatgaccaaaataaaagttgtagttcttgatgagaggatcaactttgttgttgaccatatttccatttcaaatcatttagtatttacaaatgctgtttagatttgtcatattatcaaaatcaatttcaagctgttggaaacaaagttatatagacaaatgaccaaaataaaagttgtagatcttgataacctctacaattttgttgttgaccatatttcgatttgaaataatttactatccgaaaatatgttatgactaataaaatgaattattatacaacagctatatattttgtactcacaaatataaagacttatctgggaaatggaaaaatagtcatcagtgacgggccttagttcaagcccgatagagattaatctatctctatcgggcattatcttagggcccgtcacagatgagtcatccgtgacgggcctgactgtcatctcaatcgggcattagtatggagcccgtcaccgatgagtcatctgtgacaggccctacggcaaagcccgattgagatgactcatcactctaatataactagggtttctcagatcggatcgaaaatttttctaagtcccgctacagtttcccgcctccttagaaccctagcgccgccgtcatcctccctcgccaagc

SEQ ID NO: 16188 - DNA, 1501 bp, Oryza sativa
taggcctaatgaaaactaatccaccatataccttaatttaattagcttatggacttatcgtgcattgaatggttgtatacttgtattgatcccttgaacggttgaacccagaacggtagaaccctaagtccctaatcttggtaatttaatggggaaaaaataaattagaagaacagatcaattctaatcagcgagaaggatcaatggattggatcatcacctgatcaagtgagaaggatcgatggattggatcatcaattctaatcaacgagaaggatcaattctaagctattgggctaaatacctatacaggatatatactagatcagggttggctgggccctaggccatcgcccttatggccctgctccagagtggacccgattcgttccaaaggtcatgggctttaatttggatgatgatgtgcagtgaacgttttcgttttagccaggatatacaacttttcgttttagccgttgtgttcattgcaattaaatctgtacaacaagattttacatgattacattatgatgaaaaaatttttatgtttgtaaattacttttattatatacataagttactttaatcatatataaaaattacattcataatactctgaggtgattacttttattttttttaggtaattccgtaatttgtgctgattaatttaatttctatatagagttatgtttttatccctataacaaatttacttctaatgtcatgacaatgttttttttaagttacttctataatataagactttattgaatttacttttatttgtctaagaagtaatttagtaatatctaaaagtaatttagatatattataaaagtaatttataatttttcatcataatataatcatgtaatatcttgttgtaaagatttaattgcaatgatcaaaatagtataatcggattgtatatcggataagaaatttaagagaaaactttataagaagggaaaaaaagacatgcatgcctgacactctcatgtttctctcaaattctaaactctgatacttccgactaaatcggatggccacgccaggtgtcgatgtgtaagaccagatagatgtgtaagaccagatagagatgcctctcgttatagattttatgattttttatactaaccacacttcgaatatagagtttattacacacccttgactactgggtctgtctaaaaaaaccacccgtcaaatatagaaccatggacgacacattaattggatggcaaatcctgaaatgcaaagggtatcgtgaatacatggacacttctcaacttacaaagacaggtgatgtgaatccaaaagacgaaccctaactggcaaaactaggttgttaaacccacttgtcacctaaaagaaaaatgacgacaaacagtaagaaattcagctaaaatcacataaacctggggtgttgtccaacattcccgatcacccgatgaaactatatacgaaataatcaaagtacgaggcaagcaattaattc

SEQ ID NO: 16189 - DNA, 1501 bp, Oryza sativa
cttttatagcctcccaatgacggttatggcaattggaatggttggaaatgccctctaactgtcattggggtgtaatcctggacgtccacgccaaaccctacatccaacggagcaggtgggggttcagctgaaccatgggccgggccaaaccagcccaatttcggctggcggcctcccctcttgatatactttgtaaacttgtgaattttggcccaattggtcgtgttatttctgagttcttgtcctatctttccacaagtctgattctcgacatcgtccgattgattgatcgcttgttttgatgtcgattctcctccattttatgttcattctcggcaagtggttagtaatcctagtactagtggaatatttattattctaacacaaatatgcattgcaagcataactagttctcctttattttggtagtattgacggtcgaaactgatcgctaacgaccatcaacaccggtcctcttttttttttggctcgagcaaagctgaatgtaccagttcaattttcatcataggtgcggttgttagtattggtgccgaccaataggtgtcggttgggaaaccggcacctatggccctttttgtagtattgtctgcgagtgaatttaaaaaagaatgtaggtcttgtggaatgccgaatgtgtgctatataaattattagtacggttctctctgctatgatcttcccacatgattaaacaaatacgatacccttggaatactctcgggtgaaaaactacaatggtatatctgtgcgcttgcggatgaactctgcaaccataatatactaggagtatttatgcgccattgctgggaattatttctagtaatgtcgttaagaaataccaacatggagccgaactggggggagccagagccagcggcgtcgtgcgcagccaggcccatgcctctcccgccaccagcgccgcctccgctgtcccgtcgtcgttgccgccgccatctcgtcgttgtcgccgccgccgcctccatcccatcgccacctccatcccgtcgccgcctcctctgccccaccacccgggagctagcctccttcgatggcccagcagcgagcgttggatctggcctggagggagccagatccggcggcgcctcgtccccgccgccagcgacgtcgcctcctccgtcgacgtcgcgactgccctagccggtgctgcgtcagccaccgtcggccttctccgtcggtgccacgactgccccagctggcgcctcgtcctcctctgatgcggcgcccggccagcgccgctctgtcccgatctggccacgcgggggaggggggatgggccagatccgctagcgacgacaccggctctgccgcctctggccgtcggtggcgccggagccacctcgacgcgtcgccgtccctccgcctgtttcccgtcagggccccagccgtcgggtgttggagggggtagaaggccccaccgccgccgtccttgctgccgcccggctttgccggcggctgctcg

SEQ ID NO: 16190 - DNA, 658 bp, Oryza sativa
gggtgcatttttttaggccccggagggggagatcgtggccgtggcgggcggcaacggccggcgtagggagctccggcgacgtgggcgagtggggctcgaacggcgccgatttttgggggggaaatgggggagaaagtggaggaaggggaggatgtggggtggaccacgtctgcacgtgcgcgggagcgtggaggcgcgcgggggaagcggcgtcgtggggtggctcaggcggccatggcggttggggttggccggcgagaggtaggaggaggagctcggtcccacctgtcggccggatggagagagaggagggaaaccaggggacgtaaagtagactttcgcaaggcgcgggccggccgagagagagaggaggcgcgcggcccgcgggagaggaggggaaggcttgggccaagcccaaaagggaaggaaggagaattttatttgttttctttttatttaattggttaaatgatctttgtgactttaaaattatttcttgagctccgaaaatttgcggaaaaatccggagagtattttggggcacaaagaatattacaaaatattctcggccaatgatttttaaaggaaattttaatttcctctataatttcatttgattaaattgatttaacttttaatataatttctagaaatgcat

SEQ ID NO: 16191 - DNA, 1501 bp, Oryza sativa
tacctgacacctgttgtggtactagctgcatggtagctgatacctgtgatatctgctaccagtacctgtgatacctaggacctgatacatgtgacactcgtgcaagagaatagttaatatgtctatcctgttgcaatgggatcccgttttgtagcaaccctcatctggttaagaattttgtattgagccccctcttctatagtatatccacaaatcaactcccagcactcccaaatccactctcacctagagacggcaatggaccccgttcaccgtttccctgcggtgaattcaccgtcctcctcctggtcgtcgtgtgcgtcgtcaaggcagcgatgtggcggctggcggtgatttttgcttttttttttggtttttttggttccgtgcgggtggtataacacaaccgcatgggataattgattattctgtgcggtcggcccgcccacacgcgaaaatgccgattttcccagacacccggctgcagacaggccggacaaccgcacggaaaaatcaaaatgcccgcacagaaaaatcttgtatgtagtagtgactatcgatctatcttttaaggattatgaagagttcaataatttaatggagaagaaatcaactatgactcaagacctcattgaccaattggaggagaaaaacagatgctctttccaaaagttagtccacactaatgttgtttggatgcataaactatattctgtcatgtttttctaaccatgactattcttttaaccgacagataccgtcgtgtcaagcaactaggcgtattaatttcttacacatttttgtctttgcccttgctcttcacaatatgaattttttggttaggaatttcaccaagaacgagtaaatgaagagattgattggaagacatggaattaatcttatgtattttgatgatatctgtcattatgtatatggtgatgtgcagagtgcgatgccgaagcaccagtaacacagacatagtatatcttttagttccacatagttggaattaatccagttcttaagtttcctgcagattttgtcagcaagttcctaattttttttagactttttaaattttttaattttattaatagatctttcaaagaaatattttcgagaactgaaacttttttgactatgcggccaagtggctggcgtggtaacgttgttttgccacgccagccacacggtggcgtggcaagaggctggcatggcaggacaatattgccacgtcagctgcgtgtggtgtaacaaagttattacaccagtcaggctggcgtggccaaaagattcagatttgaaaatactttttaaaaaatatattaataaattttaaaaatagaaagtctaaaaaataaaaaaaatccaagttcatcgtacgacattcattccacacgcttcaagttagtcagattgacctgaaagacaaagccaagcacggagagtctaaatttcaacaagaaaaaaaattcggtcatcaaatgaccggtggttaaac

SEQ ID NO: 16192 - DNA, 1501 bp, Oryza sativa
actttacgtgatgcatcaacatatattaattgttattatgaagataaaacatggcagcatatgcattcagcagaacttacctagaactatattatattggagagatagatggcatgagggatgagtctagtcgccaacctagtcacgtccagccgggatcgatttgcagccgccggggagagagtggagaggcgatacggtgtgcgatggtggtggaggtggtcgaaggggagagagcggagcggagatgcagaggaaggcgtctactttgaagctgctcaattaatttatccctagacaattcagaggaaccaaaataatcatttgtaaactgaaatgagattaaaatgcagatggaaacacacagacatatccaaggagtggatgctatagcagaaaaagacagattttataacgatggcatcaaatgtagacaaatatccacatatgaaatgcattctccatcagttcaaattacctcaatactgtatagaactattgatagagccgcaagaaagcatgcattttttttccgtaagagacagatgaactattcagatatatagggaggatttagcactattagacagtgaaaccaaacaatgtccatcagctttaagttaggttggacaccataccaggtggaggtgtaggggaggggggaagcgggtggctcccgtcgatccggcggtggcacaggtggagcggctgcgcagccgatggaggaggtcggttggaggctccctatgacggcgcaggtggagcggctggcggctcccgtcgatccggcggtggcataggttgagcggcagcgcagccgatggaggaggtcggagtgcgtaaaatttcaggtcaacgcattctccctcatctgccaagcaaaagcataaaaacttgatgtataatataagaagtaaaactgaaacaaagatagaaagcaatatgaaccatgagtatgtctagataacagagaaacctactcagatttgctatttaaatttggttgagataaatgcatattacaaataattaagggaggcagagctgaggcaagctttagctaacaggttatttctacttgattgcaacgaaagtatcactgcgaagaaatgctcagcatcgatagtgagctgtgcagcccagcatctcagaaatcaaggtacattcgatttcatccaatggaaaatcgcatcagttgttcagtatttacagtcgaacctaagatttggaaataacagcctcaatctcctatggggaaaatcagtaactccatttgcttcaagtgactctatctagcatcggtctcactgaaatcaacaaggcaaggcacagatcgttcaagcgtaacaaaaccaaagctattgcaagaacataggttgaaactgaaagggagagaagatgaaatctagggtttgggtaacaaacacacacctcgagaacaaacgaatcgaaacttttcttgtcgttctcaatcctgctcctgtgaggaaaaaaaaattga

SEQ ID NO: 16193 - DNA, 1501 bp, Oryza sativa
tgactagttattcccttgaaaacagtttataattgatggcgccaaattaaatggttgcatgcaaggcataattaatggaaagctgaataaatcttaacccaatcatcccctgatatagtgacattttcttggttggttgaccttttcacctctggctgctggtcggcagattgacactgcccaaatttatactccctcattctctaaatatttgacgccgttaactttttaaaacatatttgaccgttcgtcttattcaaaaacttttacgaaatatgtaaaactatatgtatacataaaagtacatttaacaatgaatcaaatggtaagaaaaaaattaataattgcttaaattttttaaataagacgaacggtcaaacatgtttaaaaaaatcaacggtgtcaaacatttagggatggagggagtacaatgtaggcgaaaaaaattataattgaaggcaccggatggatgcaatcaacaaaacaatgacacgttcagtagatatagagaaaaactgaataattctcatgccaatcataaataatgacatattggttgactttttgccgggtccaccgattggcactgcccgaatgtatagaacgatggagggaaaacagttcataattgaaggagcccagatggttgcatccacaaagaatggagaactccataaatctcagcgctaatcatcctctgaaataatgtcatgttcttgattgactttttcgccggccgcggattgacacccaaatttatagagcatatgggaagtgaaaacattttacaattgaaggcaccataccatgtggttgcaagggcagggtaatgttgagcgctgaatacatatcaagccaatcatccgctaaaataatgccatattcttggttgatttcttcaccgcaccagaccagcagattgataccaacaaatttattgagcaatggagggaaaacaatttataattgaaggtggcagatgtttacttgagcagtggaataaatctcaagctaatcatcccctgaaattatggcatcttcttggttgacttcatcaccgagcaaccagattgacgccgacaagattgattaagcaaggtagggaaaagagtttacaattgaaggcgatgactgcatgcacagcggaatgatgtattggataaatataagccaatcatcccttgaaatagcgccatcttgttggcaatgcatcagagcccaaacatggctttaggatctctagtatgcttatcagctttgttgttgatccccctgtccactgtgtctgctgcttcttctccaggtctgaccgagagcagcaacaacgacactgacctcactgcacttctggctttcaaagcgcagttccatgatcctgacaacatccttgctggcaactggacccctggcacgccgttctgccagtgggtgggcgtctcgtgcagccgccatcagcagcgtgtcgttgccctggagctgccgaacgttcccctgcaaggag

SEQ ID NO: 16194 - DNA, 1501 bp, Oryza sativa
tgtgaccaccgtgattgtgaagattgcaaccgctggcgaccggcggacggcgggcgacatatttctgtaaccgaaggatgtagtactcaattcaggaatcaggatacatataatctgaacctgaacattactgtcaacacatgtccatctatacagccagacaacggagatgcatacttttaccagaatgcctagattgactagttattcccttgaaaacagtttataattgatggcgccaaattaaatggttgcatgcaaggcataattaatggaaagctgaataaatcttaacccaatcatcccctgatatagtgacattttcttggttggttgaccttttcacctctggctgctggtcggcagattgacactgcccaaatttatactccctcattctctaaatatttgacgccgttaactttttaaaacatatttgaccgttcgtcttattcaaaaacttttacgaaatatgtaaaactatatgtatacataaaagtacatttaacaatgaatcaaatggtaagaaaaaaattaataattgcttaaattttttaaataagacgaacggtcaaacatgtttaaaaaaatcaacggtgtcaaacatttagggatggagggagtacaatgtaggcgaaaaaaattataattgaaggcaccggatggatgcaatcaacaaaacaatgacacgttcagtagatatagagaaaaactgaataattctcatgccaatcataaataatgacatattggttgactttttgccgggtccaccgattggcactgcccgaatgtatagaacgatggagggaaaacagttcataattgaaggagcccagatggttgcatccacaaagaatggagaactccataaatctcagcgctaatcatcctctgaaataatgtcatgttcttgattgactttttcgccggccgcggattgacacccaaatttatagagcatatgggaagtgaaaacattttacaattgaaggcaccataccatgtggttgcaagggcagggtaatgttgagcgctgaatacatatcaagccaatcatccgctaaaataatgccatattcttggttgatttcttcaccgcaccagaccagcagattgataccaacaaatttattgagcaatggagggaaaacaatttataattgaaggtggcagatgtttacttgagcagtggaataaatctcaagctaatcatcccctgaaattatggcatcttcttggttgacttcatcaccgagcaaccagattgacgccgacaagattgattaagcaaggtagggaaaagagtttacaattgaaggcgatgactgcatgcacagcggaatgatgtattggataaatataagccaatcatcccttgaaatagcgccatcttgttggcaatgcatcagagcccaaacatggctttaggatctctagtatgcttatcagctttgttgttgatccccctgtccactgtgtctgctgcttcttctccagg

SEQ ID NO: 16195 - DNA, 1501 bp, Oryza sativa
gaattcagaatttaaattgaggggtgctaccgtactagctagtgtaaaaaatatatcccaccacatattcacattaattgaaatacatgataattaaggccagtggcggaggacggaaaaaaacaaggtgtggctcatatggactagcgcgagagtgaaaacccaacaagaataaggaaataaacaatctcaattgcacggtatcgtacggcaaaatattacgtcaataagcctatgttaagcatggcagcaaccattgatcgtaatctattgtccatttgcaaataagtataaataaaagagtatgcattgaagaatacttaaagtaataaagtattttttattttgggaatacaagtaaacgctgaagtgcagcaagtgctaaacgctgctctctccctgcttggttgcttgccgagcggtgccggtgccgttcccagccgcagcccgcaccagcttgctcccatcctgcaggtaccacggtaccagcccggtaccaaatctcagctatttatttagctcgatcgaatggtggaaattatgcggtacctccaggtacatatttgcccatgaggtggtaccggaatagttagaggggtggaatggtaatgttgtcttttcgcgtagggatccatctcgattcagctctgatccgtgagaggtggcggtggtgctggacgggagcaacgctcagaggcggcggcgaggtggtccttgggaggtggtggcggcggctgatccgtaggcggcggtggcgacagctgattcgtgggaggcggcggcggcggcagcagcgtgggaggtggcgagtaggtggtccatgggaggcgacgaggaggtggtggctggtccgtgggctgcggtggtgaggtggtgttggcggcagtgtctggtgcttgggcccgtgtccatgaggtggcggcggcgatggcgtcgacaacgggtggttcgtggcgtgcgtggtggttcggcagcgggtggttcgtggtgggcatccttcttcaacctctggttattctgtagcactgcccacagctcaagcactcaactattatgttgagaaaacgaaggcagaagagagaaaatgaagaagttgtccaagcagaaaaaagagactgatgacattagaaatgggtaaattggaaccatgccattataattttccaaagtttgagacatgccatcggtatctcaaagacatgtaggacccacatgagtcaatgacatgtgggtcaggatggcatatctcaaattttgcaaaattataatggcatggttctaattttcccattagaaagtagttcataggaacagtagttgtagctgtgttccttctcatgaagctatttgataatatgtactatgcttgccattgttgatttttgtacatgtcaattaccagaattaatggatggggatcactcagcatgttgatgtcttagcaaccaatccatgtgaattctgtttatctatctcccaaaaactagaatattagggaagg

SEQ ID NO: 16196 - DNA, 1501 bp, Oryza sativa
gccgcccgccagctggaggcctgcgccgggggctagctcggaagtcggaggcgcgcttcgtcggcgaggggggtgtagaaccaatcgctcttccagtcgtcccactttttgcggaggacgcagggaatgtagcagttcagcacctgcccccgcggctggaagtaacagtcaccgactaccgtcggcggcgacaccggctgtacggtgaagaaccaccggaacagccggagagatggacgcacccctataaacatctcgcacaggtgcgcgaagatggccaacgtcattatcgcattgggggtgaggtgcgccatctggagatcataaaatagagaggaagaagaaaatagagaatggcgggaccagccccggccggtggcagattccggcatgaatcggcgcggcagcccggcctgcctctcgctcacgatgcgggaaggcggaagcacgctaccgtcgagcggtgcggagccccgtgccatgacgccggcggaggaggagcttgagagcgagcgagtgcggcaagggtagggcacaggaaacgaagagttagagcacaaatggcgaaggcaaggggaagagtggcgagaggaaggaaacgaatcccttcctcggcatctttacacccttgccaacgctgtgcccggctcctcgcttcccgtgcccactacctcgccccctcgtttctcgcgcccacgcctccactaaccccactcgcccgtttgcggcgcacgcggcagatgtgcggccgtggcggttgagatggggcagattgtgcgcgcattaactacgctcgccaaccgcgaaaagcgccatcatcatgtctccaggcgaaacgaaccggctcgtcccgattcgcgcgctgctcgagtgatgtagcggtcttaaagaggccgctcattattgtcggtcggttttcccttgccaatgcgcgcgatttgcgaccgctgggtttctgcccgcctgtagggaccggccccacctgtcaccaggcctaaggagtggcgtcacgcccgagcgcttccctcgaggggggcgatcgccctggcgtaacgccgggggttactgtcggtgacatggggccgggggtatcgtgactagaggattgggtagccgcggtcgcccacgtggcctgaccccctcggggggggtcgggcccgagggtgacgtggccacccctccctctgtctccccgaggggtcgggccgctcccgtttcggccccgagggctcgggcgcccccgtttcggccccgggggctggggcgccccgaccccctgtggttttggcgccacgtgtgtgggttaggtgagcacagcgggactcacctaaccgcatttatagcgggttggacgagcgcgccacaccgcatttaatgcggcgcagcgcacgcttatccggtctgtgaccggtcgtggtgtgtgaccggtcacagaccggtcagatctcgggttaggtggcaacaggcggcctgtcacacgcctcgccccgtcccgtcggaa

SEQ ID NO: 16197 - DNA, 1501 bp, Oryza sativa
aaacatttgtgctaaaacatgtgatcgagaaattcttcatttgtgtccgaatcttaagcgcaaaaggattgcaccttaatatataatatattagattcgtgtctgattcgttttcagtcatatctctataccaattaaatgataaaattacactagcggtccttaaacttgtaacgaagtttcacttaggtccacgaacttgcaaaacgcacaccgagctccctaaacatgctttaatgtattatcctggtccaaagcctcttttgaccgtgttcttgcctatgtggcatgccacatggatgatgacatggcaaaactttctttttccctttttttttctccccatattttctcatcttcctcatctcgcgtggtggacgaggtttcctgcaacggtcagtgtgcgtgctcgggcacctgccggcgggaggagaggaacggagcgcgtgcgcgggcaacgaccagcgagaaaggagcagcgcgtcggcgccggctggcgggaggagaggatccgtgggtgaaggccgagggggaggagagggagaagcggctgccggcggccatgtgagggccaccaccggagtggttcaggggtgaagagggcggcggcacagttcgttgggtcgaggcacgcgtagggggaggtgtcgccagccgcgcctgaggggaggggtggccgactgcggccgcgcgtccggggcaggggggaggtgtcagtgagctcggcgcgagcgggctgggcgctagcttgacggtggcagtgggtagccgaccgccgccgcgcgtgcggggtaggcgtctgcgagctcagcgtcagcggggtgggtgcgagctcgacagcagcagcagggtggcagggcgagctcaaggtcagcggcgcgagctcgacggcgacagtggcagaacccgacgatgagcttcgtgagagagtaggcgagctcgtcgaacttgagcagctgccgcatctgcttgccgcgcgtgcccgcggccggccggagcaggggccttccccttcccctcctcctccttcctatcgacgacgtcgttgctgccgccggcctctctgcccccttgccagcctcgcgcgggctgacagagtgacaggtgggccccacctgtcagcggtagaagggagagaaaggaggtgaagtggagaaaaaaagaaggaagaagggagaagaaataaaaaaaattccatgccatcgaggctatggacctggatgatacattaaactaagtttagagatctcgatgtgtgttttacaagttcgtggacctaagtgaaagcttattataagtttgaggtaagctagtgtaatttactccaattaaatcatactacctccgtattttaatgtatgacgccgttaactttttatacaacgtttgaccattcgtcttattcaaaaaacttatgtaattatcatttattttaggaaaaagtacgagttacccccccgaactatcgcggtcgtccgaattacccacccccccgggaacc

SEQ ID NO: 16198 - DNA, 391 bp, Oryza sativa
cccgctgtgctcacctaacccacacacgtggcgccaaaaccacagggggtcggggcgccccagccctcggggccgaaacgggagcggcccgacccctcggggagacagagggaggggtggccacgtcaccttcgggcccgacccccccgagggggtcaggccacgtgggtgaccgcggctacccaagcctctagtcacgatacccccggccccatgtcaccgacagtagcccccggcgttacgccagggcgatcgcccccctcgagggaagcgctcgggcgtgacgccactccttaggcccggtgacaggtggggccggtccctacaggcgggcagaaacccagcggtcgcaaatcgcgcgcatcggcaagggaaaaccgaccgacaataa

SEQ ID NO: 16199 - DNA, 1501 bp, Oryza sativa
ggaggcgcgggcgacggcggtggcggcggcgcgacgctcaacttcccggagcgcgcggcggccacgtacggcggcggcgccgccgtggcgcgcctgtcgccgcggtccgtgcagcgcgtggcgtccgacgccggcatggccgccgacgcgcagctcgtggcggcgcgggacgccgcgcccgcgcccgcgccggcgacggcgtacgcgcgcccggatcactgcgccggcgcgacgacggcgcggcacgacgagctggcgcgccgcgggatgtacggcgctcacgcgcatgccgccggcgcgaacgccaggacgagcggcgagcggcagctcgtctgtgccgaggagattagcgtggatgacatggagatcctgatgtaatcacgcagtgacaaaatagcaaaaaacaaaaattaagattggtattaattggctgatgcaataataaagttcaaaaaacactgataagcaattgagaagatgctgtgttgaccatgcttgcggccaggaacgccgacgaagacgatagctgtgacctcaaaactgactgaaagttccagaaccaaactggaacttcccttcgatgatttttgactttctatttggtcatttgtttttataataattaatttctgtaattagttacagcactcgtaaaacacttccactatctgcaacttacatactctccataacacgaatttgacgttgctgaaatttcaattttcaaatttattcgctgcattcatcgcagacttggcagtaattctggtattacatggcctggttgtgaatgtactgcaggtaacatctgctcacgtcaaaaccggtagactctcgagtgtagaccaactcttcagagagtatgacaacggcaacaacgcagtaattgtagttactctcgccaagaacagaacaaagtccaggcctccagggcattcagaaacgttgaatagttgcacacttgcactgaaagtctgaaatttacctgcagttctgtcagaaagtccactatcattttttttcaacccttttgagttcctgtgtcttcctttcacacagtagtttaattccatagccgttgctgtgactgtgaattaatgaattactaatcaatagggggattagacgagtagtgaggacaagtactgaaacgaacgcgggtattggcacgaaataaaaaggcgttcgtgagtgagtgcaggattgtggcgcatctgaagtatctgcttctcactgtcgcaatctgaatctccctacctttgtgcctgacgcgtttagcttaatcttgtgcaatacacgtttgactagaaaagcaaaacattttaatgatttaatctctcgggcaatagttgtactacttgccacttaagccttgcttgaacagtcacttagagagtgaagtacagtaaatatcagtaatcacacaccatgaacacaggactgagcattatgaaaactcggtcaaatgagccaaggcaattatctcaatttcggattttta

SEQ ID NO: 16200 - DNA, 1501 bp, Oryza sativa
tacttgattaaagtatgatctaattaaatattcgtctaaaatattctaataaacaaaacttaacaaataaattaaagcaagagatgtacaacagaagaaaactttgtgataaaatatgtttcttgaagcttggagcaacaatccgttttaaccatccggtaagtaaactgaaaacagctgagccacctagcttacggcagcttccttcctctctcgaaccctctctctcgaaccctcgcctactacattctttttcccttctcccgacccctcttcctcctcgattccggcggcctcgtcgccggcggagggagggagaggggtcgtcccccctcccctagtatagtttagtagccgggctagtctcgttaggtcgggttcttcccgttttgcttctcgttggtgtggtatggaggttggagtcggcggcggggttgcggatgtagccatactcggtgatggcgacgcgattacgaccgaagatgacggcggcggcggcggctcggaagcggtccacggcggcggcggctgctcggatgcggtccgtggcggcggcggcggctcggatacggcccacggcggcggcggctgttcggatgcggtccatggcggcggtggcggcggctcggttgcggcccacggcggcggcggctgctcggatgcggtccgtggcggcggcggcggctcggatgcggcccacgacggcggcggctgctcggatgcggcccgtggcggcggcggctgctcggatgcggcccaaggtggcggcggcggctcgaatgcggcccgcggcggtggtggctgctctgatgctgcccacggctgcgctgttgctgtctctggcggcgatgactgcgctgttgtggcctacgtcagcatcggtggtgttagtctggtgcttctgctccacctttgttagtaataagtctagctgctcagagtagttagtttccctctgtttttacgttgagtcttgcacatgatctgttcatcctgtttgtgtgcatagtgggcttgacgcacgctgcgttcgtgcggagtccgtggtgtcgtgcgtggtgtgctccagttcgtgggatggcgcgaagtggcaaggagtgtggcacgcacaattaggaggccactatggccacgtttaactttcttgtaatttgctatttaaggttaagctctaatccagaaaagctgccagttaatgcagcgccaaaatactctgtgttgctctgtttctgttttgccagacaagctacagtttttcgttttgccgctaacaattggtatcagagccttcggtgatcgccgggattcctgatgtcgctaccaacgccgcacgtctcccacacaccaccgcgtcgtcgctggcgctcgccgtctccgcgccgtggccgtcatggcggccgcggccaagtcgtggtggaacgcgtcgtccgcgaggcgaccatgagcagcgtcgtctacccgacactcacccgcacaaattaccaagactgggcgctggtaa

SEQ ID NO: 16201 - DNA, 1501 bp, Oryza sativa
tgaggaggaacctcaccggagaacagaatcccggagaggttgagatatctctcaacttcttgaaagaacccaagaactccgggacacggccatcggtgttgggctgtaaatagactagttatgtgtgtgtgtcttgtgtgctggcccatctattgaagagggcccatcccatgtatatgtaagtgagaatggcaatagagaaagtgaagcttccagagaaaaaatcacaagacttcatggtatcagagccaaccggctagtggctggcgacggctaaaccctagcctcgccagagctcgtcgaggagggagacgctggtgttggggaggacgtgtggcggcggcgctgtgagcggaggagtgctgcacccgtcgactgctgaggcggagcgacggcgacggctgctgcagcgcggccggtgtgacggagggagcagggctgcagtgctaggtgtgcttgtgcttgtgaaggaaggagtgagtaagtgtgcttgtgctgttgctgctgcttggatttggtagtgtacttgtgctgttgctgctgtttggatttggtacttgttctgtgagaggagacagagaagagctgtgcgttggtagtgtgcttggcgctgttgctgctgcttggatttggtacttgtgctgtgagaggagacagagaagagctgtgcgacgagttgcttgtgctgttgaaaggaaaaaaaaagggaggagacagagaggaggtgaggtgcttgtgctgttgctgttgaaaggaaaagggaggatttggtgcctgtgtagctgctgctggttagagtagctacaactagggcggttaaaaaagctcaaggctcgcgagtagctcgagcttggctcgtcctaggctcgattcgagctcggctcgagcttcaaacgagccgaacccgagcctgagcaaaagctcgcgagcttctaccgagcctggccgagcttgactgtgtataattcatattgcatgttcaccttattaatataataaactaatagataaatacatatattagtatctatttacacaataaattagcatgtgttagcacaatatatttattttaatcattttctactcttttcttagtgtgattaactagaaaataattatacttatcaaaagattatcattaaaatatatattatactacttatggccgagctcggtagccaagctcgagctcgaatgagctcgaaccgagcttgcctaaaagctcgaaggtggaataggctcggctcgagctcggctcgagcttgtgtcgagctcgagcttgggcagacaagctcgctcgagctcggctcgttgacagccctagctacaacttatagaaggtgagaataaggaactttctactgcaagtattgcttgattaaaatgggggaaaatcagggactggaacaagtaatgggtaaattggtagagatgcttgcaaagaagtttaatgaggctccaactacgagtagtgcagtggttcctcatactgaatcgg

SEQ ID NO: 16202 - DNA, 1501 bp, Oryza sativa
caagagaatgatcaatcatgttgtccacagctgccaatcgatcgatcgagctttatttcgcctttaagcaacatagtagcatcgattgatggcaatatagaccactcccttcctcctcctgctagctatagccccgttcgacaataacataacggatgaagattaagtgttgacatacacaaaacgagaaaaaacacatggttaataatgtaaaatcaaatgtgtttttgattattattctgtgatgaacaattggcatcggagattattggttttgatatttggaatttattcacgaagtggttttggagatgattggatttcacaggtgaatctacaggtactgctggaattgggtctggtcagaccgagcaggtgttgccggtcagaccggcgtgtatcgcgcggtcagaccggcgcagcccgcggtctgaccggccgacgctgtgtcggtttcggtttcgggttgtttgtttggatatccgtgattatttcatgattatggcttttagatggatactatacgtatgtaatactgttgtttgctactaatgagtcaagttggagatagcttggtctcggaatatggtttctttgtttatttcatgtgtaggtgactcgatgcctcgggagagtatttgcggtgatggaccgggagtcggctcggggataagacgacgtccgtggtggtcagagatcatgcgggatacttaggctagagttgatgcacgtggttgatggagattccatatggcatacgatggaggtattgtgtgcgtatgggatgcggagtcgaattttgaaggagtccaaatttagtatgattggttatgtaaaatttgtttcttgtactagagggtttcctaactacaagaaacttgttaatccgtgacggattctcggtgacggatttacatatcatcactgacaaacatacaccgtgacgatattttgtttttcgtcacagatgagcccagtggatattcacagcccgctaactcgtgacatttttatcacgactgtcacaatgtatgattttaaattcatcatacgctagtttgcccaaaacaataaaaaaataaaacatatttagtgcaaagaaaaatgaaaaatgtgattgcaacaagaatcaaacccataagacaatttgttaaatttgaacaaaataattttgttaatatgttaaaaacaataaaaaataaacatatttagtgcaaagaaaaataaaaaatgtgattgcaagaagaatcaaacccaaaagacgatttgttcaatttgaataaaataattttgttaatatgttacatgtatatgatgcagaatatggcaaactaaaaaaatacggtgagcatgggtttttatctgcagcatatgggatttgaacccacacttagctaggagtaggaatgtgtcttaccacttgaaccacttgttctagatgtgtcaatgcacacttaaaatacacgttctagatcatgcgggatacttaggctagagttga

SEQ ID NO: 16203 - DNA, 1501 bp, Oryza sativa
ctcccgccggtctgaccgtcgccttgtaaggtgtttagaacttttagtatgagtttggttcgtgactttaggctgcctacctcgggtataaatagagggggagcatgaggcttcccggtatcgctttggagagcaattgagttgagttttaagttagggtttcgagtttagtcgaaatttttgtaaggagtgttgttggtgcactttgtaaacacagagagaatcaataaagtcgtcatctactactctaagagttcttcgatttatgttttaccgggctttagcggtctaaccaacgactcaccgatggtaagaccggcggcaagctaggaaaccctctagtacaagaaacaaactttacataaccaatcatactaaatttggactccttccaaattcgacttcgcatcccatacgcacacaatacctccatcgtatgccatatggaatctccatcaaccacgtgcatcaactctagcctaagtatcccgcatgatctagaacgtgtattttaagtgtgcattgacacatctagaacaagtggttcaagtggtaagacacattcctactcctagctaagtgtgggttcaaatcccatatgctgcagataaaaacccatgctcaccgtatttttttagtttgccatattctgcatcatatacatgtaacatattaacaaaattattttattcaaattgaacaaatcgtcttttgggtttgattcttcttgcaatcacattttttatttttctttgcactaaatatgtttattttttattgtttttaacatattaacaaaattattttgttcaaatttaacaaattgtcttatgggtttgattcttgttgcaatcacatttttcatttttctttgcactaaatatgttttatttttttattgttttgggcaaactagcgtatgatgaatttaaaatcatacattgtgacagtcgtgataaaaatgtcacgagttagcgggctgtgaatatccactgggctcatctgtgacgaaaaacaaaatatcgtcacggtgtatgtttgtcagtgatgatatgtaaatccgtcaccgagaatccgtcacggattaacaagtttcttgtagttaggaaaccctctagtacaagaaacaaattttacataaccaatcatactaaatttggactccttcaaaattcgactccgcatcccatacgcacacaatacctccatcgtatgccatatggaatctccatcaaccacgtgcatcaactctagcctaagtatcccgcatgatctctgaccaccacggacgtcgtcttatccccgagccgactcccggtccatcaccgcaaatactctcccgaggcatcgagtcacctacacatgaaataaacaaagaaaccatattccgagaccaagctatctccaacttgactcattagtagcaaacaacagtattacatacgtatagtatccatctaaaagccataatcatgaaataatcacggatatccaaacaaac

SEQ ID NO: 16204 - DNA, 520 bp, Oryza sativa
aatgtaagtgtttaactcttttagcctaaattcattcgtgatatgttgtgatccaactatgtatgtgtgtaccaactactgatccagggattggtacggataaacacagaagatttccgattttcaaaatcgggggtctacacctatcccacacacgtggcgccaaaaccacagggggtcggggcgtcccagccctcggggccgaaacgggagcggcccgacccctcggggagacagagggaggggtggccacgtcaccctcgggcccgacccccccgagggagtcgggccacgtgggtgatcgcggctacccaagcctctagtcacgatacccccggccccatgtcaccgacagtagcccccggcgttacgccagggcgaccgcccccctcgagggaggcactggggcgtgacgccactccttaggcccggtgacaagtggggccggtccctacaggcgggcgggaacccagcggtcgcaaatcgcgcgcatcggcaaggggaaaccgaccgacaataa

SEQ ID NO: 16205 - DNA, 1501 bp, Oryza sativa
aaagctttgatagatggaagccaagtacatcagtccaaccacacttagaaagtgtccaaggtgcatagcttcgaagtagtcaattatagataaaattgggaggaattcccaaatagaagtgtgtgatagtagcactcaaatacttggataattgcattaaactgaactaaccatcgttgaactatgaagagcctcgacatggctgtgagagatggttacactgccccagcaatcatgttttgaaaattatcttatcacccatcattttagaataatgcagcatatgacgcacaatgcaaatgagtcacatgaacaaactcactaaagaatatgcatctccatgttcttctatggacatgaatttcgtacaagcaacaaaatattgaatgctaagttatgtgaaattcttgcagatttgaccactagatcattgtacatcttctcttgaatagatgtgtccgaggaatcggaacaatgagacatatagaaatgcaaaattcagggggagaatttcactgactcattccaaaatcttgatatagaaaatcattgccatcaagatgaggcataggcatatttgtggagtttttcccattgggtttttgtggagttttgatgaggcataggcatcatgcaatgaaagctcaagagggattgttaggaaaccgacaggcccatgaaggcatggcctaggttatctactaatgggccatcactaaatatggaaagttcatgaggctatgcctatcaatagatgggaggaggtgatgtattgtacactagtgatatgcaatggaaaagtctcacccctacatcttgtgtcaacactttttctagaattatgcaatccctcttagactactatgtagcaggaggggttgcataataatgacgaatagtgattgacgctcatgtatatacacacactcacactttgtctccaggaaggatcacatcaacaccctaccctacctgtcagataaatgggaaccagggttctcattacaggctgctacagacgtccatggacatgtcatcaagatcatatgacacatgttgtcgtcaaccagattcaagcgacaattgagatacatcctgtcggtgacatggggccgggggtatcgtgactagaggcttgggtagccgtgatcacccacgtggcccgaccccctcgggggggtcgggcccgagggtgacgtggccacccctccctctgtctccccgaggggtcgggccgctcccgtttcggccccgagggctgggacgccccgaccccctgtggttttggcgccacgtgtgtgggataggtgagcccagcggggctcacctaaccgcatttatagcgggttggacgagcgcgccacgccgcatttaatgcggcgcagcgcacgcttatccggtccgtgaccagtcgcggtatgtgaccggtcacagaccggtcagatcgcgggttaggtggcaacaggcgtcctgtcgcacgcctcgcctcgtcccgtcggaa

SEQ ID NO: 16206 - DNA, 1501 bp, Oryza sativa
tcgacgctcgcggctgaccccgaccccgactacgcctcctgcagatgccgactccgacttcgacgcggccaccaccgccgacgacgtaacgtccatgcggccgccacggcgacgtcgccgacgcccccgcctcgagctcgccacgctgccgcgacacgacgccgccgccgcgcccacacgccgccgggccgccccacgccgccggaccacgccacgccgccgagacgccccgacgccgccacgaaacgccgccgccgcgccgccacgccagcgctccgctgccgccactgctgcgcgccccgacattgccgaacgtgaacgaacgtgattgaaacatgaacgtaacgtgaacgaacgtgaacgaacgtgaacgaaacgtgaacgaacgtgaatgaacgcttaacgaacgtgaacgaaacgttaacgaacgcgaatgaacgtgaacgaaacacgaacgaacgtgaatgcacttgtactaaaaatgtgagaacgaacgggagcgaaacgtgtacgaacgagataattaaacgattattaaacctagcatatatatatatatatatacgattatatatatagttgaaaacgtgaaatacgatatatgttcctttgcgtttagactaatacattttcctagtaatgttatagaaaagacgtcgtcgtcgtccctcaagccgaagtggtagctagccatcgaaggaattcgcgcaggcaagtgatgtaaataagtgattgttagagatttaatataagattattagagttttaatataagattattagattattagcatatgtgagtgttagattattagacttagcatatgtgaatgttagagattcgtgatagacttagcatattgtattagacttagcaaatgtgagtgtcagagattattagattattagacttagcaaatgtgagtattagagattattagattattagacttatcatattgtattagagatttaatataagattgttagacttagcatatatgattattacaattttaatataagattagtagagatttaatataagattgttagacttagcatatatgattattacaattttaatataagattagtagagatttaatataagattgttagacttagcacatatgattattacaattttaatataagattaatagagatttaatataagattgttagacttagcatatatgattattacaattttaatataagattagtaaagatttagtataagattgttagacttagcatatagattattacaattttaatataagattagtagagatttaatataagattgttagacttagcatatatgattattacaattttaatataagtttagtagagatttaatataagattgttagacttagcatatatgattattacaattttaatataagattattagagatttaatataagattagtagagttttaatattacgcttagcaaatatgacctatagacttagcaaatatt

SEQ ID NO: 16207 - DNA, 1501 bp, Oryza sativa
ggagtcttttggtcatgaacgtcgagtctccataatagacttatcaatatctataggaagatgaggaccctagttccttatcgtcatgtatgtctttatatcttatacccactcatgagttaacactccaagattgttcacacactcactatatatctcgaacccatggtcttccctttgccctattgaagtctagttccaatgaataacgccaaacgatatttgtaagacagctacaagaatttaatcaagtaagagatttattgtcattttttatgttaaatcgatcatagtgttctataggagttggaggccatgggaaactactaggttatccatctgtgctaaatatcaactagcaataacttgatggggttgtccagagctttgtaagcgccagtagaggaaggttctcatggtagaagctagttaagtggtgcaccaaagttagggtgtggtttgatgtataactcgtgtaagtttttcttttctgtttattccctctgtgagaatagatttgcatcttttttgatgtttccatccatgtatgatggtacatggtatgcacttgtggaaacatgcacatatctaaattagttccgttttgtttgctcattcttaatttgattgggtcattgttgtttccttcggtgcgaataaggggaaggattgtggttgtactcttatccattcgatgctgagagcaaatcttctcggtgtccatgacctagcagagctctacataagaagctatatgtacctttgttgaacaaggcaagtgtatatttacgtctgaccatactagctcaattgaaaaagagcatgtgtcgacagttgtgagaaatttgtttacaaaattacaacttctatagatcttccaatactaaaaccatattatagatgacattactttcatactagatgagacatgacagattaattatccaaatgctaaaaataataagatggtgttatagaaaaaggtagaataattgagatgatgtgcatatggcttaatggggtgtagaaaaacaatttacaaaaaaaaaaaaaagaaatcatctatagaatataaacggttgacttcattagcgaagagtgaattaccattaattatagttattggcgaataatttgaaaagaatataagatttccttttgcccgcgtttgtctggatcaaatatgactacctttgcatgcatttaaagagagagagtatagctatttgtgaccaagttgatctctctagcttcactaggtcactggtatagatggccatatggcccgagggtcgtggcccgttccaagcacggcacgatccgactgatgcttgggccgctccctcggcatgatgggccagcccggcacagcacgatcgtaaaaaaatagtagaaggacgtaaaataggcttacttaaccataaaaggcaaggcccaaagacaagaagaatacaaagtagacttattttcagccatatagacacaacccatagagtttagg

SEQ ID NO: 16208 - DNA, 1501 bp, Oryza sativa
cggttcaaaaaatgttatatagaaaaataaccaaaataaaactttattgttgatgactttttcaattgaagtcgttcactgatctaaaattctatttgaacttttcaaacactgaatttcaaatttcaaattgtttaaatagtcatatggagaaatgaccaaaataaaaattttgtacctcaatgagttctgcaactttgattttggtgacttttccatttgaaatcatttaataaccccattttgacatcctggcctagggcttaataagattaatagaatactcatatcaacaagttacaactacttttccagaagccaatctccaaagaactttgatgttaagcgtgtttggcatggaacaatttcgggatgggtgaccgaccgggaagtttgaatttcccgggggtgggtgcacacgagtgaggacaaaaaaagactggcctagtaggtgacggagtaggtgacgggctatagtttgattggtcgtctgggtcaaagctatcggtgacgggctttaattagggcccgattgagatagattcaactgtgacgggctatagtttgattggtcatctgggtcaaagctatcggtgacgggctttaattagggcccgattgagatagattcatctgtgatgggctatagtttgattggtcgtctgggtcaaagctatcggtgacgggctttaattagggcccgattgagatagattcatctgtgatggccgtttgcccgattgagataactcttcacatctgtgacttctagcctgtgacggacgccatgcccgattgagatggggtttaccgcccgattgagatgatggtatcccttctagtgcgtgtttggattcaaattaatgacatcatttttaaaaacttcgtgtattcttcatttatttcttcgggtaccttttatagatacatttgctcccataactgttatatgtattgcctttcatttctcagagacagggatatattgatttttgtttatctggacattcagatatcaagaagatgggtcatgtttggttgaggggtaactggtgatggaacatccaaagatgattggttgttaccacttaccaccacatcttgatctttgggattctcatcaggttacttatcaacatgttgacctatgacaatattcttaccctgtcctggctggtttcaatgcctccgacctcattcttagaccttgttccaaaaagaccttgaagggcagagggctcatgagatctatcctgatatatgaatctaggtggtctgacacggattggacatgtatggatggagtcctttaatattatattgggactatgatatctccaatttggagggatacgatctttggtctgtttgtttctcctgattcaatgttgtcaatagaaaacctcatcagagaagttgcatctggatatcatgtctttaagaaccctttgaatactccgtgagcccctacctgacacaccaattgttgactacgataaac

SEQ ID NO: 16209 - DNA, 1501 bp, Oryza sativa
tatttgaaaatattgtttgaagttatcgtattttcaaattcaaattcaaattcaaactattcaaaaaaatttatataagaaatgaccaaaataaaagttatatatcttgatgagttatataactttgtcgttgatgacttttttagttgaaattatttagtatttgaaaatgttgttttgaagttgtcatattttcaaattcaaattcaaactgttcaaaaaaagttgtatagaaaaatgaccaaaataaaagttgtaaatcttgataagttatacaactttgttgttgataattttttcattttaaataatttattacacgaaaaattattttgactaataaaacgaattattatactgcagttaattattttgctacaggtcaactcacaaatataaacatttcatatgaaaaatggaaaaaatgtcatcaataacggccattagttaaagtccgacagaggttaagtcatctcaatcgggcattaatatagagcccgtcacggatgagtcatatgcgacgggcctagttgttatatcacacggatgtgtcatatgcgacgggcctagttgttattttaatcgggccccaagttggtgcccgtcacagatgatggtcatctgtgacggacgccaacttgaagcccgattgtgatatggaatgttatctcaatcgagcctaaattatggcccgtcacggatatgtgtcatccgtgacgggtctgagttttatatccatctaatatgtctgttcgaccatatctcaatagggctttttttggcccgattgagatgactttcttgtgacgacccgttaattataggcatattagaggccgtcacatatggaagattctgtactcatggtggtttttctttttttttccactcaccctcaaataaataatctttactgcgtgaaacactacgcacgatatgtaatatttatatgcaaattgaacgttgaaaagtggtcaattcataacccttcgtcacgccgcagaaggaaaattaatagcatacaggcatgcatttacgtacttgaaataattttatgtcgattgggtggtgagtggcaatgcctgtctacccctaccgttacgcacatacctcatgttcattaatttatgccgtttccatttaacatatctctacttcctaaggaaactgactgactgacaaataggacatgcgatttttttttaatcttcagcatatgactttgacaataaatcaataaaatttaataagttctttctatggaaaatctcgacataacagttttatgattttatattaagcgttttatttttttttacgatcaataatttaaagttttgactaaaaaaagttcaaagttgatcacaagagaatcttattaccagtcgtactcgtgttctctctctctctatatatatatggccaaacaacgaaaacacagacagagacacgagcaagctaacgagtgagtgcaaattaagctagtgatcgatagtggtca

SEQ ID NO: 16210 - DNA, 696 bp, Oryza sativa
attttttttctatgtgactgacatgtgtatctcactgacacgtaagcgtcaccgtggcatgctacatcatcccacgaaacaggttagagctcgtttggacctatatgacacccgagacaagttgagggacccaaaaatacattttgagaatttagggacctaagtgacacacctgcacaagtttagggaccgccggtgcagttcactcaatatttaattcttatttcctgacacgttccttacataggatgctccagaaatcctatttttgttgttcaattctcttaaatgctacagatcatattatatatagtacaaagataatttagttaaccaatcaaaatttactgtaaacaaatttacactagaaaaaacagcgaatggcatatatgatatctaatttggtgtgcgattgaattttttcaggcctgtctggtgttggtgaagacatttctatgaaccatgtgatagttctgtcaagacaatcagctagtattgtacatctgttcacttgccaagttgccagctctcaggctggcaactaatgttttctgctaggttagcaccttgttctctagctagaataccccaacacgaaataagaatgcttgagtggttactgtgttgcctgaaaccctttaagatactaattggagttactggcataatgctgttactatatattttggtgctcac

SEQ ID NO: 16211 - DNA, 989 bp, Oryza sativa
agcgaaacgtgaacgaacgcgaacgaacatgaacaaaacgtgaacgaacgggaacgaacgcgaacgaacgtgattgaaacgtgaacgaacgtgaacgaatgcgaacgaacgcgaacgaacgtgaacgaacgtgaacgaacgcgaacgaacgagaacgaacgcgaacgaacgtgattgaaacgtgaacgaacgcgaacgaacgtaaatgaaacgcgaacgaacgtgaacgaaacgccgacgaccgtgaatgcacttgaattaaaagtgtgagaacgaacacgagcgaaacgtgtatgaacgagataattaaaagattcttgaacttagaatatatatatatatatatgattatatatacttgaaaacgtgaaatacaatatatgttcctttgcgtttagactaatacatttttttgcatgttgtagagaagacgtcgtcgtcgtcgtccctcaagccgaagtggtagctagccctcgaaagaattcgcgcaggcaagtgatgtaaagatgtgattgttagagatttaatataagattattagatttctaatataagattattagagttagcatatgtgagtgttagagattattagattattagacttagcatatttgagtgttagagattgttagagatatagtataagattattagaggtttaatatggtttaatatatgaaacttaattaattagacttagcatatgtgagtgttagagattgttagagatttaatataagattattagaggtttaatatacgaaatttaattagacttagcatatgtgagtgttagagattgttagagatttaatataagattattagaggtttaatatacgaaacttaattagacttagcatatatgattatctagggttctaatatacgacacttagacttagcatatatgattatttgagttttaatattacggttagcaaatatgacctatgaacttagcaaatatttcttctatgaacaga

SEQ ID NO: 16212 - DNA, 1501 bp, Oryza sativa
ccgaaaattcaagaactccaaccagatgacataccttcaataaattccaaattgatgacatggttccaggaaaagctttttcaatgactttccacttcttcaccttaagggggacctcttgtcgcacacagacagtgacctcacttttaaagacacttgcgtgcctaccatagacttttccaaactgtgcagcaaattgaatgtctagtggcacaccccttgctctcagttttgcaagtgttccattaatggtgagacccctacctttcctacgtttgagacctaattgaaggaagaagtattttaatttatttgcttgtgaaggaatagattaatgaagtgaaggtaaatatgttaaatacctgtgtttccggttggtcccatccgtccctcattcctagtattggttatgacttgtcgagcagcatcatccgaagtctccatctggttcacggatggacgaacttgggaaaccattttgacctacaaaataagaaatgagtacaaacagatctactacaggattacaaaccaaattgactaagatagaaatccccacaaaacaccgatatactataagattgagaaccaaattaactaagaaagagaatcccaattaaaaatggatattaagttgcatctaattaggaaattaacacaaatcataaatgcagaaaaacaagacggagagagtggacgccagaaggggcaggtcatatccctgcgacaccacgctatcatcaatatgtagatgttgcggcaccagcgccgccagaagatccataggactgcagtgatttggagatggtggttgtgtgattgtgtcccggcagtggtgggtgtaatctctcaaagatggatgtactctagggctatgcagtgaataaaaaatggggaatgccgaatggatcctataggattgcgagaatagcaaagagccatagtagatttgtttctttacctttgactgcaagtgtgcgcagggatcgagaactctagatgcgaatggattgtactagatgggcagccttatatagtgaggtaactctgtcaatttggcgggagtaaaattttgctggcaattacttttggagggaaagtatgttttgctggccgatttatgcgtgcgtgcataacaaattagtttgtttgtgctgatccaaaatatttgttcaccagcatttgttaacaagctctcgtaaacaaatatggcaattgtttaatgaatcaataacctgtggagtgaaaaaaaatgatacacacatgcacattaattgttgatgtgggttggcacctccctgcatggaaaactaataagccagctcattaacattaacaaagctaatactaaaagcttagcttggctcagctcgtgagctggttcattaataagcatatgctcattatctaaaaaaaattaataagcatatgctatattagatgctagacatctagcaaaatcatgtctctgccatagggtatcgtggtcttgtgataataa

SEQ ID NO: 16213 - DNA, 1501 bp, Oryza sativa
taatttaatgtgcttgaaatattactctacacatatgaatataatgtttgtatatgcgtgattgttcctgattctattggcaacctgtttttttgtcaatattttgtttgtgaatattttgaatgctaattatccttgcaacacaatctttaattataggaaagtattatgtcgcaaaaatgaagttggttcctatgaattgtcatctaaactatatgttatttttaatacatatcaaatcttcgttttggagttctaaactttaagaaatttgtgttcttaagaatagttatagaactttaagcaaaaaaaattcaaatgatttcttcaatttatattgggctttggattcaacaaaatttgtttaaatttagcccaaattttgtctgaattccagttatcctttctgtttctttgggaatattggaggtctatgttctatcaattgttcttgaaatgtttttgatctcttaaaatttggatgtaaacataactatgttgagtgtacaacttggtatgggataaatgtgtcctttctaatgcaacgagaatatatatatatacaccctaatctccagttgaatcaagagcagcatcaatattaagatagagatctcgtccagcaaagtatatagggtcgcacataagatcatttactccagataaactgaactgaatagctccagtagcatcaaatataaacagatagatgattcagtttataatgaataaactaacgaaacctgtacataaactccacccatgcagcaagaatgatagccgatcagagcaagaagacttcgtcagaaatcagaacatgcctaggaccaaattaaccaacgcagcaacgatggtggcaaaacgtatggaatcgccatctccttcctgacctaggcggtggcggcggcacaacacagaggaaaactaaaaaccaatctcctaatacaaggaacatggcatatataggtggcacaaaggcctagccagctgaacggactaaagcccaacttggactcctacataccgatccaaataacagaaaaaaaaaccttattaatgtaaaaccctgaatacttggtaatcctgccgctaagcatggaagaaaagcatccacatgcatgcgtacatgcagacgttgtgggagaggatttcgtttttttgtgggtcctcatctcctctcctcgcaccacgtggcagcttgagagcgcttttaggatgttacatgtcagcttgagagcgattttagaaaagttaatggacttttagtatataatagatagatagatagatagatagatagatagatagatagatagataatagatagattccagttgtgaagacaagaaattttgatcttgcacaagttgtcattacattccagttctgttttgtactatccgaattcagaaacagagcaccatccataataccatactgcttatttaaaacctgctagctgcatgccattcactcgttcagatttcagagtgatggttgt

SEQ ID NO: 16214 - DNA, 1501 bp, Oryza sativa
catggagggagccgtgaagctggccacggggaagctggtgtcgctgtcggagcagcagctggtgtcgtgcgacgtcaagggcgaggaccagggctgcgagggcgggctcatggacgacgcgttcgacttcatcatcaagaacggcggcctcgccgcggagtccgactacccgtacacggcgagcgacgacaagtgcgccaccgccggcgccggcgccgccgccgcgaccatcaaggggtacgaggacgtgccggcgaacgacgaggcggcgctgctcaaggccgtggcgaaccagccggtgtcggtggccatcgacggcggcgaccggcacttccagttctacaagggcggcgtcctctccggcgccgccggctgcgccaccgagctggaccacgcgatcacggcggtcgggtacggcgtggcgagcgacgggaccaagtactggctgatgaagaactcgtggggcacgtcgtggggggaggacggctacgtcaggatggagaggggcgtcgccgacaaggagggcgtctgtggcctcgccatgatggcctcctacccgacggcgtgacaaccatcactctgaaatctgaacgagtgaatggcatgcagctagcaggttttaaataagcagtatggtattatggatggtgctctgtttctgaattcggatagtacaaaacagaactggaatgtaatgacaacttgtgcaagatcaaaatttcttgtcttcacaactggaatctatctattatctatctatctatctatctatctatctatctatctatctatctattatatactaaaagtccattaacttttctaaaatcgctctcaagctgacatgtaacatcctaaaagcgctctcaagctgccacgtggtgcgaggagaggagatgaggacccacaaaaaaacgaaatcctctcccacaacgtctgcatgtacgcatgcatgtggatgcttttcttccatgcttagcggcaggattaccaagtattcagggttttacattaataaggtttttttttctgttatttggatcggtatgtaggagtccaagttgggctttagtccgttcagctggctaggcctttgtgccacctatatatgccatgttccttgtattaggagattggtttttagttttcctctgtgttgtgccgccgccaccgcctaggtcaggaaggagatggcgattccatacgttttgccaccatcgttgctgcgttggttaatttggtcctaggcatgttctgatttctgacgaagtcttcttgctctgatcggctatcattcttgctgcatgggtggagtttatgtacaggtttcgttagtttattcattataaactgaatcatctatctgtttatatttgatgctactggagctattcagttcagtttatctggagtaaatgatcttatgtgcgaccctatatactttgctggacgagatctctatcttaatattgatgctgctcttgattcaactggagattag

SEQ ID NO: 16215 - DNA, 1501 bp, Oryza sativa
agatggtccccacttcggccactcctttgactgctagtgctaacaccacaaaagattgtatatcaatctaaaatacagaaataccgtagaatgttatactgtttcaaccgaatagcacgaggtatcatggtaacatgatgacgtgaacatggtatttagatgccagatctaattcttatggggttcatatctagcattgtaggtaccagatctgatacgtatagtatcatattgacgtcagtatgatacctaaatatcagatatgatacgtacggggtatcatgtttggtatcgaatgtattagatctaatacctataggattcatgccgatgtgagttattccgtcgaaacgataataccgttacgtagtctccctttatgaaataagatcttctctttttctctacaatatcggtagttgttaaaatttaaattctaaaattttgattttcaagttttttttatcaaaatttatttttcaacattggtatttaaatcgctaagaatacacacataaatgtgttatccatatttggttaaacgatggggcctaaaacacacgacaaatatatgttgaaacaatttgctatatagctcttataataaagagagaaagaataaatgaagaggagaacttttatattgtgttgttagtgatttaaatgttaatgccaaaaaaactatgataaaaaaccttaaaattaaatttagtagtaagatttaaattttgactacggctggtaaaagcaacgatcaaatgacgggtggttttaaaaacaagtacaccttgaaccaggtaatcttatttttattatatcttgaatcacgctactcttatttttattatatcgaatcacgctgactcttttttttaaggcaaattttgctacaaggcacacaaaatttgtacaatttgctgatatacatcgcaaaaacatctcacggctaaaagacatctctaaaactgataatttgctggaggacaatttcgactcaattggaacaataaattcttcaaaagaatgagaatgactctagggtgaaaagcttttgagctaaggcttgagtgaagatggaatacgatgtatactagtgatctatttggggtgatggctaatttagaattgcataatttctaagtcttcactctatcactatgtttgaagcatgtgttcctaggggcattatcttttttcctaagaatttatctttacaattgagtcgcaagtgtcctctagcaaattattagtcttttaggatggctttcaatcgtgacatgcttttacaatttctataagcaaattacacaaattttaggtgtcctatagcaaaatttgccattttcttaagtatatgaatgatcttaagtatttcggtttttacttggcaatgaactcacatggttgtgtgtacaataaattgaatgtagatagataaaagagcatatagctgtccaaaagagctagaaaagtaaaattatctagtttttttaaaactagt

SEQ ID NO: 16216 - DNA, 1501 bp, Oryza sativa
tgaagtacttgcacgccgaaatcgcatgaaattgtgaagaccgtccgatgttggtgctgtcctgtaatctgaatccaaccggcggaaatcctctcccctttggatcctctccatcgttcctgagtaaaacaagagtgcacgcgtctccggggtataaagaagaggaaaatgaactcaagaaagaactcacctaattgttcagttgacgtgcacgagcgcgggtaataggaccatgaagttgtacttgtggggacgtggatgtatcgatggtgttgatatcctcatcacatgttagcgaaaccgggcatccatactacctcgggaccttttttggatggttttatatagttgaggggtacacatttctggtattgcggttaggggaccttagacagactcggcgtacaattgagggatgtcacgtgaacttattccttttaagaatatcttttaatggaagtgtagcgtctcatgtattatcgtagattatagggttaatttgattcatgccattatatttgcttgttttgaaatataccattataattcatgaaattggaaccataccattacaatttaccataaagatgtgccattgcttaccatttcaatacaatttttacttcttcctgaccaaattacccttgtcttcttgttcatcctcttcattccctttctctcttctctcagctccaagctcgatagaacaagatccgttggttgccctcgttttgaggctgtcctacaacgtcgccaccgccggaccttgccaccacaaggcaagactgagtagaggtcagcaacttcgcaggatggctaggtgatgacctatgtctcagagactccgccaccgtaatgtgcagcaacgacctagatgatgctgctcccggagacgatgatgtcggcgacgcctacaagatcgtcttcctgttgttgttctggcggaattctccaaaagtgagttgctggggcccggccccatcctcacatagttctcttcttcccccaattagactgctttagttatgtcagtatgtgtatatctgtgttttgtagtttgtacagctcccaggaaggacacctatggagttttctagagcccattgacctggaggagatggttgttgggatatgcgtaggctacgataacataaatcaaaacttttctaccgcgtaaactaggaaccatgcaagtattagatcatagatcgttatcactcgacgcgctgcgcagcggaagaaggcgctaagaagtcgaaggaattctcgcgaagtagtgcgcgtcgatgtagaggaagtagtcgatggcaccggctcgaccttctcctcctcgtgtactcttctcgcggtactcccatccgatcagcaccgcaaatcagcggcacctctactggtatccacacgtacaaggacggaacgccacgcgcagatgtgctagcacccgcgtgcggctagggttttgctccggaagggaagtgacggctagggtttctcacgtgat

SEQ ID NO: 16217 - DNA, 1501 bp, Oryza sativa
  unsure (1)..(1501): unsure at all n locations
tcattaacaggatttttagtggaattttcagagctctagaaataattttaaccatttaaaattgagcaagcaatattttaattccagggaaaatcctttttccttttttctttttctttttcctccctttttcctccttttttcgaatgggccgccggcccattctctccttcctccccctcctccctgctgggccggccgcaggccgaggcccagccaggccggccgcctccctcctctccccagggtcgccgacaggtggggcccacctgtcgggcccttccccaacctccggccgcacgcccacgttgtcaccgccggcgaaaccgccgcaccccgccttctccggtccacgtcggccacgcccgtgcatgcgccgcgcctcccgcacccactccccctctttctctcgccgcgccctcaaccgagatggccgggattcaaattttgaatcccgccgctctctctctctctcccccgcctccaacctcccacgtcgccggcgaaatcgggctcgcctcggccacgtccgtctctcccgagcccctataaagcatgcccgcactcccctccaccttttttttctttttccaccgctctctcccgtgccctccattggtcccgcgccgtgcgcccatccgccgacgcctctcccgctactccggccgactctagccggcggtacactcgccgccgcaccgggccgtcgccggcgttgggttcacgcggccgaggtccacctcgtccacccctcctgcgtcgaggttcgccaccggagccccatccccgtcgtgcgccggtgagtgacgccatggccggcgccttttgccggggccctcgccctttcgcactctcctttgtccctataacccctctncttttgttcgttaggaggttccagagctcgtcccgccgtcgccatcgtcctccgtcgctcggcgtcgtcgatcgttgtcggtgaggactctcctactgtttctgtctctcttccgcaccgtttagccgtcgcgccgccgcttagccgcgtagctgtcgattngccgagacgccgacgatctccgatcgcggtcggtcggcggcggccggacgtttgcgccgctgccgcatacgcgccgcgccgtcgcgcgccatggccgccgggccggtttgcgccgtgcccgcgcgcaccggccgcgagctcccgccgccgtccgatctacccttgggtagatcggggccatcggttcgaccgtcgcgtggccgccgcgtggtgcgccgctcctccccggtccgtggacccgatccgccatggaccgccctccccgagtcactgccatgcgggtcccgcttgccggcgccccttcctccctctcccgagccgctaaccggtggggcccgcttgccggcgccgcgccccgccttgatgacgtcagccctggaatatattgcgcaataaatgatttaaggtttttcttgtatagtaataaacacagtgaatcttctaaaattcataactaattca

SEQ ID NO: 16218 - DNA, 1501 bp, Oryza sativa
  unsure (1)..(1501): unsure at all n locations
gcccccctttcgtgccgcggtgaatccggaagccgatcaacaggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaatcgccatgggcacgtctagcaaaaccatgcacccacagcccaccatgtagtgtattttaattaaccaacaccattgcggtggcactaatccaaagctattgccaataatcagtctatgccttaatgtgatccccttttgtgcactagttaaactaagcaaggctaagcatctcccaaaccaacatctagtcattttaatacccaagttatcaatggcgtaagggaaacaacatatagctgagtaataggacccatcccacataatattgtaaaacaatgcaatatttaatagaaatgcgggacatttgtaaattgggtacaatatgatcaattgcaatgtatgacttgccttgctctcgcactgatggaaccacagcaacgtcttcaagaaaccacgaatcgacgaaacgggcgaaatctacgcgacaaacaaagcacacaagcaaaacatgctataagactactgaaacaggaaacaaaaccatttttaatggattctatacatttttatgaatttactgagacttgaatgggcttaaacggagctcggatgaattagttatgaattttagaagattcactgtgtttattactatacaagaaaaaccttaaatcatttattgcgcaatatattccagggctgacgtcatcaaggcggggcgcggcgccggcaagcgggccccaccggttagcggctcgggagagggaggaaggggcgccggcaagcgggacccgcatggcagtgactcggggagggcggtccatggcggatcgggtccacggaccggggaggagcggcgcaccacgcggcggccacgcgacggtcgaaccgatggccccgatctacccaagggtagatcggacggcggcgggagctcgcggccggtgcgcgcgggcacggcgcaaaccggcccggcggccatggcgcgcgacggcgcggcgcgtatgcggcagcggcgcaaacgtccggccgccgccgaccgaccgcgatcggagatcgtcggcgtctcggcnaatcgacagctacgcggctaagcggcggcgcgacggctaaacggtgcggaagagagacagaaacagtaggagagtcctcaccgacaacgatcgacgacgccgagcgacggaggacgatggcgacggcgggacgagctctggaacctcctaacgaacaaaagnagaggggttatagggacaaaggagagtgcgaaagggcgagggccccggcaaaaggcgccggccatggcgtcactcaccggcgcacgacggggatggggctccggtggcgaacctcgacgcaggaggggtgga

SEQ ID NO: 16219 - DNA, 1501 bp, Oryza sativa
agatgtaaaatggtcctaatcgagcaagaccagcaccagcagcagcatgtgcaagatcaagaatatatgtatatatattcgtgaagaatctttgttgatttgagtgagaagaagtgactgactgaccttgttgatcttcaggcattcaccggccacctgcgaagacaggatagcatctgcagaagccatggttttgtgactttgtctcgctgattgtctagctattgctgcaaaattgatgattgattcaatggtacaacaaagctagctgtgtctattatatatgcaatggagaaggtaagaagagtaaatatgttgggattgagctgctgttgtttcaatggcttaagatgcaagaggataggaggctttgttggatgtctttgaatccacgttgctcgacatagtgttcttttgtagttttgctgaagaagctcgattgctagatggatagcaccctagcttcagaatctcttatccacaagatcgatggctcagcaatatccaatgctccaagccttcaagggttgtgcactttttccttctctcatggataatgatatgtagatggtgactacaagattcttttcttctttttggttgagcaaatgagaattatcattacataattcaaggtgtaagaaaggcgccattagacaaccataatgtttgtgacacattaagggcctgttcactttgatgccattttcaaccataccattttttggtaaagttgacaaaaaaatgtctacgtttagtttgttgccaaatttagtaaatacataagaaatcctgctaaaattttagcaatattgccatcttaccaaaattttggaattgccaaaatttcgtaaggtttattttggctacaatctgaacaggccctaaaataacaaacaccaagaaaaaaaagatattattctcctacttatttccatctttttcaagccatggtttgtcttggagctttatatattactgtttaatatcacttgtggattttataatttgtaaggagactgtggtttctagtgggttttattattttataatttgtaaggagactgtctaacatcttctcataatcttaacaaaaagaagctagactgtgtcgggaaggttgggactccccaaacagtccatgattgcatgggcctaccagcccatgtcgagtatggcccagcccaacgaacccaaacagaaaccaaccaacacaagacaccgaccgacgccgaccaagaagccctcctcctccaaaagccccaaaagccctagccgcctcccccttcgtcctccgctccacgagaccacgacgcaggtgaccctcctcctcctcctcggtgctaggctctaggcgctagggtttctcgagctagaacccctcgacctggagagagtcctcgggctgatccggttgcgctgtctgctgctttccttgctagggttttctggttcttgctgtcttgggatctttgatttgctgcgaaggcgaaggcgaaga

SEQ ID NO: 16220 - DNA, 1501 bp, Oryza sativa
tcaaagttggaaaagaacctcttgttttctctagggtgaaaagaaaagaaaatttattagacaccatggactcgcaatctcgcaggagattaacaaatcggtgccgtatatgagcaccaaaccggatctaataattcacgggggaaaaaaaaagaagacaggtggagaggagggcaaaggcagacctgacttcatgtcgatgcggtcgatcctgccgtagcggtagaagaggcggtcgagctcggagtggcgggtgtcgtagtcgaggttccccacgaacacgggcctcatcttcgccttcgccttcgcagcaaatcaaagatcccaagacagcaagaaccagaaaaccctagcaaggaaagcagcagacagcgcaaccggatcagcccgaggactctctccaggtcgaggggttctagctcgagaaaccctagcgcctagagcctagcaccgaggaggaggaggagggtcacctgcgtcgtggtctcgtggagcggaggacgaagggggaggcggctagggcttttggggcttttggaggaggagggcttcttggtcggcgtcggtcggtgtcttgtgttggttggtttctgtttgggttcgttgggctgggccatactcgacatgggctggtaggcccatgcaatcatggactgtttggggagtcccaaccttcccgacacagtctagcttctttttgttaagattatgagaagatgttagacagtctccttacaaattataaaataataaaacccactagaaaccacagtctccttacaaattataaaatccacaagtgatattaaacagtaatatataaagctccaagacaaaccatggcttgaaaaagatggaaataagtaggagaataatatcttttttttcttggtgtttgttattttagggcctgttcagattgtagccaaaataaaccttacgaaattttggcaattccaaaattttggtaagatggcaatattgctaaaattttagcaggatttcttatgtatttactaaatttggcaacaaactaaacgtagacatttttttgtcaactttaccaaaaaatggtatggttgaaaatggcatcaaagtgaacaggcccttaatgtgtcacaaacattatggttgtctaatggcgcctttcttacaccttgaattatgtaatgataattctcatttgctcaaccaaaaagaagaaaagaatcttgtagtcaccatctacatatcattatccatgagagaaggaaaaagtgcacaacccttgaaggcttggagcattggatattgctgagccatcgatcttgtggataagagattctgaagctagggtgctatccatctagcaatcgagcttcttcagcaaaactacaaaagaacactatgtcgagcaacgtggattcaaagacatccaacaaagcctcctatcctcttgcatcttaagccattgaaacaacagcagctcaatcccaacatatttactcttcttaccttctcc

SEQ ID NO: 16221 - DNA, 1501 bp, Oryza sativa
ccgtcgccacgccgccgccgccttcgccgccgcgcgcgcaatgccgccgccgccacgccacgccgccgccgccacgccacgccacgccaccgtcgtcacgccacgccggcgccaccacggccccacaacgccacgccgccgccgccgtcggcacgccggcgggccaaccgccgccccgatgccgtcacaccgccgtttacgaacgagaacgagaacgatcgaacgaacgagagcgagaacgaacacgtcaacgtacgttgccgcgacaacgtgaacgagaacgagaacgatcgaacgaacgagagcgagaacgagaacgatcgaacgaagacaagcgagaacgagggaacgaacgtgaatgagaacaagcgaacgaacgtgaatgagaacgagcgaacgaacgtgaacgagctagggaacgtgaacgagcgaacgaacgaggacgaacgttaacgtgaaatgcaatatatatatatatatatatatatatatatatatatatatatatatatatatatatatatatatatatatatatgtatgtatatatatatatatgtatatatatgtatatatatgtatatatgtatatatatatatatatatgttacttcgcatttatcctaatacatttttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcatatacgcacgaaacacttagcatatacatgactattttagtcttagcatgtaatattatttgagttttaatataagattattttatttgtaattagatttagtatataattatttactagctagggttgtataatatacgtcacctagacttagtttatatcacgatttgtaattagacttagcacgtaaggttgtgtagggttctaatgtacgacatttacacttagcatacatgacttagattgttaaaacataaatgtctcgtgacttagcagatgtt

SEQ ID NO: 16222 - DNA, 1501 bp, Oryza sativa
tgactgtactcctactctataataaagagacctctgttgctgtgatattctgtcttcctgtgataccagcactgtttcctgggactggtatcgattaacaggttaatttggagcgtcacggtctagtcccgctcggggctagttcggggcgtgacacgccgcctccctcgatctctctctccgatcctcgcgccgcacaccgccggcgcgcaacgccgccggcgtgcaacgccgccaccgggcgtaccgccccgacggcaccgcgccgcgcgcagcacgccgccgtcgtaccacgccgatgctgcgcgcggcgccacgccgccgcgccatgcgtcggcccgatgccgcgcgcggcgccacgccgccgccgcgccgccgttccgttgccggcacaccgccgtcccactgccgccacaccgagaacgtgaacgagcgaacgaacatgaacgagaacaaggtgaatgaacgtgaacgagaacgagcgaactaacgtgaacgagccaacgaacgtgaatgagaacgagcgaacgaacgtgaacgataacgtgaacgagcgaacgaacgtgaacgtgaaatgcaattataggcagatgaatgaacgtgaacgaacaaacgtaggtgaatgaaacgtgaccttaacgagaacgcgaacgtgaacgatatcgtgaacgaaacgtgaacgtcaaatgcaatatatgttacttcgcgtttatcctaatacatctttttgtatcttgcagaaaagacgttgtcagagtcatctctcaagccggagtggtagagctagccctcgaaggaattcgcgcaggcaagtgacgtaattatatatatgattgttatatttgtaatgcaattaagattattagatttgtaattagacttagcatataagattgtgtagtgttctaatatacgacagttacacttagcatacatgactatttgagttttagtataagattatttaagttttaatacaagattattatatttgtaattagacttagtatataattattgactagctagggtcctataatatatgtcacctagacttagcatatatcactatttgagttttagtataagattattagatttgtaattagacttagcatgtaagattgtgtagggttctaatatacgacagttacacttagcatacatgactattttagtcttagcatataaaattatttgagttttgatataagattattatatttgtaattagacttagtatataattattgactagctagggtcctataatatacgtcatctagacttagcatatatcactatttgagttttagtataagattattagatttgtaattagacttagcatgtaagattgtgtagggttctaatatacgacagttacacttagcatacatgactattttagtcttagcatataagattatttgagttttaatataagattgttaaaacataaatgtctcatgacttagcagatgtttcctgtatgaacaga

SEQ ID NO: 16223 - DNA, 1202 bp, Oryza sativa
gcaaatatttactgtagcaccacattatcgaatcatagagtaattaggcttaaaagattcgtctcgcaaattagtcgcaatctatacaattagttgttttttagcctatatttaatacttcatacaggtgttcaaacgttcgatctgacagggaaaaaaaaatttgaggtgggatctagacatggcgtaagctaacttgcattcacaagaatagaattcctattctgatttcaatgcaaggcaataatatctctaacttcacaaggactgcatggaccattagtttttgggtgaacctgatgagattgttcacaagaactacgcagaagcatcacagatcagaaagagattcgagatccattggaaaattccagagatttttgcgcccctgtgaagatgattgtgatagagccatgcccaggaattacagccttggagtatcatgacatatgcttagaatacaaaccagcttatctttcatgcccaaaagacagacacattcacatttccagattttaacagcctatgggcatgtacgatggtctttattactggtctctctattatcgcgcaagtaaatttgatgatatgtaagaaagagaaaggaggaatgagaaatatggttattatgcataacaaagaaaggaaagatgagtaagaaaattgtttttgatacattaatagtagagaccatattgtcttcaactgttgtatgacattagactctaaatagcgtagagctcatacccgtctctacctttgtacatgccctaacagtttatctggatcatatataaatattctggataattttgttaacaacacgtttgcataccaatttttgttaactattaacttatcaaaacttgagccaacacatttgcataccctatcaaacagagaaggtttgatggcataaaccatcatgatgttttgtctaatagctagtttttcgtattacatatgcatttgctcaaggtgcatattgaaatgcagaagaggaactcgtagtgatcaactgaaaatcactgcataggcttgcgtaactgcaggaaaacagaatactacagaaaataacaaagaacaatgctaattattagtctccagatcaaagttcaattatatccatttaagtttaaagtctgtaagattcaggtaccaacatctagtttagatttagtaaaatgcaaacggacacaaca

SEQ ID NO: 16224 - DNA, 1501 bp, Oryza sativa
ccggttggtatgatcaaaatttttataactggaactaaaaacaatctttactcccagttctttttggatccgagactattatggattttgccggaccgaccaaagatggtttctccaccagtgtagcttaaaaagtatgatttttttgaaaaacaactttcctatagaaataccgtttagcagtttgaaaagtgtgcaggcgaaaaactagaaaggagatgggaacacaaccaaacaaacaaacgtactaaaaatatatataatccatccttgacatgaacatgcctttttggtagctactactacttgcctagtagcttcgtcctcctttttagattaaaaaaaagtactcccaccgtcccaaaatatcagtacttttggactctgatacggttttcgagatgctattttgatcaatgatatctaaaagtaaaatgttttaaataaaagagttacatattgtaatagtttatttaatgataatcaaatctagtaacatcaattttacctagttgatccttttttattttttttgttatctatctatctatctatctatctatcaatctatcaatctatctatcatatactataagtccattaaacttcctacaaacgctctcaagcagccatatggtactcatataaacactcctaagttaccatgtggctctctaataaatcggtagacccgctattttcatctattagatttaattttagaaaaaaaaatcccacaatccatctccctcccctctccccactagcccaccctcctcccctatggtacgtactcacctatccctcctcccctatggtacgtacgtacgtatcctccccccacctatccgatcttctcatctctttctttcttttcaagtttattacaattaaaaatatattttttaaaataatttccgtatagagaaataatcataatctttaaattgcacataaatctttttatcgttattcattatcgtattcatagtgcttaactaaccattcaaattagaagctattaagagcggcgggctgggcggccgctcgcgtgccacgtcggataggtacagtgcgcgggtagaagttttgcgaaaaaatccttctattttttgtaattatatatatgtccttataaacagtacttgaaggggaaaaatcgcggaaagggactgctctgtaaaataaggaaagaatagggtttttttttcaaaaatgacgcccactaatctaaccccccagaccttatccgccgccgcccgcaccctctccctctgcccgctccctctccctctccgccgccgccgcctcggccacctggatttttcacattttgatccttttaaaaaacttatttcgcaaatagacccctgaaaaaacttatcccagaaatggtcttttttggggcgccagagtggctggcgccgtcatccaacgggacagcgccagcctctctggcgccgtcttcctgccaccgtggcgcacgcgaaccgacgtggca

SEQ ID NO: 16225 - DNA, 1501 bp, Oryza sativa
ttcgtacatgtgaaaggaatcattatgttataaatgtgagcgcaatattgatgaatataaatagaactctaacgatggcaagggtgataaagggagtttaaggccctctcttttttttcccatttcatattttagatttttgttcgcacgctttccaagtttttaaatggtgtcttctttagacaacattttaactttttagaagtcaattcattcgtttataccctcaaatagctatctcataaattagatagttcatcaatttcagctatcctaaacctctaaaccttaagttgtacatattttttttcatgcgagtcatggtaatcagtaaattggtgatcaacgaatcatcaaagtcgtaagatgaatatgtaagatctactctgaataattgtaaataggtgtcaaaattaattgctattaattagacatctaatggcttgctagccacaaaattattttctctctacatgtatataaacataaacgaagctggaacaaattttacatatgtcccctatatatattgcacggttaatattctaattacatgtgttaagtcctttaaaattccttaaaatactctcaagctgccacgtggcgctctaataaattatggcaaatattataaattctaagaaaaaaaaatcaaagtatctattacttgattttcacttaaatcggtacgtccaatattataaaccgttagattaaattgatattagaacaaactaaatactacgaggtcccacctctcctcccgcggcataggtatgcacctacgtacgtgggtacgtatgcttcccctcccttttttcattttcccctttcttcttttttccatgcatatgctttcctccctttattactacatcatgcgccttcgtgagacgatttaatcacaagaattttgagtatcttgcactcgtatttttcatttgcggccatactacacggtatgtatatagatggaatgtatgataattaactagcaatagtttcttattaactagagagaaaaaacataattcaaaagtcgtaagtacttaatccatctcctactcaaaagtttctgaatggtttttaaagataccttaagaaaaaaaaatagaacccttaaattattataaaataatattatctaaactttagtttgcctataacctataagacaaaatttctgaaaaaaaaacttatctttcaataatataatataagtgtccactcataagcggggcaccttcatagtaatttgtgtactaataaatcaattcgttttgcgggcgggaggaattaactctcagaaccaccaaacgaccacagtcacaggccagtagagctccccggccggcagcgtggctatggtcccacccgtcagccacctctctcctcccataaatatcccagtctcccacgcttccgcttccgcatcagacaaacctctcactacctcagttagctcagtagcacagctcacctcggctgtccgaatcgagag

SEQ ID NO: 16226 - DNA, 1501 bp, Oryza sativa
tttgtaaggagtgctgttgatgcactttgtaaacacagagagaatcaataaagttgtcatctattttaagagttcttatatttgtgtttcaccgggttttggcggtataaccggcaactcaccggcggtcagaccagcggcattgcggcggtcagaccggcgggagaacggcggtcagaccggcggcggcgacagcgagcagcaggcgatctcggcggttagaccggtagatcaacaccggtcagaccggcggctatgcttcggtcagacctgctaatctacttcggtcagaccgatctcatcgaaattgagggtaacttttatttccgctaaaagttttcggtttttggttataccaaccattcacccccccctctggttggtttagttattgtgatacgatcctacaacaacctcttttttagttctagattgagtttttttttaagaacggagggagttttttttttacggaggtagtaaggggctgtttggatgcttgtttcaatttaccaaactactatatagctaaggtgtggcataccacaatttatgtggctaagaaattcttggccacaagttaggcaaatgttggtaaagatatgtgcctatgacaagtggggtcataaaataaaaaattgtggcatgataaagatgtggcaaccaagcaaacactaggttaaattggtcaaagtagcttgccaaagttgtgacaaagtatggtcactatccaaacaacccatgagcgcttagggcatccacaatgttaggaaaaagcaggtattaagcaatataatatttctatgatctagtaataagcattgtggaagtgggtagtaactaatgctaggtagtaagcttatgacccactcataagaataaaaaaacattaaaatctctctcactctctccttccaacacaagatgtgctactactgcatgctgagttggacaaaaagcaactaaaaagcaatattttttccctcatgggacccaccttacaaagacctattacttagccctgctacttattacctagttaaacaagatacattggtgttcccttagaaataacatttggagctagtcccccacctacgcggctacggccaccacgccgcccgacgcgcgcgcgcgcacatggggatggggggtgggggggggggagcaccaggccaccagcacgcccgcggcgatggctcccatagtcccatcccattcctcaacaaccctgtggagattatgggtaccccatacccacacggcatggttatccgactagttataggggataacttatatatatgaaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagcatata

SEQ ID NO: 16227 - DNA, 1501 bp, Oryza sativa
gcataacgagttttatccatatgaaaagcaagtatagagactcactcaactgttaaaatcaatttaatttacgttcctatacgattttgatggtgatttcatcctacgtaacactttaacctggttttttacatgacgtagtacctacgtaacacttaacatgcgttccaattcaaaagaaacaattaaaaatagacaaaaaccacgtgtaagtctcacacgactttttttaaagaaaaacggtgaaactaacatgtcatgacagctctctcctccccttttctctcctttcagtctctctcccaccacgccatccactatatcgcactagacgatgagaccctacggaggcacctcctgagtgctgcaccgctgtcatcgacaagagcatatgccaccttgattgtcgcgccaagtgtgaatttgtctaggtagagagccttgctagtcattaacaaaagctggctgggcatcgacgagggcaaaggcagtggcattggcggaggaggcaaagctcgcttcgggcagtgcgtggagaaggcaggactgagcccaggaaagaaaggaacttgaggaggaggaggcggtgacgactacaagcccgtggctactccaggcagatgccacattggttgcatcagcggtcgtggcttcctaaatctagagagagagatagaggaggtgacgcaactcacccaacccatcctccaagtcgagctcgtactccagattggtgacgcctgcctctagatattgccctccagcattgcatgcgggatgaggacgttgcatctggtgagcgtggcctgcggttgaggagagacgggtccatctaaatctagagagagagagatagaggaggtgacgcaactcacccaacccgtcctccaagtcgagctcgtactccagattggtgacgcccgcctctagatattgccctccagcagtgcatgcgggatgaggacgttgcatctggtgagcgtggcctgcggttgaggagaggcgggtccattgccactatgaccatcatcgagaggcggattctagatcgacgaccatgcataatcttcttcacctacgttgatggcatcgtcacgccctaccatgaggaaagtggcagctcttctgatgcaagacgagaagggtgaaggagaactcgaggaagtgatgggcaggtggtcatggaggcaacgagtgaagagagtgtagaggagaggaagagaaagtagggatgacataggatggcatgtagatgtgggtcccactgaatttattttatatttactcctactagcaaaaatgcctttgcgttgcaacagctgaaaataattttcgcgattgattaaactctgccaatttaaatgactgaaacaagacaaaataatggtaaaactaaatcaaaatcatatatagcattgaaccatgttacattcgcttgcattatcatacgaagaatcctttatgtacacctttccatagcctcacaaatcgattgggtggc

SEQ ID NO: 16228 - DNA, 1501 bp, Oryza sativa
ttcctagattacgttctgatctttatcccataataacaaaaggcttgtcgaaactagatttcggcaataataaaagggggtggctatcaagctaggaaagtgtatgggtttgaagacaaaaggatttatacaggttcaggccttcttataaaagaagtaataccctactcctgtccggggatgaatccgccgagtgtgttattgattgtatgatttggagaaaatccaacctctgcccctagaggcacccggaccccccttatatatgggaaggagtccgtattacaaaagataatctatatccctaacggaataggaagatacagataaaacacagtcgtgaccgactaagtctcagggtgtttccttgatacacaagttaagaaacaaacccgagatacaaataagatattctatctacattaggtatcctgtacccagtccaaatactatcgccgtgtagatatgggatatccataatctccacagtagcccccgagacctttgcagtcaaccatcgtagccatctcaaaaataatccgagtgcttcaaacttttcatgccaaggcccgccgagtagcgaagacgaagactgtaaagggcgaaaagataaagaatatggtgcatcgaatagatgcacctaattaggtgtagcccccaactatgtgattagttaacaaactaaacatatagttgagaacaaaataacagcacaatcatgcatcatatgacaaaagcatacgcggcgcctaaagagacattcttgccgactgctttctagccatatgagtccgagtggtttacactctaaaaggttcacgaatgaacatactggacaggcatccgaatataaaactctaaagattacccaccaaatattataaaaattatggtaatgaataagtctaatagcctaggctatgactatttaccataatgaaaataggtaaataacataccaaggaagtgactatgataaaaacaagtcattccaaattaacccagacagcttttgtagcctaataaagctaacaaaaagcagtataacacctttctgtcgggcaccttttaatttgcattgcaataattccaaagaattatatgaccgcataaaaaggattttatcagcattgggcaacactattgcgcgcataatattgccaaagcaaaatatgcctaagtccctaaggaacacaatgggccacgctgttaaaagtattgggctgaagtactgttcaggcttaggcccatttgcacctccgatacccttaacaagaaatcccgagatccaagcgacgcttcgtcttccccgccggaactctcaccattttccccactccttgctacagtgcagcactgcgccggcgaactagggttcaccattccactcaaatccaccttcgaaaagtgcaccaaaatccttcccgtgatccaccgccttaatccctcatttctcccaagccatccctcgaatcagatcagcacatttgagaaaaatcga

SEQ ID NO: 16229 - DNA, 1501 bp, Oryza sativa
caatatgccctcagaaaaaaatcaccaaagaagcacaaacacaatggctcacctgcaattcaccatctgtcttagaaaaatcaactcctaacttgaaaaatcagtcaggattttttttatggaagtaagtgtagaaaaataatttctttaagccattttacattttttaattaaggaggtgccataagttgatataattttaaatgtcgattattttttattcatcccaatattccctctccacttcagtaataaaaagttggtgtgttacatttaatcccttttcttttagtattcattattattggcagacgaagactggaccggtatataccatatagataccatataggcacctcgctgtgaaatgttatcacctatcactgaaaaataaatttgagctcccgtgttaaacttagaacttaaaccgacgaggggatgtccccttagaatccacgcccacgctacgcttgatatttccttttgtgtccattatgcgcatacaagcactggattgttatttcccttgtgtgcgttatatattacgggcgtataaacacttactgagttgtcatgagcgataacaccattgacacgtttgcttattcagattgtggttcatgtggcaagcacgtacgtacaccgccatggaggcactttccaaaagcaacatcccagatgtttctagctgcgtatactagtcgcaattagcaatagagctgtttagtcacgttctggaattgtcagtggttagattaaggatctaataatagaagttgcctaatttgactgccatcctggatggttggagtctttcttggtccacaagacaagcaacagaatcaggattcgtttccagtttggctttggctttgttgtacgttccgttttccttgtactaccgggcacttgcaaattgcttgcgcattactatccttggtgtgaaatggttctaaacggaatattctacttgtagtacgtacacttgtactccacctgtacaagtgacgcatttttttacattgactttgtgcactttgttatattagcctcttttgatattaggcagtagtaccatcctaagaaaaaaaaaactcaatcaacatgtgatgcgtgtaccaacgacacatcacatactttaatttggcgataaaacacatgtgaaccttttattattagtcacaggcagtttgaaaaaaaaaatcacaagaattagtagtactgctacagtactactaaccgatcaacttggagaagaagaaaagatttcctcagagtcgggaaagcccgaggaaagcccatctcccccgtcactgacggtgtggccccaccaccggttcctctcctttcgctcttcctccctatataaaaccctcccaaaaaaaccctctccatttgcaaatcgcaaccatctcgtcaacaaaaaggcgcctctaagaattcctcccaaactttttggtgttgtcaagccgtgcgtttcggggtacatcaacggcggcga

SEQ ID NO: 16230 - DNA, 895 bp, Oryza sativa
aattgttgtttgggtaccctggctggtcctggacagggatttaatgcacattcagcttagaaattctggttcgagaatttattaaggggggtaggtttgtcacgccctgaagtttccccccttttgcttgctttaaaaattggctaaataaatcgtccgaagaaattatcttaattaacctagagctaattctctaattaataaatgcaaataataatcagaatcggcatgtggaatttttcttggattctacatgtcacaatatattaacaggatttttagtggaattttcagagccttggaaataattttaaccaattaaaaatcaccaaagtgcaatttttaaatcccaggaaaatcctttcttttctttttctttttcctgtttcctcctttttcctcttcttgggccgtcggcccagtccacccgtcgcccgcgctcggcctccccttgtgggccggcccgttcccctttcccctccccgaagtcctccctccctccctctctccttcgggcgccgacaggtggggcccacctgtcggtcgtcttcctcctctagccggttggagccgagccccaaccgccggcgccccacctccccacgccgcccgccttctccgtccctctccgcacccgcacctcgcgcccacgtcgccgcctcttcccccgcatctcccggcccgcgcgcgcgctcgagagggcgggattcgatttcgaatccacctctctcactctccctccactccccacgtcgccggccaaatcggccacctccccggccacgtccgccccctcccgcacctataaatcgctccccgcgtcttcctctctcgtttttcgcactcgccgcgctctcccgtgcctcctatcgcgctcgcgccgcttgttgctagt

SEQ ID NO: 16231 - DNA, 1501 bp, Oryza sativa; identical to SEQ ID NO: 14961

SEQ ID NO: 16232 - DNA, 1501 bp, Oryza sativa
ctccccgtgatcccctctccctttccccccatttttccctctctctctcgcgttcaaacgggcggatttgcccccgcaaatctcgccggcgccattgatgacggccggacctcccgcgccggtttccttcccctccggccgctctctcccccttccaaccctatttaaaccctccccgcacctcctccgtccgttttcgcctctcgccgccgtcgccgccgagctctggtccgccgccgtcgtcgccccggaccgcctcccacctcggcgccgcctccttcgccttcgccacatcctcgccgacctcgtccacctctctgtttcggtcgccgaccgccgaaacaccgtcgaccccgtcgacccgagccgtgccgccgcctccctcctctctgaccgccccctccgtcgccgccgtcgccccggggtaagccgtggaccgtcgcctcctttcccccttccctcccctctctcgatcgccgctccgccgcgccggtggttgccggcggcgaccatcggggcgcgggcgcgccgcctcccaccgaccacgccggcgtggccgccctcgtgcgcgccgagtggctgccgcgtggggcccggccgtcagccgcccacgccctcgggtgcggctgacgtgtggggcccacggcgccggtcggtgcgagccgggtgcgcccggtccaccgtggaccgtgaggctgccgcatgggccccactcccgtggacccggtccgcgcgcccctctccctcggctgacgcaataaaccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgctggttatatggagtttattagagtaaaagccttttcttttccgttggtcgtgtagacgctgcagcttcggaagatccgctcttcgtggaggttgaagccgacgtttgggaaagcgagcaaggaaagtcacatcattcttgagcatattgaatcccagtttataaaattattttgatttaaattattgcatgatcgctttacttaaattcccgcgttatcactgttttatttagccatgcctatttacctttgttatgaccttattattattgttattgatattattaccttgttcaccctagattaaacaaaaccccaactagtggacactctactcatggtaccactagtatgattttaggtagatgcttcgctggttaattaggcaacattaggtggttttacaactctagactttgggaatattctcatcacctggacaccatggaatggatggattattgtggaattggattcacaccttcccctctattcaaaaccctcaaaatggttttaggctgggctcggggtgcatggttttgatagtagcacctcggccatataaggaccggt

SEQ ID NO: 16233 - DNA, 1501 bp, Oryza sativa
tgtatattgtgtgagaagtaatctcaccaaaggtgtctatatccacggagcctggctccatccattcatccaaagaaggaatatgatcattctacccattatatccctcaaaccaaacatatttttccctcaaaccaaacaaaaaaaatatggttcgttctattcctccaaccaaataaaaaatagaatcatctcaacccaataaaacagggatggacctaacccatcccaccttatccccataccaaacacatgctaaggtgttcattacttatttgaatactcatgtcttttgtagtacaaaatcaagtacttgcagaactgttgtgtaatgtatgtaataatagtggaataggaacatgcacatgtagctatatactaggtgaaaccccgcgcattgctgcgggaatttagtatgataacaataaaaaaacagcgtgtaagatagctagataacattagattaagtaaattaatgtggtttatgataatttaaatttaaatagtatgtagaatagtgattcaagcgtaaaagtaaggtggtatgattttatggaagaagaaaagtagggagatagtttagaccgtagattaatcatctaaaggctaaaaacaattgatgtgatatgacttaattagaggaaaaaaggaaaaagataatttggaccatagattaatcatttaagcactaactaagtgaggatgaactatataagtatataggatatcataaaacataataaagatatacattgaaacattatgtgaattatgttggatgataatttaacatgtttgtatttgaaaagctcttaaattataaaaactataaagatatagcatgtttgcatgatgtttaaatgtgatgattgttagtggatgatgatgtggcatcttgttaattagtggatgatgatgtggcatcttgttagtggatgatgatgtgacatctttgtatgttaagcttaaggagttaatgggggataactttatagtaagataggatatgtaagcataagaacaagagctgttctttagtgttaatttgctcattaattagcattcttattagtgaaccggagtaaacatttggttattctctgcaactgatatgattatcctatatatgcttgccgttatctatatatgtgtagtgcaccaatgatagggaaattaaaatttcccatatgcacaaagtgatattttccgtattaatttaaattgtaatctactacctccgtttcaggttataaggctttacagtattgcccacattcatatatatgttaatgaatctaggcacccatgtgggtaatgctagaaagtcttataatataaaacggaagaagtagttgttatgtcaattctccttccattcgtatgtcgtcattcgtcaattgacagtaagccaattgaacgaaaacaaaaaaaatacatggattaaatagtttatcatgagctagcccattgatccctgatgatacccacttctaactatttg

SEQ ID NO: 16234 - DNA, 1501 bp, Oryza sativa
gtcgtattgcaactttctaacttacgtctatcatggattaccttcaaggtaaatcgtcaactttgctcattttactatgctgcttatacctgaaataaaaacataccagctatgaatttaagttggaataaaaaaaggtcatgtgctcagggaaaaagattatagcaattaaacgatcatgaggtagagaaattttaaatcttgtgctatcagtaatcaacaggacctgacactttaacaggagaaacaataaggacaagaagaaaaaaacacccactctcctgaacagactccatagtgaactgtatatcaaatattgtctaatctcaattaggattaacctcatgtattaacttgtataatggtgagtagttccccatcctacaaaactctgtaaatagctttattttcctgctctatcaatatacaagaatagtcaggatcgctttggagaattggcgtcaaaataacagccactctcctgaacagactccatggatgcagattaatgcagtttagactttgttatccttttcccaatacaaaataacagtagtgctagttgcttatgtcttatccaacaggatgattgcatttgatcatgcaatctgaaaccaaacgaaagctgctttgtaacgcaccggagtgagtgtaatgcaaatgcccccaatattccaggtacctctggtgcaaatatatcggttctaaatcctaaaaaaaaaaccttctgagactaagggagtagatattagagcaaagtacaacaacaacagaccataagctagctataagcacacatgtagaagagaagaagaaaaacgagatatagactttatagccaactgcagtatgggctttaagatattatgtgtgcataagaggttcaaatgataatgatatgatatatatttatatgaaaatattgtatggataaactattatattgattgtagtgatgtgttaaattttaaagttaatagtttgttatactatcaaacttgcttttagattagtgacattgtcttctgtttaaaaaactggattagtcacaaaacactagactaattttctggttaatactactaattttctttttaagagtgttagccgtaataattggttgtagctcgttgagaaaaaaccgtgatgttttatttctctactattataaaaattgaagatgtttttgccgatattttggtacatcatccgtgtttgagtcggttttttaaagttcgttctcttttggaaatacagatccgtgtttgagttggattttcatttcgtttgcttttagaaatacaaaggaattatataagaaatctctttaaaaaaactcgcatgttaatttgagatgaaaaccggactcttaattgcagctcatgattttctaaaaaaatatatccaaacgaattcccatagtcaattttgccatagccaaaccgtataacaatgataagattaaaatagcattcatccattacgacgcacaagtattttt

SEQ ID NO: 16235 - DNA, 1501 bp, Oryza sativa
gaaatttcagggctagggatgccagctaaaattaaaggatacaaaagacctgcacatcagagttttgcagaccaaagaatctaacaacaacaggacctcacaggagaaacaataaggacaacacacacacacgaagacccagtctcctgaaaacactacatggtcaaatgtatatcaaatattgtgcaatctcaaacaggattaacttcttgtattaacttgtataaatggggagtgattctccctcccacaaaactctaaataaatttgttttcctgctctatcaatacacaaggcatagttcttgctttcttagaaaacattctcagtcaggatcgctttggagaatttgcatgaaaatgtttggcgtatcagtcgctatcgctactaaattcctcaagttttgctctatcctccatctgcaatagcacactcttaagactgaaaaaaggcatttcaataccgcactcgaagactgaaaaaagaagataaccttaaaaaaaagagagatcaactcagtttgcttaggattttttttgttcaattaattaccgttttattgcgagtttggcgagtaagtccactgtaaaattttacagaagaacttcacatcagtgaataactggggccacggcccacacccacccttcaacagttaagaaaggaagtcctctttctatgtatgtttcaattttgaagatgtatcacaaccaagcatgtctaaaagagatccagcgtcatattcaaagaacacagagtggtttaatattgtagcagcatgaagatgaggtacagcaaacgccaatctcatatcgcggtttccattgaattggaacttgaaagttgaaaatatgacaaaaacatcattgtgggaagaaaaaagagaataaacagtaatcatctcgaaggaaaacataaattggttgacagttccaaacagaaattggtgatgcggatctacttagctgctggtagaacccttggcatcccgcgtcgccgctccatccatcaccgccgcccgccggcgtcatccccggtctcggcgccgcgcttcttcggcccatccatccgccgtcgctcctcatccccaatcttccctcttcatccttccatctgcttttcaaccattgacatatcgtcgaacccatagtctgaatcagccgtaataaacaattgacgcatacagttgacgaacaagtcaatcaagtgttttgtagcgcaaatttgccagaaattccactcaactcgatattaccaaaactgcttgtccatcggttgaacgcgttcgctccctgcgcgcgcttaaccaccactccatccgtcccgccccacacaacctggggccgcatagttttgaattaaaaagaacagctacatcgtttttggccggtgccagtaggagaggcagtgttcaatacgtcagaggatatcgttgcgttgagagtgacacgcgagacgacgggactcaccttgtactctcgcggtggtctctctcgacagc

SEQ ID NO: 16236 - DNA, 872 bp, Oryza sativa
acacatatacactcctatcttaaaaaaaaccttcaaaaacaagagacaagagagaaacttgctagaaggaaagagataaggaataaaccggtaaaataacccataaagtaattttctctaaatcatatagttgggatgagtaactttatgtgtaacacattgcggataaatggactcagacagcgattgagatctgcaccacaactcatcccaactcttagaactcctcaataggtgattccagaagtctgatcatagctgctagtacgagcctaaatcaaactctctttttttacggttttaaaaaaaaacttttttatatcaatttgtggatactccatagtcagacgatttctccatcaagcgttgctgattagtagttactcactccattctaaactgatctacatataatttttttaattattcctaaataatctacatatttgtgttcatttattaagtctattcgttatttgtgcattggagtaaatggacattgatacatgcatacatgcacacaagtatttataacccacatgtaatatcttgatttgctattggctagaaaatagtgggaatcgtgcatgcattgagtttgatgctagagtaaatatagtatgagagagttattagcttttcttggtcttggtgtacctatgaaatatgtaaatcaatttggaatggatgtagtatactccctccgtactcgtaaaggaagtcgtttagaatagcgacacggtctccaaaacacaactttgacttcttgtttctataaaaatatttattaaaaaatgatatatgtatacttttatgaaagtatttttaagacaaatctattcatataatttttatagagtaaattgcatcaa

SEQ ID NO: 16237 - DNA, 1501 bp, Oryza sativa
acgcaaccaaacttaaacaagcaaactaacacaatgatctagggcaacgacttaacaaggcgttctagatcttccgggcatcggaattgattgaaggctcgttcggcttgcccccatcatcttgagtagctccccactcgacctttgaatgggtgcgcttcgattcttctccatcatcatcacttacgttaacgaccgaaggattcgctgagactgggacaacttcttcttcttccaccacacgaaccttaggcgccaactggtagcgagggacaaatagagctctcttccttgtggtaagacgaaccctggccttttgtggtggtgcttctcccttcaacgcggctagttccttctccaaacgatcaactttgtcctcaagcttacatatcttaccacgattccggtcttcacgatcttgagcagctaacacaatctcagcgcggaactcatccatggcccacagcatctcaaccaaatgccttgtggtagcatcattctcaattcctgcaggttcaaggtagctgccacggtcacttccctggggttggcgaggatggtagcgatactcagtgtcggccaactgatcactgtagcaatcgcgaagctctcctatggcgatccttgccacctcctgacaagcatgaatgtagtttccccctccagcctcgaacatcagcgatgggatgtcttcatgattagtgttcaaggtgaccttgacacggcacttctcttcatcacggtcatgaggaatctgggcatacaaaggggcagtcccaaatcctatggcgaaggacatcgtacgcaactcctggacaaatccctcagtaccgaacaagtactcaggcttgaagcgcggcatctaaagacaagtgaaaggagggagttaagacatttatccaattaatagcacaagtttttggattaatttgaataaagttagaaaatcaaagtaaaaggtaaataaataaagtaaaccaatcttgcaagataagttgaaacagttgaaaacagaatcacaaattttgcacttttgaataacaggtttcaaaagaaataaaataaaagagagttataaaatcaacatgctaaattatattgcaacatgattgaataaataaataaataaatgaaaggttgtaaaatctctgctagaaagtgggccattagtatagtaatagatgtacagtactaacaacacaggaataataaataaattttgaatgagaacaattaaagggactataaactgcatgtgccattagcttggtttaattaaaagagaaagagaggagaacagttctactttttcaatctttttagagggcttctataggtatccatttggcataacctagggtcaatgtggctctgataccaacttatgacgcccggaatttctatccaaaattccaaacgcttacatgtgtgtaaaccctcgtccaggaatcagccgaggcacacaataacaaattgataatagagtgcaataattactcta

SEQ ID NO: 16238 - DNA, 1501 bp, Oryza sativa
caagaaataaatatgtttttaaatgaaaaacacaaaagggattaaataccatagatgtttttatgcaagttagttttaggaggtcccgctaattatattttcctaggtttagaaggttattaagaacataagaatcagcatgatgcaagattagaaaatgatacattttcaggatgttacagccgcggccgggagtcatcggagcgtcatccccgactccaacccgaggagcgacgccgcctaacctcgtcgcaggccgccttcccgtcttcgcctcaccatcccgtccgctcggtgaacatcccccttccctcccagcctcactctgctgcatcccgtgcatgccgccgcgccagtggtcgttgccggcgaccatcgggccatgcgccgccgctcccctgccggctggccggcttgaagccgtgccgagcccggcagccgccaagcaccgttggattcacccgaggccgtcaacgtggctgtcgtggtgctgtcccacgctggtgccacctcggcgccacgtccttgccaactcccacgtcggtccaccgtggccaccgcgtggctgccacgtggtgtgcccacggacacgcgtgcgtggactcggtccacagtgcgcccaccccttttagccaccgataggtggggcctgcttgtcattgctacccctctcccctcggtgacgtcataaatgactttaaattgcgcaataaattcagttaataattatagaaatttatttgatggctcaaaacttctaacattcatatctaattcatatgaactccaaattgagccattcaacttgtaaaattcatctaaaattgagatctacaggtttgtttacttttttatgtactgtttgcttggtttttactaaagtttttcctcgttttgcgtgccagcgtgtagtttccatcgttttgaaagatcgcaggcgcaaggaaaagagatcagaaggttgttgtgaagaagcaaggcaagtcacacattccccttgagcatgttgatctcaatttataaatgttttatcgtttgcaaatacatatgcatgttttgctaattacatgggatcagggtttacctacttgcttgcttgtgccgtattatttgatatatgttctttgtcaaccttgggtgaataaatcgcctagattgtgttacttatgttgacctagctagaaccatttgcttagccatgcttaattaccactagcacagttgatgggataattgtagtattagaccttttaatatcatgacgagctgcgtgcttgggacatccgaccatgtttctttggtcataattatccaattaaaatgcgactgaatggtgggctgtgggtgcatggttttgctggtcgcacccatggcaattaaggtccggttcgtgggatacactggaagacatacagcgcttgccacaagcgggaatgggtaactgcctaacttgaagtatagctttcctctggttgacgcatccaggcaagggtgagcgtga

SEQ ID NO: 16239 - DNA, 1501 bp, Oryza sativa
ctctctctctccccaaaccaccgccagccgcctcgttgccgacgccgccgccgacgtcatcgcggccgaacacgactccgccgcgccgacgatgccgaccccgacctcgatgcggccgtcaccggcgacgacgtcgcgccggcagtgccgacaaagccgggccatgccacgcccgccgcgccacgacgccgagacaccacgacgccgccgcggcacgccaccgtcgcgcaccgccgatgcccgccgccgccgccgcgccatgccgcagccgcgccgccacgccgccgctccactgccgccactccgccgctccgttgctgccacgtgaacgaacgaacgatcgtgaacgaacgaaacgtacgtgaatgtgaacgaacgaacgaacgtacgtgaacgtgaacgtgaacgaacgaacgtacgttaacgtgaacgtgaacgaacgaacgtacgttaacgaaggaaacatacatgaatgagaacgtgaacgaacaaacgtacgtgaacgtgaacctaacgtgaacgtgaacgaacgtgaacttaacgttgtacgtgaatgtacgtaaacgaacgaacgtgcgtgaacgaaaagtgaacttaacaagaacacgaacatgaacttaacgtacgttaacgtgaacgcacgtaaacgaacgaacgtaggtgaacgaaacgtgaacttcatgagaacgcgaacgtgaacgatcgtgaacgaaacatgaacttaacgagaacgcgaacatgaaatacaatatatgttactttgcgtttatcctaatacatctttttgtatgttgcagaaaagacgttgtcgtcaccatccctcaagccggagtggtagctagccctcaaaggaattcgcgcatgcaagtgatgtaaatatatgattgttagatttttaatgcaattaagactactagagttaatatacgacacttaaacttagcatatatgattatctagggttgtaatgtatgacacttagacaacttagcatatatgattacctagggtcctaatatacgacacttagacttagcatagtataagattattagatttgtaataagacttagcatataagattgtgtagggttctaatatacgacagttagacttagcatatatgaatatttgagttttaatataagattattagagttttaatacaagattatttgagttttaatataagattattagatttgtaattagacttagtatataattattgtctagggtcctaatatacgacacttagacttagcatagttgactattagagttttaatacaatattatttgagttttaatataaaattattaaagtttaacataagattattagatttgtaataagacttagcatataagattgtgtagggttctaatagacgacagttagacttagcatatttgacttagcatatatgattgttagcatataagattgttaaatcaaaaatgacctatagacttagcaactatttcttgtatgaacaga

SEQ ID NO: 16240 - DNA, 1501 bp, Oryza sativa
gaaaagctaaggtttcttttgttttctttattttcaatagtttgtttctaaaacggttactgatctttctccctctttcaaaattgtagatggcagtgaacgccagcttcagttcccacggttttggtgagggtcaccacgtcgctcagcttcgtgacctctcccgtttccttggcttctcgtgtcccgagtacacggggtactccgtggaccgtgttccccctcactgtgagctctcggtgtacctttacccccgtggaggtatacacggagctggccttcgcccccaccacttcactgtggccaggcccactctccagatcgcgtaccaggacctctcctggactgcgcttcgtcgcctggcccacgactacagccaccgtctcggaggttccgccttccggcagcttccacgccttccctctggccactcagacgccaggtacccttgtccgtacagcgagtctcagccagtgctgactcgcatggtcgagctttcggaggctcaggccactcagcacgacctactccttgaggcttaccgctcccttgcccgccgctacgccgctttggaggcccgtctggccgaggagggtgtcacctcagttgacactatctcttgggactcaggccgcctctgccacgccagccacctgtcctcccacagctcccgcggctctgcccgcactcccagtggcccgcgctcccccagctcgcgtgcgccgtactcaccagtgtactcgccctacccacacccagttagcccttcctacaccccaggacacaccccagttgcttcctcccgccgtggcccacgctttatccgcactgcgcggaagcgtgttgttggttctgccaccgtgttccgtttccactacccagctcccccaccgccagcggcccgtgctgctgccggccctcgacaggttccgccggtcccttcgcgtcagccgatcgacgtttcttcgactgaggagccaactacaggaggcagccaggccgacgaggagtagaggaggcagtcttcagcagccgtccgtgtgataggcccttttgttccgccgccaactcttttggagtcgtggcgaggtagtgcgtgcgtgtgtttgttgtgggtgttgtttggtagtctgattctcctaggtggtgtgcgcacagtcaagctcggcgtagctctgtgacttgtccacacccgttgtatcaggtgtttttatgatttgaaaaatccagtttatgcctagtgtgtgctatctgagttgctatttgctttgctccttgccctcctaagtgcttatctgactcttaccccgccctcttctgggagtttagatggctagccgtccccgccgtgcagctcgtgcaccagcccgctttggtgttgaggatggtagagttgagccagaagaaaatcatgaatcagctaatgagcagtctcaccacagcaaccgttcgcatcgtactgtttcccgcaacgcagaggttgagcaaccccgccgcagca

SEQ ID NO: 16241 - DNA, 587 bp, Oryza sativa
tttgctgttatgactgaaccccacgcatgacggcatgagaggagaggaagtgttggacacttgccgcggttacctgacgacaattttttagtgcttttatttttgaaagaacccagcaagctggttttattttagtgcttttatgcatgatgtttagctcagcaagtgaccaagtaatttgtatagtataaacttcctagaaattgtatgcagaaatgcaaatttgtctcctcgtcatgcagaagttcgaattacaaattacaaatgctaattatggtacaccaaatatgttgcaatgcagtaagcgcaaattaattacgtatactgcaaactttgcatacgtattagcaccaagcgtgcattttgtgatgattgcaagtttggtccgtggtttctctccatttgactcatctgggtagcttgacaccttaacctgagtttgtaaattttgtaacatgggggcttctaggatgtgtgtatgccaatatgtgtgtcttcaaaatactacgtatgtaatatatatgtaccatttctgaattgtaagtactgttgcagcttctggttagtattgagtggaattcagctga

SEQ ID NO: 16242 - DNA, 1501 bp, Oryza sativa
cctcctcggccagacgggcctccaaagcggcgtaactgcgggcaagggagcggtaagcctcaaggagtaggtcgtgctgagtggcctgagcctccgaaagctcgaccatgcgagtcagcactggctgagactcgctgtacggacaagggtacctggcgtctgagtggccagagggaaggcgtggaagctgccggaaggcggaacctccgagacggtggctgtagtcgtgggccaggcgacgaagcgcagtccagaaaaggtcttggtacgcgatctgaagagtgggcctggccacagtgaagtggtgggggcgaaggccagctccgtgtatacctccacgggggtaaaggtacaccgagagctcacagtgaggggaacacggtccacggagtaccccgtgtactcgggacacgagaagccaaggaaacgggagaggtcacgaagctgagcgacgtggtgaccctcaccaaaaccgtgggaactgaagctggcgttcactgccatctacaattttgaaagagggagaaagatcagtacccgttttagaaccaaactattgaaaataaagaaaacaaaagaaaccttagcttttcgcaagtagttttgaacttagtatccttagggtcgtcctaagcgtcgggtttcgccctagggccaagcctgtgctctgataccacctcttgtcacgccccgaactagtcccgaccggatctagcccgtgacgctccaaattaacctgttaatcgataccagtcccaggaaatagtgctggtatcacaaggagacagagtatcacagcaacagaggtctctttattatagagtagaagtacagtcatgttgggctgcggacagatcccgagctcacaactgcattacaaaaggaaagcggaagccagtacttggaccaatcatcacaggcgcgacttgggaactaggccgaaaccctaaaactcatcgtagccgacttgctcctggaagaactcctcgtcagcaggatccacttcatcttcttcagcaactaggggggattatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaacagggttggcacccggccaacagcttttcaaacggccacccgggccaacaacttttcaaacggccacccgggcctagctgatcccgtcagctgctgatttttcaaacatcgaacccagtttcacaacagcaatttcacaagcagtagtcaaacaaaactacgctaggaatcacctcacatccgcccatgaccgtgggcacggctgttcgagcagtttgttaacctctgtagagggggtacactttacccaca

SEQ ID NO: 16243 - DNA, 1289 bp, Oryza sativa
tcgccgccgagctccggtccgctgccgtcgtcgccccggaccaccttccccctcggcgccgcctccttcggcttcgccgcatcctcgccgacctcgtccacccctccgtttcgctcgccgaccgccggagcaccgccgaccccgtccacccgagccgcgccgccgccttcctccgctccggtcgccgtttccgtcgtcgccgtcgacccggggtgagccgtggaccgccgcttcgtttccccccttccttcccctctgtcggccgccgctccgccgtgcctatggccgctgccggcgaccataggggcgcgggcgcgccgcctcccgtcggctgtgccggcgtggccgccttcgggcgcgccccgcggctgccgcgtggggcccggccgtcagccgcccgcgccctcgggcgcggctgacgcgtggggcccacggcgccggccggtgcgagcccgtgtgcgcccggtccaccgtggaccgtggggctgccgcgtgggccccactcccgtggacccggtccgcgcgcccctcccctcggctgacgcaataaatccatttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacatttgggaaagcgagcaaggcaagtcacatcatccttgaacatattgaatcccggtttataaaattattttgatttaaattattgcattatcgctttatttaaattcccgcgctatcactgttttatctagccatgcctatttacctttgttatgaccttattattgttattgttattatttccttgttcaccctagaataaacaaaaccccaactagtggacactctactcatggtatcactagcatgagtttaggtagatggtacgctgtttaattaggtaacattaggtggttttacaactctagactttgggaattttctcatcacctggacactatggaatggtttaaatattgtggaattggattcacaccgcccccctctattcagaatccccaaaatggttttaggctgggctcggggtgcatggttttgatagtagcacctcggccatataaggaccggt

SEQ ID NO: 16244 - DNA, 1333 bp, Oryza sativa
ccccgccggaatcgagctcgcgctgtcgctctctctctccgcaatcgccgccgagctccggtccgctgccgtcgtcgccccggaccaccttccccctcggcgccgcctccttcggcttcgccgcatcctcgccgacctcgtccacccctccgtttcgctcgccgaccgccggagcaccgccgaccccgtccacccgagccgcgccgccgccttcctccgctccggtcgccgtttccgtcgtcgccgtcgacccggggtgagccgtggaccgccgcttcgtttccccccttccttcccctctctcggccgccgctccgccgtgcctatggccgctgccggcgaccataggggcgcgggcgcgccgcctcccgtcggctgtgccggcgtggccgccttcgggcgcgccccgcggctgccgcgtggggcccggccgtcagccgcccgcgccctcgggcgcggctgacgcgtggggcccacggcgccggccggtgcgagcccgtgtgcgcccggtccaccgtggaccgtggggctgccgcgtgggccccactcccgtggacccggtccgcgcgcccctcccctcggctgacgcaataaatccatttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacatttgggaaagcgagcaaggcaagtcacatcatccttgaacatattgaatcccggtttataaaattattttgatttaaattattgcattatcgctttatttaaattcccgcgctatcactgttttatctagccatgcctatttacctttgttatgaccttattattgttattgttattatttccttgttcaccctagaataaacaaaaccccaactagtggacactctactcatggtatcactagcatgagtttaggtagatggtacgctgtttaattaggtaacattaggtggttttacaactctagactttgggaattttctcatcacctggacactatggaatggtttaaatattgtggaattggattcacaccgcccccctctattcagaatccccaaaatggttttaggctgggctcggggtgcatggttttgatagtagcacctcggccatataaggaccggt

SEQ ID NO: 16245 - DNA, 1501 bp, Oryza sativa
acgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccaaatcatcgtaggccttgggttaaggcaggttcgtgagggttcacggccttgtttaataatactgtgtagctctaggatcgtctttataaaatagctttgggcaactaagtgacttttaaatgctgtttactgcaaaactgaacccctatattattatctccttgtactcccttgcattaatcatgcattctccggtgtggcttgctgagtactgtggtcgtactcattcttgctcaatcttttccctcttcagtaagagaagctttggagaagatgtcttaggtggagtcctggcttataccccagttgagcgcctgtgaagatggagccgtaggtccgctagtccgctgctgtttatttttgattgtcaggcctgatgcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaaatagataaaacctaaggacatattttataaataaaattatttgcgaaagttcctctttttctccttcccctaatgctatttgcaaaaggtttactcttttctttcttcggatttcaactaagtactagatggtcagctttgcgaagaagaagatgtcgtcagttgtttgccgaagctccggaagactgcaggatccgctagcgaagcgaaggaagcagtgaagccagctgtgaagcaggagtgaagatcttggagaacccgtcgcagaacctaagccaccctctagtgtttcgtttgtcgtgtgtttccttgcttgtgtgtgtagcgcgtggtttgcatcggtgggtggtgatgtaaccatgctaggttgtttgcttaatcaacttgcagaataagcaaaacaaacaacacatcaacaaaaagagttagttcctttaaggtcctgtccctagctctggtctattctttccttgtatgctttccctctcaacctctaccttgtgacagatggataatactggtaacaaaggctatgggaa

SEQ ID NO: 16246 - DNA, 1501 bp, Oryza sativa
cgcggcgccgcctccgtcatcgtcatcgtagcggcgtgtccctcgtcgtcctcgtccccgtgcagccgccgccggctgtcctcgtcgcctcctcgccggccccggtcgtcgtcgcccccgtcctctcgtcgttcccgatcgttgtggcgttcgtccctccgtcaagccgttctcgtccgtcgtccgcgttcgtcaagcgagtcgctacagccccgtcctcgtgttcgtcctcggctccgcgtcgtcaagcctcgtgccggccgcgtctcgccttcgcccaaggatcgccgccgaagccgtcccctcgccgttcgtctccgttgtgcccgtctgtctccgccgcgcccgttcgtcgttgtcgttcccacgcctcgtcgcgtggtggtaaggatccgtcttctcgcttccccgccctcgtcctttcggtgtcgccccgtacccgttgtgcgatcgtcgaccccggtacccgtgtaccggtgtcggtagtcgttcacgtgtgcgggtggtgaccgtgtagtgtccgtgttagtgtgcccgctcggtagccgcgtggtttccacgtgtgcaacccgtgtggtgtctagtggagtccgtttgtcggccactcgcctcggttgacacacggggtccgcttccgtcgacccgtggaccgtctctgtgtactcggtctaccgcggtcccttctgttgacatgtggggtccgcatgtcaacggcgcagccttcctgtcttttccaggctagcgcttacacatgttttataattgcaaagcttaattataataatccgcaaatctccatataacagcattaaacctcggatgatcatatcttggtcatacgaactccgaatcgacccgttcaagtctcttaatgtttgttataacctaaagaaccctgtgctttctttttatgtattgttattgcttctttataggcttgtagctttgcttgtgtgcttcgcgtagcttctgtcgtcccggaagttcccgaagcgtggttcgtggtcgtcgccgaaggttcggaagtccgttctctctgagcaaggcaagtcacatcatccttgaacatattgaatcccagtttgtaaaattatgttgatttaaattattgcattaccgctttatttaaattcccgcgttatcactgttttatctagccatgcctaattacctttgttatgaccttattattgttattgttattattaccttgttcaccctaggaaaataaaaaccccaactagtgggtgctctattcatggttccactagtatgaatttaggtagatgcttcgctgattaaataggacaacattaggtggttttataactttagactttgggaattctcatatcatctggacactatggaattgtcggattatggtggaattggacacacacctctcttcctctttcaaaacccctaaaacctgttttcggtggggtttgggtgcatgccagttgtgggaagtagcaccccggccactataaggactaaa

SEQ ID NO: 16247 - DNA, 1501 bp, Oryza sativa
tgccgctgcaccatctctgccgctcgtcgtcgtcaccttccccgccgttgcgcgtgccgggaagccggcgtgcgcgcggagccgaagaggactccgggtgccctctccttcctcttccccggcccgaggcggaggcgatcccacccgtgctgtcggaccctcttcccggcgatctcccgacgcggtagcccccgttcaccctccccgctcttcctctccctcttagcttgcgcggtcactagcctggaccttcccgaatgtgcctagacaccgcccaagcgtcggcgctactcgctgtgagcttgccaccgtcagcacccgctcccggaggccgcctctcatcgccggacttccacggcgccgctctgccccatccaaccccgggaacgagttccctgagtcctagagatgctccatctccgacgaatcgaaccctcgtcgtctcgtcgtcgtttccccctttgctcgctgccggttgccgccgccgcgattcgccgccgctggccgccctctggcgaatctgagccgttggctcactctttcttgtcctccttgtcgttctgatgtgctccccgtcgccctcgccgtcgcatggtgtcccggtgaaactgccgtcgtccgccgtccatctcggcctccccttcttcctcctcccgccggcccgcgtggctgccacgtaggcgccacgtcggcgccacctcggctttgaccgggccaatccggtcagccgcaccctccctccgtcttccctcccgtgcgcgcggtccacgacaagccgtgcagctgcacgtgggcccgccgccatccgtccacccggcacgccgcgcccgaaccatgcgcacccgaaaccctagcgcccggccccgcgtgcgccgcttccaccgtgcaccgcctcaccgacaagcgggcccgctcgggaccccgcgaggtgagcccggtccacccggctcccccctctctctccccgcacccctctcctgggccgcctccccgtagcccgcgccggcccaataagctcggctgagccacgcaaatcccctcgggccgcaccctagccaccctgaggaagtctgatattcctccctccttcaatttctttccaaaaaaagggtttaataaattattaaatcctttttcctttagacagaaattccttaatctttagaaaatccatatcttctcaaccgctcatccgtttgactccgttcaacttccagtaattccataaaattgagatctatctaatggcactattaattagtctaattaggatctttcttttggtcttttgtctaggttttcgattgtttgcgtatagttgcggttaccggatttttcaccgatcgtggttttctcgaagattcgtgaagcttcgtgaagaccttgagcaaggcaagtcaccctttgatcaattgctcctataattggaaaatcattattattttgtttgcaacttgcattattagggtcacacacttaatttgcttggcctcggtttgcg

SEQ ID NO: 16248 - DNA, 1424 bp, Oryza sativa
ttgcaaaataccatcgtacatgagaatgatatgggagggcctagaccaatatatcattcaactcataatttttacaatggtatcgggtaaattggccctagtagggcaaggtaccatggcaagaggtggtaaggagacagggatgcttgatgttgtctaataagatcggtttagccatcctcgtgtctgtcgttcctcctgatcctaaacatccttcgcaatggtgagtggtgtacggttggcttatgttggctcacgatggcaacctagacattagtgggattgaacgtgataccgacaacgaccggtttagatggatccatcctaatggctagttctaccgccttttgggtgaacctacttcttttcctctaaattgtttatgggatgagggtgttgaaggtcgatgccaataaggctgcacgaaagggtcttaaagtcctcaagtagcatctctagatcttgggtttgactctccctaagggagcaaatttcaagcatgaataaaagagaaaaaaaacatgaggcatctatcacttcttccggtaaaaaaaaaaaaaccttggttgcaaagacactgtgttgacctattcacatcatcacccacaacggacttcatgtcactagtgtgagggtgtcatcgctaacatcatttacgctgaggcatttaccctcggcaccaaggacttgggtgccaagctttgggtccatctttaaaacaagttctttcaaagggatctatttacaaataatatttcaaaagggcccaaacgtaaaaattcactatattcgtgatttatctgattccttagtgctggaccagtaattggcttgttagcggtcacatactccctccgtaaaaaaaacaaactcttgctatgcactcatgtctagatacatagatagggttgttttttttttctgggacggagggagtactagttttcattgaacaaatattcaaatctaaacttttgaattcaaaaacctgttatcggcccaaaaagaaatggatggctaaagtgcatttttacagacccaaaaaagacataatgtaatacgttatagatatatcacaaatagatcaaaatgtataatgcaattatcaatataagcatgcatcacaaaatatgttgtacaatatacaatccaccaaaatataacaaaagatgaagctttaaaaatgaatctgtcactttttccttttgaaatatatatatttagcaacatataaccttgccagagaagataggattgatataaattcttttttgtttacggggatatagattcatattcgattcaagttattttgtaaacctttggttgactggtttggtttcaatccaaactaacttgaacccaatatgttctacttctcgcgtgcatcggacaattcatctcggaactaaaattctaagcac

SEQ ID NO: 16249 - DNA, 1501 bp, Oryza sativa
agcgcactcactgaattatgcaagtcttgcatttggagaagtgcctgaaccaccagaaaccacccccaaaataaacataaatcagcacacatctacctagcagctacaggcatagcaggcaaaataacggataaggaactcgcctgattcttggcacgcagcatgacgatcttggaaacattgccaaacggctgcaatagctgcagcagatcagcctacaacaacagcaacaaagcagtgagcgaacaggccgtaaaggtaataaagctttcacagtaaaaccaaaccatctatctaggcacataataagcacgaaatccagaaaggagaagaaacaaaagatccacgattcaatcctccgtcacctcagcgatttcgtgcccgacgttccggatgtggatcaccttagacgggtccgccatcctccccgcaccgcaccacaccacaggtctacctgttaaccgtactaaggttaaggccaaaagagagaagcttccaaaccaaagaagagaagataagatttaaggcgaagagggtgcggatagagaaggatgtgaggaaggaagagggacgtccgtacggggtgctcaccggcggcggaagcagcaggacgccggcaccggcaccgccgctgctcgcggggggatggagatgagatcggcgcggaggcggcgggtgaagtcgcgaggagacctctccgtgggggtggaggaggccgaggacgaggagaggggagatcggctagggccggcgcaagcgcaagggagtggagtgagtcaggcccattacagttacaattggtgtaaaagttgttggaggtttgggggcactctgtagtctgtagcgggagatttgatcgtatactacagtatctcggtctctcggatgaactacggccgtttaaaaataattttttttgggctcgttcggtttggacgaaaaacaaaaatttggaattataaggattaattgttaagtgatattcagttcataggacatgtaagtacagaaaaatcgaagaaatatttcatccactcaaacctcttgaataatttattatatatggattgaaatttattagaagtattgttgggagcgctcccatattccaagcgccaaacgtgtatcaaccaggcccacctcaccccacgttccatcatcccgctcccaccgttatcggagtaaacgatttacttcgagaaaaacaacttctctggttacgatcccaccccacgtcccgtcatcccactcctaccgttatcggagtaaacgatttacttcgataataaaaacaacttccctttcgatcccaccccacgttccgcttcgtgctcccaccattatcggagtaaatgatttactccaataaaaacttctctacttctggtatatattctatttttcccgtacccaaccaaccactctcacccccacttcattttttccttttttttccggatctgaatcgatccaccatcccagcccacagatcggcgacgca

SEQ ID NO: 16250 - DNA, 1501 bp, Oryza sativa
caactcgcacacatcatcattcccatgcctgcatatttgcagctaccaacctgtgccctcaaatataaggctgtgtactttaccatcatcccaggaagtggtttagcatcacagatccttcacacaatttgaggctgtctcccgcaccatcgatggatatttgtatgagctctgagggcattcttgttaccattttcatgtttgcttgagatgagtccatctgtggatcgtcctccctggtatttatgtaaaaattcgtaatatgtgatgctctctttatctcgtttatatttgagaagcttttgccgatgatcatgtggccatggtttagagagattagaactggcctaccgttaatgtgatttttatttttcgtcaaatgtataatctcgcagaggactcctgaggaaactatatatcaagtctgtgcgttccttttcacattgttgtgtttttaccgtgttttttaccctgtttgtacagcatactctgatcacagcgttgtgatcagtttgaaaagtaagatattttttcttcggattatccatgtatacggtccattgaaaaacattgaaatttctagttcatacttctctttgtccacctattttttttcaacgaaaacaagcacagatggaatggagactatcgatgtgtttcataatagcaactcagacaacagcctctcgttttaaaagtccataaccctaaaatgaaaaggtcaggctgaattgggaatgggggctggtccaatttcctgaggacctaaaaatattttccaactctagcaactttatttatttttctcttatattttaatgtgtactctatgttgtgtatagtttaactatttctcatgcatagaataatcatattcaaactaacaatacttaaaacaccacaattccaaagaaaaataatggcttgctaagggtatcgagccagtggtaataatggcttgctaaggagcctaaggaggcagtggaggatggggagtggggaagtatcaagccagtggtcggaaatggctggaagagggctggcggtgcggtggtgcttgtgctgaagggaggacgtggagggggcgagtggtggatccagaaatctttacgagcctggagaaaatttaacaataaataaagtacttcctccgtatcataatgtaaaactttttggcattatttacatttatatagatattaatgaatgtagacaacatatatatgttaatgaatctagacatatactccctctattttttaataaatgacaccgttgactttttctcacatgtttgaccattcgtcttattcaaaaaatttatgtaattataatttattttgttatgggttgttttatcactcatagtactttaagtgcgatttatattttatacatttgcataaaatttttagattcattaatatctatatgaatatgggcaatgctagaaattcttatattatgaaattgggcatgattgcatgtagttgtggagccc

SEQ ID NO: 16251 - DNA, 1501 bp, Oryza sativa
tgcgcgcgttatgaatgtcaacgttgtattgtgtaattctaaaaaaaattatttagagttaagagtttttttaagaaaagatatagccttacccataccaagagttatccgagagtgaaggcctccaatcctatgagatctaggccagaccctatgcaccgttttctattttttgggtggcgagaggacattcccactacaaccccctccagcggcgaagccaaggcccagcgacccaggcaaattgcccgggctccacaactacatgcaatcatgcccaatttcataatataagaatttctagcattgcccatattcatatagatattaatgaatctaaaaattttatgcaaatgtataaaatataaatcgcacttaaagtactatgagtgataaaacaacccataacaaaataaattataattacataaattttttgaataagacgaatggtcaaacatgtgagaaaaagtcaacggtgtcatttattaaaaaatagagggagtatatgtctagattcattaacatatatatgttgtctacattcattaatatctatataaatgtaaataatgccaaaaagttttacattatgatacggaggaagtactttatttattgttaaattttctccaggctcgtaaagatttctggatccaccactcgccccctccacgtcctcccttcagcacaagcaccaccgcaccgccagccctcttccagccatttccgaccactggcttgatacttccccactccccatcctccactgcctccttaggctccttagcaagccattattaccactggctcgatacccttagcaagccattatttttctttggaattgtggtgttttaagtattgttagtttgaatatgattattctatgcatgagaaatagttaaactatacacaacatagagtacacattaaaatataagagaaaaataaataaagttgctagagttggaaaatatttttaggtcctcaggaaattggaccagcccccattcccaattcagcctgaccttttcattttagggttatggacttttaaaacgagaggctgttgtctgagttgctattatgaaacacatcgatagtctccattccatctgtgcttgttttcgttgaaaaaaaataggtggacaaagagaagtatgaactagaaatttcaatgtttttcaatggaccgtatacatggataatccgaagaaaaaatatcttacttttcaaactgatcacaacgctgtgatcagagtatgctgtacaaacagggtaaaaaacacggtaaaaacacaacaatgtgaaaaggaacgcacagacttgatatatagtttcctcaggagtcctctgcgagattatacatttgacgaaaaataaaaatcacattaacggtaggccagttctaatctctctaaaccatggccacatgatcatcggcaaaagcttctcaaatataaacgagataaagagagcatcacatattacgaatttt

SEQ ID NO: 16252 - DNA, 1501 bp, Oryza sativa
cctagatccatccattgaaaaagctctggatgaagtagagatcggagaagacgttgatcaagctgcagacgaagtgagtgatacagagcaaacaccatctgcttcgctcaagcagactcctccaattccttctgccacaactcatttcttgagggtaaatatctttccctggttcccttttataaccattttatcctcagccgattactcattaatcttgtctttgcagaaaaaaaattgttgtgaagaaagaaattggcaacaaaaactctcaaaccagctccaccagtaagatgttcttaatttctcattagccgatcatagccgatcttatcttacacttacctttttgcagcctcctcctcctccttctcctgttcaacaaccatcaagcgatcaaactccatcggctgtagggagtcaccatgttgaagaagaagtacaaccagctgctcctgctatcccagtaagttttcctttgacacaaatactcagatcggctatgtctatttggcctctaactctctttaaatcattattgcaggtcttagccgatttgttctcttttgatatcaaagattattttgatgagacagaggaagaaaccacaagcaaggctctagcccccctggatgacactgtcaagaaaacacttgaagacatatcccttcggctagaatcttcattagacaatctggtagccgactgaggttcaattcgggcacgatttgcagaaatccaagccctggccctagacgattcggcaaacaccattactccagcagtattccttgagcaacaccaatttaagctgaagaaggctaagcaacgtatagccgatcggcgagagcggatgaatatcgaagccacgattcaatccaatcggcagctcgtgcatgaagagaaagccaagttagatcacatctctgttgggccgattcaatcgaatatagatcggcttgaagctcgcaaaattgatctaatagctcaatgtaacatcctgaaaattcccaataataaaaatcactaaaatttcgaactttttaaaacttttgcgtcatgctggttgttatgattactattgcttgccaaaccgtaaatgatcacaaagaaagtaaagaaaagatctacatttaagcaatagatataatttacaagaatatgttatttattattaaccctacaaatattactgctcaagaaagcaagccaaatcaagtataagtcaaatgttaatttctatcataaatcacagatcaaatattaaatattcgaaccatgctgatagcttgatgccatgattagctaaaagaaatagtaaaatcaaatctaattcatttgaattcaatctcacatgaaatgatgatcaccactataatgatcgtgtttataaataagtaattcaccagaatatatagattgatacttagaacatttcaccagttcctcatgacatgaaaatcactcatataaaataatggtcatataaataaattaagct

SEQ ID NO: 16253 - DNA, 725 bp, Oryza sativa
tttgtctaacggttaatcctgaaaaacttgtcgatccaacagttaaaactattttgatgatgtcactagacgtagtgcctgtttgtggtctcacttatatagaaagcatagataaatacttcctccgtctcatattataagattttctagcattgttcatatttatatatatgtcaatgaatttaaacatgtatatgtgtctagatttattgacatctatatgaatgtgggcaatgctagaaagttttataatatgaaacggaggtagtacatgagttttcaatacagaaaaaaaaaggccagaaaaaaaaaaggcaaccgcattgaccgttcagctatcatagatttagttaacaaaacaaaaaactaaatccccgcattgtttgttatcgtagaacactaatatttgaatatagtgcgatgtggctatgcccttggaatgcattgcaacgggatctaaagaatacgtgttttgtagggtatagtttttcaatttggtttttctagtttgttaattttcactaaaaaaatatattttgcaatgggatgaggatatctgcgtcatatgattcacagaaaccatgaaggcatgaaccgcttggcctaggggggttgtgtatttggtttttatatcagtgaacatttgtcgagaacttacagtagtctgaaggagagctgagacgaaccaaccaaaacggtgaaacctcaaacaggtgaacatatcc

SEQ ID NO: 16254 - DNA, 1501 bp, Oryza sativa
atacccatagatgtctccttgtctaagtagaactagagagataaatatggatacgatccaagtagtcctggtcgtttctaacttgaactctatttgtcctttcttatcggaaactccttctatatacgagatgcggttctatataagacttggtatatggtggaccctaccgagtttagtcgattactattgggcatgtgttgtctccgacgaggcatctccaaggttcgaccgaaagttctcatgttcatagagttcgcttcaacatccgattttgcaaggcccgtattgcggctcgatgcaatcttttgcagtcgacctcgttttcgccgtagccgttgtcggcttcattgtctaggtcactgaatcaggagaagaagcgaaacgaggctagattgcttttctgttttcttttggagtccttatctgcatatttcaagaatcttttgcaagttgtgttatacttctacctgcttgttctactaagagcaactgaatctctctttgagagaggcctaaatcactcaatactatatattgaactaagtgattcctgcggaaattactaagcaattctcatttctattttcttgtatatacatatatttctattagtatatgtatataaaattgattgaatgatggttgggaatagtaaatatgatatgatatcttggttgtattattgtccaattgagtacctgattaaatatatagcatttagatagggtggtgattaatgacgttgtttaattggtgaagaagtggaggggacttttgtctaacggttaatcctgaaaaacttgtcgatccaacagttaaaactattttgatgatgtcactagacgtagtgcctgtttgtggtctcacttatatagaaagcatagataaatacttcctccgtctcatattataagattttctagcattgttcatatttatatatatgtcaatgaatttaaacatgtatatgtgtctagatttattgacatctatatgaatgtgggcaatgctagaaagttttataatatgaaacggaggtagtacatgagttttcaatacagaaaaaaaaaggccagaaaaaaaaaaggcaaccgcattgaccgttcagctatcatagatttagttaacaaaacaaaaaactaaatccccgcattgtttgttatcgtagaacactaatatttgaatatagtgcgatgtggctatgcccttggaatgcattgcaacgggatctaaagaatacgtgttttgtagggtatagtttttcaatttggtttttctagtttgttaattttcactaaaaaaatatattttgcaatgggatgaggatatctgcgtcatatgattcacagaaaccatgaaggcatgaaccgcttggcctaggggggttgtgtatttggtttttatatcagtgaacatttgtcgagaacttacagtagtctgaaggagagctgagacgaaccaaccaaaacggtgaaacctcaaacaggtgaacatatcc

SEQ ID NO: 16255 - DNA, 961 bp, Oryza sativa
  unsure (1)..(961): unsure at all n locations
caatcagcttcatcgaaggagaacaatatatcccgttctgtcgtgcttctgcaaactgtgctgctattaaattgcccgactgtctgtagcagcnaattcttttgcgaaaaaactttgtatgaattgctctttatgcatgtaaccaggattctatattatcatgcctccaccgtgataatactgaatgctggtagctatctaaaactacttcgtctgactgagcattaccaggtttattcaagcatccagtttagttcacattcatcgacccaggatatctgtgcgcttactgaccactatcggcctgctttcaggaaataaaagttaatcaccatccagatactaaacctgaatatatgtttcttccatacaaaacatctatagaccataccacaccgctgtatagtacaaagaaccaaaacacacacacacacacatacagacatacatatatatatatatatatatatatggtattgaatgctagggaaattcacccatcaaccaactccatactgaaacaacagcctacgcattctttacacactccatccacaccatcgcttgcccgtacatgctgcctttgaagagacatgacatatttgcagcgagatgccatacagcacatcctattatttctatctctaccacacttatcttctcctcttcgccgctacttgcacctccccaccacatatctgctgctcttcgccttcccgtcagcaagaacagctttcacaagctcttcagcctccctccccaggtaacaactgcagcttattatcttcagtaatctccatatgttcattcctatccctcctctccctatacagaagtgggtcagatccaaacatctgtaatagaacaatataggaaagtattagagcaaacaaactaaacatttttttgatctctgcaatgggcacgcgttaaccaacaggtcttctatttctttcctaga

SEQ ID NO: 16256 - DNA, 1501 bp, Oryza sativa
  unsure (1)..(1501): unsure at all n locations
tatagcagacaaaatctaatggaattcttattatgtgtaacataaatatgattactacagacaaaacatgctctacttggaaataactttttggatttcatttgcagcaaagaacaacacctacctaacatcatccaatgtatttcctgctttcatagtatagctctggcgtgggcgaagcaagttcaagtcagaatctatttcagtcgaagattttgagatggaaaactcatccttattttcagcagcagacccatagctcaacatcacagatacaagaatacgggaggcgatagctgaacttatgggcgccgctttcatgattgcaccaactaatttatcaagccgatttagatcagtcttcattcccaattttcccaacttgctgtttgtattctccatggcaacatgcagaaacaccagatcaaattcagatgtctcctgaacattcccctctgaaaatccaagcagacttaacgcctgggaaataattccagcctccttagaagcagcggaagatccagattgtgcaactaaatcttcagtcccggatacatgaaaaccaagatttgctgcaaaagaactaacagggggcaattggtgaccatggcagctctgatccccataaacctgacattacaaataccacatgaaagctagttagacctaattcatgaacaatgttacagaaaacaaagcaaaaatcacacacatccaaccttcagatagcttgggaactgctagttgcagtggatccacctgggcagtctcttgaccagttttctcagtctatcacgcaaaaattacaatcagcactacctactctaaattctcgcacaatcaaccctcctaagtgcgaaccggtggaagcaagatctcaccttagcagggaagagatcatcgtacacgtcgagcagctgcgcgagctcaagaatcgtgctgtcacgcttctcctccccacctacaacgaccaaaacaaggaaaatctccattcggtcagagcagcgagtagaatcacagagagagacgacgcagaagagagaatcgctggatcagtagtacccactctcgagagggggcgagcggagggagaggaagccacatgacgcgagagacgcgaaggcgtcgaggtggattccttccccttctactccggnntacgccgacgcgacgctcgccggagggagcagcgccgcgtgccccgcggcgtagagcaccagcccgcggctcggcttgtccgccattgctgcacctncccttntcttctcttcccccctcctctgctttattcggtgggccccagacgtcagcctcacccccacgtgtcaacctcccgaccccacgtgtcatcgagatcactatactagcccggcatgtgggcctaactgggccggcctggcacatgggctgaattgggccgcataggtgggtcgcttcttgggcctctggttcctcgactatacgtatacaaaagaaaaaaaaaagaagagaaagagaggga

SEQ ID NO: 16257 - DNA, 578 bp, Oryza sativa
cgtgcatgcgcggcccacaccagaaagtacgtctgacacctccggcgatcgaccaccgggttccgctcgccggcaaagtcgccgttccacgttcccgccgccggcgccgccaccgccggccgtaagttgaatctgcctccgaaattcatcggctcgatctgttttaactgttttagagattatctccattattattgttatttttttccgtttttgtttctgagcatttcttcctcagttcagagctaaccgtgtcacagttactagacaagctgaacgaactcaattttgaatttctagttactcgaggataatctgattaccgagtgataatccacggtatatacatcattatctctccttccgaatcgcatgttagagtagaggatagtgctaattaactagaggatgagataagccgttggacacattcctgcatgcaatgcaaacgcaaagcaagtgtgatccatccatgcgtgaggatcggagtacgtgtttatctgatggaatccgcagattcctccggaatcagcagcgatttctccctccctcccgatgaatcgccgccatactctcct

SEQ ID NO: 16258 - DNA, 1501 bp, Oryza sativa
gagcttgtttcacaaaactatagatattttgtacaatctatcataaaactatagatttaagaacttctttcacaaaactatatatttagtgtattcgttcatcatagaactacacatttagtatcttcatttatcataagattatagattcagtgtctctattatcacaaaactatagggtttaacaatactaaaacttagttttgtgataatgaagacactaaacctgcagttttgtgataaatgaagatattaaacatgtagttttgtgaaagtcttcattatcacaaaactataggtgacggagcgtggggctcctcaccgggagaccgcgcaggcccccctttgccggttcggccgggggcgctaagtgaggttcttcgccctcgatctgatgaacgtcagcgagagaggaagtgcacaagacacgggcgacgtagacaggttcgggccgctgagaagcgtaacaccctactcctgtgttctggtggatctgtgtgtgaaggaatacagagagccggagagcgagagagagttcaggctctagcacccattcgccagagtcccaactcctcttcctctttttttcctctttctccccctttttccttcctcctaggcctgggcctcctttttatctggtcaggggtcaccacatgggcctccagctgcctaagaaaggaaacatgctttttacaatgagggctagtctacagccggaagtgacctctgacaagcagagcccacgcctcctgccccgctcgccagcttttccggtggacgcccatttcaaccttcattcaatggccagcgacttccttgccatgcttgcgctgaagcttggaatggatttgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgaccggtcacggaccggataagcgtgcgctgcgccgcattaaatgcggcgtggcgcgctcgtccaacccgctataaatgcggttaggtgagccccgctgtgctcatctaacccacacacgtggcgccaaaaccacagggggtcggggcgccccagccctcggggccgaaacgggggcgccccagccctcggggagacagagggaggggtggccacgtcaccctcgggcccgacccccccgagggggtcaggccacgtgggtgaccgcggctacccaagcctctagtcatgatacccccggccccatgtcaccgacagtagcccccggcgttacgccagggcgatcgcccccctcgagggaagcgctcgggcgtgacgccactccttaggcccggtgataggtggggcaggtccctacaggcgggcagaaaacccagcggtcgcaaatcgcgcgcatcggcaagggaaaaccgaccgacaataa

SEQ ID NO: 16259 - DNA, 1501 bp, Oryza sativa
tcgtcggcgagaggggtgtagaaccaatcgctcttccagtcgtcccactttttgcggaggacgcaaggaatgtagcggttcagcacctgcccccgcggctggaagtagcagccaccgactaccgtcggcggcgacgccggttgtacggtgaagaaccaccggaacagccggagagatgggcgcacctcgataaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgtggcgccgggcgtccctcgcccagcgcgaccacctcccggccagtggcagattccggcatgaatcggcgcggcagcccagcctgcctctcgctcacgatgcgggaaggcggcagcacgctaccgtcgagcggtgcggagccccgtgccatgacgccggcggaggaggagcttgagagcgagcgagtgcggcaagggtagggcacaggaaacgaagagttagagcacaagtggcgaaggcaaggggaagagtggcgagaggaaggaaacgaatcccttcctcggcgtctttacacccttgccaacgctatgcccggctcctcgcttcccgcgcccactacctcgccccctcgtttctcgcgcccacgcctccactaaccccactcgcccgtttgcggcgcacgcggcagatgtgcggctgtggcggttgagatgggacagatcgtgcgcgcattaactacgctcgccaaccgcgaaaagcgccatcatcatgtctccaggcgaaacgaaccggctcgtcccgattcgcgcgctgctcgagtaatgtagcggtcttaaagaggccgctcattattgtcggtcggttttcccttgccgatgcgcgcgatttgcgaccgctgggttttctgcccgcctgtagggacctgccccacctatcaccgggcctaaggagtggcgtcacgcccgagcgcttccctcgaggggggcgatcgccctggcgtaacgccgggggctactgtcggtgacatggggccgggggtatcatgactagaggcttgggtagccgcggtcacccacgtggcctgaccccctcgggggggtcgggcccgagggtgacgtggccacccctccctctgtctccccgagggctggggcgcccccgtttcggccccgagggctggggcgccccgaccccctgtggttttggcgccacgtgtgtgggttagatgagcacagcggggctcacctaaccgcatttatagcgggttggacgagcgcgccacgccgcatttaatgcggcgcagcgcacgcttatccggtccgtgaccggtcgcggtgtgtgaccggtcacagaccggtcagatcgcgggttaggtggcaacaggcggcctgtcacacgcctcgccccgtcccgtcggaa

SEQ ID NO: 16260 - DNA, 1501 bp, Oryza sativa
ctgacaatcgatcatttagcaggcttgttgcttcatagaagcaacatctcaaatgatgaaaatgcaatgccacttcacatcaccaatcagctcagctgcaatggctggcatcatctccatccataaccggaggcacggactgctcggcgacggcggcggccaacgcgttgcaggccgcgtatatcgccgagcgctcgtcgtggtacgagtcgccggcgaggaaggtgtgccttttgccccggacctcgacggcgctccaggccggatccttcttgattcccagcgaccgcatcgcctcgtgcgcgccggcgacgctggcccacatctcgcgcgcggcgtacgcgttcgccaggacgacgtacttgccggcgttccccggctgcagccggaagaagcggcgcgcggcgagctcgaccagcctcacgtcgccgtgcttcctgccggcgccgagcagcgcgccccagaccaccgagtgctcctggcagtccggcaggttcttgacgagctcgtaggcgtcgccgagccggccgaccctggcgagcatgtcgaccgccgccgcgtagtgctcgcccctcggcgtgaggccgtagcccgacgacatggacgagaggtggcgcagaccctcgccgacgagcccggcgtgcgcgcacgccgagagcacggcgaggaacgtgacgtcgttcggccggagcccgtccacccgcgtcatccggtcgaacagcgccagcgcctccgcggcgcgcccgtgctggccgtgcccggagatgacggcggtccacatggtgacgttccgcgccggcgccgccgcgaacgcccggcgcgcctcctcggggctgctgcacttgaggtacatgtcgacgagcgcgctgtcgacgaagacgttgccgccgccgacgcgcgacttgaccatgacgccgtgcacgcgccggccgtgctccagcgcggccagcctcgcgcacgcgcagagcaccgacgcgaacgtgaactggtccggcctcatcccctccgcccgcatcgacccaaacatctccaccgcccgcgcctccgcgccgccgcgcgcgcacccggatatcatggcgttccacgccacgacgctcctctgcggcattccgtcgaacaccttccgcgcaacaccaagctcaccgatcttgacgtaaaagatcagcagcttggtgacgatgtagacgccgccgccaaaccccaccgacaccatgcgcgcgtggatcctcttccccatcctcgcgtcccgccggttcacgcattcctgcagcagaagcgcgtaggtcccctcaccggggcacaccgtactccgccacaggagacccaccgccctagcgagatcgccggcgacgcacagcgacctcagcattcgcgccaagccaacggagcccatgatccagctgcccaactctcttctatccgaattcgagctcgctctaatggcgtcgcatctctgcgccgctcagattagtagtgtatacaagatgaaatccgagaccta

SEQ ID NO: 16261 - DNA, 1501 bp, Oryza sativa
ggaggaacggcatctgcctgaggcaaagaaggtgtgagccagtgaggcagagtggtgtcggcaatggagggcgacgagctctacgcggcctgcttgctccggcggctctcccatgcatttcccccctcgccaccttattcatgtgagtaactggcatctttgttgaaagaggaaaacctatgtcaagggatgagggcctataccctctcttctccacggcatcacgcagcctaggtggaggcaagaagtaactcaccagcatggtgcactgcgaagggcctaacaccatgtctcgacgtgcgtcacccatgccctacccgagcacgctgctcgcagggcgtgccgcgtcattcggtgcgcgaagtgctagcgccctcgacgtcaccgcacacgatcgcgcagccgatgtccacacccgcgcacgcgacaataggccggagaaaatatggctctagtagacacttcatcgccctctcttttagcaacagtctagcttcatctccactctaaaccttgtatgtctagtatcttcttatgttatctaccgttgcccctccggccctcctgccaccatcaggatttccatcgcagagcagaagtggaaatggaagtgatgggtgtacctgatctgatggtggctgctctagacaaaatgagacaaaaggaaattatactaaggcaaaatttactttagaacactaactttctaggacattctacttttacggctttatcatatggtactctagtgttgtggcactttactataagacacctagttcattattttaatataacatcttcaaatagagagataaaactttataaaagaagggcgcgcgcgtgggccgcgtgggctggaaatgcgcgttggcggcgcgcacgctaactatcttttccgggccggtttccctgattttttagcgattttgttcctataagtcggttatagagataaggacgtattgtgcctatatgtactcgtgtccatgataaatccaagtcatcgcgttgactctcatacgccctcccgacgctgctttcaccgtactctcttttgcaccattactctccgtcgttgatctctcctgctcccagcgctacagcatcggcctctccacgctcgtcgtaagcatagatggaatatggtctcggagagaagatgatagcaaacttgacggcaatagcatgatttgaattttagaaaaaatcagtgacatatagtaggttttcaagaatagtagtgatatttttccaaattggtaaatttgtaatggcaaagggtccatttataacacataaaaagaacatgtgaattttaataggagtgacagtaatcatatgcctggcggttgttggaggtcacctttcattgactggtaatcgcactaatgattcctttgctttggcaaaaccagaaaatacccaaaaaggagggtgctaagatcgaaagccacatcatccctatagtaagagcatcaaacttactttaatatattat

SEQ ID NO: 16262 - DNA, 1501 bp, Oryza sativa
agaaggaagtcggctgggcctggctagcaggaggaggagcccattaggcattaaggagcagcccattccgaataaagaagccaactaggcctgaccgcatcgtcgtcttcatcggcgctggggcaccgccgcgccgtgttgggcgccgccaccaggtcgccgacgccggccgcaacttccttcgccccgacggcctccgtcgcagccggccacctttccctcccccatgctccaccgccggcttccgtgccaccaagccaagcgccgagcgccgccgcaccgccccagcctcctcctccccaccgatgccgcccctttctcctctctccttccccccaccgccgccctgcgccaggccgccatctccggcgcctctctcctctcgggcgcgcgtgaaggagccaaaggcagagaagagaacaagagagaaaacagagaagaaatcgagagagcaggaaaaggaaccgagagaagggaaggataagagagagagaaaataaaagaaagagaggaaaagaaaggctgtgggatccaccggcgggccccaccatcttgactcctctctgtgatcgacctggaaataccaaaaagtctagtttagcatgaaacttaattacaacggtagttatacagtgtcaacataaaagttcttatgcaatgtgccactgtaggacgacgatatagctatgtcaattgatgatgaaataatgaatgatatttgacaaggagctgatcagctgaagccatgccagcttgtgagcttggtgttctcgaagacttcaaatctatatcctaaaaaaagtcggacaatattagttatgctgtaatcctatcatgtaagccacattgtatgctttagccacattgatgttgaagtatcattgaactttatttatattatttgtcaatcttattgtcaacttattaatcatcatataaaggtgttgtgtggcagcataatgatgcaagggtgaaattataaggttatcttcatacatagttaaatgcgggatgataccacagttcgctgtttccgacatgaattttcgacttccgtccgatatcggtatattcccgttccgacggttccgtttccgagataccgatataaccgatatccttaccgtttccgagtatacgttccgattccattttcgagaaaataaaatgaaaatggaaatggtagagggtttttccgaccgtttccgaccgttttcatccctaatcccacccatgacgtatctataagatcatacacattgcatcatatttgttgcgtcaccgccgtatataaactttataatatattaaagtaagtttgatgctcttactatagggatgatgtggctttcgatcttagcaccctcctttttgggtattttctggttttgccaaagcaaaggaatcattagtgcgattaccagtcaatgaaaggtgacctccaacaaccgccaggcatatgattactgtcactcctattaaaattcacatgttcttttta

SEQ ID NO: 16263 - DNA, 1501 bp, Oryza sativa
gtgcttgactgtattagtggaagagtggaagggcggttaatagcttgaagaatggaaagagtcttttcgtccctctaagagcagggtataatagcatactataagccagctataaatatattttaagaagataaaatatgagagataagagtagcgggctctagatttgtagccagctgcagcacagactccaaaatgtatgtatgtatgacgggtgggaccagacattaattatgtaatatatgtttatagataattattgtatgaattggctattaaattgactataggtgatttggagccaatagttggctatactgttaaacttgctctaaaagagggaggggagcagtgaggacaaacatctggttcattttcaaaaaatggggaagaaacaaaccctaaaagtaagagtaaaatagcagttgtggttaaaagtgagtgtatgatacaattatccctataatatattaacaagagtaaattaaccctcggtacatgtactgtccgcaggaagttccgcccggaacctttgaagcaaaagcttcccctcacggtggcgtgacatgcaccaatctcgccccaaaaggagtctagtagtagcggaactgtgggaatggagtagctagccggcgagttgccctagtggccgagtcctctcttcttctccccttcttcacccatagtcacagtagtcagttgtcactccacactgctacctgctacattgcagctagctagccatggtggtcctcgccgactcagcagcaaggaagctccttcatggcgccgtcggccgagcccgcaccctcgccggcgacgccgccgtcggcatgagcttcggcctcgacggcctgtggcagctcatcgctggcctcttcggcggcctcatccacctgcttctcctcccgttccaggcgctcgccggggccatcgcccacgtcttcgaggccctggggcatgccatccagtggctcctcgccggcgtcgtcgcggggctcgggagcttggtgcacctgcttgtgatgccgttcgagatgctgtggcgcggggtccaggcggccgtcgccggcatcggccatggattcgagtccctggggcacgccgtccaggtgttcttcgccggcatcgtggctgggctcgggagcttggcgcacctgctcgtcctgccgttcgagatgctgtggcgcgggctccaggcggccgtcgccggcatcggccatggattcgagggcatgtggcagggaatacaagggttcttcgccagcatcgtggctgggctcgggagcgccgcgcacctgtttgtgctgccgttcgaggcgttctggcggtggatccaggcggccgccgccggcatcagccatggcttcgacggcatgtggcatggcatacagggcttcttcgccgacgccgtcgcggcgctcgtcagcgtggcccacgggctcgtcctgccgtccgaggcgttatggcggtggctgcagacggcggccagcggcatcgg

SEQ ID NO: 16264 - DNA, 1501 bp, Oryza sativa
tgaacaggtcgtactccgtcaagatcctcccgtggcggcgcggcggcggcggcggcggcccggggaggtacgaggtgaacctgcagcgggtgtgcttcaggacggtgtacgtggcgagcacgacggggctggcgctggtgttcccctacttcaacgaggtgctgggcgtgctcggcgcgctcgtgttctggccgctcgccatctacctccccgtcgagatgtactgcgtgcagcggcggatctcgccgtggacgccgcggtgggccgcgctgcaggcgttcagcgtcgtctgcttcgtcgtcggcacgttcgcgttcgtcggctcggtggaaggcgtcatcagaaagaggcttggctagctagctagctagtagcgagtaatttagcctggtcatcgagaacgaaatgtaaagctagctcagtgtgccatttcatctgaagtaaaaaggcgcggtgaactgtacaatacatatgcagaaaaaatgataaacataagatgttggttattacttcctcggtttctaaatatttgacgccattgattttttaaacatgtttgaccattcgtcttattaaaaaaattaagtaattattaattcttttcatattatttgatttattgttaaacaaactttcatgtatacatatagttttacatatttcgcaatttttttaataagacgaacgatcaaatatgtgctatgtcaaacatttagaaacagatggggtgccaaagtatcagctactcagaaattctgacaaataatgatagctgtttgttactgtcccttccgtttatacccatttcatatttcatattgtaagtcgcttaattttttaagttatttttttaagtttgaccaaagtcaaagtattatctaccgctttgaaaatatgtaggggctaaattcgatcgatgtactcatgcacgcacgtggaaaacacacacaattatagttgtgaacgcctactctctctggtttttaacgtttgacgcgcttgatttttggtgtcttcgatatatgtcttattaattttattttaaaaatacaaaaatataagtcatggtaggagtatatttaacaataaaaaattatagtaaaacaaaaaaacatgaactttttaaaataaaaagaactagaggttaacggcgttcaagcattaaaactagagagtaacacttgccagacctgaggtggtactaatcatgggccgaactcgagtccaatgtggagttggactccgattatagacgtcgacgcggctgggccggcagctaatccggtctttggggccccatgtatataacgtcgtaacagaaagggagacagattccgtgtccggtttcacatcccatcccacgctgtcgacacagcttccgccgcatccctcccctcgccgtcgcaaaatcccccccgccgctcgcgccgccgccgccgagagcgagacccgcacgaggagccaagcatctctgcgttctacagctccgggccaccggcga

SEQ ID NO: 16265 - DNA, 1501 bp, Oryza sativa
ctcggtgaacgacgtatataatgccccgaataacgtttaaagttgtaatggccatccactaggccactaatcctatctaaacaatgaaatattcccttttttttctatcgataagcaatatacacagttaaacagcgtctttcaaacaaaaaacagcgtctttgaagctgttttactccttaaaaaatcttccatagaaattttttcccaacatgtgcctatgtttgaaattgcttaacatgaagattttaagtgagggcacatgaaacgggaaagttatgattaattgagttttaattattgtaaaattgaaaagttaatttatttatattgcagaccaacttttacatagaatttttttttacagaccatactgttttagtagcttgaaaagtgtgtcggctgaaatcagatagaatttgtgtggacatgttctggtggtttaggttgagtaagagcttggcaaccaagtgtgtcggctaaaactcagatagaatttgtgtggacatgttctggtggtttaggttgagtaagagcttggcaaccctgtgttgcactgtggtctcagtagttgtttgccgcaggcttttaccctgtcctttgtttttctgattgctttaattaaccaagcgactgtgaggatttatggctggtttagaccaactctcttcttcttaaaaaaaatgagaactgctttcttcttaaataaaaacgggaacttgttgcaagtcacaggctcgccgctcgccgcacctgaggtctgaggacgggcggtggcgcggctgatgcttgcggcctcaggcaaccacaatgtatccaaaaagttaaccttaagcattaaatactgcaatagtataacaccttagccattgtgtgagcacatgataagtttagtgcaacaaaaaatgatcttaagcttaaggtgctaccacaaggaatataatacaatattttcattgctctttgcctgttgggcatggttgggaagtaattttttttcttcggtaggaccaccttgtgtttttccatgagcttaaccattgcagacattgccatagttattgctatcttcagcggttcctactcttattgtcaattgagtcacaaacattggccttgcccatgactcatcgccactctccttttcagtgttgacttgctgcgtgtagtctgcttgacctccctcgaaactagctatatttacaactatgaattacatatacttatatttgtaactgaaagtatcaaaactcacgctataattacatggtaagtttcaatattatgtgtcagtgttatggataccacatacctaataataattgactaaatctcggcaggacccaccacatactatgtcttatacggaaacaaccttcggatataggaggagttccgcataaggaaggataaccaaatttctacatggaaacgacaaggactactcggattgtatccatattggtttctctggttctatttggacaaggggacacctatg

SEQ ID NO: 16266 - DNA, 470 bp, Oryza sativa
ttgaatttagccgttgtacagatgtacacagagagatacggctgacgagtttggaagaatgcttccaagagtttaatggggggcttttagggatttcccctctctaactctctttattgttgtggctagcgacacatgttctcgtgtgtcttctagtagtgatcggtcggtgacatttgttatttgaaatcatggacgtgagaccattggatatgtgttgaacggggtgcgaggaattggagttttgtgtctttacttttgatgagaatgggatgctaagcattaaacggttcaagtaatttgcattgcaactcttgtaagggagacggctataatttaaaaagcacgtggtttttttaatgtgagtaggatttcttttgattcccaacaaaggtgtatatgtctcatttatataattttcaatatcaatatgatcgttgataccgttactcatattctacctttttagg

SEQ ID NO: 16267 - DNA, 1501 bp, Oryza sativa; identical to SEQ ID NO: 15976

SEQ ID NO: 16268 - DNA, 1501 bp, Oryza sativa; identical to SEQ ID NO: 15975

SEQ ID NO: 16269 - DNA, 1501 bp, Oryza sativa
cacactcaccgcgccattgttgacgccttgccgccactcccacctcttgccttcgtctcttcgccgtcgcacgcatcagaggccggtgcatgcgtggacgcgagacgaggactccggccatccctcttcttccccttccccggcccgaggccggagagctcgctcccgagccgtcggccgctcgtcactgcgcccgtcccggcttggtagtgccaccctccgttctcccttctcgctcgccctctccctccctagctcgcgtggtagctcggctagccccccgaacacgcatggacgccgccccaggtctcgccgccgcccgccataggcttgccgccgttgccgcccgctcccggaggccgccgccgtcgtcagccctcctcggcagtcctccgccccatccggtgccggaaatgagttccccgcgccccggagatgctccctcctccttgaatcgacctctcgtcgccccgccgcgatttccccttttgatcgccgccggccgccaccgtcgaaatccgtcgccatcgaatcccccccggcgaatccgagccggaggctcactccctcttatcctagccatcgttccggtgtgctcccgttggccctagacctctgcatcaaactgcggtgaactcggccaccgtccgccgtccatctcggcatccccccttcttcctcctctcgccgcccacgtggcctggcataggtgccacgtcggcttgacccagtcaagccggtcagccgctcgccctcgccccttcatccccgtgcgtgcggaccccggtgagccatgaggctgcacgtgggcccaccgcctccttgtcgaccggcgcaccgcatccgcacccaatccaccgatccgtctcgcccgtccccgcgtgcgccctccccaccatacacccgaccgctgccatgcgggcccatctcgggaccccgcgcggcggaccgcgcccaccccgttgggcctccctctctccccgcgccccctaatgggccgcctccccgtggccgcgctcggcccaatggccggccaagccttgtgaatccctcgggctgcgcctaagtcgcccgaggaagtctaaatccgatccctccttccttttcttttccaagggaattaataattccttttcctttagacagaaaatcaaataatccttagaaaatccatatcttctcaaccgctcacccgattgacttcgttcaacttccagtaattccgtaaaattgagatctatttaatggcactattatttagtctaaatagggtctttttcttggtcttttctttaggtttttgtttgtttgcgtaaagttgcggttatcggattttcgtcgatcgcgggttttctcgaagattcgtgaagctctgtgaagaccttgagcgaggcaagtcaccctttgaccaattgctcctataattggaaaatcattattattttgattgcagctcacattattagaatcacacacttaacatgcttggcctcggtttgcg

SEQ ID NO: 16270 - DNA, 1501 bp, Oryza sativa
gggaggggtcggcgaaatggggaaaaagtgagagaggacgacggcgatgcttaaatagggggagagggaaccggacgtggccgggagaggcgggaatcgccggccgacgcgggggagtggggaggagagagaggcgggattcgattttcgaatcccggccatctcgggcgcgggcgcgagcgggagagagaggggaatgggcgcgggagattcggcgcacgcgcgggcgtggtcgacgtggcccgggggaggcggagacgtgggcgcggcgatggttgcgggcgcggcggcgcgccgggatcggcgggaggagggagacgggcccgacaggtgggcccctgtcacgcccggaatttctatccaaaattccaaacgcttacatgtgtgtgaacccttgtccaggaatcagccgaggcacacaataacaaattgataatagagtacaaatattactctaattaataagcgaataaaatgtcattacagaggtagatagttcctctcaatcaataaaaatctaagcagcggaaaaaaaaaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttgataaaacagttaagtaattaaacaatattaatccaacgctatacaacataccctgttgtataggcccaaccattctgaacaaccatcccggctgcacagttctatctccaaaccaggaatgtaccattccaaaccaggagctaaacaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctctgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccatcaaaaccatgtgctcacaacccaccattaccaggttttagttggcacattaattaattaactaatcacgattgaccatcgtgaactatcaataagccatcatgaaataatagtgagtcattagtta

SEQ ID NO: 16271 - DNA, 237 bp, Oryza sativa
caaaatagaactccgcacgctcggagtcaaatagtctccactagcaaagttcgacaaaatagaactgcccacgctcggagttaaatactctccactagcaaagtccacaaaatagaactccgcacgctctgagtcaaatacattctactgacaaagtccacaaaatagaactccgcacgctcggagtcaaatacattcgactatcaaagtccacaaaatataactcctcacgctagg

SEQ ID NO: 16272 - DNA, 1501 bp, Oryza sativa
cctcctccatggttagcccgctccagtgcggtgaagcttgcaaatcaaggatgtctggtatctcggcgaggtcgcagcttcgggtagatgcatcaccagcggcttgaattagcagcgtcgagtctagggacaagtagcactacgtcggcttgaacagacgccggcatcgatgaggcttctgtgacgcgtagatgaatcggccaccgcaagttccccggcgacgacgatacgcgcagatggatccctatgcatggatttgtgcgtgctgtagatgaaagaaaacgaaacaatcttgctagcttttacctggactagccatcaagctcctctcctgcgcttgctgatgatcggatcaccgcgcgtgccctctcctgccggacgccgggactccggccgaagtcgctcgccgccgccggtgcgtgtcgtcgatggatggatcgccgatgagagttgatggatggatgtgttgatgctggatgggtagatgcgttgatgatgggtggcttgtggatgctagatgcgttggtgaatgaatgtgtggatgagttcgtgaatgcccctagctgccgaggggtcgacgccttatataggggtctgaggtctgtgctcgccacgtccgcacgccgtttgctccgcgtcaagttcgttgtagataaggcttgatcgatcaatttgtatttgttcatatccttctttgattttatctcttagcttctcctagcgtcaaatatctgatttgtaattcgctttgtttctctactgctgggccacagtccggtgataagcgcctcgccagcgctcgcgcgaagtaactaactagatcaagtttgttatagagataaaatcaattggtttgttggttatctcttaattcatctggttttatctcttccgcatattaacttctgaaatcttggcgcgtaggcagctaccgtcttcggccatgggccgagcccatgattaatcactcggatatgcataggttgcttaatcacccaggcatgcacacacatacgaccgtctactgtagtacatgcatgcatgcacgtgattgcctcaccagccaatcttcacacggctagttattggttaattatacatgcacatatactaatccaagtatatatattcccagctgcctgtgcatgcatttatttgcgtgtatatacatggccgagcattgtgtagaaatgataagctagccaacttacaaactgcttgtttgctttgtccatcatgagtaagtcttgtgtacacatataatcgccaaaataccatcaaacacatgccccccaccaagtaaattttgatcgtggagcgagcgaaattaacttggtgtcgtgtcggctcatgcgatacatgtccggtagagtttagtcatgcgacgaaaggactcccatgttgaagcttatctccggccgtgcgttgaaagaaaaacaaagctagaccgtcatcggccaggactccaaatccttggcagttacgagtaatttggatgaag

SEQ ID NO: 16273 - DNA, 1501 bp, Oryza sativa
gcatgcgaaaatattgattttcacagatacctggatgcaggtggctactttgcccatatgcaaaaataggttttggccgtctacagaaacaattgtttactggtgtagtatgccattaatttgcattgttaattcatcccagtatttgtgtttataaagttgggcttgtggattcacatattcgaatgcaccacattgcatggacacgaattagtaatttgtgggctctaataaatttacttggattacaagataattaagtgaaaaggagaaagggtatgtcgttgtgactttaattttctttaaaggatctatgactttaaatttaattagtagtaaaacatgcacagaggatggcgacaagtgaagcgtccgtgctatcataacggtcacaggacaacggttagatggaagtaatacatatatggctgttcttcgtcggcttccaagaaacattctaatagcactatcacttgaagattctttcaatgtctatatatattatccatgcgctatgatgagtcaatgaccgtatacatatatggcggcgaaaggttaaaatacaattatatataaatagtggaactgaaaaacacaaatatttcaacagtaaactatatttttatatatctaataaaataaaaaataaatagcaagtctgagtatatatccatatctgctacctacttccacacccttatccattaataacactcttctatacatgactatgaagtactccaccccgttgttattaccccggggcatgacgaccatcgatggatcaatataacccttgtctccaccgactgatccgagccgattcgatcgacattgaagaaagtgtcgacataccccgcatcacttcatcgctgactgcgcttgcgacgacatcatcaagatgactagatgatcaacgctcgagagtttagctacatttgttcatgtatatatccatgcatctatggctgcacatatatacaagcatgcatatagaacagtccaagtcagtcaaagatcatatatatttatatacgaacaaaaagcaaccacttctcgtcacacaagaaagttcaaacgtcttcacggaagagatagagatcagagaaaatggatgcctatttgttttctcaaagtattaatgtacaatgagtaatgtgcggtatcattttgtttaaaagagtgtagtaccatttaccaatggggtagatttttaaccgggatgttcatgcgtatatgaagcacatatacacttttttgaaaaaaaaggccccaagaacgtataataacgtgtataagtgcaaaattgaggggctttcaactttgtgcaggaagtgacagtcgtaatttccggctaaaaatgcatatagaaggacacgtttcacctttcacaccggctcaaatgtggcagtgaaacttcagttttctccacaaaaataataaattaaggaaaaaaatcgtcactacacgtcactcatccccatctcccaggcttgtccgg

SEQ ID NO: 16274 - DNA, 1501 bp, Oryza sativa
taagggaaaaaaaactcgacatgctcaatgtggaggcttgaagtccatgcatatccatctcttcgacaagctaggttaaatgcgagatacatatataatacattagtacagatcacgaatagatcaaatgatcgtaatgtaatcgtccatagggacatacataacaaaatatatatgtaatacaatattactgcatcatatgtacaaatgccagtttgtggcttgacctgcagtgatattaattaattaatatcgtcactagaggtttattatggcaggaattcgatatgatctaccgatgatagagtggtacttcctccgtttcacaacgtaagtcattctaacatctcccatatttatattgatgcgcatcaatatgaatgtgggaaatattaaaatgacttacgttgtgaaacggagggagtactaaagtttgtgggttgtgtttgttcgattgtactcctacttaataaaaaccttgtaacctaaagtgtaggtggtagtgaacgggtttgttgcacagtggttatgatattatagtatgcctaccagcccttaggttcgacacatcttgagagataatttttgagctggttttaaaaatgtactcgctaaccccttgtttaaaacacgtgttaagaaatgacttataattacgaaccatcgtgtacgagtaagtgcctcaaagcaaagggttaaagcctaaatcatggggtggatctgcgtgtcaaggagccagggttcgtggccatccttctcagagaaagtcatgagagtggtatatcccctgccggtcaattaaaaaacagagttgcacagttgcactaattacatattaactattataaattttaaataaattatgtatagaaacattttacacaaaatatattgtttagcggttccgaatgcgtgctaacgagaaataataaagttatcatttcgagttgataaacgaactgtcaaactcagccttagaagttgttattcacaagctaggtagctttagcgggggaaatatgtagtgtaaatttgaaaactcccggattcaatcatgagtaagaattttactagaagaaatttttctacttttgatgatatgaataaatatcatacatctatttttgaatcaaaggtaaatttaaattttccaatacatatgcggtttccactgcatgattggtagcgtgtgtgattatccatattgacttataataaaaagaaaaaccatgaggaatgcacataatttgcatggtagcgtgtgtgattatccatcttgtcctataatccaaaaaaagaaaaaccaggaatgcacataatttgcattgtgtgattatccatcttgacctataatccaaaaagaaaaaccacgaggaacgcacataattttattcaacttcaaacatcgtattgaacttcacacaatgacaaaccgaatccctatacttaagaacctgcccccacaagcacgcgaaagtacacctttttcccaattttttta

SEQ ID NO: 16275 - DNA, 1501 bp, Oryza sativa
ctcggccagacgggcctccaaagtggcgtagcggcgggcaagggagcggtaagcctcaaggagtaggtcgtgctgagtggcctgagcctccgaaagctcgaccatgcgagtcagcactggctgagactcgctgtacggacaagggtacctggcgtctgagtggccagaaggaaggcgtggaagctgccggaaggcggaacctccgagacggtggctgtagtcgtgggccaggcgacgaagcgcattccaggagaggtcctggtacgcgatctggagagtgggcctggccacagtgaagtggtgggggcgaaggccagctccgtgtatacctccacgagggtaaaggtacacagagagctcacagtgagggggaacacggtccacggagtaccccgtgtactcgggacacgagaagccaaggaaacgggcgaggtcacgaagctgggcgacgtggtgaccctcaccaaaaccgtgggaactgaagctggcgttcacttccatctacaattttgaaagagggagaaagatcagtaaccattttagaaacaaactattgaaaataaagaaaacaaaagaaaccttagcttttcgcaagtagttttgaacttagtatccttagggtcgtcctaagcgtcgggtttcgccctagggccaagcctgtgctctgataccatctcttgtcacgccccgaaatagtcccgaccggaactagcccgtgacgtttcaaattaacctgttaatcgataccagtcctaggaaacagtgctggtatcacagggagacagaatatcacagcaacagaggtctctttattatagagtaggagtacagtcatgttgggctacggacagatcccgagctcacaactgcattacaaaaggaaagcggaagccaggacttggaccaatcatcacaggcgcgacttgggaactaggccgaaaccctaaaactcatcgtagccggcttgctcctggaagaactcctcatcagcaggatccgcttcatcttcttcagcaactgggggggattatttatacagagcaagggtgagtatgggggtactcagcaagccaggggaaataagtgtttaatgcaggcttcaaggagaggctgttgtttttgcaattgattttatttgaactccttttttctaaaaacgactaagtgagtgcttctcaaacgacacggatgagacagtgcgtcttgtccggtcggagtatgtgcaatgtatcagtctttagatttgaaacaagattggcacccggccaacagcttttcaaacggccacccgggccaacaacttttcaaacggccacccgggcctagctgatcccgtcagctgctgatttttcaaacatcgaacccattttctcaacagcaaattcacaagcggtagtcaaacaaaactacgctaggaatcacctcacatccgcccatgaccgtgggcacggctgttcgaacagtttgttaacctctgcagagggggtacactttacccaca

SEQ ID NO: 16276 - DNA, 1501 bp, Oryza sativa
gacggtttttaaaatgggattggtgccggtttactctgcaatgctgcctccatagtgtcgattgggaaaaccgacacggaaaggggttttctaactggcactattcacgtgttctgtggtagtgcggattcctgctaatatggtggccctgtgcatatatattatcattgttactatgaattactaatccatccctcttaaaaataagttatctaatattagttttaaatcattttgttttaaattttaccaaaattatagaaacgaataaaaatatttacgatgtcaaatgtgcattgttagatccattatcgaatattgtttcataatttacttgtttggtgaggtggatattaattctctttctaaaatgttggtcaaagttagaatagtttaacttcggatacatcaaggatttcttatattttagtatggatagatggagtagtatgcattatgaagtttatgtttaaatatatatttattctgcgtgttttatcgatactaccctttcacactatattttgggattttttttctaccccttggaactagcagcaataatttctcgattccttgtttcctctttttcgccctcaaaatgtttagttgtaggacgtgcattttgactacaatgagcacaagacatgcatggcctggtaatcagcatggaaatttttctatgatttttccattgtgtgtagtgatgtctagagagtcaactatacattttttttttctttcggggcatgcaagggagtacacttatgctctcatactccaataaggttgtacaattaaagttatgacaagtgaaatatggattcacacggatacaaaatactccctctggattgatagtacttaacattttggcaaaatttgctataggaaatcgaaaaaacgtgtaattagctcgtggacactgcaagaacaagaatttgttgtcgggcatcaaaaaacgtgtaattagctcctggacactcgtggccttattttattatttcttgtgtatttagagagagaaacactaaataaagacaagtttgcccttaaatttggggaccgtaggggtggcttggctggcgttaagccgcggcggtggtgtccggggcagatgctagggcggtgctgggcgcggcagagggggtcatggaggggcaggagggcctcgttacgcttctcgaggagaaggcccacgcccgcgccatccgcatcgggatccgtggcattttcatgctctgccttgctaaggagaaccacccccgcgctgtcgccgccggagccgcggcggcgttcgcgcgtcgcgtcgcggagggaggcggcgtaggggagccggagcgcgctggccgcggtggagcggctgtgccggacggagggcgggcacgacgcggtgatcgcggacgccgggggtggcgccgcggcggtgtgtgcgctggtgcgcgccatgtccgggaagagattcgattcttctccttctcttcttaatcaaatttccaat

SEQ ID NO: 16277 - DNA, 1235 bp, Oryza sativa
ttttgtctttgcaatactaatccaatatgtctaatacaatggcatgataagaagccgttgatatatctatcacccgccgcaatacggtaaatattaaaagctatagcctagccatggtcaaaggtacggttggcgacatggctgaaaggtttatttaagaaaaaaaattctaaagctatatacagtttttactatagaacggtttaaaccgaagaaaacattatccattcggatgtaacaacatcagtgatgtctgaatgatacttatatgtataattaaacctttatagtctgaatgacaccggtattttttagagaagaatgacaccaatatggtgcagttgttgtcaatggcttttgagatagaatgtcctagctacagggtcgaggcgtgacctatacgaacaggtggtcagaaatgttaaagaaaacttctgctacgtagccaaccaaaagttgccatgttgcgcgttcaacacatattctatagagatccatgtgacgactacgtacatgatagggtttaccatccgatgtaatccggacttccctaaccaggtcgaaaacacaaattgctagtttttttttgttaattaaaaaatcaaactgaattttaaattttcagaagctagatttatccatgttttttgtttttatcgatttatcaatggttactgtaaaatccaaagacaccgctcatgaacggtttttattctcactatcagaattgtgaacccaaccttgctccatgaaggctcaagtggttcattcaatttcactgtcatttcgtgcccactaatcctcgacgagtctctctcgcgtaccaattaaacgatgaggcgttgacatccgttgctttgtttttattttcagttattcagttactacgtacaacattacagtgttaataattaacccatcttaattactcctggtttagtgcatgcagccaatcatgtgcagctacgcttcctatataaaccctacctctcgacttcgataccatgcatattaccatactcattagctcgagacagtaattaatcatcatcataatatataatgggaaggctagttgtaacagtactgttcgtgttgtgctcgatctctctgacgacgacgtgcgccgcggcgcttcgcgggcacgatctccggcgagccatgcgcggccgcctcctcgccgacggcggcggcgcggtcgtgccgctccactggtcccgcgagctctacaacgt

SEQ ID NO: 16278 - DNA, 1501 bp, Oryza sativa
agctagggatgttttgactgttcctgtttctactatatcatcggaatctgcttttagcttaactggcaggatcatcgaggagcgacgacggcgtctagctcctgacatggtgcaagctttggcactaatcaaagattgggagcaagcagatgcaaagatgcaacataccatggagaatttagagcttataaactcttttgacaatttgtttcttgatgaagtaaccactgccactgggactggatgattgtattggacttggactttattatgaacatttgattaatgctgtgggttgcactcttttttcctttctagggttttctcacgaggtgtgagtttttacctagaaaggtttttaacgaggcagccattgcactacacagctactttattcattgaaatacttgtgtcaagtttttgggtgaaagtttatgattttgggtaatttttgacttagtgaaacttttgaatcttagaactgtgatttctgtgaattgtccatgtcatctgtgatctaagtcaagttttttgggtgaaagtttgggtgaaaatttgtgattttgggtaatttgacttggtgaaatttttgaatctacaactgtgagtctgtgatttttgaaactcttctgtgaattgtccatgtcatctgtgatctaagtcaagttttttgggtgaaagtttgggtgaaaatttgtgattttgggtaatttgacttggtgaaatttttgaatctacaactgtgagtctgtgatttttgaaactcttctgtgaattgtccatgtgatatgtgatcttagtcaagtgatctatgaatttttgtcaatgtgatctgtgaatctttgatctgtgatctgtgaatttttgtaaaggtgatatgtgaatctagaactgtgaattcaactaaggcatgttcaaatttgaatttgtcaactaagttgtgtaagttgtgttatttgaatttgttaaccaaggcatgttcaaatttatatttgtcaactaagttgtgtaatttaaatttgttaactaaggcatgttcaaatttgaatttgtcaagtaagttgtgaaatttgaatttgttaactaaggcatgtttaaatttaaattttgcatgttcaatccattgatccattgaatttgtcaatccactgaattactggtccactgatccactggtcctaagccgtgcctgggctagcccaggcccaatgggctgatcgtgccttcgtgtcggcccagcacggcccgattgctactgggccgtgcctgggcctgacgtgcggcccatgggcaggcacggcacggcacgaaattccaatcgggccgtgccggcccgatcgctctcgggccgtgcctatccgtgcctgggccgggccgtgccgggcgggccttatggccatctataagtaccgcagtcgccaatccaaaactgtgacaagctaagactgaagctaagctaccaactgtccagctgagaattaacaatggcgctcactatggt

SEQ ID NO: 16279 - DNA, 1501 bp, Oryza sativa
acccggtgtactcccaggcggcccgagcgcgccgctggagcggcgcaatccgacgacggaggtagtcgccgtacaccatggccccggtgagcccctgggatcgcaggcccgcgaggcggtcgaggacggcgtcatagccatcccccagatctaccggcgcccgccagctggaggcctgcgccgggggctgacttggaagtcggaggcgcgcttcgtcggcgaggggggtgtagaaccagtcgctcttccagtcatcccactttttacggaggacgcaggggatgtagcggttcagcaccggcccccgcggcaggaaatagcagccgccgaccaccgacggtggcgataccgactgcacggtgaagaaccaccggaacagccggagagatgggcgcaccccaatgaacatctcgcacaggtgtgcgaagatgcccaatgtcatcactgcgttgggggtaaggtgcgccatctggagatcgtagaactccaggacatccatgaagaaagaagaaaatggcggaaccagccctgccattgcgaaggggagaaagaagacggaccgccccgggtagtctggcgccgggcgtccctcacccagcattactatctcacggccggtggcagattccggcatgaagcggcgcggcaacccagcctgcttctcgctcacaatgcgagaaggcggtagcacgctaccatcaagcagtgcggagccccgtgccatggcgccggacgaagagaagatgaagaacgagcgcgtgtggcgaaagaagggcgcagggaagaaggagttaggacgcaagcggcgaaggcaagggaaatgatggcgaaaggaaggagacaaatcccctcctcagtgcctttatacccttgccaacgctgtgcccggctcctcgtttctcgcgcccattatttcgccccctcgtttctcgcgcccacgcttccactaatcccattcgcccgcttgcggcgcgtgagatggatatgcggttgcggcggtcgagatagatcgtatcgtgcgcgcgttaattacgctcgccgaccgaagcgacattaccgtatctccaggcgaggcaaatcggctcgcccagattcgtgcgccgctcaggtgatgtggcagtcttgaagagaccgcccattattgacagccaaattaccattaccggtgtgcatggtttgagaccgttgggtttttgcccaaccatggagaccggtcccacctgtcaccaagttttaggagtggcgtcacgcccgaccgcttcccttgagaagggcgatcgccctggcataacgccgggggctactgtcggtgatatgggaccgggagtatcgtgaccagaggcttgaggcagacacaatcgcccacgtggcctggcaccttcggggacgacgggcccgagggtgaggtgtccgccctcctcctgatttccccgagggggggggtcgggtgactcctgccccggccccgagggccgaggcgccccgaccccttgtggagtta

SEQ ID NO: 16280 - DNA, 1501 bp, Oryza sativa; identical to SEQ ID NO: 15611

SEQ ID NO: 16281 - DNA, 1501 bp, Oryza sativa
ttatgataatttaagggttctatttttcttaatatatctttaaaaaccattcacaaactttgagtaggagatggattaaatacttacgacttttgaatcattttttctcaagtaaataataaactattgctagttagatatcatacaggccattcatatacataccgtgttatatggccacaaatgaaaaatgcgagagcaagatactcaaaattattgtgataaattgtctcgtgaagacgcatgatatagtaggaaagggagggaagtgtatgcatggaaaaaaagaaagggaaaaatgaaaaaagggacggaaagcgtacgtacccacgtacgtaggtgcttacctatgccagcggatgagaggtcggaccttgtagtatttagtttgctctaagattaatttaatatagcggtttataatattgggcgtaccgatttaaccgaaaatcaagtaatggatactttgcttttttttccttagaatttctaatatttcctctaatttattagagcaccacgtgatagcttgagagcattttaagaaattttaaaggacttaacacatgtaattagaatattaaccgcttaatatatatgtatggggcatatggtaatatttgttctagcttcgtgcatgtttatatacatgtagagagaaattaattatgtggctagcaagccattagatgtttaattagtagcaattaattttgacaccaatctacagttgttgatagtagttcgtacatattcatcttacgactctgattaaccgttgatccctaatttaatgatcaccatgactagcatgaaaaaatatatactactcagggtttagaactgctaaaattgatgaattatcttatttatgtgatagctattcgagggtataaatgaatgaattgacttctagaaagttaaaaggttgtttaaaaatgacaccatttagaaacttggaaagcgtgcaaacaaaaatccaactatagaatcagggaaaaaaagagggtcttaaactcccttatagcacccttgtctctgtaagagttctattgatattcgttaatattgtgctcacatttataacataatgatttcttttacctatacaaacaaacagtacaaaatccaaatatgacataacacagtacattataattattctgtaattaactctcgattccaacttaaatagagcaacaaatagtataaaatccaaatacgacataacacaatacattataactattctgtaattaactctcgatttcaacttaaatagagctaagtgttagaaaaaacacaacccttattgcatatatttatggtgtggtacgaagaaaggcttactctgaacatattctttgcttgttgcaagacaacagaatcagtgcaatatcgcccatgaacagataaactacaccatcaaccagccactttttctagaaactcccatcatgcaaaaagctaggtcgaaggaaatcatgggtgtctatctgtg

SEQ ID NO: 16282 - DNA, 698 bp, Oryza sativa
gccgaggaaaaacgatatccttgatagaagctgattaccaagatggtggcccttgttaggcaggctaattgaaaaatggagctctggcttcctggagacctggacggagtacttttctcaggacaaggaaatgctagctgaaggcctgcctgaagctgcactacagacttttccttacgatcactgtatttcccgttcgattttcgagtaacctaactgtttgagttgtacgtcagtacgtgttacggtaccgcaagcgactttctggtttgtaacatttctatgcatgaacctacttatgctaggatttcaattgtcaaccgagtatcgcggcttcatcttacgcggtagagcctgttgcatccataccatataggagtacagttggttgcattctctttttgtcaggcacacatgatcacatcagagtaccatatatttctttccagaatatagtactcatgttgaatcagtatattctgttttcagtcactttattgatcaaaatttagattttagatgcttatattccttttccaagcacctaattagctgaaaatatatggatttatgtgcattggaattagtacaaagtttaaatatatccttaagatgcttataccattttggagtgttgggactagtattttgatatcttccgttgagaaaagtacagatctgtctggtgtatgaaataa

SEQ ID NO: 16283 - DNA, 1492 bp, Oryza sativa
atgtttcgaggatcggataatcaggttgcctatctcggatttgtttgcgttggagcaaggcaagttattattccacccctttgagcattattatcctatattctatatctctattattccatgcattagccattcatgattttaaatgcataacttgaacatatagcaaaccagatatatgctagattttgcttagccatgcctagttagattgcataaaatataatgaacttagattggaacagtacggtagaaatggttgatttccgggtggctagtactgttccaaccgacataagattgccaagtacatgtgaagaacgaacgagtacgaccgcaattctagaatggggacagacttagcaaagtaggttatctaacaaaggtggtacctctgtatagtggttcttctttaagtcctcgcgcaggaggcaaatttacgccgagcagggcgattataatatttaccgaggcgcgggtaaatatattgattattgcgcgctgtgtgtgtattgtgaaaacctggttgggacgacgggggtctctcaaccagttctctctaaagacctcgggaacgccagaactcctctcgctgctgataacgttacgttcagagcgcatgaggatgagagttcatggaacaggtgccactgatgttagtaaccgaaaagctttgccatgactaagctgatgaatattagcatgtcatggattgcgggtaaagcgtacatctactgcagtatgagtatctctgaaactattcgaatagccgtgctcacggatattgagcatcgggactcactatggcatcttggttagaaatataactccagatttattaaatactgttgcatttcaacacattatagactttctccttctaatttctcagctttctgcaaatagatctagctctactcaaatactattatttcatacattcatacttaaatataatagcttgctgagtacgttatactcacccttgcttcaacccctcttctttcagagttaatttggagttcttgccgaagccgaaagttcaatcatataagttagtttcatttcaacctagttttcaagtctagatttgttagatggtttaagtctatagtaaaaccacaacttgctgagtacgttatactcacccttgcttcaacccctcttctttcagagttaatttggagttcttgccgaagccgaaagttcaatcatataagttagtttcatttcaacctagttttcaagtctagatttgttagatggtttaagtctatagtaaaaccacaatattttaacctagttttcaagtctagatttgttagatggtttaagtctatagtaaaaccacaattttaaaacattaggattgagtcattttatagcttctgttgtattagttagccacaattttgtaaattcccctattattttgtaatataaactccttccgaatcgaatcattagttttgggaccagatagcgctatttg

SEQ ID NO: 16284 - DNA, 1049 bp, Oryza sativa
aacctagtaagtatcacgtgatacatagcagaattcgtcggtacctgacatgatacctcgccgagtatcacgcgatacgtggtagaaatcgtctgataccttacaggtatcacatgatacctcacgagtatcacacgatacgtggtaaaaatcgtctgatacctgataagtatcacatgatacctcacgagtatcatacgatacgtggtagaaatcgtatgatactgtaacaccctaaaaaaaaaaggcaggcaagctagcagcagcagctgggccaggctcggtagcaggccggcccaagcggcagtagtagcaggtcgctacagtaccgtcgtggtactgtagcagccgattagtaccacctcgcctaactagcttgaggagcaccaagatataaggacgagagcctagaggctgttaactctgattctggaatttttgctttaaagcgaatttttgctttaaagcgaggatgaaaaacgtagtgagttgcagtattaggtgtggtccaactaaatgagccgttttcgggccctgcacaaatggtatcagagcagactctcgcggttgcgcgtgcgggcatatagcgcatgtgggctccgtgtgaggcacatggcatatggcgccggcattggacggtacggtcgtgcgccaagagagggcggcgtgttcgacagttcgacggggtcgtcgaacccctgagggtgggtggaatgtaacaccctaaaaaaaaaaaagaaaggcaggcaagctagcagcagcagctgggccaggctcggtagcaggccggcccaagcggcagtagtagcaggtcgctacagtaccgtcgtggtactgtagcagccgattagtaccacctcgcctagctagcttgaggagcaccaagatataaggatgggagcctggaggctgttaactctgatttcggaatttttcgttaaagcgaggaccgaccacaaatagcgctatctggtcccaaaactaatgattcggaaaccgacatgtttatactgtatcaagcttcggaaaccgaccacaaatagcgctat

SEQ ID NO: 16285 - DNA, 1501 bp, Oryza sativa
gtgtatgtggagcttgatagggataaatcgggacatacctgcatcatatatattgcaaagccaaatacttggactcaagaagatagtcaatcatactctcaaatcaaggattgcacaacttgtgtggaatgaatattgtagtggtggatgggaaaaagaaataaagaaaatgtttctccttttgtgtataccttctccaattttctcctttcaatattttggaggttgcatggctacaatatctctcttttttttcttttcaatgttgctccatattttggaagagcaaagttttatttcttcatagccatacatttccctccttttctctatttttttttcaaggagtctctaggtgaagcaggcataaactggatggagagtttatttttggatggtgatggaaatttatattaccaacttccagagtagaagcttagcatttttttatagggataatgtggtaattgtgcaaccttgatcacgagagcatgagagatatctaacacgagtcacgataatttagcaaagctcaatataataacaagtagtcatacacatatataaatggtttgataatatatattggtgtattgccttggtaggtaaaatgatgaaaccaactgagaagtaagtcccaaaagaagttttattttcaaaataaatccccaagtgtcatgatgatgaaccctgagctccactcgagacactcaaggctattgttggcctgatctttcggtgagttgatgataagtacgatttgggagaaacgttgatgacccgactacaaccgtactagacgttgttgtgttgcaccttagcgatcgatacatctctcagtgggttgttgatcttgccggtgcagatcaaccttattccttcaagcaaatcgaagaaacaagcaagaacaagataaaagctgttgacggtcgttatcgaccagtttcgaccgtcaatattacccaattaatgcagactagctatgcttgcaatgcataaattccaaataaaatatctacttccactatatactatgctactaacatgtatgcagaagaagcacatataaatggaggagaatcgacagaaaatagacgaatgatcaatcagacgctgtcgagaagcagacttgtggatagatgggctaataatacagaattaacatgagcaaacaaggccataattcataccactaagctgaggatccattgggagaaacacatgccaaatggtgggctgattgggctcggccagggttctgccgaaccccctggttcggccgaaccagcagccagcccgatcagcccaattcttcatcagctggaagttatccacatcccatggtggttgtgatcggttctacctgaaataaccgccgtggacacatgtcacaaggagggagaaagatgctcctaggatgcttcatcatgccacatgtcaagaggagagcaaagatgctcataggatgcttggagcatctccacactcccaaggcacctct

SEQ ID NO: 16286 - DNA, 1501 bp, Oryza sativa
tccacgctggccggccggccaccgccacgcggccccgccgcgccgcccgcccgcccgctgccgtgccgcctcccctccgcgccggccgacccctgcggcgctgcccgacgccgcgccgccgccgcccgctgcccgccgccgcgccgcctcccctcagcgccggccagcccccgcgccgccgccgcggccctccgcgctgctgcccgccgtcgcgccggtttcccctccgcgccggccggccaccgccgcctgtccatccgcgccgatgcgccggctgctgcccagcccgctctctctccaagcggctggcctctctcgctccgatccaagcgggctaaggaagaagaagaactaaggaagaaggaagaagaaaggataaggatagggagttagagaggaaaaaagagatagagaaagagttcgttgtgtggacgggaaaagaggataagtaatagggattattagtacgtgttgatttttattcccggttagtaacaccactcgggaataaagttagatctttagtcccagttaagatcctagccgcctgacacgatctgacatagagacaacttgatctttagtctcggttggtaaccctaaccgggaataaagatcatctagtcctgttacgcttataaaccggaactaaaaatcgtttttagtcccggtttttaatggaaccgggattatatgtggatttgggtcgaccgaccaaagatggtttctccaccagtggcatgttcgaataatagaacatcacataaatgaactgtacgtactcatagtacaaaatcgcaataaagtgttgacactgaagattgaggctgaagacacccatgaatatatattgctggagctacattgctctttggcatgaacaaaacagcatgaccaactgaagtgcaaaactaggcccttagatgagataataagcttctgcatgaactgctacgattgttagaaaattgcacacgggaaaagggtgaaatgcatgtaggcttgggaagcatcgggagtggatccgacacgcaacaacggatggatggtgccggggtacacagttctcacgactcatcgcattttcaacatgaagtgcatcaaccatgacaattttcagatgtttgtgcagagtgtaggagtgactgctgcttaaggcgttttggggagatgtcacttgattggccagcgttgcaggtgcactatgtgcaccagttcggtatctgcgattggggaaatgcgaaagaacggtacaagctgatcggctggagtagaagatgcagctgaacgtagagaggaatggaagaagatgtcaagactgctggagatcgagctgaagatgtgatcagggttaaatgtttcggtttgctgatttgtattgggggtggtcgaaatattatgaatttttgaataaaatttgaccaaatttgaacaaaatattaccgaattcataaaaaaaatgaaaaaaataaaaattttggctgaaattatatcgtatcgt

SEQ ID NO: 16287 - DNA, 1501 bp, Oryza sativa
ctgaagaaacttcaagatttgactaactcaaaaagtcaaaatctgcagtcaccatctctgcacttgacgaggcgagtggcgcggtcgacacaagatgatgaggttgccagtgaccttgggggtcaagggtcccgctgtggttggtcttctcgacaaggaggaggcgcttgatccaagcgacgacctcgtgcgacaaggggatagacagctttgttgaggttgatgacaccgtagtggaggttctcagtgatgggctgcttgaacggggagtggctggcgtggaacgaggtgtagtggtcggtgcggacgatgaggtgggagaaatgggggtgccgcgggcggctagagggcgcctctgcgtgggtgagtaggaggagcgccggcgtgaggcaacgaaatcttcctgtggatgtgccacttacatgtggccttcacatgtttttttttaattctcttctttctgactgtcatgagacctattttgtatggttctgaacattcgatgggtaaagatatcttgtataggggttagggacgttatacaaacttgacgtaaagttgaggaatgtcaagtggacttatccgcggagcccatcttaccagcccagcaacactggccacctggcgccgtgtcgttgccggtgcgcatatggcagttgccggtctcctccgctgcctcgcgcacacagcccactgtcgtcgtgggccccacatgtccgtgaccccgcaacgtctccaccttttcggccgcggcttccgccggaagccggagcacagcagagagagaggcaggtggcacgtgcttctcctcgtcctcgtctcgtctcgtctcctctccgcctctttccgggttggacttgcccactctctctccacccccccaacccacctcgtcgctgcgccgcgcggcctcgacgtggccgccaccgccgccgccgccgccaccgacgcagcgggggccccagatctggacgctctgaggcgtcgcagccgagccgccgcccgtctcggggacctgccgcgctgctgtcctggtaggtaggcccgcgccacggtgactcgtcgtcggccccaacgaaaggcggcggcgaccgcccccctccctccgttcgctgctggtctgaaaggtgtggattgatttcttttgctctctaaggtgtttggtggatcgttatcatgtgcttgaggggttgttcgggatgctggtttcggttgtgctagtttgggcaatctcctcgtattaatttacttgtgtgatgctgcggggtagatgggtgttaaacgttagtagttggtatgtgtcctgacactttggtaatctggaagaggatgctatgatgctgtgaagtaaatgttgtgcttaacaaggactagttggatcgaattcagttgttcaggttagtttttcggtacactgattgcataattgacctatgcaattgcttcattgcgattgcagcattgttgtattggaagcgggggtgagggatgtcgtcgtctt

SEQ ID NO: 16288 - DNA, 1501 bp, Oryza sativa
cgcctgacttcgggcccgttcccccctcgggggagggccacgtggcattggggggcatcctcctccgtccaatctctgggagggagtggccgccgccccacctcgggcccgacccccctcgggggagggccacatggcattggggggcagcctcctccgactagtctttaggaaggagtggccgacaccccacctcgggcctcactcccctcaggggagggccacgtggcattgggggcagtctcctccgactagtctttgggagggagtggccgccgccccacctcgggcccgacccccctccggggagggccacgtggcattgggggcagcctcctctgtctagtctttgggaaagagtggccctcaccccacctcaggcctcactcccctcgggggagggccacgtggcattgggggcagcctcctccctctaaacatgatacccccgggcccatatcaccgacaacattactttcttattttagtaaactagcacaatgcccgtgcgttgcaccggctgatggtggggtgactgaaatttggtcttaatgatttatcaaagcatgatcataagcatcggcgatgtgtacggtgaccaaaagtcgtgttattcttgacaattcatttgctttatatttacggggtgtggatgatgcttttgacgtgtgggcccgatggttgcagcataggatgaacaaatggtgaaaccacatatagaattttgtttgacgaatgaaaatattgatatacttttaagtaaataagcctaacataatgagttaactattttttaggacggagggagtacatgtgttctactatgtatgtatgtgaaaatgcagtgaagttccggttgattttggggagtttttattgctaaaaaagagcctgtgtgttgcaaagaaaaaaaaactaatgttatgataatgattatagttattttataaggttagagatgtgattgatccatatatggtggaggttagcgatgaaaaaaccatacaacaagaacggagcctacaacaatgtgttcccggtagagaaaaaacgacaacgacaagctctgatggtgaacacgactggatgagtgggtcaaacatgttcccatataagaggattccattttccttgaacgcgtatgaagaacgaaagatggagaaaaaacaacttcctcttagtggtacaacataagtaaaaatctatttcttaatgtcgtaagacaatatttttatttatgatgtcaagaattaaaaaataatatcactcgtatgtgcgtgtaaattagttcggaggattagcacaatgtaaaaaaacttgacagcaattaataactgggttgtagtcgtattttttttaaaaaataatccgaatacctagattacccaggagagaaaatatcggtttgcctgttcagagaccagccttatctctctttcgttttctctcccctcgttatctcctagtagtatctcctatgtcttccaggctctctctctcg

SEQ ID NO: 16289 - DNA, 653 bp, Oryza sativa
atgttggcttgtatattgatcttgtgtcttgatctattgtatttatacccataggtatccccttgtccaagtagaactaggaaaaccaatattgatacaatccgagtagtccttgtcgtttccatgtagaactctattcatccttccttatgcggaactcctcctataccgaaggttgtttccgtataagacatggtatgtagtgggtcctgccgagatttagtcaactactattaggtatgtggtatccataaccctgacagttactctctacctactatcgttctccgttatcctcgcaacctcaatgctatcatccatccaagttcagccccaatctctcatcccaatgactcaatacaaaattagtgtatacaatatactcataggtaaggatagacacgtggcctcttacggtttaggttgtttgggcagagaacacatttttctttcatcaaaatggatgctactaagggagcattagctgactttatagctagggagtttttctttgtcataatttaaaatgttattcgtaaaaatgcacaagaaattcaaaaacaaactctctagaaaatgcaaagaaattgaaaaagtaaactaataaaaatctctttagtctgtcgtcaacaaccaccatccttcccaaccgt

SEQ ID NO: 16290 - DNA, 1501 bp, Oryza sativa; identical to SEQ ID NO: 15131

SEQ ID NO: 16291 - DNA, 1501 bp, Oryza sativa
ctggagcggcacgatccggcgacgaaggtagtcgccgaacaccatggcccccgtgagcccctgggatcgcagacccgccaggcggtcaagaacggcgtcgtagccgtctcccagatctaccggggctcgccagctggaggcctgcgctgggggctggctcggaagtcggaggcgcgctttgtcggcgaggggagtatagaaccaatcgctcttccagtcgtcccacttcttgcgaaggatgcagggaatgtagcggtgcagcacctgcccccgcggctggaagtagcagccatcgactaccatcggcggcgacaccggctgtacggtgaagaaccactggagcagccggagagatgggcgcaccccgatgaacatctcgcacaggtgcgcgaagatggccaacatcattaccgcgttgggagtgaggtgcgccatctggagatcgtaaagctccagaacatccatgaagaaagaagagaatggcgggaccagccctgccattgcgaaagagaggaagaagacggatcgccccgggtagtgtggcgccgggcgtccctcgcccagcgcgaccacctcccggccggtaacagattccggcatgaatcggcgcggcagcccggcctgcctctcgctcacgatgcgggaaggcggcagcacgctaccttcgagcggtgcggagccccgtgccatgacgccggcggaggaggagcttgagagcgagtgagtgcggcaagggaagggcacaggaaacgaagagttagagcgcaagcggcgaaggcaaggggaataatggcgagaggaaggaaacgaatctcttcctccgcgtctttatacccttgccaacgctatgcccggctcctcgtttcccgcgcccactatctcgccccctcgtttctcgtacccacgcctccgctaatcccactcgcccgtttacggcgcacgaggcggatgtgcggccgtggcagtcgagatgggacatatcgtgcgcgcgttaactacgctcgccgaagcgccatcatcatgtctccaggcgaaacgaaccggctcgtcccgattcgtgcgctactccagtaatgtagcggtcttaaagaggccgctcattattgtcggtcgttttttccttgccgacgcgcgcgatttgcgatcgctgggtttctgcccgcctgtagagaccggccccacctgtcaccaggcctaaggagtggcgtcacgcccgagcgcttccctcgaggggggcggtcgccctggcataatgccggggactactgtcggtgacatgggaccgggagtatcgtgattagaggcttgggcagccacggtcatccacgtggcctaaccccctcgggggggtcgggcccgagggtgacgtggccacccctccctctgtctccccgaggggtcgggccgctcccgtttcggccccgagggctggggcgccccgaccccctgtggtgttggcgccacgtgtgtgggttaggtgagcacagcggcgctcacctaa

SEQ ID NO: 16292 - DNA, 1501 bp, Oryza sativa
cagtttaatgtagttagtttatatacagaaccggcacatataacttctcaaatgtgccgattctataatttgattgctcacgtggataaaaaagacatatgcttatgacggagcgtggggctcctcaccgagagaccgcgcaggtccccctttgccggttcggccgggggcgctaagtgaggttcttagccctcgatctgtggaataatcgcgagagagcaaatgcacgaaacacgggcgatgtagacaggttcgggccgctgagaagcgtaataccctactcctgtgttctggtggatctgtgtatgaagaagttacaaagagctggggagccagagaattcaggctctagaacccctctattctccttctggatctggatccgggatcccctcctcggtgggcaaggtcctccttttatatctcaaggggataccacatgcaccacttttacctactcttcttttgggtggggacccatcctatcttgaccaaaacttggctcgcgccttcgcctggaagctaaatcatagcttgtccttgagtgagggccagcgccgtcactcgcctgacacaggggatacccctgtcatttcttcattaatgggtggagatttgcaatggatgctgtccgaatgaccctccgatgggatgggccatacctacccccactctgccggaagcagatgtaacgtgggagcacagttgtctgccgatgacgtgaccggcgtcagactagtcacagaccggtcactcttgtccaccacgcgtcagtttagcataccgcacgtctgcccttcttcatgcaatgacttccccgccatggttgcgatgaagcctgtaatgtatctggccgggactgacgtgttaactccaggagttaacacgccggctccggctagggacgagtgcctggaggctctcatcattccgacgggacgggtcgaggcgtgagagaggccgcctgttgccacctaacccgcgatctgaccggtctgtgaccggtcacacactgcgaccggtcacggaccggataagcgagcgcgctgcgctgcattaaatgcggcgtggcgcgctcgtccaacccgcaataaatgcggttaggtgagcgccgctgtgctcacctaacccacacacgtggcgccaacaccacagggggtcggggcgccccagccctcggggccgaaacgggagcggcccgacccctcggggagacagagggaggggtggccacgtcaccctcgggcccgacccccccgagggggttaggccacgtggatgaccgtggctgcccaagcctctaatcacgatactcccggtcccatgtcaccgacagtagtccccggcattatgccagggcgaccgcccccctcgagggaagcgctcgggcgtgacgccactccttaggcctggtgacaggtggggccggtctctacaggcgggcagaaacccagcgatcgcaaatcgcgcgcgtcggcaaggaaaaaacgaccgacaataa

SEQ ID NO: 16293 - DNA, 1501 bp, Oryza sativa
gtagtctattttttcgcaatcagaataaaagtaccaatttatgtgctatacatttttttagatgatggattatgtgttatacatgagatgcatacatacatacatacatgattagtaagaataataatgagtaaaattgttagtgctctgttacatttaatgcgcacataagaccgtttagagcagtaagtcattcaaagaggactatgagcagctgctcaaggatgcccaagacattccccagcgaaccggctgcatagtcaacgcgcttgccatccaccccatcaccggcaagtgccacgaggttatcgtcgacaacaccaacaactattatgtgtcagcgccaatagagatgaccacttcaccacccatatagtgaggaggttcctcttcctcaaggcgcagcttggtgaggtgactctccagttgctaagtgaggagctcgacgaagtaccatgaggctcactgatatcaagaagctatgtgtcagggcagtcaaagatggccaccgtggcggaagctgtgcctgagttggcttgcctaggctctttcttccgagttctggcggccatggaggcgccacgtgagcaaggggtcatgttttcaagccatcttggcacacttggcttgtcaatcatgaatactggagggaggagaagaatgttatgctaaccatgtttggttagcctgatttcacaaaattttatcgcattgtttcgtcgaacttgagggaaattcatcatagctctaatgctcgattgggtgaaacatttttgttttaataaatttttgttgaataattcggtccaagttaatggacggttttagaattgcaagcggagacagtgattacatcttagttattacaaataattgatcacattttcaactatgaaatttattggaatgattacatttgtaattgtgtactggctgtactgtaatatgtaattggccattgccttggaaggtatctcccatggtccatgttggtggcacgatgttgccaaagacgatggcacgaccgtcgctggttgtgccgaggaaggacaacccttggcatttgagccggacgtattgttctagatctggctccatttccacatccacttcatgtcacgggagccattgactatcgtggcacgaatgtcatagaattagttttctattatgtttctctagctctggaccatttctgtaacatgttcatccaccgtccattgctatgagaagtagatatgatattatgaagtcgtttagccttttctccatcttaccccaacccttgtgtggtaccgcggtgctcaggatatcacattatctatatgtatgaaaattaaaactattccatattgtatatttaaatatcagatttgaatcggatttgattttaaatcatattaaatggttttgattttttttcgaattagatttgattttaaattcaattaactagttttgtctttttcggtggtgcgtcaacccttttctattctccctc

SEQ ID NO: 16294 - DNA, 1501 bp, Oryza sativa
gaggcggggcggcctggctaggcctcggcctgcggccgacccagctgggaggggggaaaaggagagaatgggccggcggcccattcgaaaagggaaggggataaagaaaaagaaaaaggaagaaaaggattttccctggaattaaaatattgcttgctcaattttaattggttaaaattatttctagggctctgaaaattccactaaaaatcttgttagcgaatttagacatgtagaactcaagaaaaattccacatgccagattcgattattttttgtattacattcttagggttttctcttgctttgcacctgcattttcttagggtcatttataaataaaattttaggcttgggaggagaacttcagggtgtgacaaacctaccccccttaaacagaatctcggccccgagatttggaggagctggcgaagaggtgtggatgggcgacttttaactcgtcttccctttcccaggttgcttcctcctcagaatggtgactccactgaactcggcaaaacctggtgaccttgtttctggttcttctttcgctggtatcaagtatatgaaccggcttttccacatatgtcaggtcctcctggatatcaatatgctccgaatcagcctgttcttcgggtactcttaagcacttttttaattgggacacgtggaacacgtcatggatgccgatcatattggatggaagttctaactgataagcaacttccccccttcgttccaagattttgtagggtcccacgaaacgtggtgctaacttgcctttggtttgaaaacggtgcactccccggagcggagtaacccgaagatacacataatcccctgcttcaaaagtgagctcccttcggcggttatccgcgtagctcttctgtcgagactgggcaattctcaacctttccctgatggttctgactttctcttctgcttccgttaatacctctgtcccgaacaattgccgctcgcctgtctgatcccagaagagaggtgtgcggcacttccggccgtataaagcttcgaacggtgccatctgtagactagcttggtagctgttgttgtacgagaattccgcatatggcaaacttttgtcccaagctccaccaaagtcaagagcgcaagctctgaacatatcttccaaaatttgattgactcgctcagtctgaccatctgtctgcggatggtaggcggtgctgaaatttaaacgggtccccaattcttcctgcagtttctgccaaaattttgaggcgaactgactccctcggtcagattcttgggtaccccatgcaaacacatgatccttgccaggtacaactctgccaatctctttcccgtataggtggtatgcactggtataaagtgagctaccttggtgagtcgattcatgactacccagattgaatcgtgacccgatgatgtccggggcagtcctgttataaagtccattccaattttctcccatttccattccgggatttgaagaggttta

SEQ ID NO: 16295 - DNA, 820 bp, Oryza sativa
ccagcgacaggtacaaacaactactccatctatctcaaaataaacttaattattagacttttatgtctagcgtttaactattcatctttttaaaaaaaccataaaaaaattttaaaagataagacatgcataaataaagtattattcatattttatcatctaacaataataaaaatactaataaaataattttatataagacgaataaaatatattatttgtctctacttctcctaataactttttatagacggaggtagtactcaccgccgagacgacacagtccaaagcacaacaaaagatcgcctcttctgaaagaaaagaggagagcctactcgttccgtccacacgtcgcacgcccacacgccgcataaactactcgtaaatgctcttttttttttcttttttctttgtctctacttctcctaatagtatgaaaactttttatagacggaggtagtactcaccgccgagacgacacagtccaaagcacaacaaaagatcgcctcttttgaaagaaaagaggagagcctactcgttccgtccacacgtcgcacgcccacacgccgcataaactactcgtaaatgctctttttttttcttttttctttgtctctacttctcctaatagtatgaaaactttttatagacggaggtagtactcactgccgagacgacacagtccaaagcacaacaaaagatcgcctcttctgaaagaaaagaggagagcctactcgttccgtccacacgtcgcacgcccacacgccgcataaactactcgtaaatgctctttttttttcttttttcttttccgtctaga

SEQ ID NO: 16296 - DNA, 1501 bp, Oryza sativa
taggtggttttataactttagactttgggaattctcatctcatttggacactatggaattattggtttgtggtggaattggacatacacctctcttcctctttcaaaacccctaaaacctgttttcggtggggtttgggtgcatgccagttatgggaagtagcaccccggccactataaggattaagctcgggcctctgttgcaaagcactaccgtactaaccacatgtctaatgggtaaggcttagtttgtggctcagtctagtcttaaacaaaggtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctgggacccaggtcgggttgccagttcggtccaaattaacgtaggccttgggttaaggcaggttcgtgagggttcacggccttgtttaataatactgtgtagctctaggatcgtctttacaaaatggctttgggcaactaagtgacttttaaatgctgtttactgcaaaacctaacccctattattatccccttgtacccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgagcgggaaaaggcaattttcccggtcgcgacaagctggtatcagagccatctcgactgtaggataagccaagtggataaaacctaaggacatattttataaataaaactatttgtgaaagttccttttttctccttcccctaatgctatttgcaaaatgtttactccgttcttccttcttcggattttcaactagtactagatggtcaggtcagtgaagaagaggacatcgtcagttgtttgccgaagctccagaagactgcaggatctg

SEQ ID NO: 16297 - DNA, 1465 bp, Oryza sativa
gattgaatccaagcgtaactgaacaaggccttactaggaaaatgctgcgatgcaccggtaatgtcgcggttgatgaagttgaacttatagatgtacccggtgttgtgattaaaaaaatatattttaaataggtatttttatcatttttatcgtaataccgatgataatcaggatggataaaaaatacttttgggtatttatttatagcctcgtagtggacacgtgtgctttctcgctttgtcgactctcgcgttgccagcatgcgtcttagtttctaaaatcatatgtggactcgcgtggagaccggccacgtaacatatgatgattttgtacaatttttttcacaatctatatttttatatcaaacaattgttttttcttgccttccttcgtttttttattttccggtttttcatactttttttatcatcttcttttctcggtaagatgaagttgaatattaagtttttttacgcaaaatgaggtgatattaacgtatgattgattgagttttaattataacaaacttaaaaaatagattaatatgatattttagagcaacttttatataaaaagttttcgcacgaaatgtaccgtttagcagtttaaaaagcgtgtcatggaaattttaatcttcatccaagacttgttggagaaaggaacgagacctatattattctgattttagataattacataattaaaaacagaagaaagattagcgaggagataaatttgtgtggtctgtcgacatccttatcctataactccctcactctctcgttctctctcccattttgtctgtcacagtgtcgtgtccctctctctctctcgttactctccaagcagttctcactctctaactctatcattctctctcccgttctatctctcactctctcttaatctctcgctactcaccaaggcggccggcagtggtgctcgcctggatcctgcggttctgccgtcgacggcgacgggccggccagatccaccactggcccaagtcgtggttgctgcttcctcgcgtcgatccagccgccaccatgttcatctccatcgttggctggcggcggtgaggctggtgagcggcggatccaacggtggggaggctcgagggcggcgacgaggctggtgggcggtggatccggcgttgggaggcgaggcagtgggctcccgtagccggcggctgcccagcggaggaggtggcggcggccgcgccctcccctccgctagatgtggcaggaggggaggcaacgggctctcgccgctggcgcctgcccggcggaggcggtagcggcggcggcggcggcggccgcgccctcgatgggcggcgggttcccgtaggcggcagtgtcactttctccatgtttctcctcgtcgtgctcagatgctctcgatggatccatcgccttcctccttctgctacttccttcctttcgttctttcctctcggttttctctc

SEQ ID NO: 16298 - DNA, 574 bp, Oryza sativa
agagaggtggttgatgagacaacaagatgtggtgaaacacttacgttttgttaggttggataatttcgtgttttgagagtcatcgttttaagaacttttatttgcatgtgagaacagttaaatccaaactatttatgtgcatttctttttatactggtgttgctaatatcgcttgcgtagttgcgttgagtcttgagacaacaacggtagcatggtggatgcttaatttgcgcggccatatcgccacgacgtcccgactgagcgtagcgtagtgaccaccgtcgaagacgtatagtcgccaactctccatatcatcgtggtaggctctcataccattgttaacaaattatcctctcgctcgatttcgatgcaagaacaataaattgggaaaataaagagtaaatttcactttaagccatctttattagctaaatttccgcaataaactagaggtaaatcaatattttcactaacacttttctgtctcccctcctttaatgaaaggaaaaagtacgaattacccccctccccccgggaactatcgcggtcgtccgaattaccccctgaaccataa

SEQ ID NO: 16299 - DNA, 1501 bp, Oryza sativa
acaatttccaaaaaaaatggtgagagagaaaaggggttggatatgttggagctaccaggctgtgtggttgtgcctggatcaaaaggtggagtttgtcactggagccccgtaacccaaccaagtttacaaaaacttgaacaaaaatttcaaacttttaaatatttccactacctaccacagttgtcggtgacatgagaccgggagtatcatgactagaggcttgggcagccgcggtcacccacgtggcctgacccccttggggggggtcgggcccgagggtgacgtggccaccccttcctccgtctccccgaggggtcgggccgctcccgtttcgaccccgagggctggggcgccccgaccctctgtggttctggcgccacgtgtatgggttaggtgaacacagcggggctcacctaaccgcatttattacagtttggacgagcgcgccacgccgcatttaatgcagcgcagcgcgctcgcttatccggtccgtgaccggtcgcagtgtgtgaccggtcacagaccggtcagatcgcgggttaggtggcaacaggcggcctgtcacacgcctcgccccgtcccgtcggaatgatgagagcctcctggaactcgtccctagccggggccggcgtgctaactcctgcagttggcacgtcagtcccggctaggttcatgccaggcttcatcgcaaccattacaaggaagtaattgtataaagaagagcagacgtgcggcatgctaaactgacacgtggtggacaagaatgaccggtctgtgactggtctgatgccggtcacgtcatcggaagacaaactgtgctcccacgttgcatctgcatccggcggagtggaggtaggtatgacccatcccatcgaagggtcattcggactgcagccattgcaatctccgcccattaatgaaggaatgacagggtgatcccctatgtcaggcgagtgacggcgctgggcctcactcaaggacaagctatgatttagcttccaggcgaagatgcgagccaagttttggtcaagatagggtgggtccccacccaaaagaagagtaggtagaagtggtgcatgtggtttccccttgagatataaaaggaagaccttacccaccgaagaaggggatgggatcagatcgagagccagggggggaatagaggggttctagagcctgaactctcttgctccccagctctttgtaacttctccatacacagatccaccagaacacaggagtagggtattacgcttctcagcggcccgaacctgtctacatcgcccgtgtcttgtgcattctctctctcgcgaactttccccagaccgagggcaaagaacctcactgagcgcccccggccgaaccggcaaaggggggcctgcgcggtctcccggtgaggagccccaagctccgtcatctggcgcgccaggtagggggcgcgtgtgtctttctaagccctcatcctctttcgtgtgcgccaagcttctcccgctcggcccaa

SEQ ID NO: 16300 - DNA, 1501 bp, Oryza sativa
ttcaaacggccggatttgcccgggcaaatctcgccggcgccattgatggcggccggacctcccggccggtttccttccttccccggccgccctctgcccctcccaaccccatttaaaccctccccgcacctccttcgcccatttccaccctttgccgcgccttctcctcgccggaatcgagctcgcgccgtcgctctctctctcctccgtcgccgacgacctccggccgcctcttctcgctcgccgggaccgtctcccgccccggcgtcgcctcctccggcttcgccgcatcgccgccgtcccgtccaccccctcgtcgagctcgccgaccaccggagcgccgccgtccccgtccacccgagccgcgccgccgccttcctccgctccggtcgccttttccgtcgtcgccgtcgaccttgggtgagccgtggaccgccgcctcgtttccccctttccctcccctcttcggccgccgctccgccgtgcctatggccgccgccggcgaccataggggcgcgggcgcgccgtctcccgccggccgcgccgacgtggccgtcttcgggcgcgccgagcggctaccgcgtggggcccggcagtcagccgcccgcgccctcgggtgcggctgacgcgtggggcccacggcgccggccggtgtgagcccgggtgcacccggtccaccgtggaccgagaggctgccgcgtgggccccactcccatggacccggtccgcgcgcccctcccctcagctgacgcaataaacctttatttttaattaaaatttaaatgaagaaattcgtaaatattcatttaaagagcatataaacttcaaatggccataacttggccatttgaactcggaattggaccgttcaagtctctaattttttcttaagaagtcaagaacccatttttgtgctttgttcttgcttgttatatggagtttattagagtaaaagcccttttcttttccgttggtcgtgtagacgctgcagcttcgaaagatccgctcttcgtggaggttgaagccgacgtttgggaaagcgagcaaggcaagtcacatcattctttgaacatattggatcccactttatgaaattactttgatttaaattattgcattatcactttatttaaattcccgcgttatcactgttttatttagccatgcctatttacctttgttatgaccttattattgctattgttattattaccttgttcaccctagaataaacaaaacccctactagtgggcactctactcatggttcccctggtatgaatttaggtagatgcttcgctgattaataagacaacattaggtggtttttataactttagactttgggaacattcatatctcttggactttatggaatggttggactattgtggaattggatgcacacctctccctctattcaaaactctcaaaatggttttacgctgggcttggggtgcatggttttgatagtagcacctcgaccacataaggaccggact

SEQ ID NO: 16301 - DNA, 1501 bp, Oryza sativa
actcctgtgttttttggtggatctgtgtaagagcaagttacaaaatatcaaccagccctctcctctcccgggaaaatcccccccccccttctctctttgtgggcatggtcctccttttatatcttaaggggataccacatgtaccctctcctttccaaactggacttttcttctctttatggacggagattggtatggttgccgtccgaatgacacttcgatgggacagcccacacctacttccactcccggcggagacaggcgcaatgtgggatcgtggctgtctgttgctgacgcgaccagtgtcagaccggtcacagatcggtcattcttgtcctctatgcgtcagttcagcgatctgcatgatcacccttctttttatagcatcttgcctgtaatggttgggatgaagcctggtattcatttaaccagggctaacgtgccatctctaagaggtaacacgctagccccggctggagacgtgtgcctagaggctctcgtcttgacgggacggggcgaggcgtgcgtcagaccaccagtcgccacctaaccgttgatccgaccggtctgtgactggtcacagaccggataaaagagcgcgctgcattgcgctgcatgcaacgtgacacgtttgaccagaccgcaataaatgcggttaggtgagccctaccgtgttcacccaacctatgtacatagtgcaaaccccacagggggtcggggcacctcggccctcggggtcggggcaggagcaacccgaccccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgtcagggcaatcatccttctcaagggaagcggccgggcatgacgccactcatgaagcctggtgacaggtgggaccggtctccgtgattgggcagaaacccaacggtctcaaaccacgcatatcggtaacggtgtcttggccgtcagtcatgggcggtctcttcaagactgccacatcacttgagcagcgctcgaatctgggcgtgtagatttgtttcgtctggagatatggtaacgtcgcttcggtcagcgagcgtaattaacgcacacacgatacgatctatctcgactgccacaaccgcatatcttccttatgcgccgcaagcgggcgaatgggattagtggaagcgtgggcgcgagaaacgagggagcgagatagcgagtaacgagggagcgagatagtgggcacgagaaacgaggagccgggctcagcgatggcaagggtataaagctatcgaggaaaggacttgctcccttcctttcgccactattcccctttccttcgccgtttgcgcccctaactctctctttgctgcgcctcaccttcgccacacacactcgttctcaaccctctctttctccgacgaca

SEQ ID NO: 16302 - DNA, 1501 bp, Oryza sativa
catgttgaggggatatgtttaggactaagggcaagttttataaaagaggtggatgttgcataccacatcatcaactaataaatatagaggtaacatatacaatatatcacatctatactaattctaatacagtagtcccaatgtttgtttggctaatctactcttcccctctctctttttgtcttgaattttatgtagtggttgcctctcttaattgctctaaattaacacaagtggcatctcgaattctcgcgtacaattaattcgtttggattatttcactgacgacgacaaattgacgacggcattattcgatcatatggtatacgtgcgtaaacgcatctccttccactgaattagctagtcaccgtggtatcgtcgccgtcgccgtcgtcgtcgtcgttgtcgctggtctttttgcacgccacgacggccggtcgtacggcggcgcggccaccttccgacaccgcttcttctcgcgaagaagaacgtaattaagaagatgatgataagtgataacgcggggtaagatctcgatcgatcgatcgaggtgcaacgcatgtgatgactttgagtgtgttgatcgatcgcctcctctcaaattaattaacgtgttcatctatctgacaatgacaacaccaattaattatctttctaatgaaggaaataaacaatgcatggttagtttgacaggactcagacgacttcttggtttcattaatttcttcttggtttaagtcgtctgaagaccaactccatttagctataggacaaaaattacctatgtttacggatcgatgacagcttacatgtgacaggtcgtggcgcgattagggatggtaatggattcaactttttttgttctacaaaatgtaaggggtgggttaaaaaaagaattgggctgatttagtagtttttcttcatataacttagctattctaatcttgtgtcatctaaatacactttttttaataatgaattaaacaggcctctacatccaaacagatgcacacaaccatttctccttatgtttcaaccactagtaatatttttctccttgatatttaattactgtagctagtaaaacataagtggtgaaatgtcgacgctaaaacttcgcttgagcaacgccttccgattataatgactagtgcaaatcaagaggataaactttttggcatcaacaaaagtaacatatatatgtcaacagaaaacaaaaaaaaataaaagaaaaaagaagcactagacaagtactctatgtaactaaccaaacatcacatcacagcactgcatgttttgactaaacttaacagcaatgaacagatcggtcaccaattccatggatttttaccttcatctaaagacaaatgaacaaatagattttgcattgttcaaagactaaaaattttttttctagagaaacaggtcattttctccttacccatgcaagttgatgacaagttggcaatcattgagacatgaaaaaaccagtttcaaccac

SEQ ID NO: 16303 - DNA, 1501 bp, Oryza sativa
aaaaaagttaataagactatggttaaaggaaacgtcatcttatattaaaaaaaggatagaataataagctaggtattgcatgtgcatgatgttatataaactctgtattgttattttctgctgcaagatctcaccatatcgtgtgaaggaaaagattctagcatcatctccacagtctagatctcctatcaatgttaatcaaccattaatttaggagtaactactctctcaccagatagttaacgacaagctgggtggcgcgcgtacgtcatcacctacgccatggctgacgacatcgctagctatagctagcttaattagcttcttcctcagctccggccgtatgtgatatcttgagcatcgtcgacgttaatggtatttgtgtttgtataactcaggcatgaaaggatttggtgttaaaaaacagaggtaattaactaatactccacggtgaaaaaaaggtcagctacttcaacaaactaaacagatggtctgatatggatgcatcacgcatctcctttcagaagttcagagtccattttcagcgaatatcgccgatcggaatcgttttttattttttttcccctcctgaaattgatagtcatatcaaaaggtggccaaaaggcatttgcatatctccttcatagagaacgattacactttatgtttaattttgcggccaaaatccatgccagtacatcaactgatacctttcaaatatataacttttgacaaaattattgatatgactgcacgaaattctagcacaaaagcaaatttgagccacgcagtattttattacaatgaattttccataggattacggccatgttcatttttcacagccacaaaccatcccatcatgtgggggcacctcaatataggtgaagacaaaacgtgcccacacttttatttggtcccaacaatcacttgtcacatagagtacaaatgatcgaattgcaatcccggtgaattattcatgctttatagctgtcaaatgacattttctcggttttaaacggcgtgtgttcactgttgcgtaaatattgtactgttgaaattaaagcgtatagaaggcaaagtgaccggccggatatattaatgattgatgaaaaaaaagagtaaagtctatcactggtccctaaacttgtaccgctgtgtcatcccggtccttaaactcgcaaatcgaccgttcaggtcctcaaacttgttcgactgtgtcatcccggtccctaaacttgcagattactcgtttaggtcctccaacttgttcagttgtgtcaccccggtctctaaacaggacggtctaaaaattttatatcaaaaaataattcataattttttcatgtaaactctaataaagacagactctatatcaaaattgtagcccttgacacgacctacaactttgtatttgaaaattttttgaattaaaactgtttagggtcccaaaatattgttgcacgtttatagattttgaaattttaattttaaaattaca

SEQ ID NO: 16304 - DNA, 1501 bp, Oryza sativa
gacgactggacggactgaccgtatgtagctaagctagctatggtacgtacatactgtgatagtgaagtactgtatatatatacgtaatacgtacatatatacgcgtagacgtgacagaatattaattagcgagaaatgcaacgtggattacgttaattgttaggtacacctcagaatcaattaatttagctgcatgacgcagtagactacacgtggagtgtgatggtcaacatcacaaattaacgcaggatgagctagaaagttataattaagagtgaataatatttaagaataaagtcaaatttaattcgtgaaggtttcggatagtgtatccacagaaatgaaatccactagctagctagtattcatatatatgcacttcaaaattcaaaagatcacctggggttggagatcgagattagtagtacgttcaatacagaataacaatgcatgactattaattctcgaacacgcggaatgacgaaacgatatagcaattcaacatttgatgatatgccaaaagtctttgtaaatcttatttacattgacacaatggtgaatactaaatatgtcagtatatacgtcagtcagtcgttgcaagcttctttggtcagtctcctcttcaccgccgaccacaaaataattcagtttgatcgctgtattggtcttgtctctcctgtgtagtgtgtgtgcacactgcacagcacaatttctgtttcttttcctctaccagaagatcattcttgtagtaatatttaattacttcttcaagtaattactatttatattggactggtagaagcaaaaaaaaatcaaactagagtttttgggcccttgtaccttgggcctttttacctttgaaaactttgagccagcaacagagcttgggagaaatgatcaatcatccttgttcacaaggctgcctgacatggatgctctggaagctaatggatatcaatcatgggccacaagaatgatttttcttgccatgtggttgatgtcttttaacatagtatcaaaccagagagagaaaataaagagaatctgaattttacaactgaacacacatgcaatagtggtgaggaattacctgaaaaaataaggatattctatattcagctgatatttgatttaatctgtaagttctaaccaaacctgggtgtagctgaacacctcaacttatatgtgcaaaacaagcatacatgaaagcaaaaaagtgaagcagccacactcaaccaatctaggacagaagttttttgtctgaacgctgaactcccaaatcatcctgtccactcatggcttgtggtccagaacagcctaaggagtattgaaccaaagaaaagataattctctcaatgaaaaacaagaagcaaaaaaattattcaagaaacatcatagagccagagctagagcatcacagagaaagaagaacttgctcccaataaactatccatgcttcttgcagagatgatgaacagctcagtgctgttcttgccaagct

SEQ ID NO: 16305 - DNA, 1501 bp, Oryza sativa
tgttgcaatcaatatatcaaaatgaatggagaaaaagaattatactggtatcctatgttcatattcgtagcctccgttttttatggcacggaaggtgtgtactacataatatgaagcagctaggcagtttccttctagagttttgttggggaaatattcgtagatagtcaactgtggaaaacccaatggctctcaagtctcaagcctagtcttgtccctgatggggcacatattgcaagttgcaacggataaaattttgacgatattcatgttattacaaatctgttatactccaagctttcttaggtcctgtttcttttagcttgaaattattataatccagattattaagagtaaactgaaagaaacagacaacttattggagtagcttattataatatggagcccagcttattataatctgataagctcatttaggtgagttttttttccagattattgggtgaaaaattacccaccatgccaccccacttcctctttagatttacaaacccaataatctaggctctaataatctagaaaagaaacaactaaccgcttattctactacagattataacaatctagcttatagtaatctgactcaataatctagattataataatcttaagctgaaagaaacagggccttaattgtctagatattcttgtaagaacagtgctatacatactaaaaaataatccttacaaaattcttaattagtaacaaatctcaactgtttgatctaatttggtggtatttatgtacagaaaagttaagattaaatcacaatgtgacatcagcatttgcaagaaagaattattttttatgtatatcatttcccttcttataactttcacttataattaaatttgttgattttgaagataaaataatatcacttagtggaacattattttacaaaacttactaaatgttgtatatcatggtgatatatgagaatgagatgtagatcctctgctactaacatgtgagctccattctcctctagcactatgcccatatatcggtggcaattactactatataactgtaattacactcccgttcgttggtgatccttatcatgatcttaacatattgctctttttttttaaagtaaagtccatcaccggtccctaaacttgtacagctgtgtcatcccgatccctaaactcgtaaatcgaccgtttaggtcctcaaacttgttcgactgtgtcatcccggtccctaaacttacagatcacttatgtcctctaatttgttcagttgtgtcaccccatccctaaacttggatttgaatatcatcttgttcaaataggacggtctaaggactttatatttaaaaataattcataacattttcatgtaaactctaatgaagataaactttatatcaaacttgtagccctcgacacgatctacaactttgtagttgattttttttttattttaagtcattttttgtcccaaaatgtaattttaaaattaaaatttcaa

SEQ ID NO: 16306 - DNA, 1189 bp, Oryza sativa
cccctccgtttcgctcgccgaccaccggagcaccaccgaccccgtggacccgagccgcgccaccgcctccctccgctccggccgcctcatccgccgccgacgtcgccccggggtgagccgtggaccgtcgcctcctttcccccttccctcccctatctcggacgccgctccgccgcgccagtggtcgccggcggcgaccatcggggcgcgggcgccgcctcccgccggccgcgtcgacgtggccaccttcgggcgcgccgcgcggttgccgcgtggggcccagccgtcagccgcccgcgccctcggctgcggctgacgcgtggggcccacggcgccggccggagtgagcccgggtgcacccggtccaccgtggaccgtgaggctgccgcgtggttcccacccccgtggacatggtccgcgcgcccctctctcccggctgacacaataaatcccttttaaattaaaatttaaatgaagaaattcgtaaatattcatttaaagagcatataaacttcaaatggccataacttggctatttgaactcggaattggaccgttcaagtctctaatttttccttaagaagtcaagaacccatttttgtgctttgttcctgcttgttatatggagtttattagagtaaaagcccttttcttttccgttgctcgtgtagacgctgcagcttcggaagatccgctcttcgtggaggttgaagccgacgtttgggaaagcgagcaaggcaagtcacatcatctttgaacatattggatcccagtttgtgaaattattttgatttaaattaatgcattatcgctttatttaaattcccgcgttatcactgttttatttagccatgcctgtttacctttgttatgaccttattattattgctattgttattattaccttgttcaccctagaataaacaaaaccccaactagtgggtactctattcatggtgccactagtatgaatttaggtagatgcttcgctgattaattaggcaacattaggtggttttataactctagactttgggaatattcatatcacttgaacattatggaatggttggattattgcgaaattggatgcacacctccccctctattcaaaaccctcaaaatggttttaggctgggctcggggtgcatggttttgatagtagcacctcggccacgtaaggaccggt

SEQ ID NO: 16307 - DNA, 1501 bp, Oryza sativa
atagttgctcaaatatgacacttggcgaactaaatgatgctaagaaagcaacatgttgtccgcggattgtgtgggcattcgagatgaataaatttggaaacccatcggcaaatgtcctgaaaaatggtaccaaagtaaatgtaagagataagtttggactaattttgataaagtataataagtttctctgagatagattttaggaaataaaaagattgttcctacctgcaaaattaccagtcagaacatcctaatgagttatcattccaattctaggtcccttgatagaggtacgacagaattaaagtattgacctttaagtcaatttcgataatgtatactcgttttgcttatatgctgatcaatcaggaatggaggtagtacaatggaactaaattttgaatgcaaaaatgtaaatatcagtgcgctgactgcagcaaatttgtgttttcccacaggtcccaagcccccaataaaacacaacaggcggctaccagatcatattagagctgcagatatatatagcttcacttttcatattgacctttccctgttccattaagggccaaggttaaaggtagagctttgtaatcccgacgaactaattgtgaaacaaagcaaaaattgttcagcgccgatgtatcgattcgggaaacattcaagaaaactccttccagttcagatatcctttcccactgagcgctctttcatccatgtagcgggaaagattcccattatgtaccaaacgaattaaggagcggttgagatacttggttggccagatgcaaaattcgggcaacaattaatggtaaacaatcgcaacattaaggactccaggggaaaaaaaaaacaacgagatggtagtaacaaagggcgggtaagaatcggacctccatgagatggagcgcagctcgatgtcgtcgttccgggcgaccacctgctcggcgagctcccgcatctcctcgcagtggaagagcaggacgttcttgtgcgccccgacggcgccggtcatcttcggcacggccaacggcgcgagcacgggggccgccaggtggatgccgctggcgttgctgacgatgctgctgcccgtggcgctcgcgccgccgaggtggaggcttgcgtggagcctgccggcggccgaggcgcggggggaaggcctcgcgaatgcggatgcggggctcgggctggggctggggctggggcccgggcgtcgggttttggcgccgaacgccgcggcgggggaggcggaggcggaggcggaggcggccgttgccatccctgcccgcgccgctgccgaggcccgggggggggggggggtcgttgggactgatgtggtcgagccgcgcgagtccccgcggtgcgttgcgttacatacgcgtgtggcgcgtgccggggagatgatgcgtttttttttttgcgagatttcgcgtgatttatagcctgcttcacggagcggcgtacgcgcaccggcggtgtgcgggtgccgggcgggtgggcgcgg

SEQ ID NO: 16308 - DNA, 904 bp, Oryza sativa
gcgcggtcagcgcacgcacggcgcgcgtgtgcacggctggctcggctcggcttggtttgggaccggcttgggctgggcgcccggcctaggaggagtggaggaggggaggcccgggagagagaggggaggggagggagctggcccgggaggggcagggaagaggtgggccgggaggaggaggagaggcccgggagaggagggaaagagagggaggagagggagactttgggctgggcttggcccaaaggaggaaggaggatttatttttagtttttctttttagtaaactttgataattgtttttgttgcttaataattatttccggtgctctgaaaattcaagaaaatttgagggcacttgttagaccacggagaatttaacaaaaattctccggaccacattcaaatttttcttgtacgtattttagtgattgccaatttcttctcgaattttaattaattctattattccttttagaaaataatttttatttcggaatgaatttatcaagacgtgacaaaacttaattagacttagcatatgtgagtgttagagattgttagagatttaatataagattattagaggtttaatatatgaaacttaattagacttagcatatgtgtgtgttagagattgttagagatttaatataagattattagaggtttaatatacggaacttaattagacttagcatatttgattgttagagattgttagagatttaatataagattattagagatgtaatattcgaaacttaattagacttagcatatatgattatctagggttataatacacgacacttagacttagcatatatgattatttgagttttaatacaagattagtagagttttaatattacgcttagcaaatatttcttctatgaataga

SEQ ID NO: 16309 - DNA, 1314 bp, Oryza sativa
gaaattagcatatatatatgattatatatacttgaaaacgtgaaatacattatatattcctttgcgtttagaccaacacattttttttgcatgttgcagagaagacgtcgtcgtcgtcgtccctcaagctgaagtggtagctagccatcgaaggaattcgcgcaggcaggtgatgtaaagatgtgattgttagagatataatataagattggtagatttctagtataagattattagattattagagttagcatatgtgagtgttaaagattattagattattagaattagcatatttgagtgttagagattgttagagatttaatataagattattagaggtttaatatacgaaacttgtcgcgaccgagaaaattaccttttcccgaacgctagtgtattaatccccgttccaggaaaagccggggtacaccaaacaaacatgatacaaaaggcacatctttattatatcgataatatttacattattacaaaggcacttcaggcctgacaaacaaaaataaacagcagcggacttgcgggcctacggctccatcttcataggcgctcaactggggtataagccaggactccacctaagacttcttctccaaagcttcccttactgaaggggggaaagatagagcaagactgagtacaaccaccgtactcagcaagtcacaccgggagttgcatgattaatgcaagggagtacaaggagataataataggggttaagttttgcagtaaacagcatttaaaagtcatttagttgcccaaagctattttataaagacgatcctagagctacacagtattattaatcaaggccgtggacccacacgaacctgccgtaacccaaggcctacgatgattcagaccgaactggcaacctgaccctgggtcccagctcgtcccaagccaacccaggccaaccattccacattttagttgttaagcaggttttaagaattaaaaacactaacttgggtacattgctaggcttgcccataaccgagggtgcggctattcgaataggttttactctgatcagaggtgtacatctttacccacaagacacgtcttcctcacgtgcaaccacgtgccacatgccaccacggcatatggacggaagacatgacatagtttccaacccatcctaaccatagacaagagtaccaacccaaccccacctacggccggaaaccccgagacaggtagggaggactgagcccctagcagcaggacaccggccctgtgccatgacatctcgactaccgggccgcagctcgtgtagccttcatttgtcctaga

SEQ ID NO: 16310 - DNA, 1501 bp, Oryza sativa
cggacatcacctgttagcgcgtacgccatcgtcgtgatcaacctagctagggcaaacgcaccttgctgagctccgatcctccgatcgccaccatcaccaatgaacaagctgctgcggcctctcggtggcctgaggttgctcaaccgagaagaacatccgttccgatgcttctcctcctccatcgatctcgtcttcccaggtcgccgccgccgccacatggcaaccaccgtgacccacccgccgccgacggaatccgctggttcgacggcggcggccgcgactgctgacccggcctcggtgatgctggaacgttggggctgcctcaggggctccacgccggcgaacgtagtcgccgacgacaacaccgccgcggagtcccgcacctcccgcggccaacccctccgcgtcgccctcgcccgcgcgtcgccgccagcgatctccttcatctgcttcgatcgcggggatgatggctacgtcatcgcggctcacggcgactctgtcctcttccggatgagttggaacgactacttcgtctacatggccgccgccggcaagccgccgtcgctgacgctgctccccgtctgcgacatccccatgaacgagcgctgctgggtcagcaagcaccgtttcaaggacagcttccgcaccacgggccgggtgttcgaccagcaggacaccggcatcctgcgcctccgcggcggcgacggcggcgaggaggcgccgccgcctctagtggcgcagctccagatcgcgcacgagccgccgttcgaaacggccgagctcttcgtgctccgccccggccacggccaccgcgagtgggagctcaagacggcggtgcccatcgtccaccatgacggcggcggcgaacgccgccatggcatggagatgtggcaggagaccaacgtggccgtccccgtcggcgaccgcttcatgtgctgggccaactacgacctcgccaccttcctcatctgcgacatggcggcggcggatctcgacaaccccaagctcctgtacgtgccgctgccggtgaagccagttccacccaaggagagcgacttcgacgacgaccaccaccacgacgagctgattccatgggagtatttccgcaacatcgtcgccgccgacggcgacgacacaatgcggttcgtcagcatcgacaaccgctgctgctgcggcgcgccggtgatacgcagcctgtgcgaccgctccagctcggcgttcatggtgaccatctggaggcttgccctgcggaacgccggcgacggcgacggcggcggcgagccgatggcgtgggtgaaggaagccgtgctggactgcgaggagctctgggcgatgctggcgccatgcgacggcctcccgcgtcgcgtgtacgtggtgtgcccgttcgtgagctcggagaaccccgacgtcgtctggttcgtcgcatgcgatgacgacgaggacggcaagaattggacggtcgagatcgacgtgaggaggaagacgctgatatcggttgtcc

SEQ ID NO: 16311 - DNA, 1501 bp, Oryza sativa
tctagcttatgtagatttttctggttgcaagttgattactagtgattactaacatccaaaatgaatttccaaaattattactaacattattagttgcaagttgattattagttgatcgatggttagttgcaagttgattactaacatccaaaatgaatttccaaaattattactaacattgttagttgcaagttgattattagttgatcgatggttagttgcaagttgattactaacatccaaaatgaatttccaaaatgattactaacattattagttgcaagttgattattagttgatcgatggttagttgcaagttgattactaacatccaaaatgtatttccaggaatgggaaaaagaaaaaccattgtacagaaaggcatgttaggcaaaccagagccaagtgaaaaaacaatgggggtttcacaacgtgctaagaaaagaagtattggagatgatcatgcagatgacatagagcaacctcctccaaaaaggagcagatcaaaggtattaagcatccaccttttttatgcattttttgccctcaagcagtgtttcgctttttccaatgcactacatttttcttatgatgcattaagttacttctcactgtggattaagttacttctcactgtgcattaagttacttcttttaaaattcctatgagatttctaacaccagtactcatggctatgtaactagggaatgcaaattcaagtttatttttggaagtaacttgcatgtttctaggaagtaactttttgagttttataacaagtaactttctgttcaaattgctctgagaggcaactagatggaatgtatcatgctgtgtaactagggaatgtaaattcaagtttatctggaagtaagttgcatgttcataggaagtaacttactgttttgttagaagtaacttcctgttaaaattactttgaaattttctgttaacaagtaagaagttacttctcgatgtgcctgaagttacttctctctttgcattaagttacttctctatgtgcattaagttacttctcaccgtgcctaaaatatttttgatgctgctgcttgagggcaagttattttctagaactaacttaatggcaagttacttcttggttcagttacccttttttcaactgttttatatatgtttttgaaaaaataaacaaatgctgatgttttttttatttttctttttgttgttttatacatttgcagtaagaaagtagcagggcttcacctatgaaacttataaagttgtatccccatatgagtggcgaacaaaagcgactaatagagggggctggcttccatggcctcgtagatctcaagtgctcgaagctcagacctgatttgtgcagctggttgatggagcatttcaatccagcaaccaattagcttgtattccctggacgtggagccatagatgcgaacgaggagtcagtgaagtctgtgcttggtatcccaatgggcgacaaagatgtctcataggaga

SEQ ID NO: 16312 - DNA, 1501 bp, Oryza sativa
tgaatgtcaactgctattttacccctactttttagggtttgcatttttgccacctctttttgaaaacgaacacgccgtttgccctcactcttgacacccgttagatgacacccatggctttgggttaaaaaaatacaaattgaaacagaaaaaggatttaatttactattgtacccttgagtgaatggataaggacccaagcccattccttcgctgagctcagttgtgttgaggcggcgaccggcaacggcttcggtgtgctcggcgacggtggcggttccgacatgcgcggcgagggcgggaaccgccgcgatggtgtcgattccagcgtgcgcggcagttctgtcaggaagtgcatgcggcgatggccgcggcagcagttgagcgcgagtcgacgacaggtctccggtgtagcggcggctacacttccctctcccttgtgcggtgaggtaggcggcagtcgcaggcttccatctcacttgcgcggcaatggcaggcgacggttgtggagcttccggcgtggcgatggcctgtgcggccgtggggcttccggcgcggcgaggcagacggcaacggggcttccggcacgagaagcaggcagtataaaagttggggcaaaaaagcaacatcaactaagggtataaatgtccttttgttctaaaactaacactattaaactagacgttaaaaatgagggtaaacaattggttcatattcaaaaagagagggaaaaatgcaaaccctaaaatgtggggggtaaaacagtagttagagttcaaagtgagggtatggatgcaattgtgcctattttgaaatttccactaatctatgctgtaccgtccttctgagatcaatataatcaatgaaccgtgacgggtagatgtgcatactgaagcctactaacctgacaaataatcagctgagaattttgtaggaagatggttgtgtgtaataagatggttcccggttactcccaaccctagctaccacagtgatgcagtagcagacactgacatgtgggcccggacccacatgtcaaccactgctactgcatcagcagtactgtagaggatttgcatcctagctaccacggcaagaacccattgatgttctatcgaatttctttatctccttcacatcctgttcttcctgtcttgtcatatataagtagagtaaggaatgccacgtatataagaattgattgcgttgttcggtacagctgggttctatagaatcataaaaagcttttcccacctaaaagatagccaatgaattatggtgctcccccacttattaggtctcttgaccatccaaaatcaatgtgggggacgattcaacaatctctccattcacacattagtgtccgttaaccgttccccgcccctttactgtataacgatggtctcacatgtatagtccctgtaggcaccaacggtccatcaggtcttcacacactgtctctcgggccagagatgttgaagtagtcaagctttgacatcaa

SEQ ID NO: 16313 - DNA, 1501 bp, Oryza sativa
cgatctgaccggtcacacactgcgcccggtcacggaccggataagcgagcgcgctgcgctgcattacatgcggcgtgacgcgctcgtccgacccgcaataaatgcggttaggtgagccccgctgtgctcacctaacccatacacgtggcgccaaacccatagggggtcggggcgccccggccctcggggccgaaacgggagcggtccgacccctcggggagagaggggaaggggtggccacgtcacccacgggcccgacccccccccccgagggggtcaggccacgtgggtgaccgcggctgcccaagcctctaggcatgataccctcggccccatgtcaccgacatccttaatatttgggtaataggactattaaactattaaaggtaagacatcccattgatacatttaaaaccaactttttatcaacacatatggtctatgtattttctttttatatcctaaaattaaattaacttatagattcaatatatcatgtttaatgtctccaactcgctgttgcttcgaatgtaaatttattttctacttcattatagtcacatgttggtcgagccattgccaaatacaccatccgtcccataaaaatccaatcctagctatgaacctggacacgtgtgtgttcagtttcgtagctaggattggatttttttttttggcggagagaatatggtggaatacaccagtgaccaatcccttcccatgacaatcattgcaacttaccttttccataagaagaaacctctcattattccttcttctccaactcctttttgttctccaactttccttttccaggatgaccacttgtttccaatagtgttattgtgttaacgtgtccttcttaattagatatcgtactttagcaactactctaccatacttatcgattatttttctccaaccatgattttaatattctggcagcataaaaacacatgggaacaatgtaataactgttgttaaagtcagtcggagaagccgctttcttaatttgtgctttgctcattaaccttgccaccttgatggctttacaacaacattggtgttaatatgcccacgagcatcgccaacagatgcttaatatgattttcaattcgaaaatctcgggttaaccttatcaattgcacaaaatgtttatgatggaatcgagagacttgggagaagttaaaggccctgtttgggggagcttgtcccagctgcagcttttgggaaaagctgcttctgctagaagctgtcccaaacagtccacagcttctgagaatctgtagttacagattctaaaaaatgaactaagaagccagaagctgaagaagctgggtttcagagcttttccagattctcagaagctggctaccaaacagctgcttctcagaatctaaaactcacccaaacaggccctaagatccaaatgatcaagaagattgtcagggttacggataaggtataccctctatccttggatatacgataggtatcaata

SEQ ID NO: 16314 - DNA, 1501 bp, Oryza sativa
gacaatcttcttgatcatttggatcttagggcctgtttgggtgagttttagattctgagaagcagctgtttggtagccagcttctgagaatctggaaaagctctgaaacccagcttcttcagcttctggcttcttagttcattttttagaatctgtaactacagattctcagaagctgtggactgtttgggacagcttctagcagaagcagcttttcccaaaagctgcagctgggacaagctcccccaaacagggcctttaacttctcccaagtctctcgattccatcataaacattttgtgcaattgataaggttaacccgagattttcgaattgaaaatcatattaagcatctgttggcgatgctcgtgggcatattaacaccaatgttgttgtaaagccatcaaggtggcaaggttaatgagcaaagcacaaattaagaaagcggcttctccgactgactttaacaacagttattacattgttcccatgtgtttttatgctgccagaatattaaaatcatggttggagaaaaataatcgataagtatggtagagtagttgctaaagtacgatatctaattaagaaggacacgttaacacaataacactattggaaacaagtggtcatcctggaaaaggaaagttggagaacaaaaaggagttggagaagaaggaataatgagaggtttcttcttatggaaaaggtaagttgcaatgattgtcatgggaagggattggtcactggtgtattccaccatattctctccgccaaaaaaaaaaatccaatcctagctacgaaactgaacacacacgtgtccaggttcatagctaggattggatttttatgggacggatggtgtatttggcaatggctcgaccaacatgtgactataatgaagtagaaaataaatttacattcgaagcaacagcgagttggagacattaaacatgatatattgaatctataagttaatttaattttaggatataaaaagaaaatacatagaccatatgtgttgataaaaagttggttttaaatgtatcaatgggatgtcttacctttaatagtttaatagtcctattacccaaatattaaggatgtcggtgacatggggccgagggtatcatgcctagaggcttgggcagccgcggtcacccacgtggcctgaccccctcgggggggggggtcgggcccgtgggtgacgtggccaccccttcccctctctccccgaggggtcggaccgctcccgtttcggccccgagggccggggcgccccgaccccctatgggtttggcgccacgtgtatgggttaggtgagcacagcggggctcacctaaccgcatttattgcgggtcggacgagcgcgtcacgccgcatgtaatgcagcgcagcgcgctcgcttatccggtccgtgaccgggcgcagtgtgtgaccggtcagatcgcgggttaggtggtggcaggcggcctgttacacgcctcaccccgtcccgtcggat

SEQ ID NO: 16315 - DNA, 1501 bp, Oryza sativa
tttttatcgaagtttatttttcagcctttgcttctaaagtttttattcacaaattatatctcgtttgtaaatatgccatggcttccataatattgatcgtgcgtgcatggaatcatggatggatgcaggcttccgggagacttcgggttcgacccgctggggctatcggacccggaggggaccggtgggttcatcgagccacggtggctggcctacggcgaggtgttcaacggccggacggcgatgatgggcgtcgtcggcatggtcgccccggagctcctcggcaagctgggcctcgtccccgccgagacggcgatcccgtggttccagaccggcgtgatcccccccgcgggcacctacacctactgggccgacccttacactctcttcgtcttcgagctcgccctcgtcggcttcgccgagcaccgccgcttccaggactggtacacgccgggctccatggggaagcagtacttcctcggcctcgagaagtacctcgccggctccggcgagccggcctaccccggcggcccgctcttcaacccgctcggcttcgggaccaagagcgaggcggagatgaaggagctcaagctcaaggagatcaagaatggcaggctcgccatgctcgccttcctcggcttctccgtccaggcgctcttcaccggggttggccccgtgcagaacctgcttgatcacctcgctgatcccgtccacaacaacatcctcaccagcctcaagttccattagagatgccatcaactacgtatttaattaattacgagtttttaattatgtatgtatgtacgtgcgtatgcgtatatgtgtgtacgtatgtatgtacgcaactttgtacgatcgatggtgcgtgtgatcgagaggggtatgtatgtacgtacgtatatacgatgtattattatgcatgggtgtagggtgtgggtgtaacatgtaaatttgtgctccaactgatttgcacgcatggtcgcatggatcgatttgctagcttgtctctcttttgttgggcatataactatttactacttttgttgattaaaagtttgtcactcaaagttccagtgataaatttttaattaacacttataaacgtggtaaatagttaaatatctcccttttattaggcggtagaactaggagtgtcccgtgtattttattttctccgtttttaaattattgtcatccacatgctacgctatgtaagatgtttcttagaagtatgtttatccctgacagtaaagaggaaaaaaatttttccggaagaaaactagaggagatttaattgcaccacataaaataatcttgtctagaaaaaaaaatctggtattccaaaagaaatagaaatataaaatcttgtggaccgtttggattggaatagtgatgaaggcctgagagatgctttactaggctggcccaaaattacatgatttggacatgggccacaacccacaaggcccatttttgaggtccacatgaaacaaacccaccc

SEQ ID NO: 16316 - DNA, 1501 bp, Oryza sativa
ccgcctgctacgccgcgttcctcgccgcctgggggtacctcacgctctcctcccgcgaccaccgcgccgcggcgcaccagatccaccacctcatgtcgggcctcctcgccgcgcgcctgctctactgcctctccgccgccgaggaccagcactacatccgcgtcacggggacgccgcacggctgggacgtcgcgttctacctcttccagctcgtcaagggcgtcgtcctgttcgcggtgatcgtgctcgtcggcacggggtggtcgttcctcaggccggtcttgcaggacagggagaagaaggtgctcatggtggtgatcccgctgcaggtcatggccaacatcgcgtccgccgtgattggggagaccggcccgttcttgcaagggtgggtgacatggaaccagatcttgctgttcgtcgacgtcgcctgctgctgcgccgtgctcttcccggtcgtctggtcgatgcgatcgctccgggagacgtccaagactgatggcaaggcagcgcggactctatcgaagctcaccctgttccggcaattctacattgtggtgatcggttacctatacttcactaggatcgtcgtgtatgcgctcaagaccattgccagttaccagttccggtgggtgagcgtcttggccgaggaggtggccacattggcattctacctcttcatgttctacacattcagaccggccgagaggagcagatacttttcgttcgacgaagatgaggaggaggctgctgagatggtgctccgggaagaggaattcgagctttgatgagttgcggcgattcgcagcaatggcggctgcctggcaattggaaaatctgctcaccttgttcatttgatctcttctccctgtgagatttagcacaccatacaaatttcaggaatatagctcattgtcttgtatttactacagggatgtaagattgttttgttcctctctccttgtagcttcaaattttactgatgagactcaggatactaaactggacatgtacaagaaggtttcttgcttggagggcaatgtggaaggaaggaattaattcagcatgtactattgcttagggaaaccttcaagctgtctgcattttgtgtacaaattctccattgttttcttgcttggagggcaatgtggaaggaaggaattaattcagcatgtattattgcttagggaaagcttcaagctgtctgcattttgtgtggtagacagtcctttcacttggcatgtttgacttcaggtgctccttctgttatacggagtactatacattcagtagtatcagttagttctttgatgtgatgatcaacccttctattgatatggtttgtcaatgaccacttaaatgcatccaagtccaatcacccatttttctcttacttgcattgttctctccatttgttatgtacaaattgtcctctctgaaatataaaacactggggtacctttgttttttaaactagaaaaataccccgcgcgttgcagcggaa

SEQ ID NO: 16317 - DNA, 1501 bp, Oryza sativa
catcccgccgtccccgcgtgcaataaagtggggggaaatactccccgtgattccctcttcctttccccccatttttccctctctctctcggtttcaaacggacggatttgcccccgcaaatctcgccggcgccattgatggcggccggacctcccgcgccggttttctacctccccggccactctcttccccttgcaaccctatttaaacccttcccgcaccttcttcgtccgtttacacctctcggcgcccttcctcctcgccggattcgagctcgcgacgtcgctttctctctccgccgtcgccgccgagctcttgtacgccgccatcgtcgccccggaccgcctcccacctcggcgccgcctcctttggcttcgccgcatcctcgccgacctcgtccacctctccgtttcggtcgccgaccgccggagcgccgccgaccccatcaacccgagccgcgccaccgcctccctccgctccggccgcctccctcatcgccgccgtcgccccggggtgagccgtggaccgtcgcctcctttcccccttccctcccctctctcggccgccgctccgccgcgctggtggtcgccggcggcgaccaacggggcacgggggcgccgccttccgccgaccgcgccggtttagccgcactcgggcgcgccgagtgggccaccgtggaccgtggaccgtgaggctgccgcgtgggccccactcccatggacccggtccgcgcgccctctcccctcggctgacgcaataaaccatttttaaattaaaatttaaatgaagaaattcgtaaatattcatttaaagagcatatgaacttcaaatggccataacttggccatttgaactcggaattggaccgttcaagtctctaatttttccttaagaagttaagaacccatttttgtgctttgttcctgcttgttatatggagtttattagagtaaaagccttttttctttccgttgatcgtgcagacgctacagcttcggaagatccgctctacgtggaggttgaagccgacgtttgggaaagcgagcaaggcaagtcacatcatccttgaacatattgaatcccagtttataaaattattttgatttaaattattgcattatcgctttatttatattcccgcgttatcactgttttatttagccatgcctttttacctttgttatgaccttattatttttgttattgttattattaccttgttcaccctagaataaataaaaccccaactagtggatactctatccatggtaccactagtatgaatttaggtagatgcttcgctgcttaattaggcaacattaggtggttttacaactctaaactttgggaatattcttatcacctggacactatggaatggttggattattgtggaattggattcacacctccccctctattcaaaatcctcaaaatggttttaggctgggctcggggtgcatggttttgatagtagcacctcggccatataaggaccggt

SEQ ID NO: 16318 - DNA, 1394 bp, Oryza sativa
ttccctttagcaagaattggtgtaaagttctttttgcccgtaatccgggaaaatatgcatcttttttcgttcttttcaagaaaacattcacctgaaagaattctaaaggcaaaattggttccattccacttgaaaggtcactagtttagatatataccattgaaagattgtggtgcactttaataccatcgaaaggtacatctgttttaatttttctttttaccattccatcctttgccagtttggttttttgctatttttccttttatttccacaccaaaagggtgtgcgtcagtacatgtttgccctctactgcagtgctgtttggtttcagccaagcacgaagcagtttaatcaaccaagcaaactgacccccaaattcatgagaaaaccatccatgcctacctcagtaaccttgctagttgatatacctccatcccaacaaaatcccctgctctatgccctctgttgcaccatcctttgatatcaatcaaacacagcagcacacagaagtgacaagtggtgactggtgaggtggtggggccatgtgtggaggttgttgtttacgaggatgagtagctggacacctcatccttgctgggaagcgagacggtgccatggggaagcagccagggatggctttggagaatcttcacaggagcaaaagggatgtgagaagaggattgagggagagatggggtgatggaatggaaattgaagtgagcagagtgccaaaatcgtcaacagtaacagttttaaggacagggcatgatggagaagtaagaaaactgaagatcttaaagtgtgcccatgaacttcgatggtatagacctaaaacagtgatatttcaatgccacgaaaccaatatttccaattctaaccccggtcaaaaaaaatatttccaattctaacataccaaatactaacatacctgatatggttattgtcttctctcaacttctggtaaagtcgtaatttaccatattttaggaaatattttggactccctcttcttattaactgttagttagaacatcaacatagtttgtgtatgcacttgttttatcattacattttctaatcacatactatatttatgaaaaatacttaactacatccaagaatatttcatgacaaatatactaatatcatttttacatattatctattaattttggtatatatttgtgatttaagatttcttggtttgactgcacgcatcttaaaatgacgtctatctgtgaactgagggtgccttttaaaatgaatgtaacgcattattctcataataaaatgatttacagcactagtctatgcttctacatttctttaattatgagaatttgattcctcccatttggcacccttactgattcatttaatatttttacagg

SEQ ID NO: 16319 - DNA, 349 bp, Oryza sativa
actgtctagcaaccttcatcatctatatttgactggcggccccactgaccctggatccttggtaccctcctactccttgcatcatccggaagctgcatatcaaaggctgttacaaccgtaaggtcccaaactggatgagctatcttggaaaccctcactgaattacaactctggatccgtagaatgggaccaaatgatgttaagatccttggagcaatacccagcttgcattttctcgaaagtcagaactctctgtggcaccaatggaaggatcatcatctgtggcaaccaaggattcagaagtctaacttgagatatttctcgttacgaatcaagagatgtgggacca

SEQ ID NO: 16320 - DNA, 1501 bp, Oryza sativa
tcaggtggcccatgtcgccgccggcatccttcaccaccgtctccagctccgctcttggcagctccatctgcacatcaaatcatcgaagaactaacagtggttaatgcaaatattattagtggtaatagattgatactactagctcgctagattgcccaaacagcacggttaatttagcacacctcgagtttattgaattcttcgacagcgtcccagcagctgcagcactcttcgcctttgagcgtcgtgcagtaatctgcgaataaggctgtgtttacttcgtgtgatttttttttacacgaacacatattttacatatttgaagtattaaatataaactaataacaaaatgaatttacaaattccacatgtaaactgcgagataatttattaaacctaattaattcgttattagcgaatgtttactgtagcaccacgttgttaaatcatggcgtaattaggatcaaaggattcgtttcacgatttacatgcaaactatgtaagtggtttttttcgtccacatttaatgtttcatacatgtgttaaacatttgatgtgatggaaaagttaaaaattaaaaaaaaattgaatctaaacacggtctaagtacttcaactggttatgaccactggtgtcctgtgcccatgtcagataatcagatggcacgagaaaaagttcaccggacgacgtaccggacatccggtccttggtgtgctcgacgagatgcttctccttattgacggactcgtcggcggcgccgcgccagctgagggcggcctcccgctccggtgccccgtgtctcccgacacggacgacgcgcccgcgcgcgcgcgacgaaacggccgggaagaagagccgggccggcgccgctcgcgccagcggcagcggcaacagcgtggcggtgggcggcaacatcgcggcgcgtgcgtgctgggtgagtgagtgtgctgtgtatgttggcgcgtggctgcctatcgtgcggaggacgagcaggtgtgcatggtggcctttatacgtgtacgtcgcgcatcgtcgtcgcggccgcggggcaaaaccggcagggaagccgtaacaccgccgctgttcggggatcccatcggcgcggcgcacagccacttggcaacgaccgcgcgacggcgcgacgggacgggagccgttggtttggcggattcccgtgggcttcccgtgtagaacgattcggtcgtgaaacgggtcgcgggaaagcgctccgcgatcgcgatcgagcccgcccacggcccatgggcaactctggagatgggctaacgacggttgtggctgaaactgcagcctgttccgggacgtcacacaaggaattttttttaatttttaattttttaataaaagttgtggcaaaaataatttttcattttgaaaattgacagaagtggtcgcctaccgccctctgggagggcgatttttaaaaatcgccatcccagagggcggcaaaagtgacttggcaaacggccgttcgctctcggac

SEQ ID NO: 16321 - DNA, 1073 bp, Oryza sativa
tttggttcccagccacactttaccattatttgccaacaaaattgccacaccttgtctaaggtgaggtgatcaaattgttacccacaacttactaagcctaagggaatcttgccacacttttttgagccattgacatgtgagacccaatttgttggaggggaatcttgccacaactgtggctacaaccaaatacctgtcaaatttgtctaaccttaggcgtggcaaactgtgacaaactgtggcttgcaaccaaacacacccggagtacgtaacgttgattacgttatgggcgtaatctgtttttctcttctctagctcgtgtcgtccgaggcaggcaccactcttcactggctcactgctactagtactgtactgtgcatggcatgcatatttgcataatcgatttgatctatggagtagtcacaaacacatgcacagaggcacacagtcgtgctatagctgctggtacgtacagggccctagctagcgaggagtacgtagcgatcgattaaacaaaaagattgggcaaagatctgatgcatgggaatgttcttggagggcgatgctgataggcagcaggaggtgtgtcttctccccgcgtgatgatggcgtctcccgatcgaatctttgttgcctctggcagcgcgccccgatcgacggattggaaacaccaagtttgtttttaccaagccggcttctgcccctgcctgcctctctcttccccgcgtggtgaattccgaggagagaacaaaagcgccgcgaggtgatctgataaagctgtgacgtatcccgcgccaatttgttactcctccgaccatcgagatcactagagttagttctaaattcatcgtcacggtttacgtataaataatcacgatcaccgatgttaaatcctaccacactagtactagattgatcagtgcatgtgatttgctcaatcaaaacccatgtgatcggtggcaaggtttgcagagaggaaagaccgaaaattggccacaaagggctcgtttgaagttgagcttttgggtcggcaagcgagcgagcaattctacgagagagagagagaaagccag

SEQ ID NO: 16322 - DNA, 408 bp, Oryza sativa
agagttgagttttatctgttggtacttcgaaatgtatgtgtcaaagcaacttttaggctagatcaatcgatcaccactgcattctctttatacttcctaggctactgtttgtagcttctctgttgcagattatttctaatttcaatttacccattgaagtaaaataaaggatggaaatattgaatcatttgtttgcattactgctttttgtttaatcaatccatgcagcctaaattgcaacattcatttaatcattatcatctgagaattactaacagaagatggtcattatcttctgagaattactaacagaaggtggttgagacttgatcaatctgatgtttcatgtccaagtggcatataataacctagcaagttaatctggacaatgcaggttagatctgaaat

SEQ ID NO: 16323 - DNA, 1501 bp, Oryza sativa
cggcggagggagcccgggatgtagtcggcgtggaggaacgggaagatgaggcacctgcggtcgacccagagctgcagcagcgcgacagggttctgcgcgacggtggtggactggtggcggcgcggccgccgtggcaggggcacgggcggggcgaggtgatctcgatggacctcggcggctctccctctctcttacttttctgaggtcggggcgcagggggagagggatgtgggcacgggtgatgacgccgaactggctgaggatgacgaagaagaggtcggggtcggcgggggaatgtcatcgaatcccaatccgggaaggagaggaagagccgagaggagaggaaatgactcgtggggcccacgttgtccccaccatatttatttttttttgtcgctaacacatgggtcccaccattttttaagctggcatgtgggtccatgatttttattatttttccaagatataattgccacgtaaccgccacgtcaatgctacgtgggaaaaaaaaaccagtcaaactagccacatagacgtcacgtcagccaaaaccaccttttaaaccgccgagggaccttatttgcccccgatttgacattttagggaccggttgtatctggttttgagattgttcaaggacgcgaaaatctgattaggtgtaaaattaaaggaccttagatgaacttattctcggagtaatgcatctcagatcgttggagcatggctagtttggtaacaaggcctccatcttccttacacggatcgtatctgctgcgccatatttttgggaattgctacacatcaccttatttttattttttcttaaattttcttttgttgaatgtaatggcacctatactcccaccgtccaacagaaaaaaaaactcaacctaggaggagaggtgtccaaattcattatcgggatcacctatacatttgtcgataaatttttattttaaaattttgatagatgtaatcccagtacaaccgtagtataattacactgtaatttgcatttaactacaatataattgtacattgtatgtaacttttatataattttaaaccgttagatttgcttcaagatttgtgcaagtgagaaaggaaaaaagtcgcagcacgcgcacacatgtaagaggattcgttcccatgacctccgtttcaacgaaatatcatgttatgaagagaattttgaaagttacatgcaaattacactgtactccctccgttccaaaaagagccaaccttcccctcctagtataacgaatctggttcctctaggttggtttttttggacgctcggaagtatatgcaagttacaatgtatgtaattatatttgctaaattttaggagaaaatttatcaacagatgtatatcaaaattgaaatatcagggtgaggctatagccgagggaggcaaaatggacctacacagatttggtggatccgtgtgagaaaaatggtcgacggtccagttcactgtttccatccccggataggg

SEQ ID NO: 16324 - DNA, 1501 bp, Oryza sativa
ttttttaactaataattaattagtcacacattaatgacttgctccattttacgtgcgctaaggagaagatcccaaccattccaaataaacacaatatagactatagagtttctccatatgtaaatatcttttgatcttttcatttataaaaaaaatattaactactgggtttgactagtagtgttgctccttaaaaaattgttaagtccttttttaagtcactgaatgcacttccagtaattcagattacgaaactgaagagtatccatgacacttctaatatcattctagatggtcaaaagaaatgcttctcgtaacatttgtttctttttttaaaatctcatttgagtgcataactttatacttccgctgttacattaaaaaaccaatctaaaatcggagattgatttttttacgggacagatggagtatgtgctatttgtagatattttacttcgtcatctatgaactgaactacccatttcttgatgtgtcttctgctcggcctgccatccatactttagatccattcttcgggcttgatggacatttgggcccatttccatccgtcctggacaggacagaaatactttgagcccattaacttcctcgctgggaagcccataattctagccattcagaaatgctgtacactttctttggtttatagaaaaaaaaacatatgaattttataggatactaactttcctttaaaattcctatgaaatgataaaccatttggattcttccatttacatcttacaaccctatgttattctactagtaatatatgcctctgcattggaatagtcccatataccactataattagactggttatgtatctaacctaaagattgcaacgggcctataacactgtgaataggttgactgtactccctccgtaaacaggaggagccctaggttagattttttttggacggagaaaatatttcttaactaactactttttatttggagttttcttttttatgcgagagtacgtgatgcatgcctaagcagtgagggaacctgtttgggggagcttaagaccctatttagatgggactaaaacttttaagtccctatcacatcggatatttagacactaattataaatattaaacgaagactattaataaaacccatccataattttggactaattcgcgagacgaatctattgagcctaattaatccatgattagcctatgtgatgctacaataaacattctctaattatagattaattaggtttaaaaaattatctcacaaattagctttcatttatgcaattagtattgtaagtagtctatatttaatactctaaattagtgtctaaatacagagactaaagttaagttcctggatccaaacaccaccgaagattctgagaagcagctgctgagaagctagctgatgagaatctgaagaagctagaaaacccagcttctggcttctagtttattttccagattctacaactgcagattctcagaat

SEQ ID NO: 16325 - DNA, 1501 bp, Oryza sativa
caaaaacgaagctcccgtatgaccctgttctgttaagggcatctaacggtgttaactgaagcacaaaatgtctcttttgtccttactcatttgactctattacatgtgggacccacccgcagttccttcttctcctctcctctcttctctcttctcttctcttctcctctcctccacggggcggcgactgatgggccggcggcggcggcgctttgagggggctgagggagagggggcggagggaggcagcggcggctgacggagggggtgagttgcggcgggggcgcacggagggggcgagcggccgtcctggctcgtggagggagggaggaacgacggcggcgcaggcgagcggaaggagggaggaggtggcgacggcggcagcggcgcaagcgcccggaaggagggaggaggcgggggagggggccggcgctggcgcaagcgtgcggaaggagggaggacgcagcggcggtggcgccagatctgagggggtggcggcgccggctccggctcttcgtcgtcgtcctcgtcctcgtcagcagggcgccggcttcggctcttcgtcgtcgatgagccgccgccgccactcctcgtcgtcgtcatcgtcactagggccggtgccagctcatcgtcgtcgtcactagggccggtgccggctcatcgtcgtcgtcaccagggcggcgccgatctgagggggtggcggcaccggctcgccgtctcgccgcaagtcgccgccgtcgccgcaaggagagaaatgtggatagggtttggtggatgcatagggttttctaacggtattctgggtattatgaatattagttgtatttctttttttttgttttaaattaaaacttaacggactaatggaaacagggtcagacgggagcttcgtttctgaaaaggagggtcaaataagtaaactctaaaaagtagggtcaaattggtagttaggattcaaaaaggggtcaaataagcaatagccccttaaacaaaagggcacatgttaataaaagaatggagtaagtatactgttagttctaaggatttagctaaaaaggagacatctcaaaataaaatggtggacgtcgtgtgttgaaatttatgaatgagaaaggacagcaccgctcattggaatgaactgaggaaaaggtacctgatctttggtctctgtttcagtaatttctctcttaactccgatgttgtgaataaggcttctaaatgaaaatataacatgaggcagggcacagaattaaacaaaatttaatacagcttttagaaaaaggaaaaatagataccttgctgagtgtcccataggtttgtgatcatccaacagcatatcagagtcagggtcgtgcctttcatctggatcatcttgatcttcatctggctgaataatgagcacatatgtacaggacacgaatacattcagtcagcccttgagttatcacttccaagacatctttttttttcatgcttataatattaggaagcctggagactc

SEQ ID NO: 16326 - DNA, 1501 bp, Oryza sativa
ttcttttcacgccggggacaggcgccgcttcgcccgcatcaacctcgctctctggagtcgtgctctccatgtcatcgatgagggtggtggcgcctcaccgcctgtgggcctcctccactcctgccggggctacctctctgcagcattgaaaagggaaaggggaaagtgaaacaaagggagaagtaggagagtttgtgtcatattgacatgtggtgttcactaatttttattttttcatttaaaatgcactgaaaatgtaggtctcacgctgactcagccatcacgtcagctaaaaccgggaacaaagtaccttagaactcaaaatgacccaattttaaaagttagcggatggattatatttttaggttcagagaagactttggaactcacggacaaataagggacctaaggtgaacttttccacaactcgtggtgcatattggacggcctttggttcaatatgggagtttaagattacgaggaattgttagcgagcttataagaatttagagttttctgtttctaatttattttttatcctgttctcataatatggatgaggaggtgcttttgattctgcgagaagctacaattatcattaaaaaaaagagaatcaaatgactcgtgattcagttgcactggaagaccgagcatgctgccattattgtcgtgcgagccgccaacgaggagggcagtcaaacactgcggcgatggatgcctacccttatgctcaccctcgcagcagagagggcctagccgtggcccgtggtggtggcagtgagggagaaggctgacagaggaaagacaacgaccaatggatcccacaccgatttttcaccttgtgttgccacgtaggcaaaattgacaaagagataagaaaccatcaaaataattgcaaagctaagaagcatatttggactattgtcgaacctaatacttcgtccgtcatataatatagcaatctagtattaaatgaaacattctatattacatcgaatctggagaggagagagtatatagtagtagcaaatatttaaatttccctttctcacgggtgtgattatgcagatgggttaggttgcaccgacgggtgtgattatgcagatgggctgggttgcaccgacgtgaggttgggcaatagtggtccagtccagagtccagactcagcccaaacaaaaaaaaaatgaaaaaactcccaccgcctgtttggttggaggtagtgtttagaagggattatgagtttagagggatgattaggatacatgggaattttagtggggataggatggggaattgaggaaggaactccctccttttcaataccgataggggcaggtaattggaaggcaattcctcctttatctaaccaaatctcagccatctgtttttattaatgacctaatcttcaactaaactccctatcaattttcatctcctctactaaataagatattagaattaaaaatcaaattcccatattaaactcatcattaattccctt

SEQ ID NO: 16327 - DNA, 1501 bp, Oryza sativa
cacaattctttctcacacagcctcagaagagcggtttcatggctggggcgcaagccgtcaagcgacgtcgcgaggagggaggagtaccacctgacggccaaggacggcgacctccagagcaagacgatgctgctcaacggcgcaccgctggaactctcggacgacggcggcgttccggccatgagccctgcgctcgttgctgtcaactcgccggtgtacctggcaccgacatcgatcgcctttgtagttcttccaatgtttgaggccaaggcctgttcttgagtgatcaatcttgccttcttgttgagtattacgcccttagaatgttccatttgttcttttctggtttaaatagcaaaacccttggaatgtaagcctttagaatgtaaaagaatggagtgttccatttgttcgttttctggtttgaataacaaagcctttagaatgtaaaagaatgtaccaaaacccttcgaatacaagaaggatcacaagaatttaccttagaatgcatagaacgattacaagaatttaaacatattgtgagtaaattacaagaatgtaaacagattttgagtaaataacaattgaattgtgagcaaaatttttgaagtttggaattgttggggcctttcctgataggaaaagcaccctccaaaaataaaggtatgctgcttaatgtggcgcgcacacggtattctttagtaaaaggcgaaagaatagttcgctttgtgttcaccacgcagctccatgctctgcaccgactgccaaggccacctatttgtacacctcccaggtcatcgcttctcgcttggcagtcgaggtgggactaaaatctgctagttctagtagtgcttccgtgacgccgaaatcatattgggctgggctagcaggcccattttttttagtgcgttcaagggggacgcaggttgaaactccgaacacagaccggattatttatttatttatttttcaaacgagacgaggaggggttagagattgtcagattgttaggtcattttaatcgcgattcgaaagataggtcattttaacaaaccctcagggctggatttattttgaaccccctaaagttggaattattttttgttttggattggggttagagattaatcaacgaggattaaggagggaactgaattttaatcgcgaatccaaagggtcggtcattttaactagtcaatggggtcggagattaaaatttggaccctgcaggacgaacaactttcgctcagttttgtttagcccttttttccctttgaatacgtaaacatttgtccgaaaattatcagcagcagcactctcagtgctgtctaggctaataacgtgtcatgttacaagtcaatagagatgcgtgcacatcacatgtacataagcgtctgcgtttgtgaacaaaaaaacgtgacgttcgaatcgagctaaaatctgggcaatgattcgtagtgcctcagttccgtaatcgggaaaatcaacacaaataatcttg

SEQ ID NO: 16328 - DNA, 1501 bp, Oryza sativa
tcaattcaaataagttggtttaaccataaaataggaatttaattctttaggttctgcatttctaacctaagcaaaatatttgtgctaaatagaaacaaatggagatataagatttaaaataagcaaaacttaaaatggaaataaatagacttggttgtatgtgcattttattattttaggttttttttggatattcttggtgcatctcataataggtttcatatgcatgtcatttctaaagaaaactcctaaaaataaatcaagcaacaataaattgcaccaaaattctcataaatactaaacaacatcctaagtctacagtaattttagttttaatttatcacatcaattggtacctcaaatagttccaacaactcacctagaaatatggaaaaacagcatatcatttagcctactttacaccttcaccaaaatttaaccataacttatctagctaaaccacttggtcagaatgttaactgtagtatactctaccacctggtgaatgacttaattaaattcaaaatgtaaccatatgaaataagaaccacaagttgcttaaacaatatttagactgcagtcaacatagtaactttactaaattaccatggtaactcaaaaagtaattaaatcttgaaacttggcacattgaaccatcaaatccttgtccactttgcagcaaccttgtctccccaaaattctaaattaaatggaagagagaagagggattaaaaccacatattagaataaattcaacactttgaaaatttaaagcttctaggcctcttgttctatttctctctcttacaagtgggaccaagccattgtgggacccatgtgagatcctcatcacagccaactcatcatctacatacttctcatttaatttatttttcatttctcaaaaggtgagagaagagttaaaatacaattttcaccaaattcataccctacctcactaattcttctaggaagcatctacatggacccacttatcattcacacatcagctatacaccttagttaaaaacactccattgatctttcttttgtttaaatcaaagacaaagaaagagagagggagtataaatcaattttcaccctagaacctaaccatacctcacatcttctcctaggaaatcactaaatgagaccacatgacagtcattataactacattgggtaaggtataagtggtagcacagcctaaaccatgccaactcactcaaaatcgtgtcaacaccacatatggacacctagctttcaccatgccacctcaatcttcaccattaactaaaccgactagccacagcaatattcgtcacaccctcatcgtgttccactaggcaaaacactacgaaacctcggagaagcctagaacatctcattcttctctcaatccgaaggtgtttgatccaatcttagagacctctggtgagcttcgccgcacaataatcatggaaaaatgatctgtaaataatgcctaactcgttcatgtcct

SEQ ID NO: 16329 - DNA, 1501 bp, Oryza sativa
ttttgcgaaaaggttgctgatgtccgcccgcttgctgggcgtcgaactccttgcagaggacgtgcacttcttcgactaccatcacggccttgccacctcgatcggtcctgaattttttccatgtcatcggggcttggtttggccttgaatgctgcgctgggttcgccggaggggtagggtgaaccagaacgggcgccgaactgacaacttgggcttgaacctgagtttgagcgttagcttgcacggtggctgttgcggctgcagccgccttgtcatattcagcttgtatctcttgccttcgcttggtgtcttcctcacctcgagcatatccatcaattatgcgaaagaggtgttcgatcgtccttggctccttgcgtccgatcttccttgtgagttcaccctcaagcaagccggccgaacctgcgttgacgatggatgctttggttatgtcttgtacttggcaccgtgcttgcgagaatcggcgcatgtactcccttgtcgattcccctatgccgtcgagcacgaggtggattaccttcgccttggtattctcatcgccgtgagcaactgcaattacggattcgtagatggacagaactctttcggatccgtctctcccgaataccttgggacgggagggtacttgaactggggagggatggggtgacttttaattccccagctgaggggcagaccctttttgccacccggtttgaccatagccgaaagtcatcacaacccattcaaataagccgattgcaccaggacacctaaaagctgtcttatggatatcttcttcggccataaagatttgattgtatcctgcattaccatccataaaactcaaaatcttatgccccgaagcagcatcaaccagctgatcggctactggcattgggtattcgtctttcggggtagccttatttaagtttcggaaatcaatacacaccctgaccttgccgttcttcttgataacaggaactatactagaaacccactcagcatatcgacaaggacgaataaaaccagcatcatataatcgtttaactgagagggccagttaaattgtgggtatggaagcgcgaatggcgaagctacagcttgcacatgaggttgagctgcaggtgtcgattaatgccccgtgccgaacatcatcgcttggttttgctggtctgtcgaggtagcttgcatcgccacagctgggttgaacatggcttgattccaggcttgatttggtggtggggccgctccgaacccacagggcacggcttgcacgaaagtcatgggtgcttgtgccgcggtgcttgggttgaattgtagcagttggctttgagaagaaaccccttgagcttggcttggcatggcgaactggcccagcaactatcgagctggtgcaccctgacttgggcttcccttggcttgggccggaggcgaagctcttggtacattgttgtggggtcgattgagttgttgcaagaaggcttgaaactgtgcttgtagg

SEQ ID NO: 16330 - DNA, 1501 bp, Oryza sativa
tttgtagcgcacatatattttgactagtatgttcaaaattcaacaacatataacaaacaagggattactaatttttaaacctccgtcttatgccacaactcggctgttggacaagggaaaaggaaaattgagttaggaggagtctgagatggatcaaccgactctagttcaaggaataggaggggttctgttggagtcaagtcgagtcggttgattgaactgactctgaaggatctattttggaagttcagtaatgatgttgtatctttccgatttcgtacatttcctattttgtgccgaatactttccgcatttatcttccatattttcttttgtgcacattactcgtttacttgtcggattgacctttcagccgatcgtttatgaattgcaagtcttataaagttctttatgggtttgttgttcgagtttacttcacctaggtaaattaggagttcttccttttcatcagaggaagagttttagtataagtcttaggtgtggtgcctaggctttatattttcaagagtaaaatacatggaggaccacttaacttgtttacgtgaattgtgtaggtcaatctactttcaaaatggacatctagatcactagtgtgagttaagtcaatcaatttgcctttctaactatccacatgagcataccttgtacacatgttatactatctatgattgaaaaatttgctatcagacatgtgcaaaaaaaccgcatgtgtttcttatcctttctcacagtactagcactgagaaatatacaaaattaggggaaccaaatcatttcacttgtgtctattttgatgaacttttcagttctcagtcctctctctcgtttgccatcaaacctgacagcggcgacaagctatgaatataaacaacgacgaaggcaaaatcctaggcagtggcggcgacaagctatgaatataaacagcaacagaggcaaaattcgaggaggcagtggctagggtgtgcaacggctgcagatgcctatacatgtgccacattatgtgtacaaggtgtgctcacgtggatagttagctagctaaataactcagttaactaatcctatgtggcacgcttcaggggcggatttaagatccggctagcctgggccgttgcccgggctcatgggcctgcattagtggacctactacttattatccatactaggaaaaagtacactgatggtccctcaatttgtcatcgagataaaaaacgccctggaaccacaaaaccagatatacagggtcccttaagtatacaaaaccggtcacccgagattcttcggtggttttgaccctggttttggtctacgtggcggctgagtcagcgtgggacccacgtgagccccacacgtccacgtcagcctcctctccctctttcccctcttctctcccttcctcatctctctctctcacttctctgtcgagacgagcggcggccgagattgacgagatgagtggtttccagcagggtggatagcgtga

SEQ ID NO: 16331 - DNA, 926 bp, Oryza sativa
aaaccctagcgggttcgcatcaagttcaccttgggaaaaatccaaattaatctaaaaacaattcaattgtgggtgaataaattaataaccaaataaagcatttgaatttacaaatccaaaatatgttgagctacatttcaattccaaatccaacaccattttgcagattagcccttccacttttcctttttcctttccttcttttctctctttcctcctgtcggcactattcattgcccaggacgtattcgttctgggcccaagcctcttccctgtgtcacgcatgccatccctgtcaccatcgcgcgccgttgcagcgccgcacgaacgtcgccctcgcgtcgccgctcctgccgcgtcgagccccgcgtctcacgccgtcgtgtcgccatcgccttcgctcagccgcgcgctgccacgtaaatcgcccatctatgacgttttcctcatgatgttgtatattttcgtcattgaatagaccatatctatgacaaaattttctatttcgtcatggatcagtcatggcgggataggtaccaaaactctatgacgaaattaaaaatggcgtcaaggtacaatagaaaatttcgtcacaaataatgcacacctttcatttattaatacctgttggtcccacagcgcatacgtggatatccaaatttcatttattatacctgttggtcccaccgtgcatatgtggcactggtcccaccgcccgcccaaattatatgtgccactggtcctatatgtggctatcattttttttataaaaaaaaatacacctgggaatcgaacccagtccatgagcatttgcgtaaaaagctctaccaccatgatactaagatctttgagtgaaagcttgtttttttgttaattgtcctttatgcggtgaacctggagaggacgcggcggccgtggcgccacca

SEQ ID NO: 16332 - DNA, 1501 bp, Oryza sativa
tctgggtgtggttactgactgcatgctattttttcccaggttttcctgttggaatttgcttattttataagttttcttccttaaaattccatttgttctgtgattgttctcaagtggcaaatgaggaagttgttgatttagtatattaaacattggtggaggaatattgatcaagtgcaaaattgatcaaaagttgcctgttgatctggcgacgaagatcagttgcaaaactaatactctttcaaaatagacatgatagcaaaggttgtatttttcttaagttctttgcagcataaatattccatactggtgtactgtggttctacacggtgattttcttaattttatttaattttcattttgtatggaaacaaaaatgaggcttggtgtcttctccgtttcaatgatctattctcgccaacatggattccatgtgcattgttgtactctggttggatgctctacacttctgaagtgttgtgtttatttttcattttcaagttgagtggaaattacaatgaaaatttatttattctatctctgaaacgaaaatggacagtcttggatacatattaagtatgcattgctaaatattaggttgaagcaagatgtaataaagaacgtgcattgcacgtgcatgattactagtatcaatcaaatgtcttaataaaccctcactgctttgcgacttattaaagaagtccacaaaacaagcataaaaattttaaactgtaaggtaccttttaaaatgcactgtagtaattcactaaagaattaacggtattgggtatttaatcacgtgcaaatttgccaaaacaaaaattacctaagacccaaaggaacgtgacaacggtagctcggtaagaattttgacgtgggaccaaaaccatctgaaagtagactccataagctttccagcaagtactcatgggcctcgaaattccttctagatcagcggctaggtccgtttgaagttgatgctgttaggaggcttgattccaaatccaaaacgtgtacaacttgatctcttgtcttctatgggccaaaagtgacatggtgagttagaagtagacttggagaaggtcttggtttggtccccaatcaactttatcatccatgcattcgttatgctcggcctcttttacttcgtacaagcaagaacctctgcaaacgaaaacacacaaaacttattgtgtagtaacgtttgttcaaatatataacaagtaaatctaatgtagaacatatgcacctttggttgattaatacataaagtagtcatggttatatccgagctagttgtgtactcatcagctggtatggacccgaagtggtcacacagcatggcacgtgcgctggcactggatacacggacgtggccaagaggggacgttcctggcctgggcattaatagaatacttatatcaataagctgcaacttgttttcagaagccgatctccaaagaactctagggttaagcgtgcttggcttggagcaatttgg

SEQ ID NO: 16333 - DNA, 1501 bp, Oryza sativa
tcaatagtttaacatatgttttgtcactattcatctaatatatgaataaccataaagattttttatgggaaaaattttctatacatatgttttgtcattatattcatttaacatatgaataaccataaaaaaatggcactataatacttcctccatccacaaaagttacacatatttcacattaaagtttttctaaataagttgttcctatttgtagtctttatgcattcaagacttaaatgagaagataaattaaatgtttgatggagtcatctaaatgctcattggttgcatgcttgcattcactccttacatccaaaataatataatttttcttggtcttgatgacaaaagtaatatgtgtaacttttgtggatggagggagtactatgactttgtttggcaaatgggattgggaaaataatatcccaccctttaaagggcaatattgcatcctaaccattcatccttcacacctcatttaatcctagccattcatccatttccatttcctaatcccacctcccatatcccatttgccaaacacaccctatagtttttccgctccctctctccttttatcttttcccttataagtatgactgtactgatggggaataatttgtagcttgccaatggagtcttagggcctatttagttcacgaaaagataattttttaggtgttgcatctgatgtttgaccggatgttggaaggggttttcggacacgaatgaaaaaactaatttcataactcacctggaaaccgcgcgcgagacgaatcttttgagcataattaatccgtcattagcacatgtgagttactgtagtacttatggctaatcatggactaattaggctcaaaagattcgtctcgcgatttctcccttaactgtacaattattatttttaatctatatttaatgcttcatacatgtgttcaaagattcgatgtgatgtttttggggaaaaaaattggaaactaaaccaggccttaaacctgttgccggcgatacaaagagcgcccttttgtgttgaaatagctactcggtttagattttcagcgccacgtgaaacgattagctgtttctgtgctcattttctttttttttttatcaaagagctcatagcaccttttccgaacatatcatctcgggatggtatcttaaaatcaaggcagagcatttgaacaaattagctagaaccccgggcgttgctgcttaataaaaacaaaacatttaacatatgaataaccttaaagattttttatgggaaaaattttctatacagaacacctataatttacatacaagtagagtcagatgacagagatcaatcacatagggggcagtggctcaacatacagagacgactagttgcatatagtcgggactcaggcgggcaagtggtgggccatctcgttgttggagggggagagcgcgaaccctactctctttccccattgccacttgcggagttgcggtgactagggtgcggggtagg

SEQ ID NO: 16334 - DNA, 1501 bp, Oryza sativa
atatggaagtaaagataaagctaaattttatttctatataacatgataatatgttcagttttagaacaagcaagcaaaagctgcatgtgtattgtcctgtgtatctatctattatatatgaaaaatccattaaacttcctaaaaaaaactctcaagccgccacgtggcattctaataaattagagaaaaccttacaaattttgagaaaaaagaaaaacatacagccctcgatttttatttaattcggcggacccactatttttaaaccattagatttatttaaaatacatctcaaataataatatatatgcgtacttccgtactatactactcacggcaaaaaaaagaaaaaaacgtaattaccattgtaagaagaaggattaaccctgccacagtcccacctaattggtacgagagaaatgtatatacgtactgttcacctaaaaaacccaaaaaactataaaaaagttctcacatgtacaatacgtactactatccaccggattgagaacaaaaaaaatatcctgggcatgtacatactacgcaccgtcaacccgtccctaataaagttatcaataatgttggatattttcttgagaaacaaagtacaaatgtgggcgctcacaacgcacgtacacttacccctacgaacacacacacgcacactctacccctatgagtacctctgagagattgggccgatatattttgagatcgacaaagtcaccataaatgcctcgctgtcgatggatacgtcgtctgaaagaatttgtcaagtccgggacttgaatatgagtaggaaatttccaccacaaggaacctaaccagttgaactatgttcaattcaaaataatgttggatattaaaacaaccatttaaaccagtgaaaccattatttttaatcgttagatctatcttatataagaaaaacaatcgtttattcatggtacatcacatttcaaaaatattattgtgcaattatattcacgttaggttgcgtagaacctcttacccactctacatgaaatgtttatagatggattgtctctcaaactatatcaatcatattatgctatataaaatttagtggagtttcatgtgccaccaaattcatcctctaataaaccatgataatatatatgcaataaaagaatgaaaaacacactacttttgctttacacttacttttactttcgttgaaatattttctaaagaaaataagtctacctttttttcaaatgacgaagaagattagaaataattgcttatagatattacttaaatatgatataatataaagctaataggttaaaaattataaaaccaactaatgttaaaaaaaattacggagaaatcggggtagatgttctctggttaatatatcgcttttagtgtctcaaacttagtgtacgacacatgcccgcgcatagtttctcaaaaatgtcaaaaaaaaaaaaagaagaaaaagacgattgactgaccagtgcctgactgcctgtag

SEQ ID NO: 16335 - DNA, 1501 bp, Oryza sativa
gtttgtaaaattatgttgatttaaattattgcattaccgctttatttaaattcccgcgttatcactgttttatttagccatgcctatgtacctttgttatgaccatactattattgttattgttattattaccttgttcaccctagaataaacaaaaccccatctagtggacactctatttatggttccactagtatgaatttaggtagatgcttcgctgattaaataggacaacattaggtggttttataactttagactttgggaattctcatatcatttggacaccatggaattattggttgatggtggaattggacatacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggctcggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttaaaattcttaaaatttgctcaacaactaaaatgtggaatggttggcctgggttggcttgggacgagctgggacccaggtcgggttgccagttcggtccgaatcatcgtaggccttgggttaaggcaggttcgtgagggttcacggccttgattaataatattgtatagctctaggatcgtctttacaaaatagctttgggcaactaagtgacttttaaatgccgtttactgcaaaacttaacccctatattattatctccttgtaccccccccttgcattaattatgcatctccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgttaggcctgatgcgcctttgtaataatgtaaatattatcgatataataaagatgtgtcttttatatcatgtttgtatggtgtaccccggcttttcctgggacggggattaatacactagcgttcgggaaaaggcaattttcccggtcgcg

SEQ ID NO: 16336 - DNA, 1501 bp, Oryza sativa
cctcggccaaacgggcctccaaagcggcgtagcggcgggcaagggagcggtaagcctcaaggagtaggtcgtgctgagtggcctgagcctccgagagctcaaccatgcgagtcagcactggctgagactcgctgtacggacaagggtacctggcgtctgagtggccagaaggaaggcgtggaagctgccggaaggcggaacctccgagacggtggctgtagtcgtgggccaggcgacaaagcgcagtccaggagaggtcctggtacgcgatctggagagtgggcctggccacagtgaagtggtgggggcgaaggccagctccgtgtatacctccacgggggtaaaggtacacagagagctcacagtgagggggaacacggtccacggagtaccccgtgtactcgggacacgagaagccaaggaaacgggcgaggtcacgaagctgagcgacgtggtgaccctcaccaaaaccgtgggaactgaagctggcgttcactgccatctacaattttgaaagagggagaaagatcagtaaccattttagaaacaaactattgaaaaaaataaagaaaacaaaagacaccttagcttttcgcaagtagtttttgaacatagtatccttagggtcgtcctaagcgtcgggtttcgccctagggccaagcctgtgctctaataccatctcttgtcacgccccgagctagtcccgactggaattagcccgtgacgctccaaattaacctgttaatcgataccagtcccaggaaacagtgctggtatcacaggaagatagaatatcacagcaacagaggtctctttattatagagtaggagtacagtcatgttgggctgcggacagatcccgagctcacaactgcattacaaaagggaaacggaagccgggacttggaccaaacaacacaggcgcgacttgggaactaggccgaaaccctaaaactcatcgtaaccggcttgctcctggaagaactcctcatcagcaggatccgcttcatcttcatcagcaactggggggaatatttatatagagcaagggtgagtacgggagtactcagcaagccaggggaaataagtgtttaatgcaggcttcaaggaaaggctgttgttttcgtaattgattttatttgaactcttttctaaaaacatctaggtgagtgcttctcaaacgacacggttgagacagtgcgtctcgtccggtcggagtatgtgcaatgtatcagtctttagaatttaaacaaggttggcacccggccaacagctttttcaacggccacccgggccaacaacttttcaaacggccacccgggcctagctgatcccatcagctgcagatttttcaaacaccgaaccccttttcacacagtaatttcacaagcagtagtcaaacaaaactacgctaggaatcacctcacatccgcccatgaccgtgggcacggctgttcgaacagtttgttaatctctgcagagggggtacactttacccaca

SEQ ID NO: 16337 - DNA, 307 bp, Oryza sativa
tcatcgccagagattaattacgaccccgtagcgattgctatggggttttttgttgtttaggcgaataaaaaagaacaaagaataaataacaaacaataaacaacagatagcaagtaccaaacaacaaataaggtaattgggtactagatagctaaaaaagtcgcgggatagacataattctagttgtttttataggcgtgcaaaatgtaaatccattttagcgtacttatctttttttcttctcaaattgcctatttctcgctatgctgatatgattttagtattaattggtctatacggtttaaga

SEQ ID NO: 16338 - DNA, 1501 bp, Oryza sativa
taagatctaatagtgaaaactaataatttaatggtcaaaaatgtttggtctaatttgaatttaaataatataattaaaaaaaggagggtggacacctgccaaggaacatggggaggagggcgtactataagtacgttgtcagggttatgggctaaatctcggcagaacccaccacatatcatgtcttatacggaaacaactttcggatataggaggagttccgcataagaaaggatgaatagagttctacatggaaacgacaaggactactcggattgtatccatattggtttccatagttctacttggacaagggaacacctatgggtataaatacaagaccccctaggaggagaggggacacgaaacaatagatcaacatacaagccaacatacgccaagacaagacgccggatatcgacttcagagataggcatggctagtcccctacggtgcctatggataccgtcaggagagatatagcgttgtctctgatctcgccggatgtggattcgaggaggaaggctaccctgttatcgactacgagttagaccttcagaccgccatgtcgacaacagttagataggctaccccaaatattgtactggtgtgattatgataaataagagcaacgaccggcttcggccaacaggatgtagggttattacctgacaattcaagggcccgaacctgtataaaaatcctcgtctctgtgtcttttacctaagtctcgcgtatatactagtatcaacgatctccatactatgcaaataccggaatcacgacatcaaacgtcgacatacatgtataggacaatgatttagttttattttctaaaaacatattataaataattgtgatttccatctaactaaaatagcataaaaataggagagaaaaggaacaaaggggagggcgtacacccggtcaaaaataaaaagggggagggcgtacacggacacgtacataagcgacacgggaggggatgtgattttctttttttttttttgaaaaatagatctaatgacatataatgtcgggtcgatcatataagtgtaaatctaatagatgaaaacctaaaatagtgggtccactgattaattagagtgccacatggctgtttcggagtgcttttagaagttattttttcactcaagaagaataatagatagatagatagatagatagatggaaatagatagatagatagaagttattttttcactcaagaagaatagtttatccgaactatatatcctaaagaataatgcacaattgatagccatatatgtatatatatgaaacacgctccagtaatttacacacttttttacccgggtggcaatgaattgaaccagttttttaccattggaattatcggaactatatatgcaatcgagcctaattatttcgtttttgtttcatctcccattgaatataaatgctctctactacagtgcaagagcggcaacaatcctcatattcaaggcgtgacttcgcc

SEQ ID NO: 16339 - DNA, 1501 bp, Oryza sativa
ttgaagccatggatgcgattctccctttgttgtcaaccggagtggaagtaggggatcgagaacctcgaaccacctcctcgcttgtcggtgtaggtgaagtagattgtcacaccctgaagttcttctcccaagcctaaatttaatttataaatggtcttgagaaattaccggtgtaaaagcaagagtgaaaccctaatcaaattaatgcaaataataatcggaaatggcatgtggaatttttcttgagttctacatttcgaaatatgctaacaagatttttagtggaattttcagagctctagaaataattttaaccaattaaaaatgagcataagtgacggagcgtggggctcctcaccgggagaccgcgcaggcccccctttgccggttcggccgggggcgctaagtgaggttcttcgccctcgatctgaggaacgtcagcgagagaggaagtgcacaagacacgggcgacgtagacaggttcgggccgctgagaagcgtaacaccctactcctatgttctggtggatctgtgtgtgaaggaatccagcgagccggagagcgagagagagttcaggctctagaacccctttttcttctcttctcttctccccttctaggcctgggcctcctttttatctggtcaggggtcaccacatgggcctctagctgcctaagaaaggaaacatgctttttacaatgagggctagtctacagccggaagtgacctctgacaagcagagcacacgcctcctgcccccctcgccagctttcccggtggacgcccatttcaaccttcattcaatggccagcgacttccttgccatgcttgcgctgaagcctggactggatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacgccgcgaccggtcacggaccggataagcgtgcgctgcgccgcattaaatgcggcgtggcgcgctcgtccaacccgctataaatgcggttaggtgagccccgctgtgctcacctaacccacacacgtggcgccaaaaccacagggggtcagggcgccccagccctcggggccgaaacgggggcggcccgacctctcggggagacagagggaggggtggccacgtcaccctcgggcccgacccccccgagggggtcaggccacgtgggtgaccgcggctacccaagcctctagtcacgatacccccgaccccatgtcaccgacagtagcccccggcgttacgccaaggcgatcacctccctcgagggaagcgctcgggcgtgacgccactccttaggcccggtgacaggtggggccggtccctacaggcgggcagaaacccagcggtcgcaaatcgcgcgcatcggcaagggaaaaccgaccgacaataa

SEQ ID NO: 16340 - DNA, 1501 bp, Oryza sativa
cgccgccggcgatgcgcctcttcttgctttgagaagccatcggtcgtcggctcgtcggttgtggccctaggttcgtgtcgaaacaagatttcggcaataataaaagggggtggctatcaagctaggaaagtggatggatttggagacaaggaattttatacaggttcaggccttcttattcaagaagtaataccctactcctgtccggggatgattccgccgagtgtgttattgatcgtatgatctgggaaaaaagaaattgtcccgagaggaacccggacccctccttatataggggaagagatccgtattacaaaatacagtccatatccctaaaggaatatgtgattacagataaaatacaatcttaaccgactaagatctcgggtatttccttgacatacaagttagaaactaacccgagttctcataaatatattctatctatatttggtaccgtatatccgactaaattataactgtcatgtagatatggggtatccataatctccacagtagcccccgagaccttcgcagttgacaaaatagccttctcgaaacaaaaaacagtaatccgagtgcttcaattcaacttgctccagcttgccgagtgctaaaatcaaagactgtgaagggcgaaaataaaacatggtgcatcgagtagatgcacctaattaggtgtagccccccgactatgtgattagttgaaacactaaacatgtagccaagaaccgagtggttttatagcgaagtatgcatggtactcagtaaaatacccagccgactacttctcaacttgaacatatcaaggataaaaaatacgaaaagggccgagtgataaacactcaaaaggtctaaaaatagacatatttgataggaatccgagtaagaaactcttaaaatgatccaccaaacatgataaaaatcatagtaatcaacgagtctaatagcctaagctatgactctcaccataaccaaattaagcatataacatgctaagagaatgactcttaataaattagtcatctccaatcaacccaaacagcttttgcagcctaataaggcttacaaaaatagtataacaccttcctgtcaggcaccttttgtttgcatcgtgttaattccaaagaattatcaaaccacattaaaaaggattttaacagcattagtccacatcattgtgagcacaaattgccaaagcaaaaagcgcctaagtccctagagatcacaacgggccacgctgaaaataaaattgggctaaagtactgtgtttaggctaataacaccgaagtgaaataaaacgtctcttcgtcttccccgccgagactctcgccattttccccatttcctgctatagtacaaaactgcgccggcaattcatcaatccgctccaatccatcctcaaaaacttcacgaaatttcaccccgcgtccaccgcttcaattccccatccctttccagccatatctcggatcaaattaaaccattcagttcacattca

SEQ ID NO: 16341 - DNA, 775 bp, Oryza sativa
ctccgtctccgtgtcccgcgccgccgcccacaccagcctccatccatcttcgcgccgaggggcggctgctcgtcatggcagtggccgccgccgcctcctcgtcccccgccgtcgtcgctgcgtcccccgcctgccgccgagtcgcgccgaccggcgagaaagcgagaggaagagtgtgagaggagagagaggagagagaggggagtatgacaggtgggtactatatttttttaataaataaaatgattactggactgccacgtgtacgccgcgtaggacaaaaccggtctgtattaggtcgaggggggtaatttgtccggtattaaaagttgagggtgaagaatgtctggttttccggatcagggggtaattcggacgaccgcgatagtttgggggtaattcgtactttttcctatatagaaatattttgctatttatcggtcatcagattttgatccaattcttttaaaaaataaaacggatagaaactatgcaaatatatcaccagtggatatatacagctaaatatcacaagtgcttagaccttggtttcacagaacatcaacaaaagaaaacgacaagaagaataaacattgattttttttctcgccgtgctatgctgccatataggtaatgatatttgctcccttgctatgcagcaacaaacagtttttttttttcagccggctaaaagttccactgcaattaaacgcatgtgaaaattatttttttcaggcagacacactaagcaaccctgatgtgtgaaaacctcttg

SEQ ID NO: 16342 - DNA, 1501 bp, Oryza sativa
atagcttcataataattctgcaatgcttcataataattctgcaaagcttccacataatttccttcagattgagacaacatctattatggtcgttcattctatttaataaaaatctccgctccaaaactatactccctccgtactcgtaaaggaagtcgtttaaagataatgtttaagtcaaaccttgagagtataaatcatgaataactctcaagttgttgagtttgaaaatgtaaaaattataaaatactttcgtaaaagtatacatatattatttttcaataaatatttttatagaaataagaaggcaaagttgtgttttggagaccgtatcgttgtccaaaacgatttcctttacgagtatggaggatgtacatgaggttttcacctcatacggctcctcatagtaataatgtaaaaatagaattaattccatatcattagtagatcgtgccgtttaaaaatgatgagacatgttatctggagtataccaattgtcaatgttagaaatgaaaacggatatcgagtatatgtgcaattaatgcatagtgtccatgccgacgtttgactagaaagagatgctttctctcatcatcaatgatggagcctgctttgttttcttaatttgtcatgatctttcatccacaaatatctcttgaaatttgaagtatcgtttaaaagcatttgcttttgatcaaggaaaataatagtgaatttaataattgtatacttaaaaaagcggttactttatctctatataatagctctaactcctccaatctcctagccaaagtaatccatagaattctctctcatcccgattatattttctctataatttttctttagatctgtataacaactacattattatttttagtttgtgtgatctccatattagccttcttactacccaaccctcactctaattataataccattatttggcaccgaactttatcaaatcaaagtattgaagagatcttttattcatcatcatcactatcacgagttcacgaccgccatcgatctccttatctcagagtatctcagatctgaaaaagtacttacctatattattatttccctaatttcgggctgaaaaatctttccaaaaacaagaagagcaaaccccataacaaaatccgatctccggcagtttccccaaattttgttcgaatatatagtttccaaaggggcaaataacggattccatctcttgatttctactaccaccgttcgcatggaaagaaaaataaataaacaaataaaaaaacccccaaagaaaatccccatcacctcgtcttccccaccatttctctctcctctctcctctcactacccccaaagcagcagcaagcggcatcagcagcgagcacccaagctaagccagcagcagcagcagcagcagccaagccaattcccccaaatcgcctcctcccaaatgcgactcctcctcctcccctgacgaaaccctccccctccgcctccgcctccgcca

SEQ ID NO: 16343 - DNA, 1501 bp, Oryza sativa
gccacgggcagcgtccgcagccactccggcggctccaccgccggcggctgcagcgacatggcggaggcggaggcggagggggagggtttcgtcaggggaggaggaggagtcgcatttgggaggaggcgatttgggggaattggcttggctgctgctgctgctgctgctggcttagcttgggtgctcgctgctgatgccgcttgctgctgctttgggggtagtgagaggagagaggagagagaaatggtggggaagacgaggtgatggggattttctttgggggtttttttatttgtttatttatttttctttccatgcgaacggtggtagtagaaatcaagagatggaatccgttatttgcccctttggaaactatatattcgaacaaaatttggggaaactgccggagatcggattttgttatggggtttgctcttcttgtttttggaaagatttttcagcccgaaattagggaaataataatataggtaagtactttttcagatctgagatactctgagataaggagatcgatggcggtcgtgaactcgtgatagtgatgatgatgaataaaagatctcttcaatactttgatttgataaagttcggtgccaaataatggtattataattagagtgagggttgggtagtaagaaggctaatatggagatcacacaaactaaaaataataatgtagttgttatacagatctaaagaaaaattatagagaaaatataatcgggatgagagagaattctatggattactttggctaggagattggaggagttagagctattatatagagataaagtaaccgcttttttaagtatacaattattaaattcactattattttccttgatcaaaagcaaatgcttttaaacgatacttcaaatttcaagagatatttgtggatgaaagatcatgacaaattaagaaaacaaagcaggctccatcattgatgatgagagaaagcatctctttctagtcaaacgtcggcatggacactatgcattaattgcacatatactcgatatccgttttcatttctaacattgacaattggtatactccagataacatgtctcatcatttttaaacggcacgatctactaatgatatggaattaattctatttttacattattactatgaggagccgtatgaggtgaaaacctcatgtacatcctccatactcgtaaaggaaatcgttttggacaacgatacggtctccaaaacacaactttgccttcttatttctataaaaatatttattgaaaaataatatatgtatacttttacgaaagtattttataatttttacattttcaaactcaacaacttgagagttattcatgatttatactctcaaggtttgacttaaacattatctttaaacgacttcctttacgagtacggagggagtatagttttggagcggagatttttattaaatagaatgaacgaccataatagatgttgtctcaatctgaaggaa

SEQ ID NO: 16344 - DNA, 1501 bp, Oryza sativa; identical to SEQ ID NO: 15415

SEQ ID NO: 16345 - DNA, 902 bp, Oryza sativa
atacacggttccatttagccgaggctaaatatattttcccgatctttccaaattcttttaaacccggttagggttaataaccgggactactgataagcgcactgaatattaatttccattacatatgtgttcctaaaatagaaaataatgcattaaaattttttaaagtcgaaaaattaatgacaattacttcgaaaaattattgttgtctgtagtaaattaagtggataaaacgtaataagcaaatatatgatttaaattaataaaaattctaataatcatatatatacttagcgtatgaatgatattaaattgttaacaattgtaattaacatatgtatatacatacgacatgcatgatttaaaattaataaaaattctaataatcttatataattagcatatgaatgatattaaattaattgttaaaaactctaattaacatatgtaaatacatatgacatgcatgatttaaaattaataaaaattcgaataatcatatataattagcatatgaatgatattaaattaatttttaaactctaattaacatatgtaaatgccacaagcatgatttaaaacttttaaaaatcctaattatcgcgtataactagcatatgcagggtttaaaattgttaaaaactctaattagcatatgtaaatgccacatgcatgacttaaaacttttaaaaattctaattatcgcacataactagcatatacatgatttaaaattgttaaaatctctaagtaaaattgttaaaaactctaagtatcatatgtaaatgccacatgcatgatttaaaacttttaaaaattctaattatcgcatataactagcaattacatgatttaaaattgctaaaacctataataaacgtacgtaattaacatatgccata

SEQ ID NO: 16346 - DNA, 1501 bp, Oryza sativa
gacaccaccagccgggggcacggagggctggtcctcacgtccatgtcgaggtgacactctggacgaggaggcgccctccgttgcacggggagtacgccggctattacgccggcgctcgatgttgaggcgggcatccggctcctcatgctgatcctcccgagtcgaaggtgtcgacgagggagtggcagccgaatgacgtgcagccgccgccgctcgccgcgccctccgccttgatgacacggaaccggtggtggcggcgccggaagtcttggtggtggcggaccgtccaccagcacccaggcgctgctgggccgtcacgaccaagttggccacgtcgtccagccatcgctgagctggagactcagggtcatggacgacgggtgggtgacgtaggagcgcgctagcagcctgaagcgcgccctgaggcgtgctgccgtcgccgtagacgaggaggcgacgctccccatctcgccgttctcctgcatcacccacgaccggtgatgctgcggatttatcaaccctctcgagcgcctccccctgcttaggactttggcgtggaggaggtgggggagtacgagctcgacggcgcgggtttggctccccgtcgtcgccgctcacactcggagagaggtcgtgcgcctttgcttgctcggccattaggcagaacaagggaaacttggcgcacacggaagagtatgagagctcagaaaacacacactgagccccctacctggcgcgccagatgacggagctcgtggctcctcaccgggagaccgcgcaggcccccctttgccagttcggccgggggcttagggtgagatctcaagctctcgctgtgtgtggaaagatcgcgtgccaggaagaaacacgagacacggcgatgtatacaggttcgggccgctgggaagcgtaataccctactcctgtgtttttgtggattggtgtatgaatgagctaccaagtgtcagccaacttctcccccgttctaagctctaaatctggaaaagaatcaaccaacccccttctctatgggcaaggtcctccttttatacttcaaggggataccacatgcaccctcctccttccaaactggacttttcttctctttatggacggagattggtatggttgctgttcgaatgacacttcgatgggacagcccacacctacctccactcccggcggagacgggcacaacgtgggatcgtggctgcccgttgctgacgcgaccagtgtcagactggtcacttttgtccaccatgtgtcagtttaacaagatgcatgtttgcccttcttcgtgtaacaccttgcctgtaatggttaggatgaagcctggtataaatctaaccagggctaacgtgccatctctaagagataacacgctagctccggcttgagacgagttgcctagaggctttcgtcttgacgggatggggcaaggcgcgcgtcagaccgccagtcgccacctaacccttgatctgaccggtctgtgactggtcac

SEQ ID NO: 16347 - DNA, 1501 bp, Oryza sativa
cgatccagagtcgggtcgaggccgatggaaaccctaaccccctcctcctcgtcctcctcctgctgctgcttgccgccgccgccacccctctccttctcctcctcctcctcctcctcgtcttcttcatcgaggtcgccctcgaactcctcctgcttactccgccgccgccgccgcgtccccgcgcggaggcacccgttgtcgtcgtagaacgcggaggcgcagggcgtgtccccgcggtcggcggcgtcggccccctccctcgcctcctcctcgtcgcgggcctccgacggcttcgcccaccgccgccgctccacgtccccggccgccaccgaccacgacgccgccgggaaggacgaccccggcacgtcgtcgaacagcctcgacccgaacagccgcttcacccgctcctcgaacccctcccctcctcctcctcctcctcccccaccacctcccgccgccatctcccccccctcccctcctcgacctcaaccacaaccttctcgaagcttctcgaaggttcgcctcgcctcgtttggatttgtacaagggtttgggttgggttgggagatggtcggtatttgagccgcgcaggttggaggcggttcgcctcgcgctcggagtgggcctccgagtcggtgacgatatggccggcccaccgcacaattgaatgggccatgggctttggtcctaggcccgcatggagttaaaacaagcaacagtaaatttcagagaaaactgcaattatttaaacaaaactatcacttaaccacaacgttaactttatatttttcacaaaattgcaacaatagaaaaaaaacatttatcagaaaactgtaactttttatgcgctatgtacatatgacatgtgggtccaacttgacaaaccatgagtactacaaatatatgtagtacatgttaggcctaattttacaagacaaccaaagcttgcaatattccgataatactttctccatttcagaatataagactttctagcattattcacattcatatatcatatagatattgtcgagattcattaacatttatatgaatatagacaatgctagaaagtcttacaatatgaaacgatatgaaacggagggattatcagttgcagttctctataataataactttaatttatagaagtaattattttatcttaaaatatgagggattgtgattggatatgacacattgctggacaggattgtacagttttgttgaaaggaataagttcaccggctgtccctcaactttacatcgagattttttgaggtcccttaaccacaaaaccagaaatctccacccctaaattatacgaaaccgttcactcaaggtccctaggtagtatatatgggtggttttgctaacgtggcatcatagtcagcaataaaataaaataaaataaatatgtggggtctacatgtaagtgagacaatggtgtgggttccgcatttcttttttttttctttttctcttctcttctctccgagtt

SEQ ID NO: 16348 - DNA, 1501 bp, Oryza sativa
atgtcctaaccattttgcctatcatcatagtaccactggtataaagcgatcacttgaaattgaaggcttcaaaatttattgccacttgttggaaaactgaaagttagtaatgacaacaattggatgcacatgtgagtgattgttggatatatggtaactgaaatcaaaacatcaaacacatgatccattctaactttaacttgtgcccctgctctattcccctgtttcatgccaaaagaaaaaaaaatgaaactgaaatgctgcctacaaaaactgaaatatgcaagtaattaaacttatgatataatttgaggtgctactgaacatcaaaatgagcacttacatatgcacaccaaaaaatgaaattaaaacaatgacatgtgcagcactatgatgtgtaccaccataaataaacacaactcaaaaatctatgtatacataaaaacaataagataaattcaggctttgaaatacaaatgactattcatacaatgcattgttttattcatcatttgtatatcaaattttgaggtgttctttttttggtaacacatacaaatacaattatgtgttgcgagacttaaactcaacctaacctaggttgatataggtagtgcacattccattttctctcccattgtctaatggaaaagaaccagtttctcagcttaaagtagctttccacaccacaacatctacaaggcaaagcgatttccccaatggaaaactggtacacaagcatggcacacacactcaactaagcttgtctcttgcaccccccccccccctaaactcctattttaaacaaaacaaacccaaaatcatctggataaacaaaagatcacaaataattaaacaaacacccaaatctaactttacaccatcttttgcctaccttttacctttacctttgcgaaatcatcatcagaacccaaccaaatggagctaagctctgctctcacttgaacacctggtcccatggattgcctatagctgattaattgattataacccataataataaattatagataaatttttcacatatatgctctcggcgacttaaaagttaatattaaaaagaatatatcaaaatctatcaacttcaaaattaaaatttaaaatttgacatcagcttataaatatagggcaaaagatgagagatcgcttatgcttatgcttatcagtcaaaatttaaatttttaacttatatttggagctgattttagggtttttcagtgaagtttatttttcagcatttgtttttagatcgctaagaagaactatataaatttttttcacaaattatgaataagtgaaacgttggggctatgtttgacaaataggatagggaaataattttccacccatcaaaagatatctttaaatcctaaccatttattctcccccttcatttaatcctaacccttcgttcattttactggggcacgaggcctgggattaccctgtccaacctatttattgccacctatccttatct

SEQ ID NO: 16349 - DNA, 1501 bp, Oryza sativa; identical to SEQ ID NO: 16237

SEQ ID NO: 16350 - DNA, 816 bp, Oryza sativa
cgcagcgccgcacagcctcgcctgcgtcgcccttcaccacgccccagcgccgcccttcaccacgccgctgcaccgcccagctccacctgcgccactagggttaggggtttgggtggggaatttttcacgagggagagggagagaggggggggagggggagggcagggatatttttatgtaactgccacatcatttgccacatgggtgtgccacgtcggaccaaaggggtaaaatcagtcgaaattggtcgcgggggggattgaatagttcaagggggtattatatctggtatcatagtttaagggggcaaagcgtactttcgcaagagtttaggggggtaaatcggacttaaccctttaaggaataacctatatcacttagttgaaatttggcccatagttgaaagaaaaaagatttacttttcctaatatttgcatgtcaaatatatctccaacacgcattgtaaattaaatacgtgtctaagttttcttttcacacaaggcagtaacttagctttgataaaccacatgaaaaaaaaattgatgggcccgatacatcaacattgtccttatgcacacccatgatgagaatatatgtgtcctattaagacgcacttatagcaagcatttttgaagaaggcaactttgttaaaccacatacctgaatactttgataacatcagttggctttctcagtatttcactcctagcttgttggatttcctacacaaatagaattgtggttgctacacgaaaactaattggatttcccatgcaattttacaggaccaattaaatagaaatgtgtttactacac

SEQ ID NO: 16351 - DNA, 1501 bp, Oryza sativa
caacgctgaagcacactagcaagagcattgtagcacaggctgccagccaataactaactcatacgaaattaatggagcatagtagcgctttcccctgtgcatcactcacatcaactatcaactctttatctatgtcaattcttgattgacagacaagaaggagtaggcggcagtggtgaacaatcatcggtatccttcttttccccataaacaagcacggcttttgtgattgttcttggaatagcatactccgactcgcgtaaatgcagcttcaccagagggtacggaatcggaagactcacttgtttaatcatataaagtgaaagaagttctcctatcatggattgtgaatggctcaagtgattgcttggttgggtcagtccggttctcagagaatccatgtgtttcgtgcttcgtgttagcttgtgagtaaacggctactgttttcttgactctccttgttctggcctcgcttgcttgcattcctgtacttcctcaaggtatcaatgaaacaggcaatcaagatctagttgagcaaggcatgaatgataattgatgtgactaatccccctgtttgcttcttccttcatccgggctgggcacgtactccgatttcgaacttagtttggctagattcgaatgccttttcgaatttaatacgacatctcttgatacctttcactcctattggtcagacagatccgggcttatcaagtggtactgaaatagggtaaaattcagtttagtagaaaggaaggaagcaagtgaagaaagatgggatcaaattgtgaatgttcttggttcgcatcttgctttttgggcgtggtttcgcaatggagctagaaagattggtcaactacttcttaaacccaagcaagctactttgactactttacctagcccaagccagacttcaaacttactttctctatttagctcttaagcctttttctaccgaccgaacatgaagaagctcacggaagaagtaagtcattacggttggcagggattgactttccgttgaagtattttcttacctgttgtatagaagtcttcgtttcagtcctcctagtggccattgctcctagtatgagtagttgtgatgggctgcgagttcccggggtgacgagcctttagcatccagattgggcaatacgagatagattgatttacttcgaggatagtctttcttttccaagcgagaaagtgcaagtgtttctattttcacaagtgaagatattgaaaagcatatccgaaagcaaagaaatattacctgggcgttgtacgcccttcttgtttttgaatcacggaaatgcggaggttttaattagtgcttacctgcagtccaccctttctttgaaccttgtcaatgatcgaatttacagatatgaactgagtgccatttgatgagtaagatcgaacaagggagagggatatggaaaggatgaagtaatgaaagaggaagtcattgctagtagtaacgacttgtcacgatccattg

SEQ ID NO: 16352 - DNA, 921 bp, Oryza sativa
aacaaccattttttttagcatatggggtggctaaaccaaacatcagtgttttgtcactgtgcacactccgtaatcacccggggcaacgcacggccacttttgctaatatatatattatatatatatataatatatataatatatatatataatatatgctgagtgtcagggttatggataccacatatctaatagtagttgactaaatctcggcagggcccaccacataccatgtcttatacggaaactgacctcgagggagttccgaataaggaaagaaaaccagagttctatatggaaatgacaaggactaatcggattgtatccatattggtttccctagttctacttggacaaggggacacatatgggtataaatacaaggccccctaggaggagaggggacacacacaatcaacacccaccatagacggaacaacatacaagccaacatatgccaagacaagacgccggatatcgacttcagggataggcacgactagtcccctacggtgtctccggatactgttaggagagacgaaagcgctatctctgatctcgccgggcacggattcgaggaggaaaactaccctattgtcgactacgagtcagaccttcagaccgccatgtcgacaacagttagataggttaccccaaatattgtactggtgtgattatggtgaataagagcaatatcggcttcggccaacaggatgtagggttactacctgacaattcaggggcccgaacctgtataaaaatcctcgtctccgtctcttttacctcagtctggcgtatatcctagtaccaacgatccccatactatgcaaataacggaatcgtgacatcaaacgtcgacagtgacgcgccaggtaggggcattttggtgcttcaggattttgatgagatggattcaaaaga

SEQ ID NO: 16353 - DNA, 1501 bp, Oryza sativa
agggtaacatgttatagaatgtatggaaaactgaaaatgaattaggtttacaaaccaatgttttgtatatgagcgtccactcttttaccgacttcgaccaatcagtttgttgagttatacactctccctagcccccagccttgtcgtcggagaatcgttctcgggtgataagactcttggacctttgacctgccttagttgaacaagtactgatcctagcccccagccgtgaagttggaaaatccatttccgattacacggcttggttaatacgcacggtgagaactcttacacgaccagatcttacatggtctttcgtctctgaaggatccgacaaagccttatccgctctgggcgtccccagccgaagttcccttaggttcctcagaggctttgtcaagacgacgtaaagggacattaggataggtttcaatgctaggtgtcttttgtggtaagggatctctgggcaaaacacttggcgatattgtgcacctgatatcaactctgttggagtagaggtaatgggagaatcgctacacctctggtcgaggaccaggtagtagtcgtaacccgaccacttgaagtgaaaatagtgggagaatcgctacacctctggtcgagaaccaggtagtagtcgtaactcaaccactagaagtaaatgtacgagagatcgctacaattgactggttgaggaccagtgagtaggtgtctctcaatcatttgaagtcgtggtgcgaggaccgcttgtgttattgctgtagtcgttcctcgaccatctgaggttgcggtgcgagagattgctacgtactggttcgacgaccagcgaacgagtaaaattatctctcgaacaccaatggaggttgcggtgcgagagagtgctacgtactggttcgaggaccagcgaacgtgtagaattatctctcgaacaccaatggaggttgccgtgcgagagagtgcaacgtactggttcgaggaccagcgaacgtgtagaatcatctctcgaacaccaatggaggttgtggtgcgagagattgctaagtactggttggagaaccagcgagcgagtagaatcatctctcgaacaccaatggaagttgcggtgcgagagattgctacgcgctggttcgaggaccagcgaacgtgtagaatcatctctcgaacaacaatggaggttgcggtgcgagagattgctaagtactggttggagaaccagtgagcgagtagaatcatctctcaaacaccaatggaagttgcggtgtgagagattgctacgcactggttcgaggaccagcgaacatgcagagttatctctcggacaccaatggaggttgcggtgcgagagattgctatgcactggttcgaggaccagcgaacgtgtagagttatctctcggacaccaacagaggtgctagagttggtttattatgtgcgtctcatgtggctagcttgactcacacacccaacttgtagcatatccggatgtccgttcacaatcatatcg

SEQ ID NO: 16354 - DNA, 636 bp, Oryza sativa
aggggaagggctcatgcggcgagaaggagaggcagagtagcccgcgttcgtgtggtagctctccctctcctggtggtaagacctctcagctcagcctttacgtttcgttattgatcatcccctctcgaaatcgcaagtgcaattgcctctccattctagtctttggagttcatcgatcgatgcttttagagttttaggtgggtgaatagcagtggggatcgattatccggcacagcgtagagccctgatctttggtaagaacagttagggttttgtcaaccgctatatttcgctgtttcaggcgttaattccagtctaatcaatgatcgattgacagattaggatgctaatttacgtgctccacacatttattgcgtcattcttttactcttgcagtaatttgatggaacgtaaggattaggggaaattctcttttttcccccgaaagcctcagaaaatcccagccccaaaaatgtggggaagaatataattttttaatccagtgcagccattgttgtcatagcaagagtatatcttttttttttctgtcattttgtttcccctggacgttggctgtgtggagaatgtgtgcttcttttaacatcaagattaactgcaaatatgttcaaatgcaga

SEQ ID NO: 16355 - DNA, 1501 bp, Oryza sativa
tatatatatatacacatatatatacatatatacacatatatacatatatatatatatatacatacatatatatatatatatatatatatagagagagagagtattaggaggtggagtaatgtggaccattcatcaagaggggcatggtacagaatgaaaattattataaccactggttgtggagtaattaactagtaaaatattagtattttaagtggatggattactcggctggactgaaccggtattgatcggtaggtaaaacgtaaatcgggcattgatttacgcatcgaatagatcttcacagaaaaaaggatcagaacgtcttctttcttcttctgcattggtttgttcttgttctagggtttgacctaaactcactaaaaagaaacaaagggagaaccgttggaatcattgaggattcaatataagacgagatagaccggtcaatggttaggtgaagcccatcttgtaagatctccttcacgcagttgattagttatttatgtagttcacaaattccttcgtataaggggctgaaataagatctctgttctaatagggtttgaataggtggacacaaaagaacactagtacagatcctctcatctgtgacggcccatcacatacctaggcaacgtgggtcgtcagaacgaagtcatctcaatcgggcctaaatttttgccattgtagatgtactcgtcggggtgcatattcctatagcctgtcaccgatgacactcatctgtgacgggctcgaagttaggtctgattgagatgacccccactatctcaatcgggcccaaatactgagcccgtcacagatgagtgtcatcggtgacgggctccaaagaaggcccgattgagatggccttaatgcccgtcaccgatgactcttatcagtgtcgggcttctatttatgcccgttagagattagtgtgcgcccgttagagatgatattttttttgcccgattgtgatatactttgcacactatatatattccagcagtccgttgtctgtagttatcccactgttcactatgttggtgggaggttgaagggggcaaatttttgtaatttttttgcaaacaaaaactggaaaatcataaaagtaagcaaaagggtactaatcatttcctattaatttagtagtacttatgttatgagatgttaactaatattttgttcattgtttagcgatggatcgaagttggatgtacacgactggcctgatgcgtcagtacaaggagtttagagatggcgtattaagttttatgaaagccacagtggaggataggataagaagaaacgacaagtacatgtgttgtccatgtagcgattgcaggaatgagatttggttggatgatgaaaaggaagtacacgctcacttgatacgccgaagaattgttcccgatcaagcttcctacgcgcaggctcatttcacagtgctgcaacatatggctgaagtaacccagtgaacttcagcctattatagatgaga

SEQ ID NO: 16356 - DNA, 1501 bp, Oryza sativa
ccctctcgtgcctaggtgaatccggaaggacagaggccgtcgcagggcccgtcccgctccatcacgcccacccttgcctggatgcgtcatctagaggaaagctacactacaagcccagccgttgcccacaatggcttgtggtaagtacgataagttcttccagggcatcccgcgaaccggtccttaattgctatgggcgcgaccatcaaaaccatgcacccacaacccaccatttaatatattttaattaaccaacaccggagcggtggcattaaccaacattattactagaatctgatatcaactcaataatgtattttccccattgtgtgttagttgaactaagcatggctaagtaatccctagtccaatatctagtcatgttatatccccaagctaacaaaggagcatggtacagaaatagcatggctgtaacagtaggtaaagatcccatagtaacattataaaacgatgcagtttttaaaggaaaacgatagagcatttgcaatataggatcaacatgttcaagtgacaagcatgacttgccttgctctgctgctggaggaacctcggcgactatttcaaagtacaccggagcgtcaggagagccggaatctaagcgacatacaaagcaaacaatgcaaacaggctataagactactgaaacagagaacaaaagcatttttaatggattttatgcatttttcttgatttactgcgacttgaataggcttaaacgaagctcggatgaattagatatgaattttagaagattcactgtgtttttactttaaacagaaaaatccttaattgatttattgcgcaatatatcccagggctgacgtcaacaagggagggacggcgccgacatgcgggccccacatggcagtgactcgggtggcggtccacggtggaccgggtccacggaccggggaaggaggcggcgcaccacgtggcgccgacgtggcgcacacgtggcagccatgtggcacgccacgcgggcggccgaaccgacggccccgatctacccgagggtagatcggatggcggcggggagcacgcggccggcgcgctcgggcggctcaagccggcccggcggccatggcgcacggcggcgctaacgcggggcggcggcggcagacggcggcgaccgatggcggcgtgatgagcggcggcggtgcgacggcgcggacggcgatagtggcggctaagcggctaggtggtggcgcggcggctaagtggcgcgggagagagagagaggaaggggagaggggaaaaggtgtctcaccgacggcgattgacgacggcaagcgacggagggcgatgacggcgacaggacaagctccggaaccacctagcgaacacggtgcaaggggttagagatgaagaggaaaatggaagagggcgaggacgccggccgaaggcggcggccatggcagtgctcaccggcgcacggcgcggagtgagttccggcggcggaatctgacaggagaggggtgga

SEQ ID NO: 16357 - DNA, 1501 bp, Oryza sativa
acttttatttaatttctggaaaatacattatttaatgatttttaatcccaacgaaaatcggggcgttacagctaggcccatctggcctggctctttgcgcatcttcccccctgaccttctctacctatttctcaggattttgggttgactctcgggtattttgatgaagttcataacccatccttgtatggatacataattctcctcactttagtctagatttcctcccaacatcgaggtttatcacctgctgacggagcatgggggtcctcaccgggagaccgcgcaggcccccctttgccggttcggccgggggcgctaagtgaggttcttcgccctcgatctgaggaacgtccgcgagagaggaagtgcacaagacacgggcgacgtagacaggttcgggccgctgggaagcgtaacaccctactcctgtgttctggtggatctgtgcgtgaaggaatacagagagctggagagcgagccagagttcagggtctagcacccattccccttttttctcctccctccagagtcccctttctttttttcttttctcttttctctccagagtccccccctcttaggcctgggcaccctttttatctggtcaggggtcaccacaagggcctccagctgcctaagaaaggaaacatgctttttacaatgagggctagtctacagccggaagtgacctctgacaagcagagcacacgcctcctgcccgctcgcccgcttttccggtggacgcccatttcaaccttcatttaatggccagcgacttccttgccatacttgcgctgaagcctggaatggttctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgactggtcacagaccggataagcgtgcgctgcgccgcattaaatgcggcgtggcgcgctcgtccaacctgttataaatgcggttaggtgagccccgcagtgctcacctaactcacacacgtggcgccaaaaccacagggggtcggggcgtcgcagccctcggggccgaaacgggggcgccccagccctcagggccgaaacgggagcggcccgacccctcggggagacagagggaggggtggccacgtcaccctcgggcccgaccccccccccccccgagggggtcaggccacgtgggtgaccgcggctacccaagcctctagtcacgatacccctggccccatgtcaccgacagtagcccccggcgttacgccagggcgatcgcccccctcgagggaagcgctcgggcgtgacgccactccttaggcccggtgacaggtggggccggtccctacaggcgggcagaaacccagcggtcgcaaatcgcgcgcatcagcaagggaaaaccgaccgacaataa

SEQ ID NO: 16358 - DNA, 1501 bp, Oryza sativa
taatgaacggttaggatttaaagatgtcttttgttgggtggaaaatcattttcctttcccattattcaaaaactgcctaggtgtttttttttaaaaaaaaagacaacctaccggagggattttttttatgatgtggcaaacgatcatcagctcgtgctaacggggtgaccgctgggcggatggcaattttgcaagcaaccctactgttgcctctaagggggtgtttctttaccaggctagagagttgttagatttagcgctggataaactcatctcattttatcagatcgaacacatgggaacaaagagtcatgctgagtgaagctgtcccaactcgttggatgaaacatgtgcgcaaatatagccgaacaacttcattaagtgcgacttcttcatgttcccatgtgttcaatctgataaactgagatgagtttattgattgcaaattatctctgtcatgaaagaattggaacgacttcattaaacgtggcctcttcatgttctcatgtgttggaactgataacatggggtgagtttatcgagcgccaaatcaaacgatcccttagtcgggtcgaaaaaaacaccctctcggagagtgataaggggactgcatgcaaaattgctgcatgcccattggcgcgactaactagtgttttccacatgaaaaaaaatgcattttagatggtgcttttttaatataaaaaaccatcctaaagggcgttatcgagtatagaaacataaaacttgaaaactcaaatatacttttataaatatttaaaaataaattacagcatttgaacaggcatacgtacctggcctgcattgtttagtgaaataatgtatagctaggaaacacaatatatgcatgcatggtgaggtatactagaagtaacatacaggattgttatacacacacaccatatcggttgtgaggtcaatgggttattttagacagatacgtacagcacagaacgatacaaatatactccatccgtttcaaaatatttgacaccgttgacttttcagtacgtgtttgaccattcgtcttatttaaaaaatttaagtaattatttattcttttcatatcatttgattcattgttaaatatactttcatgtatacatatagttttacatatttcacaaattttttttgaataagacgaacggtcaaacatatgctaaaaagtcaacggtgccaaacaatttgaaatggagagagtatattgtgtccggcacgttgtgcatgcaattgcaaccaacgaatctgccaaaaaaaaaatatatggagccactgtagcgccacgggtacgtagtacgtatcaaccgttgcaaatgattgatcaatggaatgtcccaccaaacactttccaaattctggtttttggattctcatctccttgcattgatcagtcagtcaatatatagtttgttaatgtccaatcccaattttatatgtgtgataccagatgatatcaacagtaataagaatatatatagtt

SEQ ID NO: 16359 - DNA, 507 bp, Oryza sativa
aaaaaagaaaccgcatgctgcccgcgctcccctctcctcgcgcggcgactgatcgcctattagctatttcgaccaagtaaacagttgggttcgttgtctcatgagtcacaaattgccttcggtcggaccgtactaagagcaagtataatagtatagtcaactactacctccaaatcatctatagccaatgtaatagtcaattcatacaatagttacttactatatgtcagggttgtggataccacatacctaatagtagttgactaaatctcgacaggacccaccatataccatgtcttatacggaaacaactttcggatataggaggagttccacataaggaagcatgactagagttctacatggaaacgacaaggactactcggattgtatccatattggtttccctagttctacttagacaaggggacacctatggttataaatacaaggccccctaggaggagaggggacacggaacaatagatcaagacgcaagatcaacat

SEQ ID NO: 16360 - DNA, 1501 bp, Oryza sativa
cgttgttgtattcttatagctggttctgcatttagcagaatgctttttcaaggatgaagaaggttgtaaatccttcatccatgggggcaattttgtgtggacataaacagatgtctgaggtatgattacatttccttctgttttctttgatatgctgaagttgttgacttgatacaaccctcagaccgtgtcatacattaaatgtgttatgatttttttttgtccaagtgtttcaatgctttatgcaattttgattctgaattattctcttctattgaccatctatacataaaagcatagccttaaaggcttcaaccactaatactctccaacaatatgccttttcctgatatactggaacatggtttacatttcctcatatgaaactgtcatataaaatacagacaccagtgtggaattgctttgtagctaatgctcaatctgaggagatgaatgaattatctaccttactagtttgcgccagagagcaacaagttactgtaccgctaagatttgcatttaactgcagaataactatggccaatttatcttcatggcctgatagtttctgtggtaatccgtaatcgccaggggtgggcgtgtgttgagtgactttgttgtgtacattcattctgattttcatctatattgatatgttgcaggaaattactagagcacttgttgctgacggtgtgccaaaagatagaatcttaacaaacttctgactgcccctagcccactagaacacaattatcagccttctagatgttgtatccttattactcattacagtgattattctttacagcaagcgcgatggaaactcgcaacagagaaacagttttgtactacttacatataggggcttctttttccaattttcctgcacgatgcaacatgctgcgctgtaatctggattttgccagcctgatgtatcaatatcaacacttggtgggcattttcgcatttgaaccgaaaggccctagttcatacagttttgtacctcctgaaacaatacccccttggaaggtgttgatatactccaaattacaaaagctagctcaataaaaggggtagagatgagtggcctcatgtatttgccttataaaagaggtagagatgagtggcctcatgtatttgccttcagttataatttgtcttcagttataatttgtgtattatttccccgcaaaaaaaataataatttgtgtattagaaggctataacaggatcagttttgaattgatttgagatgcgtttgtttgtatgtatatacaactgttcttcccactatcaacaaaataaagagtaatgttcttttcgatcatacataaatttatatgcatgcaacaaaagcggacgtaaagcatgcatgaaaattttcatgcattgacatttactaatgtactagccgataacccagtacctgtagcagtcattcgagttgatttctacaattcagcatcacaacggtaaaacatagcacaactgtgccagtact

SEQ ID NO: 16361 - DNA, 1501 bp, Oryza sativa
tcactaccatagacactaaaattggagacgtcactacaaacgtacgcactctttgctcgtccggcgtatataaggcgcaccccctcagttctactataaacgtacgcactcttgctcgtcgttgcaccgcaccagagagcacttacatgcatataataggtcaggaggaactggcaatatgcaattaatctctttggaggattcatctgtactaatataaaaaggaggagttcacccctagcaatcctacaagtgaaatcaaccactcttatcccatccgtccatccaccctctcatccaatctgagccgtccgctgtacaccgtagatctatatccaccagcgatttggcccgatctcatcccaccagcgatttcgcccccacggcccgacgcggtaactgcgacgcgcaaatccccggtgcgatgactcctccgcctggtcgctccgcgcctctctccccgcccgcatcctcgctctgcgcctcctctcctcacgacggtccaccgccggaccagcgacctcgcctcctcgctccgcctcaatgtcggaccagcgccgaggcactaccgcactgctgcccatggccaggcacgggtccagtcgcctctgaccggcaccacagcgcctccgctgctcgcagggacgccgccgctacccgcccggctacctccgttgccaccgccaacacgcgagtctcctcctccctgatcgagatcgagtcgacacacatacaccaccaaccaccggccggccgccgcgcaccggcgagcaggatggggaggccgccgtgctgcgacaaggttgggtaaagaaggggccatggacgccggaggaggacctgatgctggcctcctacatccaggagcacggcgccggcaactggcgtgccgtgccgaccaacaccggtacgtgttcttgtgtgttcttgatcgatcgatctgcgttgggttgcgagatctgagatttttgcatgtttgatctgtgcgtgtgtgcaggggtgatgcgttgcagcaagagctgcccgctccggtggacgaactacctccagccggggatcaagcgggggaacttcactgagcaggaggagaagctcatcgtccacctccaggctctcctcggcaaccggtgatttttcttttcttggttttatggttgctttgattgctttgtccatggcgtccatggctgagtgggttgttggctggctctggctgtctacgatgggcgtccatggcataagaggattctgaactgatgcataagagtgtcttgcatttgcagttctctaccataatagtggtccacaacatagccgtgctttctgaatactttcaatggataatcaacgaagctctacactacaaatttctgcaataacatgtactattattttttgtctgaattttgctttgcttgctacctttattttacctggagacaatttatatttggcctgtgataatactctattgtagtgtatgtactaaaaggtgttttta

SEQ ID NO: 16362 - DNA, 1501 bp, Oryza sativa
aggtagtttttggtggtttgcatagtggaacactgtgagaaatagatgaggttcacagtggcgagttggctagattaatcactactacagggacccttttagattccgtgcaggcggcaactcgtcgcttctgggaaaatcggctcattttcacgtgcggtccttttaagaggatggcacggaaaaatcgatgtaaaaggcaacgagtaacaatgttttaagtgtactattgagtagtccttcataaggtaacttagttgtgtttgtagcgtactatagtactcgcaatatctattcacaagcagagatcgccatatctattcacaagcagagaacacagagcacactcgtcctctgtgaacactgcacatccgttttaaattttattactgttccactgctgcagttcagctagcaagcacacactgttcgaagatctcaaggagagtcctgtcgtggtcgagatgccctgcgcgtggcattttatattttattactgctccactccactccgcatttccactgcatgggtccatttactgaaactttttaagctcatctccctccatcgaggagcgcctaccgataagtcgtcaactcttcttggcttttttaatagaaaaaaacaaaactatcaatatttcagagctccacgcatataaaaaaaagaaaacatttcacagctccagtttttctccggtttgaggtgtcaaacgtcgaatatttcactaccatagacactaaaattggagacgtcactacaaacgtacgcactctttgctcgtccggcgtatataaggcgcaccccctcagttctactataaacgtacgcactcttgctcgtcgttgcaccgcaccagagagcacttacatgcatataataggtcaggaggaactggcaatatgcaattaatctctttggaggattcatctgtactaatataaaaaggaggagttcacccctagcaatcctacaagtgaaatcaaccactcttatcccatccgtccatccaccctctcatccaatctgagccgtccgctgtacaccgtagatctatatccaccagcgatttggcccgatctcatcccaccagcgatttcgcccccacggcccgacgcggtaactgcgacgcgcaaatccccggtgcgatgactcctccgcctggtcgctccgcgcctctctccccgcccgcatcctcgctctgcgcctcctctcctcacgacggtccaccgccggaccagcgacctcgcctcctcgctccgcctcaatgtcggaccagcgccgaggcactaccgcactgctgcccatggccaggcacgggtccagtcgcctctgaccggcaccacagcgcctccgctgctcgcagggacgccgccgctacccgcccggctacctccgttgccaccgccaacacgcgagtctcctcctccctgatcgagatcgagtcgacacacatacaccaccaaccaccggccggccgccgcgcaccggcgagcagga

SEQ ID NO: 16363 - DNA, 1501 bp, Oryza sativa
gtggtatttacatatgattattagaatttttaacaattttaaattatgcatatgctagttatatatgattattagaatttttaacaattttaaatcatgcatgtggtatttacatatgataattagaatttttaacaattttaaatcatgcatatgctaattagatatgattattagaatttttaacaattttaaatcatgcatatgcttatccacttaatatatttttaaggttttgtcattaattttgtgacgtgaaatcattatttactattttagaaacccatacataatgaaattaaatatgtagtgctattatctttagtccaggttcttaaccctaaccgggttaaaaaagaatttggcaatcgcgggaaaaaatcaactaggactaaagatccgatatgctcgaggcgcacttgtcttctccaccagcacttagaagtttttctccgatctcggcttctccttcaccgccactgcctagggcatcccacgcgccgacgccactgtcgtctctcaccgtcgtctcgctgtcgtcgtcgtcgccgccgccgccttctcgatctctctctctccaaaccgccgccgcctcgtcgtcgtcgtcgttgcgacaccgccgtgccacgccgatgccgaccccgactccgcctcccgccgatgccaaccccgacgtcgacccggccggcactgtcgacgacgtacgccaaccccgtcgacgccgaccccgcgatgcgccgtcactgccaacaacgccgccgccactgccgcgccttgccatgccgccgcccccgctgcggcacgccaccgccgctccttttcggtgccgccccatcaatgccgaatgggaacgaacgcgaacggaagtgaacggacgtgaacgaatgcgaacgaacgcgaacgaacgtgaacgaaacgtgtgaacgaacgcgaacgagacgtgtacgaacgagaaaattaaacgattattagacttagcatatatgattatatacttgaaaacgtgaacgaaaaatatatgttcctttgcatttcggctaatacattttttttgcatgttgcagaaaatatgtcgtcgtcgtccctcaagccgaagtggtagctagccctcggaggaatttgcgcaggcaagtgatgtaaagatatgattatctagagttaccacatatgattattagacatagcatatattaattattagagttttaatataagattattagagttttaatatacgaaacttagactgaacatatatgattattagagttctaatatatgattattagagtatcaatatatgattattagacttagcatatatgattattagacttatcatatatgattattagagttttaatataagattattagagttttaatatacgaaacatagacttagcatatatgattatttgatttctaatatatgattattaaagtattaatatatggctattaaagtattaatatatgcctattaaagtattaatatatg

SEQ ID NO: 16364 - DNA, 1501 bp, Oryza sativa
ataaatcaatctacgtgatacttcctgatacatcaaatctaaaaataagcatttaaatttattacctcctccatcccaaaatatttgacgtcgttgacttttttaaaagtgtttgactgttcgtcttttttaaaaaaattaagtaattattaattatttttcctatcatttgatttattgttgaatatacttttatgtatatatataggtttatacatttcataaaaaaatttaataagacgaacggtcaaacatatttaaaaaagtcaacgacgtcaaatatttaggggagaagggagtatattaaaatgtgtcagctgtagtgtaggaggttaatttatttcggaattgaacgaagactacttaatccaataccaacggccaacctccgacattgtacttgtcagttgtcactctgctcagctgcggtcgccaacgaggggctgcaatggccatgcccatgccgatgccgccgccggggccgggcggcgacgcgccaccggcgccgacgatgatgcccggcatggcgatgccgatgacgacgggcatgtccttcacctggggccaccgggcggtgggtgctcttcccgcggtggccgggcgaccgcgccggcgtcggcatgtacttcctctgcctcctcctcgtgctcgccctcgccgcgctcgccgaggccctctccgcggcgtcgcgccggctagacctcgacctcgacctctcccgctcgccggccggcggcggcggcggcgacaacagctgctcgccgcgggcgtccacgcggccaggatggggctcgcctacctggtgatgctcgccgtcatgtctttcaacgccggcgtgctcctcgccgccgtcgccggccacgccgccgggttcctcctcgcccggagcggcctcctcggctctcgcgccgccgcgccggaaatcgacggcgccgccgccgccgccgccgccacgtcgaatggttcttctctccatccatcgtcagagccgaaaccttaaaaaatatgtaattctcttcatgctgtcccgtaattaccagataatgaaagttgtagtcaaaggagattatattaaaaaaagactgcaaaattgtactgcatcaaaatggtttattactgatcgatcgtctctcgatctgaatttcgttttcactcctgaaatccaagaacttgtcaggcttgtcctgcagcttcagtttttgacttgtcaaaattacaagataagtgcaagtattaatcacactgacttgctggctagtggctacactcttgagctggtagtacagtatctactaataattggcagctaggttactgtagctgtcgtagattggctcaagctagctgcggccatggcgaccttgctgctgctgcccgtggcggcggcggcggcggcgtgggtgtggtgggggcggtacgcgtggcgggcgcgggcggtggcgaggaggctggcggcgcagggggtgcggggcccgcggcgcggcgggttgctgcggggttg

SEQ ID NO: 16365 - DNA, 848 bp, Oryza sativa
atccccttaatccaggggcccgtgccaccagcgacaggtacaaacaactactccatctatctcaaaataaacttaattattagacttttatgtctagcgtttaactattcatctttttaaaaaaaccataaaaaaattttaaaagataagacatgcataaataaagtattattcatattttatcatctaacaataataaaaatactaataaaataattttatataagacgaataaaatatattatttgtctctacttctcctaataactttttatagacggaggtagtactcaccgccgagacgacacagtccaaagcacaacaaaagatcgcctcttctgaaagaaaagaggagagcctactcgttccgtccacacgtcgcacgcccacacgccgcataaactactcgtaaatgctcttttttttttcttttttctttgtctctacttctcctaatagtatgaaaactttttatagacggaggtagtactcactgccgagacgacacagtccaaagcacaacaaaagatcgcctcttctgaaagaaaagaggagagcctactcgttccgtccacacgtcgcacgcccacacgccgcataaactactcgtaaatgctcttttttttttcttttttctttgtctctacttctcctaatagtatgaaaactttttatagacggaggtagtactcaccgccgagacgacacagtccaaagcacaacaaaagatcgcctcttctgaaagaaaagaggagagcctactcgttccgtccacacgtcgcacgcccacacgccgcataaactactcgtaaatgctctttttttttcttttttcttttccgtctaga

SEQ ID NO: 16366 - DNA, 1299 bp, Oryza sativa
acacactatctgatataagatgagcagaggtagagctagctagctgacaaccagagaaaaacaccccgggaagttgtctaactcgaacctgacatgatttcttttgctcgtgccgcatccgaaacctacacgtatatacgtacgtacgtgcacacggcctcaacataacgcgcatagctagtttagctgtattgattgtcgatcgaatcgccaattcgccatgggggaggagaagaaggaggaggaggaggagaaggccgcggcggcggagggccccgatctcctgtgcagcttgctggaacaagggcggctggcctcgccggcacggccgccggcggcacagccttcagatcatccgatgatcgagagagatatatggaatcctaccggtgcccctgctggcatcagagcacttgtggtcagtacccctctctgtacgactgcacataatgacatacacaagttcgaccaaagccttttattttttttatgctgcattcgttctgaaaatataaggaatttaagatggatgtaacttatcttaaaactacgagttcctgttcagattcatagtcacatacaccaaaaaagttttatattttaggatggaggaagtacatttttagaggcaatcgagccttctatcgtttttcttttctattttcttaaacgattatatagtagatgcactctagtacagcctttgagtgcgaaagcgctaatacgcgactagtcgcgcgcgttccttcccgcacgactagccatgtggcgcgcgcggagaggggacggcggattgcgcgcggaggagttaggtagcattggtttttttccggttttcccttttttccgttcgtttcgttggttttttttccggttttctcgttttattcgttagtttctgccgttcttctgttttttttgtccggttttctcgtttttctacgttggtttctttcgtctttgttcggttttttctctcccttttcggttttttagtagcaagtttgtatatgcacgtgtacaaagtttgtatacatacatgtatatatttttacgtacgtatataaagacatgtacaaagtttgtaaacgcatatacaaactttatatacgcacgtataccaagtttgtatatgtacatgtataaagtttatatacatgtatatatttttacatacatatacaaagtttgtatactctcgtatacaaagtctgtatacgtcgtgtataaagtttatatatatgtatatatttttacgcacgtatacaaagtttttttttatacgcatgtatacaaagt

SEQ ID NO: 16367 - DNA, 1501 bp, Oryza sativa
gaaatcaccacaggtgcctcgctgtcgacgagtacgtcgcctaccactgaaagcacaacgtcgttaaatcctggaaaaattctgaattactaaaatgtgtgtttttaaaagattcatatgaaaagttaattgaaaaaatatagtgatatatttttttaagtgtaaaataattaatacttaattaattatacactaatacctcacattgttttatgtatgttctcaattctcttctctattggatatcgaggtcaagtcggtagatttcgaggtctatccatgtcaggttccctccgttgcaagatgcaacgatgatcgaaatcacacggctaaaatttgtttttttgtttaaattcgagttaaaatgggtgccgacaattaactcatttacttcatccttaatggttatcataagtttgtaagttagctagcgctcaacagatttatcctcttatatattttttttaacatgacaagagagacaatgcagatctagttagccaaaaagctcatacaaacaaaggcaccaagaaattcgagcaaagcagatagtaaattatagtttgggtcaccttttatcagcaatgtttaactttgaccatcctttcgtttggattgtataaccttaccattttttttttggttagaactactcaactctctttattattcatgtacttcaatttcgtgaaaatctgtcctgcatatagatggaaaagttcacatgcgtaccaaaaccgatttgattgagattattaatgagtgctgaagaagttgattgggtggtccaagccaaaaaaaaatttataaagttacctgatccaaaataaaaagattattttaaaggagatccaaagtgaaacttggataataaaatatgacctaaaatgaaattcatacacacactacactgccttgaaatcgtttcagagtttcaggattttcatggtcaggtcttctccagcgtcgtcacggcgtggctgccgaagcccagggcatacgacggcaatagtgtggagattatggataccccatatctacatgacagttataatttagtcagatatacggtaccaaatataaatagaatatctttatgaggactcgggttagttttgaacttgtatgtcaaggaaatacccgagatcttagtcggttacgattgtattttatctgtaattacatattccgttagggatatggactgtactttgtaaagcggaccctttcccctatataaggagggtccgtgtgcctctcggggcacgattcttttttccagtttatacgatcaataacacactcggcggaataatccccggacaggagtagggtattacttcttgaataagaaggcctgaacctgtataaaattcttcgtctccaaacccatccactttcctagcttgatagccacccccttttattattgccgaaatcttgtttcgacagttggcgcgccaggtaggggtagcgtcaagtttttgccgactaagtgcga

SEQ ID NO: 16368 - DNA, 1501 bp, Oryza sativa
atatattatatttattatacaaagtttattaaactttatttaaacgctcttaagccgtcatttggcacactaataaattagagcaagtcctataagttacaagaagcaaaaaggttattgatataatcattgattttcagttaaataaatggtcctataattttatactattagattaaatctatttaaatagaaactcaaagtaacccaaagtaccccatcctatcaggcacatcaatccccgtgcgatgaagaattgaacacacatacgtaccggcctctgcctctcttttccttctaattttctaggataaactcaaacaaagaaacaatcaaaatttaaattcaataatcctttgcgtcggtcgctcgggggagggagaaaaattgggcgctccctccccccgcgacgggctctgcctcctgggccccaccagtgcccctaccccctgccacgtgtctccaccacatactccattgcaacaaatcacccacatattttggaaacactctattaagggaattcgttttattttttgtttcactaaaaatgtttcacctagtgcactcataatgtttcactatgtatgaataaaatgttgcagtgaattgaaacttttttttcaacaaatcacacacatattatggaaaccctctattaagaaaatctgtttcatcctttgttgcaccaaaaatgtttcacctagtgtactcgtgatgtttaaatatatatagattaaatgttgtagtgaattcaagcattttttcgctatttgctaaaacattgtttttatataaggtgaaacaacggtcgatttaaacgattgaaacattttcgatctacttagtgaaacaattctgatatacttggtgaaacaacgtgaaatatttaaaaataattcaataataagctaaaaaaattttcatcggaatatatccatgtgcagtcttgttttaaagatttaattgcaacgaatttaatggtgcaatcggattataatttggttaaaataatttaaaagaaaaaatagttaaaatagttttgcatgcatgcatgcatgcgtgctgacgtcagctgacgtgagcgtccgatttttcccacccaagatcgggcgcccgacgcgtagtgccctccatttaaattaagtcccatatgttttaagttgtatattcaattatgaatatgcatgtatggaccattattttatttataattagctcaacaatttaagacataaaatcctgcaaacgctcctaagctacacgtgacactgtaataaatttgagaacaaaatttgtattttaaaagcaatagccgaatttaaatatttgagtccatagtccaggttctaccaccagcaaagacctcgaaaccatgttaggtactctaggatagaacccgacggaggcagatctggacgattagcaaagtggaagcggatgccggcaacatcggcttctaggagagttcctgagcctaatagcattcaagatgattaga

SEQ ID NO: 16369 - DNA, 1319 bp, Oryza sativa
  unsure (1)..(1319): unsure at all n locations
cgagtggacgggggccggtagcgtcggaagcgccaagtgagggggttgggtctggagtcaagacatgtagcggtgatgtaggaacacggggggggagcctgcagatgcagtggggaaagnccatcgtccgcccccgcgtgctatctgcccgttcgcccccgctcgccgcctaccgcgccagccgctatctgatataaccatgtaagatcattatataaatatttaattataacgaatctaatggtataattaaatagtaggttggataaatgattgtagagaaacatgtatttaaattttgaatatttgaatatgcatggatgcatgcacttgacgtgtgcttacgtgcactagctccctgcatgcacgcgaggacttctgttgtctcgggtgaagagacaccgttactaccgtccgatttcttgcgtcggcccggacgcccgatgaaaagcattctcgcaaactttacaacgatagcctccacagtcaagctcaacaaagacaacaagagccgaaaccacgcacgcccggagagagtaggagaaaaatggacactcacttagaactcgagagagaccgacgagagaggtaaagtggcagataggagagccatgtctaaaaatcaagggttaatttgatcaatggcacagatcaaattaacccaaaaatcaaacgggcatatagattgaattgccttttcgaatttgattaggatgctcaattataaagaataaggatattattcttaagtcaaatatcaaaactcttatcgtttcaatttactttgacaggatttgagtcgaatacgaattcagtttctatcttcttataccggacaatacgaattcgcataagtatcgaacttgcacccctgattctgataagcttatttaatgtactagtaccaaataatagcacactaagcaaatgcaaaacacactcccaatgggaagtgaagcaccagctctaccacgagcaaatgagactagcaacacataacaaaccaacgaaacaggcatacaatccagcacaacgagcaaaactatctttaaaggcaagaatattattcataaatgacgcatgatttttatcaaaacgcttgcaaatgatatcagataagtagagtcaacaagacaaaactgtatctgccaaagcacacctccccaactccacccaattacgccattatttctgggcaaaagcaaacggcttcccattcctccccttcaccagtctcaaaccataaaccccacaacaaatcctcctaagtgacggcatataagatgatgaaaacaaagcaggatactccagagtcgtca

SEQ ID NO: 16370 - DNA, 1501 bp, Oryza sativa
accatagtggatggttgttccatcgttgtggaacatttgtaacaatgtatccttgggctttgtatgtcattagcacgtacagtggttggtttttatccgttattaaaaaagcaaaattaatgcacatgctgcagaagaaaagcaatgcaaattgaaccatctatccaaataagcaatccttattgtttttcttaaaagcactatagttacagtattacaggaagagacaaacatggtgacatttgaattacctctatttatttttctagaatataatttgctgcccctgtatttctctgaaaatgcacaaatgaccaagaatacacgttaacatgtctactcttggcaactatggatttaccattcctctctcttcgaaattcttttaatctcgaatgctagttgtctcctttcttttcacttgtcatttattcatctgctcgttctatacactctcttgactccctcttccactcctttttcgccaaagtcaagtaattggagacttctattgaaatttagatgcctagatttttggtaaaagtcagacttcctggaatatttgagctcaaaaccttgctagaataggtgttgaattaatgtactagtcctatttagttatagttggacttggagttgtaataggtggtaggaacggagttagagtcgaactctgtaacctgaccgcaaaatcaaagtgtgtttgattcttattctgtgatgaacaattggcatatgtggttattagttttgatatttggagatgattggttttgcaggtgatgaacatgagataccactgactatttggacttgtcagactgggcaggtgttgccagtcagactggagctatgtgagcggtcagactggctagcccaggtctgatcagccgactctgtgtcagtttcggtttcaggttcatttgttggatatccgtggataattcatatttatgacttctagatggatactatgcgtatctaatactgttgtttgctaacaatgagtcaagttggtgagaacttgtgctcggatatggtttcttggttgatccatatgtaggtgatcttgatgcctcgggagagtgttgttggtgatggatcatgagtcaacttgggagaagatgacgtccgaacgatcaggatatcatgcgggatgtttaggctaaagatcaatgcacatggttggtgaagatgccatatggcatatgatggagatattgtgtgtgtatgggatgcggagccgaatttggaaggagtccaaatttggtataattggagtttgtaaagtttgtttcttgtacgggaaggtttcctaggagattaggacttcttgtacaagtttggttcgtggctttaggctgcctaccttaggtataaatagagagggagggtgtggcctcccggtatcgctttagagcgagagttgagttgacagataagttagggttttgagtatagttaagattttcgtgaggagtgttgttgttgcactttgtaa

SEQ ID NO: 16371 - DNA, 1501 bp, Oryza sativa
aaggatcgcagataattcaacacggtgtcgatcgattgcatcatcgttattaccggacattaattgtaaagatcggtcaatcacacaatgttattttattggacaaatatgtataaaaaaagatccagctatctccttatcagcacaataggataaaataaaggcattgcagcgagcaatctggcagcttctgtggtgtagctttctgcggtgtacgtagtcgattgtctagttcagttcagacatgtatgggatctcccaagcaattgtgtcactgtgaatccgtccatgtggcatcactgtatatatgtgcgtacaacctgtcatgcacgcatttttttcacttgccaaattgttgaaacatttatgctttctaaattttgtgcaattgactgaagaattttcatacgcaaggcaaattcctacggttttttattattattttaaaactttttaaatttgttttattttaaaaacagacaaacttattttcaaaactaaacttttggtcacgccaacctgcttggcttggtaaaataccagtgtcacgctacctctaacaagtgtgacagttttattatgtcacgccaactagatcagcgtggccaaatggtgtcacaccatctagatcggcacgcaagtattgttttaccacatcagcctagctagtatggctaaaaagttcatatctttaaaataagtcttggaaagattttttaattaaaaattaaaaagttcaaaaatgaaaaaaatccattcctatctgcaaatatatttaactttttaataccacatttcaggttttgtttttttcttctgcaattgtccaggctcttttttcattacacaaaagacccgcatacatacaccactatacacgtacacaccacacgcctatacctatgcaaacacacactgaaaaaactacattaatggtagatcattagtctcattaaatttctgatgcgtatatcatatttgtagacgcaatagtagtaaattccaaactacttcttttgttcatattatatattttacgttttgaatagattcatgcatggatttatatatgtgtttcatatgtatccaaatccaaatttatatggacagtgtagtgaatctagacgaaagatgaagccaaaacatgtaacgcagggagtagaatgttacgctatattaatccgtgcagctacgaaaattaaggacatctttggtttgtctattgaattggcactactaaattttttgtatgacaataaactaaatatgctcatttattaccctattaaaaaatttggtagttctggtaatactgcaaatcaaacatgccctaatctcttatcaaattttgatagagttagttcggacaacaagccaaacaaagtcctaagttgctgcaaatctaataataataagaagtttaatactagagccaacttactacagtctatatcatttatagccgttttgtttgatgctaaaatgtaccgtaccaattttt

SEQ ID NO: 16372 - DNA, 1501 bp, Oryza sativa
gattccctctccctttccccccaattttccttccctctctcccttggattcgtttggaaaccctcccttaatcccgccggcgccattgatggagcccgagaacgccgcgctggtttccttcccctccggccgccctctcccccttccaaccctatttaaaccctccccgcacctcctccgtccgtttccgcctctcgccgcccttcctccttgccggaatcgagctcgcgtcgtcgctctctctctctctcctccgtcgccgacgacctccggccggccttctccgctcgccgggaccgtctcccgccccggcttcgccgcaccaccgtcgaccccgtccaccccctcgccgagttcgccgaccgccggaacgccgtcgaccccgtcgacccgagccgcgccgccaccttcctccgctccggccgcctttttcatcgtcgccgttgacctagggtgagccgtggactgccgcctcttttcccccttcccttcccctctctcggccgccgctccgccgtgcctatggccgccaccggcgaccataggggcgcgggcgccgcctcctgccagccgcaccgagtggccgccttcgggcgcgccgagtggctgccgcgtggggcccggtcgtcagccgcccgcgccctcgggtgcggctgacgcgtggaacccacggcgccggccggtgtgagcccgggtgcacccggtccaccgtggaccgtgaggctgccgcgtgggccccactcccgtggacccggtccgcgcgccccttcccctcggctgacgcaataaacccctttttaaattaaaatttaaatgaataaattcgcaaatattcatttaaagagaatataaacttcaaatggccataacttggccatttgaactcggaattggaccgttcaagtctctaatttttccttaagaagtcaagaacccatttttgtgctttgttcttgctggttatgtggagtttattagagtaaaagcccttttcttttccgttggtcgtgcagcttcggaagatccgctcttcgtggaggttgaagccgacgtttgggaaagtgagcaaggcaagtcacatcatccttgaacatattgaatcccagtttataaaattattttgatttaaattattacattatcgctttatttaaattcccgcgttatcactgttttatttagccatgcctatttacctttgttatgaccttattattattgttattattattattaccttgttcaccctagaataaacaaaaccccaactagtggacactctactcatggtaccactagtatgaatttaggtagatgcttcgctgcttaattaggtaacattaggtggttttacaactctagactttgggaatattcatatcacctgaacactatggaatggttggattattgtggaattggattcacacctccccctctattcaaaatcctcaaaatggttttaggctaggctcggggtgcatggttttgatagtagcac

SEQ ID NO: 16373 - DNA, 1501 bp, Oryza sativa
agttgtgttgctttgcaatgacttggttattcagataataactctcaagtccctacaaagataattaggtatattgtatgcagccaacatataacaaattgatgggcttttttggttttcggccagaagtctttctattcaaaccgagcctactaagctcgtgagctgctcgcgagctggctcgggctcggctcggttcacaaacgagctaaaacccaggctcgggctcggctcgttcaggattcgagccgagccgagccaggcgagcccgagccgagcttgagccgagttcacgagctcgagctatttgtccagccctagtatcatacatacagatactggtagagtagtattcaatcatagagcggcccgacctgacctctgacgaccagtttgggtccctgctgggagggagggttgagctaggttagacagcagagcgatatcgacgacgacgacagagaattccgagaaagaaggaagatcctggtcactgtcgggcgatcgcgcgacgatcccaggctgcgcggacgtggcgcccgggaacagcctccctccccccctcgtacgtggacgccctcccctccacaactccaacgacggccaccacaacccatactccagcaggtgacaccacccggccgccccttgcacatgcccaatactactagctagctcgtgcatgcatgcaattgcaagagatcgatctcacacttctcaaatttcttttgacgatattgctcacagcaggtacgttacgtgcacacaaggaccagcacacaaaatcgatttttgctgcaccaccaccatgtgcacgtttgtttaacgcacgcagttatatataattaattaatctgatggccggcacgtaaccaggcaacacgtacatacgtagtactccctctgtattttaatgtatgacgccgttgacttttcgactaacgtttgaccattcgttttattcaaaatttttgtgcaaatatgaaaatatttatgccatgcttaaagaacatttgatgacgaatcaagtctactactacttaaaaagtaaaacctgcttccgtcgtccgttgagaaaaaaagagcgacaaaaaaaaacttcactcggaaaaaaaaaggtccgactcatccagtggtaaaaaaaagtgagaggaaaaacaaaaaaaaagaaaaaaaaaacttcgatcgcgaaaaaaaaaggcgtcaaaaagtccgactccccggtggagaaaaaatgccgagaaaaaacaaaaaaaaaagcaaaaaacttctaccgtattttaaaaaaatatatatataaattaaagatgtttttgcatccgtgtatgggtcggtttttaaatccgttcgcttttggaaatacaagtccgtatttgagtcatttttttaagttcgttcacttttaaaaatacagaaggaatcgtataagaaatctctttaaaaaactcgcatgctaatttcagacgatcggactcctacttatatctcatgattttctaac

SEQ ID NO: 16374 - DNA, 1501 bp, Oryza sativa
acatgcgggccccacatggcagtgactcgaggagggcggtccgcggtggaccgagtccacgaaccgggaaaggacgacgcaccacgtggctctgacgtggcgccgacgcagcggccacgcggcagccacgtgggcggccgtacggacgaccccgatctacccaagggtagattggacggcgggtgtggctcgcggccggcgtgcgcgggcacggctcaagccggcccggcggccatggcgcgcggcggctagcggcgcgcatgcggcggcggcgcgagacggcgaccggccggcggcggagggcgacggcatcgcggcgacgcgggcggcgaagcggcggccaagcggctaagcggcggcgtggcggctagcggcgcgggagagagaaagaggaaggggaggagggacctcaccgacgacgaccgacgacggcgagcaacggagggcggcggcgacggtgggacgatctctggaaccacctagcgaacacggtggaaggggttagagagggagagggaattggaagagggcgaggacgctggccgaaggcggcggccatggcggtgctcaccggcaaacggcacggagtgggtttcggcggcgggatccaatggaagaggggtggacggggtggcccgcacgacggcgaacgcgacggcgtcgtcggccggctcggcgcggcggctagcggcgaccggagcggtggcggcggcggcgaagaggagggcgacggcgctagggcgttagagggctcgagagggctcggcgagatggggaaaaagagagaggggtggcggtggtgcttaaatagaggagggggagcccggacgtggccggtagaggcgggaatcgccggccgacgtggggaggtggaggaggagagagaggcgggattcgcatttcgaatcccagccgtctcaggcgcgggcgcgggcgaaagggagggggagtgggtgcgggagacgtggcgcatgcgcgggcgtggccgacatggcctggaggaggcgggaacgtgggcgcggcggcggttgcggtgcgcgacggcgccggctggaggaaggggacgggcccgacaggtgggccccacctattggcgaccccgggggagaagagggaggcggccggctcggctgggcctcggcctgtcggccggcccagcggaaagaaggggggaagagagaatgggccggcggcccagttgaaagaaaaagagaaaagaaaaaggaaaaagaaggaaaatggattttcctgggattaaatattgcttgtgctcaattttaattggttaaaattatttctagagctttgagaattccgctaaaattcttgttagcgtatttcgacatgtaaaactcaagaaaaattccacatgccaaatccgattattatttgcattaatttattagggttttctcttgctcttacaccgatattttctctggtggattataaattcaatttaggcttgggaaagaatttcagggtgtgacacgttgtcagc

SEQ ID NO: 16375 - DNA, 1501 bp, Oryza sativa
gccataaaaaagataaataagttttttcctctggtgatggagcgctccttccccttccctcctttgttttgttgatggagtactagtatttttcttcccctgaagcagccaggcagttccagttccatggcgaccttctggggtaaaaacttatttgaagggaaaaatgtgtcgtggcgagagcggtgagagtggtgtcgtggcgacacgagggcgccacagcgtggcgacattggagcgcgcgcgcgcaaggtgttcaacacttttcccctaaggaaaagcgctcgaattggaggaaattttccctaaagcgtggtgagatacccccatctgcgcggcctgcttcgcgtccccctgaccctggaggggaatcctgggctgcctgggagcccaacgctttggttgggctacacccatgccgtcccgcgttctcagcccagcctttgggtttctatatcgatgaccttttcccgaaagcctcaatgtctccaagccgctggctgtgggtgagaaaagggaggggtctcgatccggagctagggttccctgcttcctcctcagatattcatcgatttggggacagtgcgagggagatttggagggttgaggagaagaagcgagatcaccgctcctacgcaaaagtggtgatggatcggcgtcccctgcaaccgcatgttgaccaagagctgtacaagcgtcgtatgatggatctggatgcagagaagagaaccattgccagcgaaaatggaccattgtcagcggcccgcataagacaactgccagcgaaaatccgttttcactgccggcccatgtaatagagccgccagcgaaaatccgttttggctagcggttaagttccgtttgtgaaaacttttattttctctagcctttgctttcaggcggctagcataaccgtcagcaaagactgattttggccgccagaaaaaaccatttttgtagtagtgagtaggacgtcgagacacattttaaacctactccctccgtcttaaaaattaatttcttaggacaaggggatgcaaagcgaagtaggatgaaattcaataaaatccaggctacaaagcacaatttgggtaaccattaaccaacagtgcatgaaaatctaggcaatttgagagaaaccacgagcaacaaaattgagcaaagaaaggccgtggtttatgcccatcaatactggcccaactacctttgcagctcgggcctgcgatccaactttaacaacggaataagttcactttagttacctcaaatttgtcacaaaagttcgaaattcatccctgaaccgtaaaatcgaatataacacatccccaacttataaaaccagcgcaaacgagatccctcactagtattgtccccggttttggcttacatggcgcctacgtggctcctttgactaagtgtttgtcccacatgacattgacgtggcgcttcgacctggaaaaataatcaaacctgtggaacccacatgtcagttacacacaaa

SEQ ID NO: 16376 - DNA, 593 bp, Oryza sativa
acactctgcacaagtaatcacaaaccgagaaccgagcgttgctcggttgggtagcttcgctggtgagcgagcagcccgcgcggcttcgatccctgggatcgtcacaaaagtagagtgacgtcctcgtcacgcacaaggtccttaagtggctttgtgtatctcattagcacgtgtgtgtagttgatatcgtcacgcacaaggtccttaggtggctttgtgtatctcattagcacgtgtgtgtatagttgataggtctagcatgcgtgtaggggtgtgtgtgtgcgtggtggaatgcgtttgcacgtatgttcagatactatagcttgtactcaaagtggagagctctcaaaaaaaaaagtgacgtcctcgtcacgcacaaggtccttaggtggctttgtgtatctcattagcacgtgtgtgtatagttgataggtctagcatgcgtgtaggggtgtgtgtgcgtggtaaagtgcgtttgcacgtatgttcagatactacagcttgtactcaaagtggagagctctcaaaaaaaaaaaagtaatcacaaaccaatagcttcagtcatcttctttgaatccaaatgccaacactcc

SEQ ID NO: 16377 - DNA, 153 bp, Oryza sativa
taacaaattaaagtgaaaataattattgcacattcacaactatatttgttatttttgttacaacttgtagaagctgaatttaaacctgcatatttgtggagtgatatatttcatattaatatatgttgctaacttcttttgtattcttttagt

SEQ ID NO: 16378 - DNA, 1166 bp, Oryza sativa
tgtaccccaaaacacaaccccacatcatgtcaccatgtgcctcaataccaccacggtacctcggaaaggagttgtgacaataccccttgcataacacaatccaccgcagcgcaccttcctggatcataatcacccccttataaaaaaggcatggactccccagcgacccccgtgggcttatctccgccacttctcagtctggtgccccgcaatgaaccatgctatacaaaagataaagccgttgcccacgctggcttgtggttggcacggttaatgcttcacaaccgaaactcgtgaaccggtccttaattgtcatgagcacgaccatcaaaaccatgtgctcacaacccaccattatcaggttttagttggcacattaattaattaaccaatcacgattgaccatcgtgaactatcattaagccatcattaagtaatagtgagtcataagttatcccaatagtgagctaatgtttctaagcagggctaagcaattatatctaatatctagttgaaccaatataaataaagctcaactagtcaaattataataacccaaggtatcaaggaataaggtaatcaagaacaaaagggctataacaagcaattggttaattccacccaatgacattcgaaaataaatgcaatatttgaatagaaacaatagctttaaataggatcaacatgctcaaagggttgtttgggatctgtgtgacttgctttgctggccttggaactcttcaaactattctccggtgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttgaagattaaattggattaaaacacttaaattgattttaattgaattatgacgcaataatgaattatttttgaaaaggaaaagaggatttattgtgtcagcgggctagggtttcggtggaccgggcgcacggtggcggttcacgcgaacggacggccgagatcgacttgatccaaaacggacggccgagatcgatcggtccacgaccggctcacggcggacggtcccga

SEQ ID NO: 16379 - DNA, 1037 bp, Oryza sativa
caacatgggagtcctttcgtcgcatgactaaactctaccggacatgtatcgcatgagccgacacgacaccaagttaatttcgctcgctccacgatcaaaatttacttggtggggggcatgtgtttgatggtattttggcgattatatgtgtacacaagacttactcatgatggacaaagcaaacaagcagtttgtaagttggctagcttatcatttctacacaatgctcggccatgtatatacacgcaaataaatgcatgcacaggcagctgggaatatatatacttggattagtatatgtgcatgtataattaaccaataactagccgtgtgaagattggctggtgaggcaatcacgtgcatgcatgcatgtactacagtagacggtcgtatgtgtgtgcatgcctgggtgattaagcaacctatgcatatccgagtgattaatcatgggctcggcccatggccgaagacggtagctgcctacgcgccaagatttcagaagttaatatgcggaagagataaaaccagatgaattaagagataaccaacaaaccaattgattttatctctataacaaacttgatctagttagttacttcgcgcgagcgctggcgaggcgcttatcaccggactgtggcccagcagtagagaaacaaagcgaattacaaatcagatatttgacgctaggagaagctaagagataaaatcaaagaaggatatgaacaaataacaaattgatcgatcaagccttatctacaacgaacttgacgcggaggaaacggcgtgcggacgtggcgagcacagacctcagacccctatataaggcgtcgacccctcggcagctaggggcattcacgaactcatccacacattcattcaccaacgcatctagcatccacaagccacccatcatcaacgcatctacccatccagcatcaacacatccatccatcaactctcatcggcgatccatccatcgacgacacgcaccggcggcggcgagcgacttcggccggagtcccggcgtccggcaggag

SEQ ID NO: 16380 - DNA, 1501 bp, Oryza sativa
tagcgccgccgccgcgaatcccgccgcccccgtcctccccgcgtgcaatcaataggggggaattattccccgtgattccctctccctttccccccattttcccctctctctctcacgttcaaacgcgcggatttgcccccgcaaatctcgccagcgccattgatggagcccgagagcgccgcgccggtttccttcccctccggccgccctctcccccttccaactctatttaaaccctccccgcacctcctccgtccgtttccacctctcgccgcccttcgtcctcgacggaatcgagctcgcgccgttgctctctctctccaccgccgccgtcgagctccggtccgccgccgccgtcaccccggaccacctcccacctcggcgccgcctccttcggctttgccgcatcctcaccgacctcgtccacccctccgtttcgctcaccgaccgccggaacgccgtcgaccccgtcgacccgagcagcgctgccgccttcctccgcaccggccgcctttttcgttgtcgccgtcaacctagggtgagccgtggactgccgcttcttttcccccttcccttcccctctctcggccgccgctccgccgcgccggtggtcaccggcggcgaccatcggggcgcgggcgcgccgcctcccgccggctgcacaggcttggccgccctcgggcgcgccgagtggctgccgcgtggggcccggccgtcagccgcgtgggccccactcccgtggacccggtccgcgtgccccctcccctcggctgacgcaataaaccctttttaaattaaaatttaaatgaagaaattcgcaaatattcatttaaagagcatataaacttcaaatgactataacttggccatttgaactcggaattggaccgttcaagtctctaatttttccttaagaagtcaagaacccatttttgtgctttgtttctgcttgttatatggagtttattagagtaaagtccttttcttttctgttggtcgtgtagacgctgcagcttcgaaagatccgctcttcgtggaggttgaagccgacgtttgggaaagcgagcaaggcaagtcacatcgtccttgaacatattgaatcccagtttataaaattattttgatttaaattattgcattaccgctttatttaaattcccgcgttatcactgttttatttagccatgcctatttacctttattatgaccttattattattgttattgttattattaccttgttcaccctagattaaacaaaaccccaactagtggacactctactcatggtaccactagtatgattttaggtagatgcttcactggttaattaggcaacattaggtggttttacaactctagaccttgggaatactcttatcacctggacactatggaattgttggattattgtggaattggattcacacctccccctctattcaaaatccccaaaatggttttacgctgggctcggggtgcatggttttgatagtagcac

SEQ ID NO: 16381 - DNA, 442 bp, Oryza sativa
cgggcccaaatactgagcccgtcacagatgagtgtcatcggtgacgggctccaaagaaggcccgattgagatggccttaatgcccgtcaccgatgactcttataggtgtcgggcttctatttgtgcccgttagagattagtgtgcgcccgttagagatgacatttttttggcccgattgagatatactttgcacactatatatactccagcagtccattgactgtagtttatcccactgttcactattttggtgggaggttgaagggggcgaatttttgtaattttttttgcaaacaaaaacaggaaaatcataaaagtaagtaaaaggctactaaatatttcctattaatttagtagtacttatgttatgagatgttaaacccttaaaaatttaaaattttttttttttttgggggggtggttttttccccattgttcagc

SEQ ID NO: 16382 - DNA, 1501 bp, Oryza sativa
caaatctctctctctctctgctttgctgtgaagcagcaatttgttcttgcagcatatgcaatgcaacggcgatgatgcatgctttgcataggatgctagctagtagctgcgacatacatgtgggccccaccgctggatttcgtcaggttggcgctggccactggccagtggccactgatcattgcgcccccaacatgcatgctgctatagctactagtactagtaccactcgcgatcgagattaacaaatctgatcatgcgctcgtgcgcatgcatgcatccacctaaccaacatcgatcatcgatcgcttcctaaattattgatcccccatctctcgtccagctcaaaccggtattatttgatcgcccgcaattatacggatcattgatcggtcgagctagctagagtgatccagaatggcagaatatataatatatgatggccgtggttttgattttcttaatttctagatgcgtctgtcttagaccgatcgatgacaatgtttaaagtctcttttcatgtaaaaaatgataattgcatcggttgtaatgtatactaactcttaatttatttattattttagaagcttaattaatttgtatatgggatggtcataaggtgttttcattaagatttacccctaacattattactctagtacagtatagtagagtacattagctagcttccagaacactcggaggcatagcactatactccctatatgcaaaaatttcgggtatatttattttatcactaagattaaaaagaaattaacttattccaaaagacaaaaactataagcatgcatgcaaccaacgagtattaacatcatgactgcttccagtcaataatttaatccaacactgtaaaaaggaaaagataaatccatttatttaagtttgaatgtgtgaaaactttaaatataatatctcatttgaaaaaaatagaaaataaaatatgcagaagatttttaaatgaaaggagcatttgtgcaagtggccacgagatccctacccggaggcagtttcaattggttccaattaaccgcccaccaactgccactatccactccagtcccatgtgtgctttgggcccctactgctccagccagcgtgcaagtgcaacacacttgcacaatttgtgatacttgttcatcatacatctatagcaaagtcactgctcaccgctcgttggcacattgtcttccttcttcttcttattttttctctgagcgagttgacacatgcattctctatatatagtccgtacgaccacctgaactatcaattacacgaaattttcatccctaattaataaatactataatcaacagacatgtatctattagtaataatccaaggtcatttttttggctgggccggaagctctatatggcccaccagaactacggagtacatgactagcaattcctatcctgggccggcctagctaattcactattggtgaagcccataggatcatgacgacgacctggtg

SEQ ID NO: 16383 - DNA, 1501 bp, Oryza sativa
ttcttcttccctcatctcctcttccctttttctctctatccttcttcctcccagagcacgagagcagcggcggtggcattcttgagcttgtggagtaggagatcggtggcggtagagtaggggactcgttgcggcgacgaggctcaagcacatccccagccttcccttctgcgctgactgccggcgagacccaggacaaggtccgcctctcctgtcgtaaccgagctcgccggtggagctagagctgctcggggacgtagagttcgacggtggcaacggggcttggggatgaggaactgaagcttgacgagacggcggcggctggcggatgcggatatgagcttgagcttgtcctctaccaagcgttggcggcgctccatagggaggactcccccccctcgtgtgtagctccggtgaggtccgcctcttgcgcgcggggcagcaagctccaccgtcgtcgccactctccttgccggtgaccacctctgcaaccctggcagccccaccgtcctcgcagcagctccacaccaccgccgccaacggtcgtgaggaagagaagcacgaacagggcagggagagatagagaatatgggcttggcccatattacctcgtgggctgacgtagcgagggttgacgtggcatctgacgtgtcaaaaaccacggtaaaaacagttcgggggttaagtgttcggtattgaaagtttagggtgtattatatctggttttgtaattcgggggtgtattttggacaagcataagagttcgagggtgtaaaatggacttttccctataaaagggtatattagcaatatatcagctttataatgtaaagatgaacttgaaatgaagtgcaatttattactcgtacaaatctcacatgttccccacttcctgtacaggatatgcactttcacctgggcaccctttttaagtgaagatacaagcacagccaacaggcacgtcaacagcatccgcaaaggctccgacagctgatgagcagtgactcactggcagcgaaggcagcaggcggactccaactcggaaccagcattaccatccttgattactgatttcaattccgattcgaactagctcgaacacagcggcgtagtcgcgtgcgtggtatgcgagccctagctataaatctgcacgcacatgcggtacataccgatatacgcgtccctgcacatcaatcttcaaattctcgatcggctagctgctcattggtgccgagcgtcgcgcgcattcttgtcctagtcgccggagcatggcgaccacaggacgattgctgctgccccacgacatgtacaggaggctgcaggctcccacggcagcggccgcggccgcggccgcgctctttattttggcgccccaccttccagaggcctaacgctgccgctgccgtaccggaaggatacagcaacggtcgcttcggctccgtcccggcgtgcagcgaggccatcgccgccttggaggagacgtcggccggcgaggcgaagg

SEQ ID NO: 16384 - DNA, 1501 bp, Oryza sativa
tttagctacatctacaaaaacaaatttgtttgataatatgttggttttaagtaaaaaaaaatgttgctatgttttttataatcttatttaaaacttatctactttttttaatcacctcatatttttctcatcgtcacacgggtcgtcctgcgtgacgtggtacttgcggtgcgccgggtggtgaaggcgaggacgggacgggcgtcagcgaggtggacgggatgccacggcgagggagacgggatgccgcggcgagggagacggggtgcgcggcgagggcatagcttgcgtccacggcgaggaaccgtatgttgttcactgactgctccaccacctccgccgccggtggctactgcgcgcggagggcagtcggctgtcggcggccgacggcgaggcatttttgacatgaaacaatggcgacgttcgcatgctcgactacgtccgttcctcttcttcttccttggttaaggccaagtaggcagaggacgagcgggcacgcggcatcaatctttagaatatgagtggaagcgaaaatcatggaatttagatgaaagcatgttcattttgctagtttaaaaaaattgaccaacaaaaaagtcaagtcgagtaatataaaacgtagtgagtatttttttttagctatttcacattgtattgggaccaaacgaaatttagtacaaaatttcagtttgcaatccacacgtaaatagttcagtttgcagatttgttgagaaaaaaggacgaacagggtagtttgcattcctaatcttatcgtgtgttttggttagaaaacaatacagtaacgctcgtggtccacatgtcagaaataaatcgcggcaaaattctcgcaggcgcgcggcaaggtcgccaaaaatctggtgggtgtggccaagtcaccaaaatccccaatctctctgtcctcctctcatcccaatcaacccaccacatcgcgccgccgtccaaggccgccgccgccgcgccgcgtccagtccaggccgccgccgctgcgccgcgtcccgtcaaggccacatcaccgcgccgcagccagtccaggccgccgccaccgcgcaccccatccaaacccacgacgtcgccccgcgcccatccatctggtgtcggtcgagtacgagaccccagcccgcacgtgcaccgccgtgccgacgccaccagtcgccacgcacggaagaggattggctgctcgtccagcaaccctccctaggactgattcgtctcaggtgttgttgtcttgctcctggaatcctcattcggccttcatgtttcatcatcttttttattagtgaccagttctagaatttactagtcaggttgcggttgtactaagggattgcagaactaggttgttatgccatgtgaaagtttgggtgattgatgatccgaactaatggttgatattttatttcttaatcatacaaactaaactaggcctttattattcttgaacctttcatgaatagaaggacatttcctaacatcaatttat

SEQ ID NO: 16385 - DNA, 1501 bp, Oryza sativa
tcatcttgatatgtacttggaggaagaatgtccctgctactactgattttgatatcttgcaatactggaggacattctaatatcacaacaagaatcctgttaatccgtgatggaaaatttctgtcacggatcgctgaaaaaccatcaccaaacaacatctgtgatggtttcagaaatcatcatggattgagcgtcatggattgacctgcgtgacggttcgtcgaaaaccatcacagattaacagaatcgatgacggttttaaaccgtcacgatggagcccgagatctagttagtctagccaagcccatttcctatgacgaaaaataaccttcatgaatagctgccacgtagacatttttccatcacagattagctgccacataggactttttttccgtcacggattcaaatcgccacatatgtgccatgggtacgccaaggtggatgttgatgtgtcatcaatgccacgtaggatttagcccacgagttttgtggcccaattcgggtttccaggagctttcggcccatttatgcccatttatgaccagctagattttttttgttttgggccgatttgtttttttgtggggtattttttcggccttttagtcatcattcaacccagttcaaattgggctactactagatttagcccaagtaaaattcagctgctgctaaatttagcaaaatacaaatatttcgtccataattttagcaaaattaattacagatcattaatttacattctctcatcatcagcaacaaaatagttacagatcagtaaaaacacattccaaccttcacatctcatacaacattttttttgagcatatctcatacaacataattaaaacctgttcaaaagcacgtgacaatgctggagcagccaccaaagcattttggccactcctccatcgaagttcgcatatgtttgagcccagcaacctgatagtacagtaccatatgttagattatttttttatgcgctagagaaacaacaagaaacaatccacatatacgatattagtttttgaatgataggtctactttgtagaccaatctgatgtccccataatatattgcactaacaaaacccaatgttcccatccccaacccacctcatttcattggccaagcaaacaagcaactgacgctagactaatagtatttgattaaacaattatccaaaaatatgagagcaagtaaagtggtacaagaaagtgaactagaatgtataggagtatagcactaaaatttagacactaaagtatacgagtaacttcctatgcatgcttcatttctacggactataggcatatagcatttaaacatacagatttgtatgcaggaccgtaaagtgtggtgtaaagttatggacgccatttaaacatgcttcatttctacaaagtacaggcatacagcagcagttccacgacaacatggagtgcaaatgccaggcaggaaccaaaaatgcatcaaaagaacattttcaaacttccaa

SEQ ID NO: 16386 - DNA, 1108 bp, Oryza sativa
aaacgtgaaaaaaacgttaacgaacgcgaacgaacgtaacgaaacgttaacgaacacgaacgaacctaacgaaacgttaacgaacgcgaacgaacgtgcacgaaacgttaacgaacgcgaacgggcgtgaacgaaacattaacgaacgcgaacgaaacgttaatgaacgcgaaagaacgcaacgaaacgttaacgaacgcgaacgaacgtgaacgaaacgttaacgaacgcgaacgaacgtgcacgaaacgttaacgaacgcggacgaacgtaacgaaacgttaacgaacgggaacgaacgtgaacgatacgattacgaaacgtgaacgaacgtgcacgaaacgcttacgaacgtgaatgcatttgtactaaaattgtgagaacaaacgcatttatactaatacgatttactagtaatacatatatgattatatatgtaacttggtccgtttagtctaatacattttcctggtaatgttgcagagaagacgtcggcatcgtccctcaagccgaattggtagctagccatcgaagaaattcgcgcaggcaagtgatgtaaataagtgattgttagatatttaatataagattgttacacttagcatacatgattattacacttttaatataagattattattgatttaatataagattagtagcgatttaatatgagattgttacacttagcatatatgactattacaattttaatataagattattagagattaaatataagatcgttagagatttaatataagattgttagacttagcatatatatatatgattattacaattttaatatgagattagtagtcatttaatataagattattagacttagcatatatgattattacaattttaatataagattattagagattaaatataagatcgttagagatttattataagattgttagacttagcatatatatatatgattattacaattttaatatgagattagtagtcatttaatataagattattagacttagcatatatgactattacaattttaatattagcagagttttaatattacggttagcaaatacatcctacatacttaacaaatattttttgtatgcataga

SEQ ID NO: 16387 - DNA, 941 bp, Oryza sativa
gtgtgggtccgggctttgataaataatattgtatagttctagaatcatgttacaaaatagctttgagcaattaagtgtctttaaatgcttgtttactgcaaccctaaccctttatattataactcccttgtactcccttgcatttattatgcacttgtgggtgtgtcttgttgagtacggtggttgtactcagtcttgctcaatttttcccaaacccagaagaggagtctccggaagatgaagattttggtgcctagctcgtgcctgccgtcaagcgcctgtggtcgtcgccctagtcttccgctgtttctcgtttgtctttgtgtgtgctgggccttcgctgcccatgtaataaattaactatttacgcttccgcttgttgaactctgaactgtatcaacttttggtgtaccttgcctcctgggacaaggaataatgcacgcacgtaaggaacgcccgttgggttatttccggtcgtgacaatctcggccgttcgtttccgtgagccactgccgtgcacccggtccaccgcaaaccctagccgctgacgcaataattcccttttccttttcaaaaataattcattattgcgtcataattcaattaaaatctatataagtgttttaatccgatttaatctttaaaaattcataactaattctttgtaactcagtttaatgtggttcaagttgcaaaaattatataaaataaagatgtacatattaaaattatccataaattgaattaaatttatttaattctttttaaatgggctttaaatagatttaatctcgtaaaattcataataaattcatttgaagtcagaatgaggccgttcaagtctcataattcatctaaaattatgatctacatgtttgtttactttatatgtattgtttatttgatttttattagtctttttcctcattttgcatgttagc

SEQ ID NO: 16388 - DNA, 1501 bp, Oryza sativa
acagcctcatagtcttcatgaagaaattcctgcagattgaaacaaccaggaagaggccctatccaaggaagacactggcaaaaactggtgcacgagccaagaagcctttggctccggctcccaggaaaccaccgcccacaccaaggaacaaaaaggtgtgcgggtaaaacagacgacgtccgctccttcacctccagagacggacaaaaaatcttcgcactaaaattgctggaggtacggtcttgctcgttggacctaaaatcgacgtcaccctcgccaataggtaaagttggtatgtatctcatgtttattttcatcaatttgattcttgcattcatagcatatttgaatttcctgaaaacattgcattaggaatttaaaatttgagacaaatttggacaatgaattttctgagcacaaagaaataaattttgcagcatttatcaacgtggctcctacacgtgtagccgttggagtccaacggccgaatgtggggccagttgggcccaccaatggttcggccgaatcggccgaagcaacggtcaggttatccctttttgtgccagtggctagtgggtcccacctcacagttatagccattggtagatcattataaaaagggtatggccggtagaaggagttcatcccattctcaaaccatcttcactccttctcaaagtttctttttgctctcaagctcattccaagctagttcaagctttgcctcacattttagagttctacatttgcatttgcatatacaacttactttggtgcaaggctaaccggcacgtagattgtcttgtgttagcttagcccccgctcgagttttgccttgtgctcttgctcttattgcattcatgaagaaacgacactctcgcttgttcaaggggtacggctctcaatccagccgtcaacaacacgagtcaagtgatcggtcatccgccgatgtgccgatggaggatacgggtgctgaaccgctactcctaaccgacgccgatcttgatcttgttagtggacgggaacctcaagcctacgagacgctgatggaccgagtgttagctcacacccgagcgtacgtttcgggattgctccagaaaacagagtcgattttcagaaggcaacttccggttttgagaaaaacagattttgggaagatatttttggtgcaccgatttgtaagaaacctagaaccaatgacatccataatccaactcttaggctcatgcataaatggatttccatgactttgtttcctagtggagatcttagacttgttcatgataatgagttatccttaagcttgcttaaggatgagttttcctcatttcttctccattttatttgcttaatccctagaaacaaataatactacaagtacaagtggaagtagattattctaaaataaatatgcattgcaagcatagctaaatctcctttattttagttatatttatggtcgtcattggtatataacgaccatcaacaccgtttcaagagg

SEQ ID NO: 16389 - DNA, 1115 bp, Oryza sativa
aacgttaacgaacacgaacgagcgtaacgaaatgcgaacgaacgcgaacgaacgtaacgaaacgttaatgaacgcgaacgaacgtgcacgaaacgttaacgaacgcgaacgaacgtgaacgaaacgattacggaacgcgaacgaacgtgcacgaaacgcttacgaacatgaatgcacttgtactaaaagtgaaagtgtgagaacgaacgcgtttatactaatacgatttactggtaatacatatataattatatatgtaacttggcccgtttagactaatacattttcctggtaatgttgcagagaagacatcgtcgtcgtccctcaagccgaagtggtagctagccatcgaaggaattcgcgcaggcaagtgatgtaaagaagtgattgttagatatttaatataagactgttagacttagcatacatgattattacaattttaatataagattgttatcgatttaatataatattgttagacttagcatatatgattgttagagatttaatataatattgttagacttagcatatatatatgactattacaattttaatataagattagtagcgatttaatataagattgttatacttagcatatatatatatgattattacaattttaatatgagattagtagccatttaatataagattgttagacttagcatatatatatatatatatatatatatatgattattacaattttaatataagattagccgcgatttaatatgagattagtagagatttaatataagattagtagcgatttaatataagattgttatacttagcatacatatatgattattacaattttaatatgagattagtagcgatttaatataagattgttagacttagcatatatgattattacaattttaatataagattattagagattaaatataagattgttatagatttaatataagattgttagacttagcatatatatatgattattacaattttaatatgagattagtagccatttaatataagattattagagatttaatataagattagcatagttttaatattacggtacgcaaatacatcctatatacctaacaaatattttttgtatgcacaga

SEQ ID NO: 16390 - DNA, 506 bp, Oryza sativa
gcatcgtttccgttgctatccttctcccattttccacacggcatggacttggccagctagcttccgtgtgatcctgtcccgcaaagttcccaaaactaaaattttcacgttgtcacatcgaatgtttgatacgtgcattaagtattaaatgtagaaaaaaaataattacacaaattatgtgtaaattgcgagacgaattttttaagtctaattgcgccatgatttgacaatgtggtgctacagtaaacatttgctaatgatggattaattaggcttaataaatttgactcgtagttttctggcagaatctataattagtttttgttattggactacgtttaatactttaaatgtctgtccgtatatcctatgtaagtacgtaacaaccaaacccaaaaactttccccaactaaaccaggcctaaaaacgaatcagaaaagggcaaggtgacatatcatccctcctgatcaactcccaggccagcgctagaaacctcactctgcaca

SEQ ID NO: 16391 - DNA, 1170 bp, Oryza sativa
cacaaacctttaacttttccgtcatatcgttctaatttcaatcaatcttttaattttggcggtgagcgtgagacaggccagctccatggcgaagtcaagctgtgaaacgcaagcaggagctgtctgtttcagccgacgtgcaatctgacacgctgaagaatcagcatcgatgtgacggccggccatggcctgagggccatctcatattagtagctgcccggttgatcgatcgaccagcctgtaattgatgcaaatgctgttctgtaattgatgcgtactatgctgttgtgctctgcttcagtttccttgtggttatacgtcactgttgagttcggctaatcctcatcgatctgaaagctactgctactgatcatctatctgaatctgatcgagataatttagctctctactcagctagaatatccatctctaaccatccaaccctgacaaaccatggcatctgcctacactgcttttcttgctcatctgataatctttcatgcttattagtagctcaaaagaaagcaaaagatctgtctttttcttttctttttcattcgcaaagcctggctgctaattaacaggtgacatctgctgctgatagctttcagtaaagggaagcccacgtttcatttggctgcatcattagcgtacgactcatagccataggcatcatagctgtagaatccctgtaagatctgaacaggagacagggaaccgatagatcagaatctgaacatggattcctgtggattcagaagaatcttgatccatgataagataggaccatgcaagttgcaacgaggataagatacgccttctgatcttcagatcccgttcatctttcgtcaagttcggtggtcacaggctaggctagtgaatcttgtcaaaatctttacagagatcatatcatctcagcttttttctgcatgagatttagagtctgaagctcaactgatgccagaactgatcgaccacctgtagtcaatcacccttacagaatactcctagctagaagtaatacagtagatgaattaccaagttttgcgagttttcatcttgtcacgttcttgcaatcacggaaagaggggaaaacctttcaaattcaaaccaccaaactcaaaacgaatgcattttaactgggttgattcaaatcacccagcaacgaca

SEQ ID NO: 16392 - DNA, 1501 bp, Oryza sativa
ttggcgagtgggttcaattaagtgcgataacttaaaaaatgacataccaatgcaacaacttggctaggtgggtgtgtttgtggttcaaaaggctaccacataaattttgccatgtcaactgtccatgttggacaaagtctacatggaacacccttcacacatcatgataaatttgtacaaatcctcttatgttattctcatttgaggacttttttctgtacagatgaatcaatcaccaagcccatagatgacgagggatggggcttcaaatctgtagcgttgggcttcttgaagcttgtagttgatgtcttgaactagccgccatcgatgtcctcgaagcagccggtggtggtaggtaggacttgaagccaaaccatgttgacgtgtcaaattgcaagccaaacctatattgtaagacaaaccatgttgatgtgttaaattgtaaagtaaaatcatatgtatctgatgtgttatcagagccgtctctagatatttggggcccctgaacgaaatgctaattgggccctaaattttgaaaattttatataactaatataaacaaagcatactttcaatcaactatataactttaatatgtgttattttatacaaatattaatgctaaaagagaaaaggtagtactactgacctcatgttgtactgaaaagtgaaaagcatcatccttctagtgtttcttgaaatgaaatctttaattatatcttcataattaatatcgagattgagctgctgcatctagcctgtctcttcttacgtttttcagcacctgaatcatgctttctgtttctagaagtgacgaggaactgaagcaattgaggaaataaaagccttcctgagttcctgttttataaacaaaataaagaaaaggcgtgtttgattcaatcaatcattcaaaaaaaaaatcaaaatactgtatacatacatacatacagtatacacactaatagagaatcagagatgactagatgagatgatcagatgaaagtctagttcgttcgtcaaattacttgatgatcaaactctcagtctggttgcccggcgcgccctcgccggctcgcccttgctggttgccggcttgccgcgcgcgactgccggagttcgccacgccgccgctgccgctcggcgctcgcccgctcgattggccggcgattgttgtgctgtcagctgccatgcgcgtgcgctgcctcgcgttctccctgcctcggctgctcagtccattgtccacgcctccatggccatccaacagaccaacacagcaacactaaatactcgcgagttggagtcggtgaatcgcgacgcctcgactgacgcatgctgcgcgcgatcaccaatcaccgcttgagatgaaaacaacgcaactacgctcgcgagtcgcgacgcctcggactgcaaacttccgccgttctgcgctcttggtagcgggcaagcggctgccaggtatgtcaagaactattcttgaagggtacaattatatcacactcag

SEQ ID NO: 16393 - DNA, 1501 bp, Oryza sativa
gccaagctaagaggcctaccaaaaaaatagttctatttttgctagcggcgatgctaagaggcctgtcataaaaaatcgggttttcgctggcagcaagttacagcaccgtcagcgaaataaaatttaacgctataaaatcaccgcccccacaccagcctcgtccttatcctatctctcctccacctccctccactccctctctccctccaatcctccagcgccggcaacggaggactgcgcgacgaaggcgacggcgagctcgggtgcgggcggtggctctcgggaacgggaagtggagctcgggcgcgggcggggaggccggatccgccgccaccggatcacggggagggtggcaccgacctcgacgccgtcgaccgtgctcctgtctccctcctctccgaccgtgctgccccgtgctcccggctccctcctctccgaccgtgacgctgtcctcatcgtgctcccagcttcctcttctccgatttgaaattttttttgtgcatgttgttgttccagatgatgcacatgttttggtctgtgtaaatgatgtttgatatgtgctaatgatgattttgtatttcgtgtttgaatttggaagtgagcatctaatctagatctctagatgtggatttgaattttgaaaatgaatcaacgagcttttctccaaatcatcttcgctggcggctgggtagctgcatgggtatattttttggcccaaaatagattttcactagcggcctatttaacatagccgctagcgataattcatttttgctggcggccgtcttaagccaattgccagcgaaaatggatttttgctggtggctggttaagacgaccgccagcgaaaatgaattatcgctggcggttgataaccgctagtgaagatcttgatcttcactagcctttgctttgtagcagctccaaattccaccagtgaaaacccaaaataaccgccatgaaagatggttttcgtagtagtgttagtatcactctgagtggaattaatcgacgtcccgcagcacccattcagtggttcgtcatgcatatgtaccgccaccattgatgcccctttcgctagccacgaagagaaggaagaatctaacaaacggggctaaggacatttttgacatgttacatggtttctttctcatatctcattacactagaaaaaatgtccgtgcgttgcaactggtgaaggttattttagtattattattgttatacggtttagttaaggtaaaattcactgtgggaattcacttggatatatatttttctagacaataatgagctgcaattaggagtccaatcatctcaagttagtatgcgagttttttaaagagatatcttatacgacttcttctgtattttcaaaagcgaacgaacttaaaacccgacttaaatacggatttgtatttccaaaatcgaacgaacttaaaaaccgactcatacatggatgacgtaccaaagtactagcaaaaacatcttcaatttttat

SEQ ID NO: 16394 - DNA, 1501 bp, Oryza sativa
ggttttgttatgggcctggcctgcttacgtgggctggtcgatgtcaatcgtgggccacgaccagagccacagcgatacggcataggaaaaagtacaccgaaggtccctcaacttgttatcgaattacaaaatcgtcccccaaccgtaaaaccagatatatgacatctcttaacttacaaaaccgttcgttttacatccttcggtggttttcacccggttttattcgacgtggcgggtgagtcagcatgggacccatgtgggtcccacatgtcaggacgccacgtcatcaggctctctcttccccctcctctcccttcctctctctctctcactcatctccctaggcaggctggtcggcagaaatctttacaaaaatagaccctgcggccctccatttaggcggcaagctgacgtggcacacggcgtcgtgacgtgccgtgtgcgcattttgagcttagacccttggggctaaatgtaatttttttccatgctaaaaaaacaattgactagttctttttgcatctgggctccttgccgcccttgcgaattttgcacggaggctccttccgcccagacagagggcggcaagggggccacgtgtcgtagccccccaaaacgaccgtcctgcaccgtgtgccacgtcagctttttgctgatataacatttctgttaatattaaaaaataaatctaaaaatgaaaaaaatcagtgttcaacagctactctgaaacagagccaaatatttcctgtagtgccaaatatttcctgcatccttcgtacggcccacagctaaatatattttctccactacaaaatgttggtacctagaatgaaatttagacaacgaatctggataaacttttatccagattcgttgtcgaatctgtacataatttctatccaggttagttgttctagtatggattaaatctcattttatattacaacattttaagacgatggtaccttcagaatagacaaaatgccaggtaaaacctcaataatataaaactcgaaaatgtaaatgaagtctgctctgccttgtgaggctacgctgttcagggaagcaggaaccaagtcaagcatggactgtaacatatccatcgtggcatccaaaaagcatgaatgaacaggacaatctgcagagtgcagttatcaaagatacagggtatctcaactccccaacgttgagatgcattgcaactctgcaagttcagtaaaatttaaaagaagcttagcatgaagatttattatcacatattggcagaaaaggtgtcaactgtaaggccttagttgtatttctgcataatctgacctttaaggctgtcataaatagaacagtatctcagtgccttataattaatggagagctcataagataatcacacctcacaatccatgcacgtaaactcggttcatacaagtgaaactctcatccatcagaaatgtctaaaactattatcccatttacaagtggtcctatttattattattattattat

SEQ ID NO: 16395 - DNA, 1501 bp, Oryza sativa
actaggccatcaggctctgcccactctctcttgtaatttttttctgtgtgatctctctatcaatacatatacaaactgtaccttcctaacattcaaaacaaaagaaaacaacaacaacaaaaaactagttgcagcataggcaacaagcacaaacaagctcagaattgggcattcttggtaggggagcataaagaggggcattggttgagatgtatttatgtacactgcgtgaatcgatacttcttttaatgtagggtaacatatttttcttttcaactggcctacaggctctgcccactttctcttctaattttttactctctgtatctcaatcaatacatacaaactgtaccttcctatatttcaaaacaatagaaaacagaaaaaaactcgttgtagaggcaaacaattttggttattttggtaactgattgacgacactagtccggtagattttcatgagaggagcaactggacatacaaatatcactcgtgctttttctatacgcttatacgctcccacactacagtagaaagaattgtattgaccggtagacaaattaagtatatactgaaatcattgtcaagattaatatttgtgatgaacaattggctttacaaatgatttattcaatgaattggtttgtgtggatgttggtgtgagtgcgtgtgactaatgtgggtcaggttgtgatatctgtgcccagaaacggttggtttatctgattgtgtgcaggtgacttgaggtcagccttggtcaatggtgaggaccggaatatgttcagggaggaacagaggtctagtgcggtcgggataccatgtgagaaggtgactagagtcaggattcttgaagatcaactttggtcaacggtggggatcgggactagactcagggaggagttgaggtccagacggttaaggataccgggtgacgaagttggatacgagatggcatacgatggatggatatcgtgtgggagagatatccgcaacgggcttcacgaggtatgaggacaagcgtcggtgttcgtgaatgaaattggttgaggaaatttggagtagtagtatgcagtacatgcatgtatgtgtgatcgatgcgtgcatgcatgctagtatgtagtgtgtatgtgtactgtgtgcagctggttggctagcatgcatgcatatacatgtggagctgagattggtttggatggatggtgtcctggtcgatggcaaggcttgatccatgcataggcaagccgagtcggcttcatgcagcaagcaacagcatcgcggcaggaggagttcgacttcggtgcggctgcagttttggagaaaaaagaaattaagggattgatcgagtcctattgtgaataggagttctacacctactttgagtaggagatttttacggtataaataaagagggagcgtaagacttcccggtatcgttttggagagcaattgagttgatggtttagttagggtttcgagtttagtcgagatttttgtaaggagt

SEQ ID NO: 16396 - DNA, 1501 bp, Oryza sativa
aagtacttgcacgccgaaatcgcatgaaattgtgaagaccgtccgatgttggtgctgtcctgtaatctgaatccaaccggcggaaatcctctcccctttggatcctctccatcgttcctgagtaaaacaagagtgcacgcgtcttcggggtataaagaagaggaaaatgaactcaagaaagaactcacctaattgttcagttgacgtgcacgagcgcgggtaataggaccatgaagttgtacttgtggggacgtggatgtatcgatggtgttgatatcctcatcacatgttagcgaaaccgggcatccatactacctcgggaccttttttggatggttttatatagttgaggggtacacatttctggtattgcggttaggggaccttagacagactcggcgtacaattgagggatgtcacgtgaacttattccttttaagaatatcttttaatggaagtgtagcgtctcatgtattatcgtagattatagggttaatttgattcatgccattatatttgcttgttttgaaatataccattataattcatgaaattggaaccataccattacaatttaccataaagatgtgccattgcttaccatttcaatacaaattttacttctttctgaccaaattacccttgtcttcttgttcatcctcttcattccctttctctcttctctcagcttcaagctcgatagaacaagatccgggggttgccctcgttttgaggctgtcctacaacgtcgccaccgccggaccttgccaccacatggcaagactgagtagaggtcagcaacttcgcaggatggctaggtgatgacctatgtctcagagactccgccaccgtaatgtgcagcaacgacctaaatgatgctgctcccggagacgatgatgtcggcgacgcctacaagatcgtcttcctgttgttgttctggcggaattctccagaagtgagttgctggggcccggccccatcctcacatagttgtattcttcccccaattagactgctttagttatgtcagtatgtgtatatctgtgttttgtagtttgtacagctcccaggaaggacacctatggagttttctagagcccattgacctggaggagatggttgttgggatatgcgtaggctacgataacataaatcaaaacttttctaccgcgtaaactaggacccatgcaagtattagatcatagatcgttatcactcgacgcgctgcgcagcggaagaaggcgctaagaagtcgaaggaattctcgcgaagtagtgcgcgtcgatgtagaggaagtagtcgatggcaccggctcgaccttctcctcctcgtgtactcttctcgccgtactcccattccgatcagcaccgcaaatcagcggcacctctactggtatccacacgtacaaggacggaacgccacgcgcagatgtgctagcacccgcgtgcggctagggttttgctccgggaggggagtgacggctagggtttctcacgtgatg

SEQ ID NO: 16397 - DNA, 1501 bp, Oryza sativa
  unsure (1)..(1501): unsure at all n locations
atctatttgtttagttattaactacatctaaattattaccgcgaattgatttcttatagaaattgccaagaataatccataatttatattaaattttgcaattctatgactataattaacctataaaattccaattattttaaattttctaaacttccctaatctccctctaattttctatttatttcctttttctttttctccctttctttttctttttttttctttttcttttcctctctttctttttctctctctgccggcctctcttttcctctccctctctctctcggctctctctcccacccgagcggtggcggcggtggacgcgaggggaacgaagggcggctcaccggcggcggcagcggcgacgacggcggcagcgacggtggcgcacgccggcgcgggagtggcggcacggcggcacgagaacggcggtgcgggggcacgggaaaaatggcgcggcaacaccttaaatgcgnncncggtagcggggagatgaagctccgncggcantnnggngnnggcccggtanaaaggnacgtcgcctaggggaatgggtgtggggganaaaanaagggctgggggttttatagggtgtgagagagagaaaaagaggggcggtaaagagggtagcaacgcggcgccgggggggcacaaagggtccggccaaggggccgcgaggcggcgatggtacgcgcgcggcgacgggacgcacgtggcgatgggacggcgcggcgcgacggcgatcgcgacggcggtgtagggctcgaggcggcgacggcaacggcacgtggcgacggcgacggcgcgcggcgcagcggcgggcgatgggacgcgcgcgcgacgagacgggtggtgacagggcggcaacggtggcgcgcggcgcgaggcgggtcgcgacggcgacggcgacaacgcggcagcggcggcacggggcgcaaggcaacgtgacgggcgagcggcgacggcgacggccaaaggcgacggcggtagcggcggtgcgcggtgcgaggcgtggggcgcgggcgcggcgtcggcgcggcagcggggcagggttaggctaggggacctcgtcgaacacctggcggccgacgaatagcgtcgttttctatttacccgatttaagcctatttatttatttaaaattgattctataaaccttaatttttgtacaaatgaagttcactcaatatttgtgttattccaaccaatgggtccacccttgattaattttacccatattttatttttatataatttccttgaatttaattagagttaattcttattccgacacttttcaatttaattgatataaatatagtcgtaataatattttactcatttctatactcactaaatattattttaaattgtactttaattatttacttagtcaatttactttttagggtttattcctaactaattatccattattcgcgatttataaactccgaaataaaaattcaataaaataatcgaacaaaattggcat

SEQ ID NO: 16398 - DNA, 1346 bp, Oryza sativa
tctctccgccgtcgccgccgagctccggtccgccgccgtcgtcgccccgaaccacctcccacctcggggccgcctcctacgggttcgccgcatcctcgcccacctcgtccacctctccgtgtcggtcgccgaccgccggaacgccgtcgaccccatcgacccgatccggaacgccgtcgaccccgtcgacccgagccgcgccgccgcctaccttcgttccgggcgcctccctcatcgccgccgtcgccccggggtgagtcgtggggccgtcgcctcctttcccccttccctcccctctctcggccgccgctccgccatgccggtggtcgccggcggcgaccatcggggcgcgggcgcgccgcctcatgctgaccgcgctggcgtggccgccctcgggcgcgccgagtggctgccgcgtggggcccggccgtcagccgcccgcgccctcgggtgcggctgacgcgtgggacccacggcgccggccggtgtgagcccgggtgcacccggtccaccgtggaccgtgaggctgccgcgtgggccccactcccgtggacccggtccgcgcgccccctcccctcggctgacgcaataaaccctttttaaattaaattttaaatgaagaaattcgcaaatattcatttaaagagcatataaacttcaaatgaccataacttggccatttgaactcggaattggaccgttcaagtctctaatttttccttatgaagtcaagaacccatttttgtgctttgttcctgcttgttatatggagtttattagagtaaaagccttttcttttccgttggtcgtgtagacgctgcagcttcggaagatccgctcttcgtggaggttgaagccgacgtttgggaaagcgagcaaggcaagtcacatcacccttgaacatattgaatcccagtttataaaattattttgatttaaattattgcattatcgctttatttaaattcccgcgttatcactgttttatctagccatgcctatttacctttggtatgaccttattattgttattgttattatttccttgttcaccctagaataaacaaaaccccaactagtggacactctactcatggtaccactagtatgattttaggtagaggcttcgctggttaattaggcaacattaggtggttttacaactctagactttgggaatactcttatcacctagacactatggaatggttggattattgtggaattggattcacaccttcccctctattcaaaaccctcaaaatggttttaggctgggctcggggtgcatggtgttacaagtagcaccacggccatagtagcaccacggccatataaggaccggt

SEQ ID NO: 16399 - DNA, 1501 bp, Oryza sativa
caaccattccacattttagttattaagcaggttttaagaattaaaacactaacttgggtacattgctcggcttgcccataactgagggcgcggctattcgaatagattatactctgatcagaggtgtacatctttacccacaagacacatcttcctcacgtgtaaccacgtgccacataccaccacggtatacggacggaagacatgacatagtttccaacccatcctagccataacaagagtaccgacccaacccacctacgggcggaacccccgggacaggtaggccaggactgagcccctaacaacaagacaccggccctgggccatgacatttcgactaccgggccgcagctcgtgtagccttcatttgccctagagatgtccatcgacccccgacttcgtccatctccatccgggtacttttggttataaccagactgagccacaaactaagccttacccactagacatgtggaagtacagtaggtgcttttttggggccaaacagaggcccgaagaccggtccttatatggccgtggtgctactatggccgtggtgctacttgtaacaccatgcaccccgagcccagcctaaaaccattttgagggttttgaatagaggggaaggtgtgaatccaattccacaataatccaaccattccatagtgtctaggtgataagagtattcccaaagtctagagttgtaaaaccacctaatgttgcctaattaaccagcgaagcctctacctaaaatcatactagtggtaccatgagtagagtgtccactagttggggttttgtttattctagggtgaacaaggaaataataacaataacaataataaggtcataccaaaggtaaataggcatggctagataaaacagtgataacgcgggaatttaaataaagcgataatgcaataatttaaatcaaaataattttataaactgggattcaatatgttcaagggtgatgtgacttgccttgctcgctttcccaaacgtcggcttcaacctccacgaagagcggatcttccgaagctgcagcgtctacacgaccaacggaaaagaaaaggcttttactctaataaactccatataacaagcaggaacaaagcacaaaaatgggttcttgacttcataaggaaaaattagagacttgaacggtccaattccgagttcaaatggccaagttatggtcatttgaagtttatatgctctttaaatgaatatttgcgaatttcttcatttaaaatttaatttaaaaagggtttattgcgtcagccgaggggagggggcgcgcggaccgggtccacgggagtggggcccacgcggcagcctcacggtccacggtggaccgggtgcacccgggctcacaccggccggcgccgtgggtcccacgcgtcagccgcacccgagggcgcgggcggctgacggccgggccccacgcggcagccactcggcgcgcccgagggcggccacgccagcgcggtcagca

SEQ ID NO: 16400 - DNA, 1501 bp, Oryza sativa
atctcatacatgtgtaattgaaaataaaaagttcatcgcctgcttgaaagttcctggagaaggtgattttctcggcaactagtcttctctaatctctgttagtgcaccatcattgttgtagtatagcagtatacctgtcttcacgaaaagttctcatttcctttttgacagatcgtttgcaaattgtgttatggcagttattttatctttgatttgaccttgccttaattagtgctaccaaatactgggtttgttgataaaaagattgacacgtaaattggtctgcaactgtaattttccccagtcagcaattatttttgaccaattgcaattcactattgtcaacttatagccacgactagtgctgatgaagtgacaattgattgcgtagttggagctatctatactaaccaaaaacacaatgtctgggaccaaattgaatatgcaatacaactgctgtatcacaagcaaattttgcccctgacgaatttaagcaaataatgtttctgcaaaagtacctgtgatgttatcacctacctaaaaaatactttgcaaagatatattttcattgttttttctctgaaggttttgcatcacatatggatatagtcgtgttagttcttattaattagatttttctatgttttgcacataaataacttgttaccgttgaaatcagattcattagctctatcacttctgatggacaacaaaggcatggacccactttatgttggtattacaactccagaatttgtcacttcagctgaagacaccatccatgtccaagcaaatgatcataatgaggtgagctaatgcaaatgagtatcttgaagataattatagtaatgagattttctggcttaacttttctttatgcaatatttgcatggtgttacttccacacatgttatttcagaagagactgtcttttatattctttattgatatgaaagtttttccagcgagcttttgagaggattatactgcaggttttctggcttattttttcccatatgtactatctactgtatgtgttgtttcaaaatagagtagctgttttttgcaagcttatagaaggatagttgctctttaccaagatcctggcttcatggtgtcattaatttatgttttgtcatataattggttcgtgagttatatatttcacgtgaactgcggtaggttattcccatattgatttatatacatgcataattgcattagcttattttgagttcttgttgatagtgtatctcaggattagcagaatgtcagtatactattgctgttcttatcagcttttattcaaggggaactggatctttctcatgctgtttcaatgttttcaatcgatgtactgatcttcttttttattttcatattgttaatttagacacaggtgactatttttaacaacggtgcaccaaacatgacaataattcttagagttgctgaagagacctgcaatattagcattcaccgagcaattgcgagggagata

SEQ ID NO: 16401 - DNA, 1501 bp, Oryza sativa
atgtgcaaaacatagaaaaatctaattaataagaactaacacgactatatccatatgtgatgcaaaaccttcagagaaaaaacaatgaaaatatatctttgcaaagtattttttaggtaggtgataacatcacaggtacttttgcagaaacattatttgcttaaattcgtcaggggcaaaatttgcttgtgatacagcagttgtattgcatattcaatttggtcccagacattgtgtttttggttagtatagatagctccaactacgcaatcaattgtcacttcatcagcactagtcgtggctataagttgacaatagtgaattgcaattggtcaaaaataattgctgactggggaaaattacagttgcagaccaatttacgtgtcaatctttttatcaacaaacccagtatttggtagcactaattaaggcaaggtcaaatcaaagataaaataactgccataacacaatttgcaaacgatctgtcaaaaaggaaatgagaacttttcgtgaagacaggtatactgctatactacaacaatgatggtgcactaacagagattagagaagactagttgccgagaaaatcaccttctccaggaactttcaagcaggcgatgaactttttattttcaattacacatgtatgagatgggtcacaccccttgataagaggatcttgtgagaagtctgttacatgcgaggattttgctgtgttgatatctttatccacatgatgcacagctgccgcatattttgccgtgctaataacttctgttgatttgtccttcttgttgttcccatcagggtcattctttccttcatcatgatgtactgtattaggatttgtttcatcatgccgtcctgtcttcccaccatctgaatgtgctatgttgttgtcattatttttgtctgcttgtagaatatttgttttatcctaaattcaaaatgaaacaacatatcagcaacaacaatgaaaacaaaacagattatggcatttgttagtcactggatcgaattaagttttcatggtaggtattggtgaattgagctttgactgaccatcacaagttaagtgagagcaacgaaatctttcatgcgacttgagaatcacaaataagtgcacgaactctagagtgcacaaaaaggcgatagagatgcattgccgatggattgaagcataaacagctaccatcaccagcaatgatctcgccatctaatattcaagtcatcccaaatacagaagggatgacagcttttatgtttcgtcagaactaaaatgagccaacgtaagcacaagttaattagtaatcagtaatcattcaaccaagtcgtatataaatctgtgcatctatagccatctatctataccttacttgctccagttacttaatgcaaataatacttacaaatttggaagatattacaccttacctcttctgcggctgcagcaataacaagcaggcaaaccagtgggagcagccgcaggccgcaccaccgc

SEQ ID NO: 16402 - DNA, 1490 bp, Oryza sativa
ggcgaattcgagctcggtacccactatcaggtagcaagtatatacgcaactactagaacaactaggatgtatagctatcaggtagcatgtatggaatattgtgtctaggagacataacggcagaatatcaaccggatataacacctacataccgtgcatcaaaataattatttctccataaattttcttcatcacaattgtttgtataaattttccaggttgtttgttagctttaaactatacgatattttcttcatacccacaaaaaattaattataacatttttcattatcttaaaaggaggttaacttaatttgtttaaaacaaatatctaacaaattaagtgcaaattaaaaataaggtgattttccttttaagttgaatgtttaggtgctctattttttttaacaaatcctaaaaaaatattattatcaataaatatgttttatttataccataaagctgcccctccttctaattggtttcatacccaggcaatttttacatacatatatatgagtactagaaaaatgactgtgcgttgcaacgggtgaaaactattttaattttattattgttataggtttagttaaagttaaattcactgtggaaattcgcttgaatatatattttcttagaaaatcaggagctgcagttaggagtctgattgtctcaaggcatgcgagtgtattttaaagagatttctatacgactccttttgattttcaaaagtggactaacttaaaaacggagtcaaacacggatatgtatttccaaatgcgaacaaaacttaaaaaccgactcaaacacagataacctacaagtaccggcaaaatcatcttcaatttttataatagtagaaatatatatgagtgaataaagaaaagagatctacataccttattttttatgatatacttaatctgtagtatttatttaaagttctaaaatataaatctctactattataaaaactgaagatgtttccgtggtccgtcatccgtatttgagtcggttttaattttatgttttggttttaatctatatgtcttctcttctctacttttataaaaattgaaaatgtttttaccggtattttggtatgtcatctgtgtatgagtcggtttttaagttattttgcttttgaaaaaaatacatatccatatttgagtcggtttttaagatcgttcacttttggtaatacagaagaaatcatataagaaatttatttaaaaaaacttacatgctaacttgaggtgattggactcctaactccaggccatgattttctaaaaatatatatatccaagcgaactctcgcagtaaattacatcttaactaaaccgtacaacaataataagattaaaataaacttcacccgatgcaacgcaagggtatttttttagtttaatactaatagagtaacagtgagggggtaattatcaatttgacagtacggataaattactaaggatttcttcttttttttt

SEQ ID NO: 16403 - DNA, 1501 bp, Oryza sativa
acccaattacggagtagcgtttagcagtccctaagtaagctactacacatgttgggaaccatgataatctcaggtctaaggattcaacaccaacactaactgagatcaatgatgacacaacacatatggctcttgcagtgtctcatgttgggtatatccaacaacatgttcaccaacatgtgtccacattattaatttggtatctctataccatgatccatgagacatgatcatcaattaatatatgtgctgatcatctaaacatatttgttccacatatgatatttgatcagggatcctttagaaatagcaacacacaacataaagagcctcatgaaagaatcacatattcattaaccaataatgagttatctatttcaaggaacaaagttggataaatatgtaaacatagtatgtgatacaatcatctctatgattgcctctagggcatatcactaacatttagtgcttccaaaggctcctgctaagaaaagagatggtaaaacagttctttatgatcaagtgagaatgcaaagctcgaggttgagggccttgctgattgatgttgcggacttaaatcccaggatgggcattggtaaacctaggggaaaatttgcaaagaagttgaaataattggcatgtatttctaatgttttatcttctggcagtatccttaaggaatctaactttgattctgatatttattttgaaactgattattccccatctgattgtctgtttccctttttacaaaagatgggagttcaaacgtgcagtctatctcttgagaaggtggctaaaagcaagctgggaggagctaaattggacttggtgcccaggccagctgaagaagatgattagtttaaattgtttatcaatggcagttcgtttcaaaaaacaatttgttttaaatatggtgtttttatgtggttattttgtaatgatagttattgtactcagccggtcactagttttttctgtatcatgccacttatgccagacttgctttgcttggtctgttttctctctttgttcatctttttacttatgaatcagcagcgtagctcaaatatcctatgttagaataagggggatgaattcagtggacaagtgggctgctcttataaatattgatgatagtagctaccagctagggtttgcttttaggaaactaaaagagagattgtagactgtgcttctcttaaaaaagttgtgcccaaaagatttgatagttttcactttgtgccttctcatggtgcttagggggggcattttggtctgttggtgtggttccatttttaggggttctttgataacctctaataattttgcactttgcctaaaatttacttctaggcataactctaaatcttggttcctagcttcaatttatggtccttgtagaggccatgaaagagtttattttgtcgattggttaaaatccttccaaattcagcatgatgaagcctggatttttcttagtgattttaatttttacaga

SEQ ID NO: 16404 - DNA, 1501 bp, Oryza sativa
gtgagtggtacgcacctgctgctaagcaacgtgtctcgatcgagagctagtcctgaattgatgtcatcctgtattctcctgtgagatacagtaatataatagttttgcacatgtgtatgtctcgtatatactctcatggcatgtttattcatcattaattcggccacatgcatggggctatatgtatctatgatgcaacatgcatacggtgctccaggacaaaacacagttagcgacacgatacacacacactatgtgtatggtcaggtgatcatttgggaagccggcctatgatacttaattgcttgatcctgtagagttgggtacttaggtctgaaggattaacactttaacatatcttatacttatgggattaattaatttcttgtttttgggagaacttacttgtcaacttagagcaagtttaagaacatgtacaatgggaagctataaataaacacaattcaagaagataaaagagaagagagaatgatagcgggctatagatttgtagccagctgcagtacatactctaaggtgcatgtgtgtatgacatgtgtgaccaaatattaattatgtaatatatatttatatataactattatatgaattgtctattaagttaactatatatgatttagagtcaacagttggctatactattagagcaacttaatagccaatttatacaatagttacctataaacatatatttacactactaatatttggtcccacttgtcatacacatatgtatcttagagttcgtgctatagctggctacaaatctatagcccgctactcttctatctccttttttatctactcgagatgtgtttatagctctcctattgtacctgcttaagagcatgtaaaatagcaggctataagccagctataagagctgcgtgctacagatttgtagccagctgcagcacggactctaagacacgtgagtgtatgacaggtgggactaaatattaattatgtagtatatgtttataggtaatggattgactattaagttgactatagatgataaggagccatcagttggctatattaaacttgctcttaccgactcgccgccgtacacaagtgtcgccgacgctaccggcgcagttagcccgctactttactgatgggccgagcagactcgatcgggcccatatacttgccaacaaatctagccctttcggcccattttgactgcaacgagagaagcagaaacggagagcgaggaaaaaaaggggaagagaagttgaaaaagagaagaaatctaagcaaaggcaaggcacagcatcgtctccagcggagtcaaacacaaagacaagtcgagatccggcggccggtggcgtcctcctccctctccctcctccccaaccaacggcgctgatcccctccgccatctccgtccatctccgcctaaaaaaactaaggtaagccaccaactttcccttgacaccagcagtagtggtagtcgctctccttctcaccgacc

SEQ ID NO: 16405 - DNA, 1501 bp, Oryza sativa
actactgctggtgtcaagggaaagttggtggcttaccttagtttttttaggcggagatggacggagatggcggaggggatcagcgccgttggttggggaggagggagagggaggaggacgccaccggccgccggatctcgacttgtctttgtgtttgactccgctggagacgatgctgtgccttgcctttgcttagatttcttctctttttcaacttctcttcccctttttttcctcgctctccgtttctgcttctctcgttgcagtcaaaatgggccgaaagggctagatttgttggcaagtatatgggcccgatcgagtctgctcggcccatcagtaaagtagcgggctaactgcgccggtagcgtcggcgacacttgtgtacggcggcgagtcggtaagagcaagtttaatatagccaactgatggctccttatcatctatagtcaacttaatagtcaatccattacctataaacatatactacataattaatatttagtcccacctgtcatacactcacgtgtcttagagtccgtgctgcagctggctacaaatctgtagcacgcagctcttatagctggcttatagcctgctattttacatgctcttaagcaggtacaataggagagctataaacacatctcgagtagataaaaaaggagatagaagagtagcgggctatagatttgtagccagctatagcacgaactctaagatacatatgtgtatgacaagtgggaccaaatattagtagtgtaaatatatgtttataggtaactattgtataaattggctattaagttgctctaatagtatagccaactgttgactctaaatcatatatagttaacttaatagacaattcatataatagttatatataaatatatattacataattaatatttggtcacacatgtcatacacacatgcaccttagagtatgtactgcagctggctacaaatctatagcccgctatcattctctcttctcttttatcttcttgaattgtgtttatttatagcttcccattgtacatgttcttaaacttgctctaagttgacaagtaagttctcccaaaaacaagaaattaattaatcccataagtataagatatgttaaagtgttaatccttcagacctaagtacccaactctacaggatcaagcaattaagtatcataggccggcttcccaaatgatcacctgaccatacacatagtgtgtgtgtatcgtgtcgctaactgtgttttgtcctggagcaccgtatgcatgttgcatcatagatacatatagccccatgcatgtggccgaattaatgatgaataaacatgccatgagagtatatacgagacatacacatgtgcaaaactattatattactgtatctcacaggagaatacaggatgacatcaattcaggactagctctcgatcgagacacgttgcttagcagcaggtgcgtaccactcactgttctcctaaacaatgacgaggaat

SEQ ID NO: 16406 - DNA, 1501 bp, Oryza sativa
aaagaggcaatttcctttaggcaagatcctcctcggctacttgtatcaaatgctgaacaatgcatcggctaaaattgttgtctgctcagctgttagtgtaggcgggccatggtggttgctgcaaacctggctaaacctggtagccatgaaagctgtcaatcggccagctatgacagaagctgagtttccaagattaaagccgattaccaatgatgatggagaagagcgcacccaccgcaggtgtatgtcctatggggaatatgcatccacaccagccgatgctggagcaaagttatcggctgaattgctcaaggattggttctgtagcttttatgaaggcttccagagagatgctcgagtttggttcccatacgaagattaagtaaatttgggtatcccagcagacttcagatttgaggatatcaattccgaaaaatttgacaagtccagataagtcttctcggctgctattagtccatgcatccttcctgtcggcatccatcaaggaagaaacatacaagtttggtgcccatgctagacagtttggaatgggatagacgccaatcggcttattctttgccgataaaatccaatgaagcgaggagatctcatccacactgatgatggatcggctactcaatatcccaggaccccctgatgcggacatcactacctcagatacacacaacaatcctccaatggtcattcaaggcccgataacaagagctcgtgcgcgacaattaaatttagaggtgagttcattcctatgttcttctttgtatgaattcaagaatagcttgctacctaatgattatattgtgcttaggaacaatggaggggacaaggagacacttggagaaatacttagagccatggaggaccatcggggacgtccaagtcaaggtggaggcccaaaccaactcgacgtcgggtgcaattcggagtccaggaccagtctacactaaaatgggcgcccaggtcacatacgtgctcggattagggcgttctttatatggatggaaagctaagaagaaaacctttccaatggttttggttccacatccaaattctttccgagtcaacgggaattgtccgaacaatttgacgtccagaatctgtcctggtgctgcgtcaccgtatttgggcctttggcccgtgtatcgtgttggaacccattagggttgcgtcgagaggggtttacacgacctaaactctatatatcagtacccaccaacatctttaggtttttgggttttgcttagattaatctgtcgagaacagtttcgccgctagatcggtttgtaagaccccaactcgtgagcttaatcattcatatgcaattttggttgtttttctatcccgttcttgtttgtgttcttcgattggcaaacagggattagccttctcggcgaggtcatccacgtttcgacacgggtgataaccagaggagacgtggtgctgcgattgcggggctcaagagcgtgcgcgttcaagaagccgg

SEQ ID NO: 16407 - DNA, 1501 bp, Oryza sativa
ttacaaccacccatgagattttaatacgagctattcaaaagggttccggttattacggaataattcagattatgaggatttttttcgtaactaaaaatcaaaacgggctcggtatctggatccgcttgctgacttggtcggtggtgttcgctgatggacggtggatggaaccgggagtacctactcctgggagtatagaatcattatatatatatatatatggtgagactattctataccccccgtcgcccttaagagcccaacccactaccccctccttttattgggctcaaaacccacctgctaccccagtcaaagcatggtcaaaggacggtcaaatcgctgccatgtcggtcaaacccgtgtgctaacttcctcccacatccacctatttgttgtccttgtctcgtacgaacggtgcagtaacatgacgaccactatgcagtaacactgtaccttacttgcagtaatactaataaaatatagttaaaatatagtcatgacggatctagttttgtagagctttttttttaaagcattacggtgcaaacggttcaaaaatataatatgtggtgtgagagatattattgtttaaagatgtgaattcaaaagatatcacttgcatttacattttactagttcaaagtgggtgataggtcctgtacctgtgtttggttgttaccacctcttattgcagtaatgctattaagaaattgcagtaacatgcagtgttactttaaaagttatagttgttactgcacacatacagtaacgccatgatggaatggtagtaacacacaataaaaagtagtaacaataatgatttagtattactacttatggagagataaatttcaaaataccaatcttcgagaagaaatagtagtaacacactcgattactgtaaaagcacataaactgttacaactctacaggacacaaagttccatagttgtaagaagctaattagaagacaaatatatatgttattacaaaactcataacaagttactatgttttagtagtaacattatcgtataagtatagtaccacgtcacgttactgcaaaacatataggatgttactgcacttttgatagtaacatcgtagtgaaattgtagtaaactagaaatcgaaaaaaaaatatatgagttaaaagtctacatgctaaccatatatttgttactgcacaaaagtgtaagtgttactgcatggcagatacacgttaccacaagtgtatgcagtaacactattcaagaattgcagtaagatgctttgttactgcaaaacttataaaatttaccacactttcataacaatgttatgatgggattgtagtaatgtacaatagatagtaacaacacttgtggagagttaaattttaaaagaccaatctttgaaggttctctctacccttgctgtcgcgaccgagaaaattgccttttcccgaacgctagtgtattaatccccgtcccaggaaaagccggggtacaccacacaa

SEQ ID NO: 16408 - DNA, 783 bp, Oryza sativa
tgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacagcaagggtagagagaaccttcaaagattggtcttttaaaatttaactctccacaagtgttgttactatctattgtacattactacaatcccatcataacattgttatgaaagtgtggtaaattttataagttttgcagtaacaaagcatcttactgcaattcttgaatagtgttactgcatacacttgtggtaacgtgtatctgccatgcagtaacacttacacttttgtgcagtaacaaatatatggttagcatgtagacttttaactcatatatttttttttcgatttctagtttactacaatttcactacgatgttactatcaaaagtgcagtaacatcctatatgttttgcagtaacgtgacgtggtactatacttatacgataatgttactactaaaacatagtaacttgttatgagttttgtaataacatatatatttgtcttctaattagcttcttacaactatggaactttgtgtcctgtagagttgtaacagtttatgtgcttttacagtaatcgagtgtgttactactatttcttctcgaagattggtattttgaaatttatctctccataagtagtaatactaaatcattattgttactactttttattgtgtgttactaccattccatca

SEQ ID NO: 16409 - DNA, 342 bp, Oryza sativa
ctccactccgcggacactagcgctgcagcagcgtccactacggcgccctgcagcagcgcgacgagcagcggcatccgtgtgtcgtcggcgagcagcggtcctccatgcccatacttctccgtcggcaggccaccaccacacgttgtcaggctgtcgtcatcgccggcgccgcggcggcgttgatgacggcgccctgcagcagcgcgtagttggcgagtagcggcagccacgtgtcgtcggcgagcagcggtcctgcatgcacattcttctccaccgcacaacacgtagtcaggaggccatcgtcgccggcgctgccgcatagtcgatgacggcgccctgcag

SEQ ID NO: 16410 - DNA, 379 bp, Oryza sativa
atgaatttttgtcaatgtgatctgtgaatctttgatctgtgatctgtgaatttttgtaaaggtgatatgtgaatctagaactgtgaattcaactaaggcatgttcaaatttgaatttgtcaattaagttgtgtaagttgtgttatttgaatttgttaaccaaggcatgttcaaatttatatttgtcaactaagttgtgtaatttaaatttgttaactaaggcatgttcaaatttgaatttgtcaagtaagttgtgaaatttgaatttgttaactaaggcatgtttaaatttaaattttgcatgttcaatccattgatccattgaatttgtcaatccactgaattactggtccactgatccactggtcctaagccgtgcc

SEQ ID NO: 16411 - DNA, 773 bp, Oryza sativa
ccacaaatttgccgatgaaatgatgtattgggtgtactccctccgtcccaaaatataaacatttttagcatagtgacaaatcaaacatttttaactttgactattaataaaaaaataaaaatgatcaattatgtaaaattgatgttgctagatttattattaaaatactatcataatatgcaacttttttatttaaaacatgttacttttatagatattgttagtcaaaatagtatctcggagacctgatcagagtttaaaaatacttatattttgagacgagggagtaacttcttccaacaagaaaactgaaattaattatggtcgactccgactcgttaaccacatgttttgcacaatgtcacaagccattttggtggaccggatcgacctgactgaatccctaacacccaagcgccaagccaggcagctgagtcaaacatacgcggtcctcactataaccacgtcatcttgttataaaaccatatcaatttgcagagtatttaaattttcaggacccttctctgtgaccaagccacgcagcctcagtttattatgacaaactcccaaggactcgttcccgcccgtaatgtcaacttggattaatatatagtaactgggtgttacgtacgttacgttgcacctatcgcttctctgcaacttgacacaatacaacacctcaccagacacttgttctttacctacgccctcgcgccttccgggaaccgctactagttataaactgacgatttattatacgtgtccacacgtga

SEQ ID NO: 16412 - DNA, 1501 bp, Oryza sativa
aaaagaggggtggaggccggcacggcacatggtacgagattcaccgccgccgccaactccaccccacaaaaccctaatccgatcgagagggggcgcagccagtgacgggaaacgccaccgccgcgccacgcctcatcgccgggacgtctacgaccaccactgccgcagccgtcatcaccgtcgacctcaccggcgccgtatccacgtcaagccgcgacgacaacgacgatgtccggcgcctcttactacacgaacttctcaaccggtcggtatctaaaccctctccctttcatctacaatgtcgttcatcaaacccaaatagaaccacccgactagatctaacctaggtgatcctagagcaaagtctaacaatggtatcagagcaaccctagtgttagatcgtttcggggaaagaaatccaaagaaagaaaagcacaagatccgcacggatcaaaagaaccaaaaaccctaaccctaattcttacctcgtcgccggccgtcgtcgacgccggcaacggagggggggaggggcaaagaggcgccgcctaggagccactcgacggccgcgcgcgcacctgcacgcgcgtgccggcgagggggcccgcggcggcgccgccatctccgtcgtcgccatctctctctcacacggtgggggttagagacggtggggggagcggataaaagaaaagaaaggagcgccggccatggcgcggcggcgcgagggccgccggcgtcggcgacgccgctcggcgcgaccgcgcccgcccgagagagagaaagagaggagaagctagggtttcggcggccggccggggcacgaggggttttgatccccgttttcggcgcccggccgtccgatcgcaaaccctaagatcggacgtccggcggcggccggaccgaaatcggcccaagtggggagcgcgcggcggcggctttcccggcccaggcccaggttgcggcctgggggaggggagggggcgctcgcccgcgcgcaaggtggccatgggccgaccggcaaaggccggaacaaagtccatataaggtccctccggggccgaaaatgaataaaagagaacagtagcaatttttccattttattttgtcaattttcatgcaaatttcaatagaattttgaatagatttttgcatgttttacctctgtttaaatttgaaccaacgggagaattttcacagagagagaattacagagatttagctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctact

SEQ ID NO: 16413 - DNA, 1501 bp, Oryza sativa
ttttcagccattattactttggagattataaaaatagatgataaatatattaagaatagataaactactgaataataaaaatagttacattagggatttgataaagggatagtattttagtttttttatttatatatactacatccgtcccaaaatataacaacctatgattgaatgggatatatcctagtccaataaatctggacaacactttgtattcaacgtgcaatcctaaatagtcatattttgtgacggagggagtactagtagataagtaaaataataaatttattttgtgaaagatggagtatagttcttacacccaaaaatgaatttcgtttgtttgacaaacggaccaacgatcagaccacgctgtgactgtgagccggacaacactttgtattcaacgtgcaattgtgactgagggagtactagtagatagataagtaaaataataaatttatggctgaatagctaatttaatccctcaagttttaccgaaggctcaatttggtccttcacattttattttgtccacatagctcctctaaatatttgttttggcttgaaatcaccttaggcccacttaatatgccatatggctatttctagttaatatttctattagaaaatgtcccttttacacttaatttgtatatacaactatatactagaaaatagaaaaccaaagatgaataaacaacattgcagatgtgtttcccattatttcaacatgtgcacataaaacttaagcaattgctactgtatatactttctagtacataatttattttcgttttacataatttactatggtgacctataagaaaatcaagcatgcaatttttctcttatatatgtgaatgataggggtataagtgtcatttatcaaaagagttgttggttcaatgctacatttgaactaaaatgaaaacttaaaggactaatacggatagattgaaacatcaaggactaaactgagtcccagatgaaatttgaaggagcaccttttgtgaaagatggagtataagctcctacgccaaaaaaaagaatttcggttgggcgacaaacggaccaacgatcagaccacgatgtgactgtgagcctggacaacgcagcagcaagccccgtaccgcgcgtacgccggggcaacgtggcacacgctcctaccctagcgatcggagacgagccgaccgcgttgtggcgcgcgcccccattgccattgcaattgctcgtctcgtctgtcgtctcatggctctgctcgagtgctcgactcgcccacacgacactgccaccgcgcgccattaactcccgcacccgcattcatgcccgcgccgcgttccaaccaccgcaccgccttaaatgcccctccatcccccattcccatccctcctcacctccacctccacctagctctagagccttccctctcctcctcctccacatccaccggagagagtgtgtttattggttcttggaggagagatgtccaagatggcgg

SEQ ID NO: 16414 - DNA, 1501 bp, Oryza sativa
ttttggcttcaatccaaacacaactttgcctagccaaaatttggcatcgacaaaaattggtaaggccaatttaggtcacaaaccaaaccaggtgtcaaaatctacgcgaattttcgcactactaatgctgttccctctataaggcgcggttaaagttaaaatggtctacaaaactaatctttagttcataatatcttatatattataaggtttgtagcaacaaaattatagccatatacaagtaaatttaaatatcaatccaatgatataatttttaataaataaaattcattccatattatactatgtatgggtcaaatgttttacacgttgaatcttgaaatacgggcgcgtcttatattataggagggaggaaataattctttggtaggtagagtaatctgatattctagagccgacgggttttcatgcaaatttacgcagcacggcgcactatacattagatgacgggtgtagtcctaggccctccactccccttcgtggcttcgtagtagtagcacaactcgagttggggtgcccctaatgagtgatttgcacgggagcgtgggcgcgtgaccagtccactcctcctgcaactactgctctaccactactcctactcctactactgctactaccactgttgcgcgccgctactactgtagtagtagcaacagcaatactactacgacaatactactacgtttcagggttatggataccacatatctaatagtagttgactaaatctcggcaggacctaccacataccatgtcctatacggaaacaacctacggatgtaggaggagttccggataaggaaatacaaccagatttctatatggaaacgacaaggactactcggattgtatccatattggtttccctagttctacttggacaaggggacacttatgggtataaatacaaggccccctaggaggagaggggagacagacaatcaacacacacccaccatagaagagacaatcaacatacacggaacaacagaggccacaacatacaagtcaacatacgccaagacaagccgccagatatcgacatcagggataagcacggctagtcccttacggtgtctccggatactgtcaggagagacatagcgttgtctctgatctcgccgggcacgaactcgaggaggaaggctaccctattgtcgactacgagtcagaccttcagaccgccatgtcgacaacagttagataggctaccccaaatattgtactggtatgattatgatgaataagagcaacgactggctttggccaacaggatgtagggttattacctgacaattcaggggtccgaacctgtataaaaatcctgtctccgtctcttttacctcagtctcgcatatatcctagtaccaacgatccccatactatgcaaataccagaatcgcgacatcaaacgtcaacaatggcgcgctaggtagggggatttggtgcttcagggtttcgacgagatgggtttaagaga

SEQ ID NO: 16415 - DNA, 1501 bp, Oryza sativa
ctgccgagatttagtcaactactattaggtatgtggtatccataaccctgacagtagtccccgacttcaatgcaaatgaacgagttcatattctcaaccgcaaaccttagaggaactgttatcgagctcacgtgaccgttctcggtgagttcagagataacgttaaacttcctttatcagcctcgtgtgggcacctaaagggtttgtctgagtcaatcatcaaagtcaaccaagaaagtacagagcatatgactaagttacccgtcttgctgtaatcgagaatttggattgaagtcaagaaattttatctcgacaggtacaccatctcttcattccgtattccttgtcgagatccaccaaccgttcttgagtaatcgagtaggcgtagagtctgcgacggagccttgtcaacatttgtcgtactcgcctttgtcgatcttggtgtagaaccatagagacatggagtcttcaacgatgtcgaatagagttttcctgaaatcaatacttagaaaagaatattagatagaaatagcccccgagtgaacgctcaaagggtgacatgttataatatgtatggaaaactaaaaatgaattaaatttacataccaatgttttgtatatgagcgtctactcttttaccaacttcgatcagtcaatttgtttgagttatacactctccctagcccccagccttgtcgtcggagaatcgttctcgggaaataaggctcttagacctttgacctgcatcggttgaataagcacttatcctagcccccagccgtgaagttggaaaacccaatttccgattacacggcttggttaatacgcacggtgagaactcttacacgaccagatcttacatggtcttttgtctctacaggatccgacaaggccttatccgctctgggcgtccctagccgaagttcccttaggttcctcggaggccttgtcaagacggtgtaaaaggacattaggataggtttcaatgctaggtgtttttgtggtaagggatctctgggtaaaacgcttggcgatattgtgtacctgaggtcaacttttgttgaagtagaggtaatgggagaatcgctacacctctagtcaagaaccaggtagtagtcgtaactcaacgactagaagtaaatgtacgagagatcactacgattgaatggttaagaaccagtgagtaggtgtctctcgatcatttgaagtcgtggtgcgaggaccgctgcgttattgctgtagtcgtacctcgaccatctgaggttgcggtgcgagggattgctacgtactggtttgaggaccagcgaacgtgtagaatcatctctcgaacaccaatggaggttgcggtgcgagagattgctacgtactggtttggggaccagcgaacaagtagaattatttctcgaacaccaatggaagttgcggtgcgagagattgctacgtactggttcgaggaccagtgaacgtgtagaattatctttcgaacaccaatggaggtgct

SEQ ID NO: 16416 - DNA, 1501 bp, Oryza sativa
taaagatctaggggcatatatattccccatgcgcgcccttgtcttctccaccaacacttaaaagtttttttccccgatctcggcttctccttcgccgccactgcctagggcatccccgcgccgacgccgccgtcgtatctcgccatcgtctcgcgggcgtcgtcgtcgccgccttcgccgccgccgcatctctagggtgagccgccgccgcctccctctctctcttgacctcgatctctctctctctctccaaaccgccgccgcctcgttgccgacgccgcagccgacgtcgacgcggccgaccccgactccgcctcccgtcgatgccggccccgacctcgatgcagccgccaccgccgacgatgtcacgctggccctgccgacgacgccgacgccactgccacgccgccgtgccacgcccccaggccacgccacgccgccgcaacgcgacgccaccgctgcgacacgccgccgccgcgccgccgccgtgccacgccaatgccgcgccgccacgccgccgctccgctgctgccactgccgccccgtcagtgaacgaaacgtgaacgaacgtacgtgaacgaaacgtgaacttaacgagaacgcgaacgtgaacgaaacgtgaacttaacgtgaacgcgaacattaacgaacgtgaacgaaacgcgaacttgaacaaaatttaatgaaatgcgaacgaacgtgaatgaaacgtgaatgaaacgtgaaagaacgtgaatgaaacatgaacgaaacgttaatgaacgtgaacgaaacgtgaacaaacgtgaatgaaacgcgaacgaacgtgaacgaaacgtgaatgaaacgtgaactaacatgaatgaaatatgaacggtcgcctttacgacactacgtgaaatacaatatatgttactttgcgtttagactaatacatttttttgtatgttgcagaaaagacgtcgtcgtcgtcgtccctcaagccggagtggtagctagccctcgaaggaattcgcgcaggcaagtgatgtaaagatatgattgttagatttttaatataatttaagattattagattattagacttactaaatgtgagtgttagagattattattagagttttagacttagcataggtgagttagcatatatgattatttgagttctaatatacgacacttagacttagcatatatgattgttagaatttataagattattagatttttaatataggactaataatataagactattagatttttaatataagattattagagttttaatacaaggttattagagttttaatataagattattagatttgtaattagacttagcatatatgattatctagggttctaatatacgacacttagatttagcatatatgattgttagagttttaatagaagattagtacaattttaatgattatctagggttctaatatacgacacttagacttagcatatatgattgttaaagaaaatgtgacctatagacttagcaaatatt

SEQ ID NO: 16417 - DNA, 1501 bp, Oryza sativa; identical to SEQ ID NO: 15275

SEQ ID NO: 16418 - DNA, 1501 bp, Oryza sativa
tacgccttgatcgtctcgccgtcggggtagctgacgcgcgacaggggcatgaagttggcgccgagtggtgttgtcgcgaggaactgcatctgggtggagatggcgatcatgcccacgccgccggcgtcggcgaccatcttctcgagcatggctgcactttcgacgcgattgcagagcacgatcttgtcccggacgtcgaccgccttcagcgcgccgtcggcgaacctgccgccgacgtagacgatcggcttgttctggacgcgtttgtacctcctggaagcctcgccgtagatcaccagcccgttgccgagctggaccttggagattacgcgccgtcccatggtgctcgcgccgacggtgagctgccacggcgcgcagttggtgactgtctcggcggtcgggccggcgttcccggcgctggtgctgaagaagacgcccgccatgacggcggagaagctcccgacggcgatgaggtcgtcgtagaagggcttctgcttgttgtcggaggcggagatggagagcacgtcgacgccgtctaggaaggcgcccctctccgtggcggtgagcatctccgtggcggagcacatgtcggcgaggcacacctcgtacatcgccaggtgcgcgcggggcgccatgccggaggccatcccgaggttggacccctccaccatgacgtccctgacgaaggcgcccacggcggtgcccgacgtgtgcgtgccgtggtcctccagcgtcttggcccgcccgccgatgagcttgttgttgcacggcgcgccgccgaagtcgcacttgccgcgccacttggccggcggcggccgcatcccctcgtccccgaacgagacgtggcgcgggtcgacgccgttgtcgaggacgccgacgatgacgccgtcgcccatgttcccggccacgctccacgccccggtccgcggggtgctcatgccgagcagccgcggcgtgtccgtggtggtgagggtgtacgtggagtccgggacggcgtcgacgcaccactgcagcctcgccatggccgccgcctcgcgcggcctgagccgggcggtgaacccgctgacgacgtgctggtaggagtagaccagtctctccccgccgatcaccggcgcgcccctgttgccgccggcgccagcgccgtagaggatcgcgtcggttgtgctgttgagcacggaggcgagcagcgaggcgtgccacgcgcgcagcggctcgccgccttccttggggccattcatccggcagacgaccaccaggtacgtcctgagggtgtcgtcatcgtccgcggcggcggcggtgagatcgagggcggagaggatggtggggaggaggaggagaagaggtcggatcggggagcgcatggtggcggtgaagggggagaagtggtacgcggtggtgtgtagacagtgtagtgttagttttaatggcgcgcttaagaggccatgagcgtttgaagctgaccagcatggcagagggagtgagggacctgtctatatttagg

SEQ ID NO: 16419 - DNA, 1501 bp, Oryza sativa
catacatacatacatacatacatacatacatacatatatacatacatacatacatatatatgtgtgtagattcattaatatctatgtgaatgtgggcaatgctagaaaatcttataatataaaacggagagagtaattattaattttaccaaataataatatggttgaaaatgtcatcaagaacatgccctaattttaccaaacctatgcagctttcactgtgactgtctctaaatatggaaaaaatttggtggagaccgggtgtaaccgatctcatctacagccctgctccggatggatgccacgtggatgacctagggattgaacggttagctcggccctgctcccggcactgcacgacgaggacacaagcggcttggctccatgagcacccgtgtctttcaggctctccgtcggctcgattttacgcacatcgcgtctcctttgcctggtgcgcagcgacctgcgtcttcctggggtcgtcctcttcctcctcctccagcaccgcggacgtcctgagactgacatatgggagcaccatggccaatgtgttgagctccaccactgacatcacttttgatgtgctctttgtactggtgttttttttttttttggcgatcggcttctagagtcaggtgctgtcgccggctgcttgtccatggcatgagaagaaaacacgcaaattaaaagtgtcataggatttgcatcagggagaagaactggaggcagcagggtcatcgtcgaagccgtaatcgatcaagtgttgcgtttcgtccgtggcggcctccaggaattggaagacgggtaccgtcgcagccagcagccaaacgcgccgcgggatcgatcgcctggcgctgcggctcgccaggcgaggagacgtggtctgcgttgaatcgagccgtcggcgaggctgaaagcgtctgcgcctggagccaactagccaagccatctgcatcctcctcgcacagcgcctggggccgagccacgtgatccattcgattctttggtagtccacgtggcaatcatccagtgcggagctgctcagctgctgatgaggccgattacacccggtctccaccaaatttttttcccctaaatatagacaggtccctcactccctctgccatgctggtcagcttcaaacgctcatggcctcttaagcgcgccattaaaactaacactacactgtctacacaccaccgcgtaccacttctcccccttcaccgccaccatgcgctccccgatccgacctcttctcctcctcctccccaccatcctctccgccctcgatctcaccgccgccgccgcggacgatgacgacaccctcaggacgtacctggtggtcgtctgccggatgaatggccccaaggaaggcggcgagccgctgcgcgcgtggcacgcctcgctgctcgcctccgtgctcaacagcacaaccgacgcgatcctctacggcgctggcgccggcggcaacaggggcgcgccggtgatcggcggggagaga

SEQ ID NO: 16420 - DNA, 1501 bp, Oryza sativa
ggaccaccagcgaaaaccgatttttgctagcggccacgctaagaggttcgccatgaaaaatactctattttttgaggcggacctcttaagtgtccgccagcgaaaaatcacgttttcgctggtggtaggtaagaaagaccgctaaaaaaaattcgaggctaataaaatccaccgcccacccaccagtcccatctttatcccttttccaccgtctctcccgtctctcctcccttcccgtctctctccgtctctcctccctcccttctccaccgcgccagctcgtcgcctccctaccaccgccggctgccatcaccgcagctccaccgccgcatatgaccgccgctccgaccctcttctcttcctcttccagctccctatctcccaacatggagtgcgcggcgaaggcggcggcgagctcgggcgcgggcagtggcgactcgggcgcgaacgcggcggcgctcgggagtaggcggctgctcacggggagggcggatccgccaccgctaggccgcggggagggcggatccgccgccgccgtgccgtggggaggcccgatccgccgccgtcgggccaccgggaggccggatccgccgccgctggaccacggggagggcggcaccgacctcgacgccgtcgaccgtgctcccgcggctggatttgatttttttttctctttttttttgcatgttgttccagatgatgcacatgttttgatctgtgtaaatgatgtttgatctgtgctgatgatgatgagtaaatgatgtgtaaattcgtgtttgaatttggaaatgagcatctagatgtggatttgaattttgaaatttaatgaatcaaaacatggggcttcatgtgtatttttgctggcgggctctgcagctgcatgggtattttcgatttaacacaaccgccagcgccgtcttaagccaacgccagcgaaaatggatttttgctggcggctggcttaagccaacgccagcgaaaatagatttttgctggtggtcaataaccgctagcgaagatcttgattttcactggtctttgctttgtggcggctgcaaattccgccagcaaaaatccaaaatggccgccacgaaaaatggttttcgtagtagtgagaatactaaactaaagttcctggccctcaaaagcttcggtagggtgtggtttacttggcacctatctgagaaacaccttgaactcgaccagaatataaaacaacggcttgttggctgctaccctgtgaaaaaaacttacattcaatgaaggagtggtaccatgtcctatgaattggacaccaccacttttgggacaagagtaagctgattgggtcgatctgacatggtcctcccaacagtgggataattgatcgggagcatcgatgctgagtagacttggaaagttacgggccgatccaaaggagggtgaacatcgattggggtgtatctccctgatcagagcgatcataaaaccttcattggaaaaaacttcctttcgaagcaag

SEQ ID NO: 16421 - DNA, 1501 bp, Oryza sativa
caaaattttctcaaacaccgaaagaccgaaccgagagttttttgcttgaatgcatactaatatgtactcacatgcacgaacatgccacggatgctctgttgatatgccatgaatgaattgtatctccaacgggagacgtgtctgacagcagcagtgcagtacatttcacctgtctagctaactgtatatacgtcgttggtgcgtacacacatactgtacttgtacgtcctgacccagctataaccacagtactaatatgcgaccactgatattctgaattctgatacgtatcttctggtcgaccctacggcgtatttaagtagtataatgtacgtacgtcacgtggaagtaactgtaggccaatcgtatagtaacgcccagtacgtatgtactggggtacagtagttttcgagtgttccgaaacctgaatatataatgtctgaagaaactactgcaaacatgcaaccatcatcggttctggacattttatctgaatactactcatatctgtcacattttgttctctgaaattaacctgaatatctgaattctagttttctacccggggagtcagtcgcagaatggacatttcatcagatgaggctgctacaataataagcaacttaattactcttaactatactctgtaattagcgggtactacagctgcagcacaagtgaaaatgacaccactagaggagctatagttacctgctctgaaaacaacgtacgtgcatgtggtgctccataatgagagacacccttttgttttgaatgctgctgctgttaagttgttgctgaatgtaatggccctgtctgactcattcaccaaacccctgaattacgaggtcttgattgcaccactaaaacaaaagagatcgatcgccagaattgcatgcacacacttgcacagattaatggagatccttatcaaagatcacatgataatcttcacctaaaacatttaggccaggataatcaggaaaaaaagctagtactagccagaactgatcatcagggagcactaagcttcaatctgccatcatcatggatatgatcattgcgtacaaatatatttatgtggttctgatgtcaccatcctgggtccttcaaggattgacgtgtacagggtaccagtagacctgggcccacaggtcagtgacacgctggcactttgcaaatagcaccctcaactagtacagtgctacacttgttggccattataaagctcagcttccctaagcaacacaccccctcctggcttagcttcccttctcactcgcacgcgccgccgccacagagctcagcttagctcgaagctactccgtctcgaggtagctagctagctaagccttcatccatggcgtcaggagaagcagagccactgcagtacacggtgagccttgatctgaatgaaatcaatgcctccattggaggctagagcttagctctaatgctcgatctttgcgaagacgacgacgacgccattgttgttgttttg

SEQ ID NO: 16422 - DNA, 1420 bp, Oryza sativa
tttcctggaatactttttttagtgtacaaaatatgttattgtctccagtattatctactttactgatgtgtttcattgtgtgcgaccttgtaccacgcaagtgtattccttagttgcattattgacaactttatcatgatctgacaaatatcattattgtgtgtgcaccttttgcctcatcatcttggtggatgttttttttttccactggaatattgtttacctgtggtctatgtgctttgatttgtcattgtcagcatctccatgcccagttccatatgaaattgcagtcaaaagagttcacatttttttttgcatgaattaaactttgttctgtttttgccagcagcttcatgcttaggtccatgggattgtgtggcaatgtaaacatgtttttttcttctgtttactccttttgaccacaatactaatattatgatttttgagcattgtagatggtctctgcttctggagagtggagactctggttagcatcagtcacttgacccactacaaataatagaagttcctgggatgaagaaccaataactgtcagccacaaccctttgtttgcattcttattacctttgttacttagtctccgctagattatccatctcctttgattgaggttaatcatgtccttttgatccaactggtttaaaagttacaacttttcatctaggtggtgcatttgttattaatttgttaaccacaatccatggcatggtactattcaccttttcttgatacataaaacatttcattcaaaaaatggaagtggatcaggtttacacttttgtcactcacctctcctaggatcttcaactcagttctagcttttccaacctattttttctatcattaccacaaaaagattgccctttacttactggttacccaagtatagtgtcttttgcctatccctacatgcctcatgttttcttcatggctaggagtttgtagtgatatttcaagactagtgcaaatatttcatattttttcttcatgacaaaggggaccttcttaaaggtacatcgtgagaaacaggtggagttctgcgtcacacagcaaagcaaggcaatggataatggaggacagcgtcttgatataatttttaagttttcaacatattatcacatcacattacacttttcaatagaacactactagagggagttccataaattgagacactgtcgtgtccagaaagatagcaagtggatcatcttgcacaggctgcaccgtcgtattggttcagaatctttcaaataaagtcgaaatattaagaagatatgcttctcagaccatgcatcaccacactatataaggggcaaacaagctcccagtatcgttactttgagcccccgcctccccttttgaaataaggttgactgtaattctgcttttgttcgtaata

SEQ ID NO: 16423 - DNA, 1501 bp, Oryza sativa
  unsure (1)..(1501): unsure at all n locations
cctggaggaagtgtgtagcggaggcaagggactgagccacctgaggcgagcacctccacgcgagcttccaggaggattctgccctagcccacatggcaacgccctcgccggccaacagaatgccgtcgccggagcccgtccaggccacggcggcgacggcgaaggtctcggtgatagcccatctcagcacccagccaaacgatcctgcaaacccaagtccaatctccagaagctaagcaatgctagcaaaaacaacgagaggacgagaatcagaggcgagctaggacgaacggacctggggaagaggacggcgccggctggaacacggacacggagctcccggcggcggcggcgagctcgcccccgccacgtcggcaccaggagacggcggacacgggggcacggaggtcgatggcctggcggaagaacgggccatcgtcgtcgccgccgccgccgccgccgctgctgctgcttccctcgcggggaggggaggggaggtgggagacaacnaggaaggaggcggcgccgtaggcgacccaggggaggccgccgaggtcggggaggaaggagagggcgcgggggtcggcggcgggcgccggcgggatgagatgcggcgggtggagggcgagcggcaacggcggcagctcgtccggctcccccatcgcggcggccggcggcggggatcagatgcggcggttggatcctcaccgcggccgatcgtttgggcagccggcgacggcaccggtaggggacgcggttgtgtgggcctaggtatgggccttttcctggcccgttcgatgctttctcttcagattggatttacttgggccgttatccttgtccccactagaaaaacaagaaagggcccgttatagttttataccctttccagcttgtttggcaacttgaggggaggggattgggagtttatacgaggtaattgatggtgagattaagatgggaatttgatttttcatctcagtctcttatttggtagaggtggtagaaattaatagggagttaagttggagattagatcattaatgaaaacggatggctaagatttgtttaggcgaagtaaaggaggaattccctccaaattaccacacccctacccaggtattgaaaaggagagatttcattcctcaattccccatccccatcccaccaaaattcacatgtcttccaaccaaacaaaacagttaatagcctcatccctctaaactcccaattccttctaaaaactccccccaaccaaacgggccctccggccttccgagcgtttgtcaatgtaaccgatataggctatcatggatgtgccccgtgataggagaaatttcgttacgtccgctcagtttgcaatactactagccgtgcccccccgcgcgatgcgcgggcatcatccaagatctttaatcataaaagaaaaaaaaaagcatgattgaaaacaacatagcttgcaacagtgctatacaacaacaactcgatcagaaaaagaata

SEQ ID NO: 16424 - DNA, 1501 bp, Oryza sativa
ctcgtgccgcggtgaatccggaagccgatcaaccggacaacccagccgacccaactccatcacgcccaccctcgcctaggtacgttggctagaggaaagctacactacaagcccagccgttgcccacgctggcttgtggtaagcacgataaattcttccagggtttcccgcgaactggtccttaattgccatgggtgcgactagcaaaaccatgcacccacagcccaccattcagtcgcattttagttggataattacggccatgaagcatggccagatgtctcgagcacgcagctcattctgatactaaaaaggtctaatactgtaattatcccatcaactgagctagtggtaattaagcatggctaagcataaagttctagctaggtcacataagtaacatgagctagtcgatttattacccaatgttgacaaaggacagatatcaagtaaacatggcacaagcaaacaaataggtaatacccggatcccatgtaattagcaagacatgcaattttatttacaaaagataaacatttgtaaattaggatcaaaatgcttaaggggaatgtgtgacttgccttgcttcttcacaataatcttccgaactctgatcctcgtgaaagcgatcttccgaaacgacgggaactacacgctggcatgcaaaacgaggaaaaactctaatgaacaccaagcaaacagtacataaaaagtaaacaaacatgtagagctcaattttagatgaattttgcaagttgaacggctcaattcggagttcgaatgaattagatatgaattttagaagttttgagccatttaaatggatttctagaattattaacgaattattgcgcaattaaactcgatttatgatgtcaccgagagggaagggtggcgccgacaagcgggacccacccgtcggtgactcaagggcttcggcctaccgtggaccaagtccacggaggcacgggctagcgcaccacgtggcgcacacgtggcgacgacggagcaccgacatggcggccacgtgtgcggacacacgggcggcccggatggagaccgaggccgatccgacggcccagatcgatcgcggctgggaccaatgggaggcagcagccggctgtccgacacagccagcagcggcacgggcgcggagcgcggcgacggtggcctggccggacggccaccggccactgacggcgagcggcggcgcggcgagcggtggcacggtaagcggcagaagggagcggggaggagaggagggatgctcaccaaggcgacgacggcgagacggcaatggggaagccggcggcgggctcctcggggaggcaacggtgacggcggtccggcggcattccgcgagcgggaaacggcggccgacggtcgaggtacctagggaaggaaatgaaagggttaggaagggaagaggagatgcgaggtggcgtgaatcaccagccgaaagcgagaggaaaaaccggcgacctcacctcgcatggtgaat

SEQ ID NO: 16425 - DNA, 1501 bp, Oryza sativa
ccgtatatcaatagtaacattaaaataacattcacccgttgcaacacgggcatattttctagttattataaaaatttaaaatatttttgttggtaccttcataagtcattcgtgtttaagtcggttttaatttttttatttcggttttaatctctactcctccaaatccataattttaaaaaggcgaaaaactcaggcgggaaaagaaaacgcgcacaaaaaacgcgaaagaaaaacatggaaaaaaaagtccgattcgtaccggaaacaaaaaaagtggcaaaaaatgttgagtaaaaaacaaaaaggtcgacctaaaaaataaaaaaatcgccgactccaaaaaaaaaaaatagtcgtgcggagaaaccgattggtatttgtccgtctcttttatccagctttttttttccacttctcttttttcttccatccggcttttttttcaatgttctttccggttattttgccatcgtctttttccttttattcatttttttcgtccctattttttattcgtattcttttgcaagctgaagggtgtgcgcacatggttaaaattctttttttaatctactcggttttttccgtcgtcgggctgaaccctagcactatgccaccaccgccacatctatcaacctcctcacgctttttctcctccaatctattgtaaaaatcaattctccactactccatcatcattttccatataatttatcttttcagttccgctttaattcaccagattcaatatctatttaaaagtcaccgtttatatcccacagttttgtggattcactccaattttaataaaaatgaaaagaggagattgagtgaatcaaaagccctcaaccaattttgagagatcgagaaaaatttgaccggatttaatgggaggatcggttctggcatagtactacacgggactgtcttccggaggttgaagatggcagccgactgtgcaagttaggcctatagttctatttttgtgctaggttaaagagaagcaggctgtggagattatggataccccatatctacatgacagttataatttagtcggatatacggtaccaaatatatatagaatatctttatgaggactcgggttagtttttaacttgtatgtcaaggaaatacctgagatcttagtcggttacgattgtattttatttgtaattacatattccgttagggatatggactgtactttgtaaagcggactccttcccctatataaggagggtccgtgtgcctctcggggcacgattctttttcccagtttatacaattaataacacactcggcggaatcatccccggacaggagtagggtattacttcttgaataagaaggcctgaacctgtataaaattctttgtctccaaacccatccactttcctagcttgatagccacccccttttattattgccgaaatcttgtttcgacagttggcgcgccaggtaggggtagcgtcaagtttttgccgactaagtgcga

SEQ ID NO: 16426 - DNA, 1501 bp, Oryza sativa
ttatcaagatgtgaaatgaaaaggtttagatcaatctctcgctggtgtgatgtaagttcatattgttcactggattggttccaccctctgctcgtgtgtgcacaatttagcccagattttgtagatcaggataagttgccaacttacgcccatattggatcaaactgccaatatcacaatggagaatgttttcgttaacaagctaatatgggtcgccccttcttcttgcgccaaagatcttaccatttccgaagcggaaatggggctacatttcttttcaattttcattcaagagtttctatctgtttccacgcccttttttcttttttagatccgggggacaaattaaatagtttttattttgaaagaaaaacagggccatatttgggaagcttaaaattttgagaagttggtctcgatcttatgactataacttcttagaattttagatgaaaagctgagctgccataagctcaagttggtctcgatcttattatgactataacttcttagaattttagatgaaaagctgagctgccataagctcttgcaaacagaccaatattgaaccgagcaactaaacgagctttatttatattccaccatataaaatatcgctctccctaatcagctaatctctcgtgtcgtttgacacaaacctttcttttcttttttaaagaaagttcaccttaacatgtgatgataccaatcccggtccagatgtggtccatatggatgggccgggcttgaaccgcccatctaaaatgagcccttattcatgtggcccaaaacccacgtccactaatcctggcccaaaagccatctattcacgtggatctcctggtgggcctctgccatgtggggccgcgtagtcagcggccagcccacgtggcgcgacgctcgcgtttacccacatctctcggcgtcaattcgaagctaacctccaccttctcttccccaaacggctccgccgcgtaaggtaaaagctaccgttgcctccaccaggtggacacgtgtacggtggatacggtgcccacgcgcacatccgacggctacggagaagccgcttagacctcaagctaaacccccccgtggcggttggtcgcgtccaacccaagcaagccacgcgcccacgcccgtataaaacccctcgccgtcgtctcgcctcgccgccccaacccgcctcgtcgccgccaccgccgtcgccgccgccaccaccgccgtcgccgccgatcgatcgatcggaagaggtttctcgcgaaggtttctcggttcggaatggtgcggttctctctctctctctactgtgatggatgttttttgtttggtgggtttgtttcgattgattcgtctgcttgctgctggggtttggataatgggatcgttgattcgtctcgatcgcgagtgattgggggatttcggatgatccgcattgatttgttgtgaggttgttcttgtggtgattagtaatggattccttgtgatgtgatgtcgcgtgcgc

SEQ ID NO: 16427 - DNA, 1317 bp, Oryza sativa
cgcccgcgccggcgacggcgtacgcgcgcccggatcactgcgccggcgcgacgacggcgcggcacgacgagctggcgcgccgcgggatgtacggcgctcacgcgcatgccgccggcgcgaacgccaggacgagcggcgagcggcagctcgtctgtgccgaggagattagcgtggatgacatggagatcctgatgtaatcacgcagtgacaaaatagcaaaaaacaaaaattaagattggtattaattggctgatgcaataataaagttcaaaaaacactgataagcaattgagaagatgctgtgttgaccatgcttgcggccaggaacgcgccagtagccgatagctgtgacgtcaagagtgactgaaagttccataaccaaagtggggttcccatcgatgatttttgcctttccatttggtcatttgtttctatcagaattcatttctgtcatatagaacagctgctgaaacacttccactatctgcaacttacatactctccataacacgaatttgacgttgctgaaatttcaattttcaaatttattcgctgcattcatcgcagacttggcagtaattctggtattacatggcctggttgtgaatgtactgcaggtaacatctgctcacgtcaaaaccggtagactctcgagtgtagaccaactcttcagagagtatgacaacggcaacaacgcagtaattgtagttactctcgccaagaacagaacaaagtccaggcctccagggcattcagaaacgttgaatagttgcacacttgcactgaaagtctgaaatttacctgcagttctgtcagaaagtccactatcattttttttcaacccttttgagttcctgtgtcttcctttcacacagtagtttaattccatagccgttgctgtgactgtgaattaatgaattactaatcaatagggggattagacgagtagtgaggacaagtactgaaacgaacgcgggtattggcacgaaataaaaaggcgttcgtgagtgagtgcaggattgtggcgcatctgaagtatctgcttctcactgtcgcaatctgaatctccctacctttgtgcctgacgcgtttagcttaatcttgtgcaatacacgtttgactagaaaagcaaaacattttaatgatttaatctctcgggcaatagttgtactacttgccacttaagccttgcttgaacagtcacttagagagtgaagtacagtaaatatcagtaatcacacaccatgaacacaggactgagcattatgaaaactcggtcaaatgagccaaggcaattatctcaatttcggattttta

SEQ ID NO: 16428 - DNA, 1501 bp, Oryza sativa
tattcatttaaatctttttggtataactttttggcactttgtataattactaaatgtgtgttttggtggtatgtgctcttcaacagattcttcaaaattgattgcactaatgaagggagtgatttgatcatacgtggaatgcaatgagtagtcaaacctaatgctatgaattaaactttggatttaatcctaggttgaaataataatggacatggtacagccttattagagaacacatgcccacaaaatattgtgggcatgccctatgtagtagaaactttaaaaatggatggatagtttattttatatacaactcaaaatggatggatattttattttatatacaactcaagggtggtacttgacaatatagattatttgttctaattataacgtgatatactattatctctaaaatttaactgatgtctcaaagaatgctctatgacaaattgtgtattttcttctggttgtaggtgagataagactgcatagccagccatcgcaatgtccgcaacatgtgagaaactgagaattccctgttgtttacctcacaagttcagcccatgaaaatcatggtcatccttgttaggtaattgcttacttgaccatcctctccgtgcaaattttaagattgagttaaaaactataatgtggtttattataattctttgttagcaagaaaagaaagtctcatctaactgtcgccattgtttaattatgtatcgacaatttagttccctgatatttacactataccagctcttgctattacgttcactgataaaatactctacaatccacactgaaactctctttttgttttcagtgtatcagaaactccttttcatattccaaggggttcacagtaaacggtggaaaaacacaaggatcagaactcagaaccgctgctgtttgcattcggactttcaatttggagtaacagtgtaccttgcaggagcaaaattgatgcttcactgatgcagcagcctccctggagttttgatcgtggtgttgtagactaaatggtagggcgcatgagaatatggggtgtggcatgtatgaggccttgtgaaatatggctgagtgagccgatgtgttagtgccgtcttttagttggcaacattctgagtgaaaatagcctatagaacgttgctagtatatgttcttgataattgcctgatacattgttcttgtacttgtatgctactatgctagtgcatatcacttgtcaaatccatggaatttctttccagtggagactgcacaatgaagttccaatgtttttttcttaaaattcatctgatgtgcccttgtccataatttattcagctccagtatatgttgagtcccatgatcatgttagtctgattgagatggaggccaacaagcccatatgtggtaatgttatcctgctatggatccacgtcatgagtcatgaccaaccgaggatgaaacgaattaaggaataactctatcatgcctcgcttttctctttgct

SEQ ID NO: 16429 - DNA, 1501 bp, Oryza sativa
cgagatgatggagaagagattgacgagacggtttacgaggggtccaagaggctcagccccggggggcccaaccctcagcatcactgagctatgatcagttcgtcgtcgacgatgagggccagctagcagcatctgcatatcagattcgggaaacaatatcaaaagcatacgagtttatagagtgattaataggcttctttcttaatttatatctgtcggctacttgttttagtctccctgaagtgagttccatctgctcagttaattacagtaaatgttttgatctttcaaaaaaataatgataactagtatagtactatatgtattttgtgctagcttttgcttttcaataccctaaaagctggttcatagaggaaagagcgtgcagcatggggattctgtgtgtatatgcactgctgtttgtaagaccgacgcattaataaatgttccaacaattggtatcaacgtgttgaatttaagggccacatctttttttcctgtaacgtatatgctgataccaaaaattttaaattttttaaagttgattttaagtttttttataatagtttctcttttaacattgacgtttaaatcattagtttttattcataaattattttttatcactaatacgacgtttggtttattatccataattggccaaacgatggcatcctaagttagccctgatataaacacatttctttttagtgtgttacagtgactagactagatctaaactgtcaggttatggataccacatacctaatagtaattgactaaatctcggcaggacccaccacataccatgtcttatacagaaacaaccttcggatacaggagaaattccgtataaggaaggatgaataaagttctacatgaaaacgacaaggactactcggattgtatccatattggtttccctaattctacttggacaagggaacacctatgggtataaatacaagaacccctaggaggagaggggacacggaacaatagatcaagacaaaaaatcaacatacaagccaacatacgctaagacaagacgtcagatatcgacttcagatataggcatggctagtcccctacggtgcctatggctaccatcaggagagatatagcactgtctttgatctcgccggatgcggattcgaggaggaaggctaccctgttgtcgactacgagtcaatactacagatcgccaaatcgacaacagttagataggctaccccaaatattgtactggtgtgattatggtgaataagagcaataccggcttcggccaacaggagtagagttattacctgacaattcaggggcccgaacctatataaaaatcctcgtccccatctcttttactacaatattgcatatatcctagcaccaacgatccccatactatgcaaataccggaatcacaacatcaaacgtcgacagtggcgcgccaggtaagggatcttttggtgcttcaaggtttcgacgagatgggtttaagaga

SEQ ID NO: 16430 - DNA, 1501 bp, Oryza sativa
ccgacgccgccgtatctcgccgtcgtctcgagctcgtcgtcctcgccgccgcctccgcctcctccgctgccgccgcatctctggggtgagagccgccgcatctcccttcatgcatctcgatctctccgatctcgatctctctccgtcgccttcgacgccgccgccttcgacgccgcgcaacgccgccgccgcatgccaacgccacgccgccgccgccgtcgccacgccgccgccgccttcgccgccgcgtgcgcaatgccgccgccgccacgccacgccgccgccgccacgccacgccacgccaccgccgccacgccacgccgccgccgccacggccccacaacgccacgccgccgccgccgtcgccacgctgccgcgccaaccgccgccccgatgccgccacaccgccgttaacgaacgagaacgagaacgatcgaacgaacgagagcgagaacgaacacgtgaacgtacgttgccgcgacaacgtgaacgagaacgagaacgatcgaacgaacgtgaacgagctagggaacgtgaacgagcgaacgaacgaggacgaacgttaacgtgaaatgcaatatatatatatatatatatacatgtatatatatatacatgtatatatatatatacatgtatatatatatatacatgtatatatatatatacatgtatatatatatatatatatatatgttacttcgcatttatcctaatacattttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattaaacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttatataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 16431 - DNA, 1501 bp, Oryza sativa
ttaaacgtgcatgtttctagtatatgtgcatggctagttgatctctgcaataaataattgtttgcttgcaatacatgcatattagcataaagtcgagaaaatagcatttacagatcatggtaaatagggtatagcctcatgaataacagcaacaaagaatactgacacctggcattcccacaaataggttaactatttctagagagcctcagcttattttattttggtaactcgtaggagttgtccctagaacattatagtatagggtgtaaccataatgtgactacattccagtcaaacttgatgtgtgactccattcagatactaattcattcatttgtcttcatgattttttttcttactgcttagaaataagagtgatcttaaaaatcattacacactacagtgcctttcagcttcaaaagggcagaacccaaatagacttatgcatagagctcagcagcatggtcaatcctaaactggaaatatcacgtctatgccaagccaaagaagtcagcaaaactaacttcatgttatgtttcataccaggagaaaaccataacctaggtcagttcgttcgctttacttcctgatttcggaaattcattgtaagactatcacacaggatccacaaaacaagaaaaattaaccattacaagaatacatgagcatatgagaaaaagagaataaatgcaaccaaatgactgccgcgtgcctgtgtcatgtaagttaatcctttcatcaagagagaataaaacaaccgttgcaaggacctactagtaatttatcgcttcacacttcaataaaataaatatatttggcagtatgcagaattaatttatttaatcacctctattgacttgaaaagtaaaatctgcggtgctaaagagtaaacagaaagcagcaggatgtccaaaaatacacacgtcatcgattatcacaacactagaaacaagatcccgcccgagaatgcaagagtccccatacgctctaggcacgcataagagggatacggatacctccctcagcgaggagcggagcggcgacagagatctctacacacctggatgcgcctcgatcagaagccctaacaggtggacgtgccggaggcatggggaggctgctgcggcgccaattgtggccacggccatgggtgagagaaggagaggagagggtttagggcttggatgcggcggcgatggcgagacggagaagtggggaattctcgacgagacgaggaggggaagagatgagatcggacagggtaaatgggcttcatgggccgcctgagtaagtaagtagttgggccgtcgagctctctctctgctcggcgcgtcggcatcggttcgtcggcaaatggcggcgccagcctacgtgtcctctcgccggcgaatcccacatcctcgctgaccaacgtgtcatcccctcgtgcacacgtgtcaaacccgaaccgcttaagctccaatattttaagcctcccgccgcaacgctgtcccgatca

SEQ ID NO: 16432 - DNA, 1501 bp, Oryza sativa
caggagcaccaattggggggcgtcgaacgctgtttctgtaatctcacaaggaaatcacaagagcaaaggggtagagatctctctctgaatttattagcacacagctgaacaaaaggtgttcatattttcactgtccaaaagtcttctaaatgataaaacataggggatatttatactaggaacaaccctcctagatgagaatgaaaagtcttgggagtttactggacataggctaggtcaaaggtcataataagtgaattcccgagaagactcgcgcgtctgtttggcttctgagcagtcttcaatgatttgtccataactccttagtgggaagtcgaaatgacgagccgtttgttggaggtgaaactagacttgattatctttccaaccatatatattaagcatggagaaagttgactggttgggtcgcacaagccttggaagttgatccttttgcagcgtaaaccatcttcttgttagcgtagacagctactggtttggcatgggctggttcctcctcgacgtaacccttatcgtcctcaacgtaacccatccttcttgccgtagtgatgatgtcctcgggcgtaaacttgagcaatacaaatgtagagcatttatgtagtataaaatttggattaagttgagcaaagagtgagttcacctcttgttgtattttcctagcacggctgcgcgtaattggaccatgatatgcttgatcgttcttgttgagacgtaatccatcaacataatttacgtcattttcattttcctcatgtgacttatgacgtaaaccatcatccttgtttatgtcaagtgtagctgggatgtgctcatcatcatgtgatgggggttagggcacatcaggaggtgagagagagaaggtgagagaaatatgagtggataaggatgaaaaactttgaaatattaagagggaatgaggagttaactcaaagtttaggcggagcatcaagaggtctgcctacgaaaatatatttttgtttgcagccccttaagaggtccgcctgcaaaaaatatgcttatttttacgtgcggagccttaagaggctcgtctgtgaacatcgatttttgtgtgtggtccccttaaggagtcgtatgcgaaaatggaggacgatttttgcagatgcggctagttaaaattacgtttgcaacctaaagagggtctcatccaaaaattcatttatgtagtagtatgtcacgtccagaaatttagcccaaatttccagactattttgtgtattaaatccctgtctaggaatcatccagggtacacaaaacgacaagtaataaacagttccaaatgtaaataaagcgtaaaatacttatagaagaggtacttagtcctcacaccgaaacgaaagcagcagcagcggaaaaaggcaatcctagcggggcttcatctccactccataggcaaaactcaactggggtctgagccttggtcctctaacttcgtcttcagctcagaagtactacacttctg

SEQ ID NO: 16433 - DNA, 1055 bp, Oryza sativa
ggtcatttttctatataacttttttcccaatagcttgaaattgattttgaatatatgacaaatctaaacagcatttgtaaatactaaatgatttcaaataggaatatggacaacaaaaaagttgatcctctcatcaagatctacaacttttcttttggtcacttcttcatccgataaagtgatagttatattattcacaaaaatcacatttctctcatctggtttataaacatcaacacatatatgtcaattttataaacattggtactatcactttatcggatgaagaagtgaccaaaataaaagttgtagatcttgataagttatacaactttgttgtttatggctttcccatttgaaatcagttagtatttacaaatgctgtttagatttgtcatattgtcaaaatcaatttcaagctgttgggaacaaagttatatagacaaatgaccaaaataaaagttgtagatcttgatgagaggatcaactttgttgttgaccatattcccatttgaaatcatttagtatttacaaatgctgtttagatttatcatatattcaaaatcaatttcaagctgttgggaaaaaagttatatagaaaaatgaccaaaataaaagttgtagattttgataacctctacaattttgttgttcaccatatttcgatttgaaattatttagtatctaaaaatgtattatgactaataaaatgaattattatacaacagctatatattttgtacgcacaaatataaagatttgtttggaaaaatggaaaaatagtcatcggtgacgggccttagttaaagcccgatagagatttatctatctctatcgggcattatcttagggcccgtcacagatgactcatctgtgacgggcctgaatgtcatctcaatcgggcattagtatggagcccgtcaccgatgagtcatctgtgacgggccctacggcaaagcccgatagagatgactcatcactctactataactagggtttctcagatcggatcgaaaatttttctaagtcccgctacagtttcccgcctccttaga

SEQ ID NO: 16434 - DNA, 1501 bp, Oryza sativa
tcagcatttttatatagcaataggataattttatatccttaagagttatttggaggtaacatattttatagtgtaaaatttgatacctctgagtattaattatctcaaggtattaaaaattttaatgtaaaatttagataccttaatttactttttttaagtactataaaattcctcgtaaaaaattaccttatcttagaagaaacgagatagagtcattaattaaaaaaaattgagtgaaaaccataactaaaacaacaaccaactaagctaataactaccaacatggaagcaagacacaaccaagctgaaggaacaagaaaactccccacaccccggccacaacccaacatcatcaccatcacacgtctccgactacgttgggaagcataaaacaacgacagcaatttaaacccgtgccaaaacacaacttgattgggctcatgttagcaatgtataccagaaacatatttttttttgggcatacatcttgtttaaaacaacgagtatcattgcttttttttaaaaaaaggtgatagaatatgcatgaggatagtattcatgtgccaaaagctatatttgtagaagtaagatccaaattagaccccttatatgtcaacacaaacagcttgttagttgcattcatgcggatactagaaagaaagatcacgttcacatgtctcaaattgaaggaccttgttagttgcatttgcacatagatacaaattacttcatataaatctaccatccaatcctaggttagtactcgttattaagattagcaaccaaatatatatcttctcattattaagagcatacccaacaaatacctaaaatccatctctaaaatattgtctttggaaattcctggtttgattttaaggtgtaaattattatttttatctccaacagacatcttaaagttaactcccaataataaaaagtgaacccaccatagtaacagataaaaaacagaaatcattcattccatccccacacatctataagagaaaatttggagcaacttgttaaaacaaaatataatttagaattaggtttcacttcggggtgctgttagctatactttatcacccacctaagttaatcctggccttgaaggggatctgaaaaaaaatagtgtgaaattattcgcctcagttccccctctcttggggattaaacaaacaagaccttatatggaccgtgcttccaactaccccaaacttctaattttctatcatattacatcacatccaaaacttttctacacacacttccagctttttttccaagcttataattttccccaaacttctaattttttttaggaactaaacacagcaatggtctagccctgtgctttatccagtcaatttcccttagtgtatctaaaaaagattgtaaaatgtactactttcactggccaggtttatctaatccataatctaaaaggaaccgtactatcgcatctccaagactccatgtaaccactacacacgtc

SEQ ID NO: 16435 - DNA, 1501 bp, Oryza sativa
catcgtatttcaccactaacccctggttgaatcttcaacctcggggaggggtctccactccccgttgtccgaagaatcgccccctcgatagtggcatattatagagggagataaagtccatagcaaatcgttgaattaggccccgttttaaactccaaatctaaacttcaatttcttcgttttccgttagcacgcttcccaaactgctaaacggtgtattttttcaaaaaaattttgtataaaagtttctttaaaaattcaaacgaacccatttttcaagtttataataattaattgatcatgtgttaattgcttgctccgatttccatggcactgaaaagctcaatttttatgctgcatccaataaagcattagagtaaactcaatggcatataatatattctcttataaaggagcaaaaccaaaatgcatatagtgcctatctatgttttccttttgtccaacacgtgttactagtaagtgtcacgtcctgattttccttcggagattaaaaatcattaaataatgtaattctaaaatttatattaaattttaaatgagttaaacaagtgaattaacgtgggtaataaaatttcctttaaaaatcatggctggaaatatttttctaatattctccatgccctaaagcattttctgaaattttccgtgaacttttagagctcaaaaaataattttagtaaaacaaatttcattcaatcaattaaataaaataaaaaactaattaaaatccccatccttgctcttgctctgctctgtttttggcccatcctcacccacaatcctgttattactcccctaagctggcgccagctcaagcaccccgaaaaaagaaaaagaaaactcaaatcctgcgctatgaacttggacgagtatagccaggatttgatttttttttcacggagtgagtattgcttatatacttctacctaatttatataatctgctagtactatacttactctaagagcaggtacaatagtaggctataagtcagatgtaaatatattttaagaagataaataaggagagagaagagtatgggcctacagatttatagccagctgtagcacgaactctaagacgtagtgtgtgtatgacaggtgggaccagttattaatagtgtagtatgtaactattgtatgaacgagctattaaattgtctatagatgaattggagctagtagtgggctacactattaaacttgctctaatcctattctgacgtggccacccgctccgacgtgtacagccgccacgtcattcggggacgtcaaggctccactttgtccgccacgtcaggcgtcgccgccgtgtcggctccgccggactctcaaaatcccaagtctcaactcgatcagcctctctcgatactcgattcgatagtgacaagaggaaaagcgcggctctctccgtctccggcggcggtgacgcgaggaggaggaggaggaggagcccgcgccgccgggccaagccatcatgg

SEQ ID NO: 16436 - DNA, 1501 bp, Oryza sativa
agctgttcgtcaacctgcttcttgacctctgctagctcattagctgccattctgtacggcctcttgtaaattggagcagtcccgggtgccaaatcgatccggaactcgatttctctcttcggtggcattgtagtgaggtcttctgggaacacctcaggatactcttgtactataggaatatcctccaacttcctgggacttttctccactgtttctgtctgaccctcaatagcagcctgattcagactcgctacggacttctgcgacgctggggaacggaaggtgatcttctcccctttgtcgttggttagggtgatggtgcggcttgcgcagtcaatcactcccttgtttctggtcaaccaatccattccaagaatgacatccaggtctttagattcgagaaggatgaggttggatagaaacggtgatcttttgatctctatagtcaccgaggggcagtagtgtgctgtcctcatatcatttccaggggtatgaacctgcatcggtattttaagttccactaccgataatccatgtgtcccagcaaatcttttggaaatgaaagaatgcgaggcacctgaatcaaagagaactgttgctggatatgagttcactggaaacgtgcccaacacgacctctggtgctgcctgtgcttcctctgcagacacatgattggcgcgggcctggatgaacctgggtccagtgcgattcagcttcggacacttgccagcaaagtggccgtgcttgccacagttgaagcagggtcctggctttcctacagcccccttcttgggttgttctaactgaactgacacagctggcggatctgactgagctggtgccattagtgggggtggagtcgagttgtggttgtgctgcttactgttgttgtgactgccaccattgtaatcgttgttgaagttactcgggcgatagggacggtgctgacagacgatcagggtggaaggcccacctagctgtcccgtcatgaaacgaggcttctgattgttcccctgaggaaagctgatctgagctgtctttctttttcggtctattttgttgcgttgctcttcctggcggatagccttgtccacaagcttctcaaagtcctcatagactccggagattagttggttggtcaattcatcatcgagcccaaacaaaaacttctcctgcttctcagcatcggtgcgcacgtcctcgggagcgtagcgcgcgaggcggttgaactcgtgcaggtactctgtaaccgttctggttccttgttgcaatgcacggaactctctcttctgttgtgccataatcccttcgggaatctgtgccttcctgaagctttgacaaaactctgcccaagtaacctccgttgcatctggacgggtcaccacgtagtgatcccaccaagcagaagcaggaccttgcaactgatgtgtagcaaaagcaaccttctctcggtcgttacattgcagaaggatcagcttcttctcaatagcacgaagccagt

SEQ ID NO: 16437 - DNA, 1501 bp, Oryza sativa
attggtttccatttgttagggtcttagcttagggaacatattaatgggatgtgagtgtgttgctgcagctaatgaatggtaatgcacaagaacatattccgtgtaataaaaaaactaaaagcgaagtgagcgtagtttaatttgttaggtcagctcgcttggtttaaattctgaattagatacacgtgctcgcatttacgactaattcagctcaatggcggagccaagaatttttttaagcccggacaagtctaatgaatggtaatgcacaagaatctttcacatatgtaagattgtgcaaataatatttttcactaaagtatcatcatggttccttgtatcaactaaacgccgtgacattaagtttgagctagagctagatatagataaacacagaggatcctaatccagtacaaatctgattgattaatcaaatatagatcacaataaagtaatgactaatagaaaaacaattcttattagcacttcagtgctcctgctgatcggccaaacgctgtgcttgctactgctcttgctgccaaaaaaaagtgcagattttcatgcagcttcgccagcaaaacagagcaaccgatgtactgatgcagaccgaggagcccgagcagctgcccagcctggccgggccctaaatccgcccctgattcagctgatgtccgtgctgaattcgtaaattttaagatgtaccgaacccgtaattttagatgagctcatagaaataagatatgtgtatgtttttaccggggttagtgcgtgcattgtgagcgccacatttgtcccgtgtttttataaaaaaaaaatacgcaatagcttcacgccaaggttctctggttgtgatcgatcggagcatcagacagccaggtcggcgcgccagctgccgccgcgagagcagcccgcgcgcgacacgagaggccgcgcgcgccgccacaagtcgctcgccaaagctgcgcgtgcagcacagcagccagccaagccaagccagccagcacgcaacgcaacgcaacggcgcgcgcgcgggcgcgcggcgatcccacccagtcacccacagctcacgccgccgcgggcccaccccccggcccgcacaccattttgccgttccgcccctggaacccgcgcgatttagcgcgcgcccctcgcatttcttttcccacccaacccacccacacggccacaccactccaccaccagaagcgcaagcgactcctctctctctcacctccgctcgcctccgcgcctccgagcaccaaaccctagatctcgcggcggcggcggcgaccggggatggcgaagccctggggaggcgtcggcgcgtgggcgctggacgcggagcgcgccgaggaggaggagcgggagcaggcggcggcgttcccggcgcccgagccgcccgcggccgccggtggcgccgccagcttcccgagcctccgcgaggccgccgcggcggcgggcgggggcaagcagaagaagaagaacaagggcaccaccctgt

SEQ ID NO: 16438 - DNA, 1501 bp, Oryza sativa
gagtgtaaactaacgaaaagagcaaaatttttaatcaacctttaataatttatagggtaaaatgatctttttatagcacttaacagatggatgcaaccgaaaacttaacaacgatggtaactctagaacaaaagcacttgtacgatgacatttctaaagagattagatttatcgatgatattttttgaattggggagagtctacacatctgtcgacagatttttcatcataaatttgtcaaaatttgtacctttggattaaacccataaacgatagatggatgacacgtgtacagcactgctgaggtcccgcatctactaatcgatagtatggatgggcttccgacgttaattcacactctcgtttcttaatcaaaattagttggttatttatccatattaattattaatccttgagagctcatctgctcatgtatagtgtgatatctactagatattttttagtgcatacaaagatattaccaatccatctactaaagttacattgttgttacactataattacaccatagttacaaatgtaattatggtatagttacactgtaattttaattacattgttgttacactataattacaccatagttacatatgtaattatggtataattgcactgtaattttaattacattgttgttacattataattacaccatagttacatatgtaattatagtataattgcactgtaattttaattatattattgttacactataattgcaccatatttacatacatgtaactatagtataattacattgtaattttagttttctaacactgtaacttcaatataaactttattttgtcttgaaccaacttggcttaattgctctgtggtgtacgtttaacagggaaaactagtgctcttggaatcgatcccccgctacgcacagacttgtctcttttatccatcgtattagttagcacaaatctccacgcaaatcatatggcccaaaaatcgacaaatctttaaacgaaaatctgtcgacagatggatagcgaattcgtttgaattgggatatttatcgatgacattttatgaattttctctttttactatggcagttcgcctgttggcaatgcaattttgcccaagtagcccataaaacctccggaccaacacaagcacaagcaacaacagaagaaaaagcccaaaaacaggtaaggcccaaaccgcgagacaggaagccgcaccaaaaacccacacggccccccacgagagatccatcatccaccgtaatcctcctcgacgtcctcacacgcctcacctcacctcacctcaccgccgtctccttcctcgtctcgtctcgtggcgtcgcccaaaaatcccgagtccaaagccacgcacgcagctcaaaaccccaccgccaccacaccctctgatccgacggcccagatcgctccccccctaattcccgccttgccccctcctccccatgtcgccgccggtggccggcgccgcctcctccggcgac

SEQ ID NO: 16439 - DNA, 1501 bp, Oryza sativa
cactccatgtcaacatcattggtgaatggatcatgggggcatgacgtgatgttgcgacacctacttgtgggacttgctgtcacatatcttccggtagtccgggcttgttgtttactgttctggctttctgctttgtcgtcgtgcgttgcaaccttcaactttttctttgatcactagtagcagcgatcgcttctatctttcttcttccatagtttttggttgatggtgagttttgatatgggaaacaaggaaaatgtctgaatatggataatgatgtctgtttagtgatgggccaataaattctttgatatagggaaacgagtaaaatgtctgaaatggataacgatgcccgtacagcgatggaccaataggcttgttgactatgtgaatcatggggccatcagcaatatggaatctgcactttatctgtatgcgccactaggcactggtcgtaagctgatcatgcaggctggtccacggggccatcacaaagtagtaatgcttgcgggatgctgaagaagtgcagtgtacgtaagttgaacgcttaatttttgtgtagcaaaccccaaataggctttcctttgaaactcactgggcacgatcttctattctttgccgggatggccgtagaaaaggccatccaaatgttattaagattctgagcataatctttgattctcatctcatccaaaatatcgttacgcattagacaaattctgcttcatagtttataagctaaaaagacagacagacagtcattttcagttttttgaacagatatactttctgaaaacggttgaacactggtgtaatacttcacctgatgttggcaggggttactgagaagaattattagtctcttaagactctacctcgtcaaatttaacttcaaaatagatcgtgccttcctaattttaactgtgttacatgaagggatgatttacagtaatgcagttgatacccctacgtgttcgtctaattagatcaaacaattctccaatcatgtctatgtggtgtataaataagggactttatttcctgttaacaactagatctaagatgggggacataagttgatagaacaataatgaatatatctgcactgtaatgtactaagattcatgtcaccgctgctttgtttatctgtatcttcagataggtcaacaactgcttttttattaactattatgtattgcttctattcgttcaaaaaaaattatgtattgcttctttagccttcctgataagcacatctagcatggtctacttgacctgccaaattatctattatcgattgttgacctatgttattgaagaggtctgtatgttcatgcaggagtttggttatttgttgttggtctatgcatgtatatttttgtaatttcttggaagttgtttgagtgacctgttcagcatacatgtcttaattgaattatattcattattattacccgtttctaatgttctgctggatggaacaaaatggcagggatacctataa

SEQ ID NO: 16440 - DNA, 1501 bp, Oryza sativa
  unsure (1)..(1501): unsure at all n locations
caatggccaagctacccgagcaaaacaaaaaaaaagtcatgtacagacacagaccaaatccttccttggaactagatgacgatgaggagagagatcacgacggcggcggcacgggtgccacggacgggagtgcctgcgtgagcgccgccatggcgccttcgccttgctcggcagtggcggctgcgagcgcgcggtaggcggcggnggtgtggcgaggcgcacgcacacgcgcgcgtgcgggaggcgaggcgaggatggcaccggctccaccgcgaccgccctcgcgcctagctcctcccccgccgccgccgctcagttctttccggtcggccgccggccacgccgtgcccagccgcccgcgccccgcctctccgtcccgcgcacgcccgtcgcccgtggaagggggattggaaagggcagtagagagaggaaggaataagatgctgacatgtgggacccacgtgggtcccatgctgagtcagttgccacataggataaaaccggagtcaaaaacaccaaaggacctattgtgaccggttttgattagttaagggacgtgggggacaattttgtaactcgatgacaagttgagggaccttcggtgtactttttccatactacggggacatgcggcccgtcagcacagctgcacagggcaggagcaaaacgaggcccaaagtgtatggcccatcaaagagtgtatgagcgcttcgatgagtcagtgagtgagtttcagtacaggggaagaataatttctagtccagttgttaattactcggaacagttgagatgaaactagagcactgaactgcaataactgaacacaaaactcgattctgatttcagagtccatataagagggttgatgatttgggggtgaactctaaagcataggagagttaattgcaactcaatctgctgttaattgcagttggcatttgaaattttccatttacaattttagccagatttgtgtgtacagtaaccattttgtggcaagaactcgagttctgaatcctgtacaggagatgtagcacataagccattgctagtagagcagattacaatgcgaaaaattaggaaaacagcttacatggaatattaggaaggttgaagtatccaaaaggggcactttttagcatcccatcaaaactacagttaattcaacaatatgacgggacaacaaggggaaaagctagggtatttgtcataatatctctcctgattcctgaaccaatcctgatgacagagtaacaagctgttctgttcagcgtttaaatggaaaaggatggactcaataaaaaacgatgttggataatggaaggaatgattttcttttctgttcatcaagatatacatggattttgtggtcataaagcatcatctggtggaggaaagagggccttgcacacaatcattgctgatgtaaaattcagttaaggtgggctgtaaccatcagggagactaaatgtaccgagatagtccaagagggattgcgtaa

SEQ ID NO: 16441 - DNA, 1501 bp, Oryza sativa
cacggtgggcggcgaacctctcgccgtcgacgacgaaggagacgtccgtcgtcccatccccgccgttttaggaagagcgataagtaatcaccattgttgccctccttctcgtaaccacgcgggtaatagtctacactccaggtgaacccaccggccgagaagacgtcggaggtgagcatgtcgccgacggcgtaggcgttggtcgccgaataatctagtttgagctccaaaaaaccggaggccggcgccatgttcatggtggtggcagatggacagtctgcgagatggggagatagatcgaaaagcaatgtatacatatactaatgagtaattatgagtatcatttttctgttttttgagatccgtagatcgattcactttcctatacggaaatatatctaggccagttcagatgcataggcgcatcaccactgacccatatcgatgggactgactaggtgactagggctgtgttagggagtgaggttgggaaccctctgcttcgcacgtaaaacggagcagcgtttagtgtatgactaattaagtattagctaaaataaatataaaaaatagattaatatgatttttaaagcaactttcatataaaaaatttttataaaccgtttagcagtttgaaaagcatgtgcgcggaagagctggagaaaactcagcgtaggaagaggagttttagggtgagtttgagatgaggggaaaagagacgattgagaagatatgcaaaacgaggtaagccattagtacaagattaattgagtattaattatttcaaacttcaaaaatggattaataagattttctaaagcaaattacatatagaattttttttttgcaaaaaacaccctatttagtagatcagcatgctttctccagctgccaaacgcagccttagagcaggtacaatagcaggctataagccagctataaacatattttaaagagataaaggaagagagagaagaacaatgggctacagatttgtaatcaggcgtagcatgaaatccaagacgtaatgtgtgtatgacaggtgagactaggtattaatattatagcaagtagctattgtataaatcggctattacttcctctgtttcataacgagagttattctagtattgcccacatttatatatatgttaaatgatgtgagcaatggtagaatgctttacattataaaacggagggagtacattggctatgatgatttggagttaatagtgggctatactattaaaacttgcttagtacttgagaggggaggtatcaaatctcagccattgattaaggttaatcggatggaaatgattgatcggtacctgttgcctgttggtactaacgtcgttccgccgcggggtacctagtggttggtagggcagctaagtaatttcgctgtgtcatggttgactctggcgatgggtatctcaccaaatcggctacagatcagctccacggttgctgcttcttcgctggcttgcaaattgcaatc

SEQ ID NO: 16442 - DNA, 292 bp, Oryza sativa
catggtgacgtgggcgaatctcggacgtccatttctcgatccaacggtagttccaagtttccactacatatgtggtttgtactacatattttccccaaatgagtaggcatcgcccccgttacgcgctcaaatatcggaataattaattatttgtcactcttacgaggggtgataaatgatttgccactggatccacatgtcatatacacatgagggctcacatgttatacacagcgagtggcagataattaattgccacatcttaaaagtgaaaaaaaagttaaatgtccct

SEQ ID NO: 16443 - DNA, 1501 bp, Oryza sativa
tggacccgcacgtcagtgtcacacgtcccccctcaacatatgtgcatgtcaggggagcacgttacacaccgtggactacacggtgagtttgaagaggtgattgagaagatacgtaaaacgagattaaccattagcgtatgattaattgagtactaactattttaaaaatggattaatatgattttttaaagcaactttcctataaaaattattttttacaaaaaacgtaccgtttagtagtttgggaagcgtgcatgcgaaaaacgaggtgttttctgacattggatacaggtatacacatttaaagtattaaacgtagactaataacaaaataaattatagattccgtatgtaaactgttatacgaatttattaagtataattaatccatcattagtaaatgtttacttagcaccacattatcaaatcatggcacaattaggcttaaaaaattcgtctcgcaatttacatataatctgtgtaattagtttttttatctatatttaatactccatgtatgtatccaaatatttgatgtgataggatgaaaagtttttgcgtgggaactaagcatgacctaaatctttataccgatttcaggattataattctagcatgttattgggccacgtggcaacctgataatttagctgaacaactccaaatatttttcacgtgtcaattatgtcgtgtcaataagatatctaccagaatctctcttagaaagctcctgtgatttgagagctccgggccaattgtcgaatggttaaccccggcacatgggattcacaaatttggttccctcttgcaagaggcagctgggtcatgccatacacgttgagtagggaggtgacgacccaatccgatagtatctgaaacggatggttgggctataaccttcctaagaaatacaagttctaagtaaaagatctaatctctgttttataacatgtagaagtagatttgttgtatcaacacatgaaaattatatcatttaattttaaaacaaaaaaaatgtacagatggatagcaaaccaaggatccatttctaaaataaaaaaaacataagaagatttaagcaccacatcggttatattaaagggtaatttaaaaccatgccattataattttgcaacctgcccccaattgtacctcccacaacgattttggagtcgcgtgttcgatcgccgtgctatccacgtcgccccgcgcgctggaaggcggaggggtttttcgagctggcaattttcaaaaaagaccttggttttatatataatttataataggtccctcactatatgtttctatgttctgtattcttatgtaaaagccctccacaacctactatatcttatacgaagaaggaaaaaatgggaaaatagggctgcgctctgataaacgaaaagtgaggggtttttctgaaaaaaagaaaatccctacccaccccaccccacccgaagccctagctgccactgttccctacctttcccctctccttctc

SEQ ID NO: 16444 - DNA, 1501 bp, Oryza sativa
aatcgatcgatcgccatgcgcatgcatatctcctagccttgttgcctatcctaattaagttcacacttctgatgttgcctaaacaatatccactcgaaatacatttgtcggattcgtatattgattaattcatgtaaaattcatgcgctctaaaggcgggcctctttcagtctcatgcatttaaaaggatatacatggtttactttatttggtcaaacatctaaaactattactatcaataattgtcaaatatttagtatgtaaacatagttatcaatttctttataactaattttataatattataattttggtagataccatatgtcatatcgatcctaatgaaaatacgccaaagacaagataaaattaacaatgttgtacatttaaaaacagagatgatatataatggcaattgcatcaagctttatttgtttgtgaattaatccgggcgtcggcggctgctgtcgacgggccggccgggttggattgaaagcgacgacggcgacggcaaccggattggccatggaaatggatggatcatgcatggatgctcatgctcctgcaggtacagcagtagcaatccccagcatgcagatgatccaaaacggtcgtcgatcggtccatgcactcagacgcagcacacagcactgttgcatgcatcatattaacaattgagctggtgaagaatgaatggatgaagagatttgctcatgtccagcaaaaagtatctcgaggtaccgatatctgacggtaccaaatcgtttccgatcgttggacctaactgggtaggatgtgtattgttagatccaacgatcatatcctaggatgtatattgttagatccaacgatcatatcctgcccagatagattcaacaatcggaaatgatttggtaccgtgagatagctatacctcgagatattttttgttggaccggagtaaatctcataaatgaatgatatatcggctgctagatctgagagggtatggccctcatgcatttctcatcactctctgatcgatgagatggtgatgataatccatcaagaattcaattgaaccccatgcattgcaattgcctcatcatcatctcatatatagccatcttgatcccaatggatgattgattgattgtttgatcccaacagaatctggtcctatctggaacacaacattttttctgttttgctagctagcccatctgtagggaactaaggattgaactgtttcgtgtgaaaatcatttaaaccatcggaaacgaccaaataggattcaccacatatatttttttcgctgcataggattttcctaaggctcaccaaattattgtgaaccgtccattgcacacactgatccaaactagacttacaggctccattcgttcgttctgcttcccaacacgaatagtgcgcacggaaaacatagcggtttattaatacataattaattaatattagcttttttaaaaaaatagatcaacacgattttttaagcaacttt

SEQ ID NO: 16445 - DNA, 1501 bp, Oryza sativa
ttgtcatgggctgacgtgcagggcacatatgtaattgagcctgcgttctagttgggccggaatctggcccatgtcgaatccagctaactcattgttaatccagctagcccatatgtatatacacacattttgtttgaagagatcacatcgccaaatgccagaaaatcaacagttaaattaaccggctataataggctagtaaaacaatagctagttaatctagtagtaattaatcatctaattaacaatgctatcaataatcatcatcataataacagttaattagtagttgaaccaccatcgccagcgtccgatgatcttgccgacgtagttgtgttcatggggcttgtacctgcacacggtggggaacacgccgagcacgtgggcgcactccctgagcaccacgtcgccgacgagcctcttctccctccgccgcgccggcgccgccctggtggcgcgccgcccggtgacgaggaacatcttcccgtcctcgaacaggtagtggcacccgccttcctcgacgcggcaccgcagcgcgtaggcggcgctgctgttgaagacgacgacgtcctggaggaagttgcccatgtacccccacttgcagaggatggcgtacggcacggcggcggcggagttcggcggcggcggcggtggctggaagaaggcgcgctggggcttgtaggggtcgaggatgaagtagtggaagtactcccagttgccggagaaggcggtgcggcagctgaggatcatctggccgccggtcatggtgctcagcatggacaccgagtggttccgccccggcgccgccggcgacgactggtcgcggggctccgccgcgtgcggcgacagcatcccgacgatgatcacgatcgacgggatggcgatgaacacgaacgggatcgagatgatggtcagccgccggagcaggtccttcttcttctcctccatatttattatgtacttttaatttcttgtagaaaatgcttcagttttgctcttcttcttcctcctctctctcctcgaagcctctaatttatcgtgtggttgacgaggtggcgtgtcaaaattaggaagtgaccacacctgaatgcagatgagaaatatgagatattttgaccaaatgtatcaacgatttaaacttgctcgtagctactccctccattccataatataagagacagccacttttcttagatgttctataatataaggttttaaactataacatattttttattaaattactactttttttaaaatccttcactgtcacattctttaactttattggatgcatgcattatatttattaggatgatccaaactacaagataataataactatttcttggtctttgggttaagagtggttgtggcttatattttggaagggaccacctatacatttgtcgacaaattttctcctaaaaaaataacagatgtaattatagtataattgtagtgtaattacattgtaacttgtatgtaactacagcataac

SEQ ID NO: 16446 - DNA, 1501 bp, Oryza sativa
aaagatagcttgtcgtccctcctatttttggcatcgtatcttccatatttggtgaacggggaatgcatagtaagccccactattaccttccgttctctgtaatattttccgattattcactagctaggtctatttcactgaaattagcccgtaccaattgtgcatgagttaagccattcctcttctctctcgatacacttgcatggtgacggagcatggggctcctcaccgggagaccgcgcaggcccccctttgccggttcggccgggggcgctaagtgaggttcttcaccctcgatctgtggaatgtacgcgagagagaaaatgcacgagacacgggcgatgtagacaggttcgggccgctgagaagcgtaataccctactcctgtgttctggtggatctgtgtgtgaaggggttacagagaactggaaagcaagagagtacaggctctagaacccctctttctctttctctcctctatcagctcaggtattctctaagttctcctcctcccggatcccggatcccggatccctttcttcggtgggtaaggtcctccttttatatctcaaggggataccacatgcaccacttctacctccccttcttttgggtgaggatttacaatggctgctccgaatgaccctccgatgggatgggtcatacctacctccacttcgccggaagcaaatacaacatgggagcacggtttgtctgccgatgacgtgaccggcgtcagaccagtcacagaccggtcattcttgtccaccacgcgtcagtttagcatgccgcacatctgtccttcttcatacaatgacttccttgcaatggttgcgatgaagcctggcatgaatctggccgggactgacgtgccaactccaggagttaccacgccggctccggctagggacgagtgcctggaggctctcatcattccgacgggacggggcgagacgagtgtcaggccgcctgttgccacctaacccgcgatctgaccggtctgtgaccggtcacatactgcgaccggtcacggaccggataagcgagcgcgctgcgcttgtattaaatgcggcgtggcgcgctcgtccaacccgcaataagtgcggttaggtgagcgccgctgtgctcacctaacccacacacgtggcgccaacaccatagggggtcggggcgccccagccctcggggctgagacgggagcggcccgacccctcggggagacagagggaggggtggccacgtcaccctcgggcccgacccccccgagggggtcaggccacgtgggtgagcgcggctgcccaagcctctagtcacgatactcccggtcccatgtcaccgacagtagcccccggcgttatgccagggcgatcgcccccctcgagggaagcgctcgggcgtgacgccactccttggtgacaggtggggccggtctctactggcgggcagaaagccagcgatcgcaaatcgtgcgcatcggtaagggaaaaccgactgacaataa

SEQ ID NO: 16447 - DNA, 1501 bp, Oryza sativa
cggaggcgcgcttcgtcggcgagggggtgtagaaccagtcgctcttccagtcgtcccacttcttgcggaggacgcagggaatgtagcggctcagcaccggcccccgcggctggaagtagcagccaccgactaccgacggcggcgacaccggctgtgcggtgaagaaccaccggaacagccgaagagatgggcgcaccccgataaacatctcgcacaggtgcgcgaagatggccaacatcattaccacgttgggggtgaggtgcgccatctggagattataaaactccataacatccatgaagaaagaagagaatggcgggaccagccctgccattgcgaaagagagaaagaagacggaccgccccgggtagtgtggcgccgggcgtccctcgcccagctcgaccacctcccggccggtggcagattccggcatgaatcggcgcagcagcccggcctgcctctcgctcacgatgcgagaaggcggcagcatgcttccgtcgagcagtgcggagccccgtgccatgacgccggcggaggaaaaagcttgagagcgagcgagagcggcaagggtagggcacaggaaatgaagagttagagcgcaagcggcgaaagcaaggggaatagtggcgagaggaaggaaacaaatctcttcctcggcgcctttatacccttgccaacgctatgcccggctcctcgtttcccgcgcccactatctcgccccctcgtttctcgcgcccacgcctccactaatcccactcgcccgtttgcggcgcacgaggcggatgtgcggccgtggcagtcgagatgggacagatcgagcacgcgttaactacactcgccgaccgaagcgccatcatcatgtctccaggcgaaacgaatcagcacgattcgcacgctgctcgactaatgtagcggtcgcgaagagaccgctcattattgtcagtcggttttcccttaccgatgcgcacgatttgcgatcgctggctttctgcccgccagtagagaccggccccacctgtcaccaaggagtggcgtcacgcccgagcgcttccctcgaggggggcgatcgccctggcataacgccgggggctactgtcggtgacatgggaccgggagtatcgtgactagaggcttgggcagccgcgctcacccacgtggcctgaccccctcgggggggtcgggcccgagggtgacgtggccacccctccctctgtctccccgaggggtcgggccgctcccgtctcagccccgagggctggggcgccccgaccccctatggtgttggcgccacgtgtgtgggttaggtgagcacagcggcgctcacctaaccgcacttattgcgggttggacgagcgcgccacgccgcatttaatacaagcgcagcgcgctcgcttatccggtccgtgaccggtcgcagtatgtgaccggtcacagaccggtcagatcgcgggttaggtggcaacaggcggcctgacactcgtctcgccccgtcccgtcggaa

SEQ ID NO: 16448 - DNA, 1501 bp, Oryza sativa
tcctagattatataagatatctgccactttatgaaacacccaacggcttgattgtctagatattgttcttcttttcatacttaatgctgcatcagttgagtttgatctattaagtcgtgcttagaatatcaatctctagcctgtcatctggttgccgattagggtagtatcggagtttcagccgatcttatctaatttaaccatattcgatctatatgcttcagtgacatgttaaatccgccctttatgtcaagatcttattgcatttaagtatattaagcttttgtttggtatattatacctgttttgatatctttatatagagtagtatcggagtattagctgatacatgctagatctatctgatcggctatgctataaacatatataatcctgttattaatatatatttcgatctaagtgatttatactgtctcggcatggtgaccgatctattccaatcacttgatttaagtatatattaatataagaactatatatcgttaatatctacagccgatcgaatagatttagttccttactgtctatttataaccgccgatcgattcataaatgacatcggctcaaagataaatgattgtcatcggcacctagccgatcggctatcatttatagatttaaccacgaattctttgtctctatttcttgttggttacaggatcaaatcaactggcacgctcatacattcgaaggcgagctttggacctgcactggagttaagcagatctcccaggcctcgtgttttctgtcaacagcagcgtgagctcccgccgccgctcgcctcctccgccgcaccctgccgccgccgctccctatcccccgcctactgccgtgcgcctgagtgagacatagagagagaagagagagagaggggaagagtgacagataggaatagtggaataggagtatgacaggtgggtctcacattttttttaataaataaaatgctgactggactgccacgcgtacgccacgtagaccaaaaccattgtggattaggtcgaggggggtaattcgtccggtttgcatagataggggtgaagaatgtccggtttttttggttcagggggtaattcggacgaccgcgctagttttttttggagggggggtaattcgtactttttcctttttaaaaacaaagacaattcacttgtggacgagaatggagatagtatattttataagggggagtataacactgctgaaatgtatgaactttgataaataattgactatttgtttacgaacggacagaccattgccgatgttttacatataagaagaagaagatgtcccatttaaaaaaacagataattaattaagaaaaattgagcgaaaactacagcagcaaatactccaagaaacttaacctgccaacgcaatgaagcaaggttaggcaagcgcaacacttaacaatgctgctcaacacaagaacgataaagccaagcaacaagcaagaagtaaacaaaactcccacact

SEQ ID NO: 16449 - DNA, 1501 bp, Oryza sativa
tcgagatcctcgaggctgtacttgatgtgcttcgccgccgacgaggagtggcggccgctgctgctgccggactccagcagctgcctcgaccggccgacgaacgagcggtacgccgggatgagccgctccgacacggcgatccggagctcctcccggagctgcgggtcggtcaccttccacgccgtctggctccggtacagctcctcgaacgccgcgttgaagctcctcgccttctccttcagcgccgccctgccgccgtgcccgtgcgccgccgccggcgaggcgtcgtcgcggagcgaggccagcacggacatccacgacgcccggaggtagcctgtctcgtactgcctgatctggccgcggtggcggcgcacccagtcgtcgccgaggagctcgcgcagcgccgggaactccaccatcatcttctgcacgatgtagtagatgttgttcatgaggaagatgttcttcagcccggcgtcgtcgtagagcctcgatttctcgtcgaggttgcggaggaggtgggtgaggatctccctcatgcaccgccccgacggcgtcgacgaggcgccaccgccgccgccgccgtcgtggtcgtcgtcgttggtgtcgtggttgctggtgttgttgtcggcgaggaccatgtcgagcgtgacgcggcactcggcgaggaggccgcagtagttgagcacgtagcgtgtcatggggtggatctcgccgccgaggactggtcgccgcgacgactcgccgtggatgacgttgacgaactggtcgatcgtgtggcggatggtgctgcccagctgcgccgcgacgccggcgacctcggaggagaagaagtcgcgggcgtctccggtgaagagggattcaatgtccggctcgacggcggtgagcgcctcgtacatgccgagcatgcggtagagcttctccgtcgccggggtggacatggcgacggcgtccgcgaagccgatgagctgcaggaggcagcccctggcgacgtcggcgaagcactcgtggccgagctcctcgtcggaggcgaacacctcgtcgcagaggcggcgctcgccggcgaggagggtcttgaccacggctctgacggcgtggctccaccgccgtatcctctggttgagcaccccccactccatcctgagcacctcctcgatggcgacggcctcgacgccgaggtgcgccgcggactccgcgagcgcgtcgcggcggacggcgacgtacacctgcgcgagctccgggccgtacccggcgcgcagcatgcggtccgcgacgccgctggcggaggcggccgcctccggcgagagcgcgtcgcggcgcggcggcgacccgtcgggggtcgtcgccgcgcccgcgtcgtcgaggtcctcgaacgagtcgagcgagaggcgccgcgcggaggagcccagcagcgcgcgcacctcctcctcgagccgcggcatggcggcctgcacggtctccgcggcgcgggacgccagctcgccctggagcgccgtcgcgg

SEQ ID NO: 16450 - DNA, 1501 bp, Oryza sativa
agggtgtcagcaaggtagacctaccttgcgctgtcatttctccagaagctttgacaaattggcacacaaaagagattaattgtcagacctgaacacccaaccgccgcattagcccggtcctgtctggccagcctgattaatcagtccaagtggtgaagccacagcatgtgaacgattgattaattccgattagaaaatcagcacgttccatttgattagtccggccatatacatcaaatgtatgcagtgtgtgtgcaattgaccagttcctggtctccatttttcttttgctaattttttgctggtcagactgctcatttacaaccacttgtagtaggcagtagtacatgattcagcaagtcagctctgtcaagttggcatgttcaataatgtttacttcagcaatgtccttatgagtatgacttttgaaaacaaaatcaaaatctcgatatgtttgatgaattcgcacagctgtttttttgtagttgtatatggcttcttgtagaagttgatctgacatgcaaaagaaaatgttcttttttaggttaaaattgtggcagtggtcatgtcagcgatttttataattcttaagaagacatcgtgatataccatattttatagtctaatttttgttttaccatctagtatactaaaactgtatagtagttactgggattcaggatccactatctcagtatacctaaatttcggatcggaaaaaaaataaacattaaacaaattctgatcgaatttaaatacattttgccacatacgcattttttttttgaatttttcgtgcgaaatagtttcatgcccgggccaaaaaatccccaaaattgtgagaaggggaagaaaatgcatggcggcaatggctgatcatatatagctttgcatttatgcagcagcagcagaagaagaacgcgcacgtgccgaaattcggcaactgggacaatggcggcaacgtgccgtacaccgtctacttcgagaacgcgcgcaagggcaaggtcgccgccgccggcaagatgttcaaccccaacgaccccgtcgacaacccggaggccttctcctcctccatcgccgcgccatcgccgagccgagcccctcctcctccgccgtcccaccacgagcgcgccccgagcgacgcgccgccgccgccgccgccggccccctacgccggcggctcgccgtaccaccgccacgccgctggtggtggcgagacgccgccggcaagaagaggaggcgggcggacaagcggcggcggcgggtcgtcgtacagcgtcgagcactcgccgtcgccgtcgccgctgcacccctactccgacagcgggagcggcagctacggcggcggcctcgtcgccaactcccgcgccaagggcggcggcggcggcgccccgcgcggcaacgagacagtaagctagcttccctccgctccgctcgacctctccgccattgatgacgcttttgcaagcttcgtgaccttgttgttgtgatcgccaatggc

SEQ ID NO: 16451 - DNA, 1501 bp, Oryza sativa
ccgacaagcatttataccacatttattacagatggagggagagatggaggcttcagccgtttggattttggttaaaattaaaggtaatgtgactgaaaagttatgtgtgatgtgataaaaaagactgaattttggatccaaactttagatctaaacacagccagagatcccagcagcaaattgcaattgttaaaagagggcaaagtgtgtgtgcgtgtgtgtgcatttctaggctggattccagtgcagccacatgcgttgtgtctgctgccgccgcgacccatttaggacaggaacagccaagccactagcccgtgctgacctgctagaattaaccaggtgaatcaacttaatactgctctagggctgtgatctttccttcgagttcctaacctcacctccctctttctccacgcacacgcttcccaaactatcaaacggtgtattttttacaaaaagttcctatataaaaattgttttaaaaaatcatattaatctatttctaatttttttactaatacttaattaatcatatactaatcagtcactccgtttccgtgagaaggggagaggtcccaaccctcctaaataacacagccggctcaccagacaccaccaatctgtctctgtttgatcctcgttgtcaagcccacagctaagctaactcactcctttaattgcttaattaactccacctgacactgacaggacatttaggcagctgctgaccgtactcataaattatacttcctttatccacaaacacaaatatatttcacgtttaaatttatactcctttacaaaagtggtggaccccacctaccatgataaattttgtaaataaccctttgaacctattaatactagaaaacaataaaatctaaatggttagtcacatgtaaaatcatatttagatggatatgattggcaatttgccggttcgttaaaaaaaatatttagatggatatgtctatagtaaaaagatggataacacattcttaaaaaatgtatttttatttattttaaataatattataatgtatttttcctgtaacaaagcacggcggaattcagcttgcaagcatttatggatgactaccaatcatctgttatgattccttgtatttatcagtgttgcactgagtatgatgttttctactaatcagatactactacctccatattttaatgtatgacgtcgttgactttttatccaacgtttgaccattcgtcttattcaaaaaaattatacaattatcatttattttattgtgactcgattcatcaacaaatgttctttaagtatgatataaatactttcatatttgcaccaaaattttgaataaaacgagttatcaaacgttgatcgaaaagtcaacggcgtcatacattaaaatacggagggagtactatagtaatttcactccatattaatctctgaaatgcttataggggtatttacgaatacaaaattgcactcatagaagaaacgcaatcaatg

SEQ ID NO: 16452 - DNA, 1501 bp, Oryza sativa
gatagacaaaaaaaatttgacacttgtttgtgccttgatcctaaattagtctgttttttttctagtgcaacagacggagctggggacaaatagttctacgatagtacaattatgtatagtttgaattcctggcagaaaaatatatatatattaatggttgtaaaagtctaacgctgactttgagaacgatactagtaatatactccctccgtcccaaaaaacctcatgaatcccctttgtccaggttgagttttttttgggacggagggagtatgtttttggtcaccatgataatgaggttgtcatttgagaaagaacttcagacttttagaatgaggcttcatgcatgcttgaacatcttcatgcttagccaatgcaaatagacagccacgattatcactgggagtgtcaacggtatgagcaggcagtaatacctgtaaatataagcagaaaactaatttaggtgattccggtgcaaccgtacatcaatgccctatgcagtaaaagaacatatctatgaaaacagtgaatgatgctgaacatctgttctgtccttgtttttacttacctatcgttttggattgctgacagaaaccggttttcatatggtggaagcatcttggtcaaaaccgcagcatagaagaaacccacaaataatatgatgccaaatgcgatgaatgccgacccaatcagctggtccctatgcatctttagatcaacctgtttgacctttggtgtgcaatctcccgctcctaaatagatgcaggcaatggtgaatcaagaaactaaaaatatcaagtcaggtactaaatgaagtttgaggaatcgtaagcaggatttacaagtatgccgatagccaaaaaagaaagaacatgaccatagtgtaaaagaaaaggaaggtgctttaatgaagtgtgttgaatttcactgggtgtctaaaatgtttactcactgaatgaatcaccgcaatatcaattttttacagttcttatacaggagatccaagtgccaccataaggactgttttgacttcctacggaaaattacataacctctgatgataaaaatatttctctaggtgacactcaaattctacctgaagataatttggtcagaacaggctggaaagtggataaatgccattgttgtggtgtagcactactcatgtccccttggcaaagtttactaggaacatatgtaagctgttcatcttgcttgaacatgtattaatcgtagtaaaccagtgatagttggcatatctgcaatctgttggtcaaatatggaaggcacaaaattggccgttttgaacacaagcttcatgcccacccagttccggtggacttcttatattcaccatcggttaatctattgagctcaaaaaaaatatgcagtggggacgtgcaggagaaaaatgtgagaagtttacatgatcagtttcagcatcagcttcagttaggaactgcaaaatgttactaagagttttagaagaaaaaaaagaaga

SEQ ID NO: 16453 - DNA, 1501 bp, Oryza sativa
ttcttttttggctatcggcatacttgtaaatcctgcttacgattcctcaaacttcatttagtacctgacttgatatttttagtttcttgattcaccattgcctgcatctatttaggagcgggagattgcacaccaaaggtcaaacaggttgatctaaagatgcatagggaccagctgattgggtcggcattcatcgcatttggcatcatattatttgtgggtttcttctatgctgcggttttgaccaagatgcttccaccatatgaaaaccggtttctgtcagcaatccaaaacgataggtaagtaaaaacaaggacagaacagatgttcagcatcattcactgttttcatagatatgttcttttactgcatagggcattgatgtacggttgcaccggaatcacctaaattagttttctgcttatatttacaggtattactgcctgctcataccgttgacactcccagtgataatcgtggctgtctatttgcattggctaagcatgaagatgttcaagcatgcatgaagcctcattctaaaagtctgaagttctttctcaaatgacaacctcattatcatggtgaccaaaaacatactccctccgtcccaaaaaaaactcaacctggacaaaggggattcatgaggttttttgggacggagggagtatattactagtatcgttctcaaagtcagcgttagacttttacaaccattaatatatatatatttttctgccaggaattcaaactatacataattgtactatcgtagaactatttgtccccagctccgtctgttgcactagaaaaaaaacagactaatttaggatcaaggcacaaacaagtgtcaaattttttttgtctatcaaattttgccaccagagtataattattgtttatagtacaaagacttcaaatcttgtgcactgccttttatgtcaattttttaccatgggtcttgcattgaatttttcttttttttcaaaaaaaacatattgttgtgctaaaaaaaaagagaaaagaaacaaaagcaatctaaatttggtagcgcgttggctttgctatgtttacccgggatatgtttgggccgtagagattgtcacggatcgggctatagagagcagcagtaattttgagttaacaaagcaagtttagagttttgatcctgtccaactaatcgccgggttaatcgggtctacacgcgtgacatgcgccgcaacgagattaccaaaaaccaaaacaagcaaagggcgggcggttcattcattcacagaagaagagggccatcactaggaaaaaatcatcatggtcgtcatggaggggagagacagtatagcctaatctaatcccagattgctagtgattagcacgtagatacatagaagcgatcgatcgaggacacatcgagaaaaaggtaaaagggagatcaattaatcgaagaagagagtttttgaaatatcgatcgatctagctatcatcatgtcgttcatccggaagaagt

SEQ ID NO: 16454 - DNA, 1501 bp, Oryza sativa
cgagggtggtcgatgttccacgggttaggcagctctgtgccgtcacccgtggccagccgaacggagcccggccgggggacgccgatcactcgatacggaccctcccacattggtgagagcttgctcaatccagcacgcgtttggacgcggcgtaggacgaggtcgtcgacgtagagtgatcgggcccggacgtggcgctgatggtagcgccgcaggctctgctggtagcgcgcggctcgaagggccgcgcgccgccttcgctcttccaagtagccgaggtcagggagcgtcggcttccttctttttgtcgctcgcaggcctcccctttcgggtggcccgcggagcgccctcgacggcgaggacatgaccctcgtcgtcggtatgggctgacctcttcttcctcctcctgtcacgccgccctgtctgagtggcggatccgggggcggccgaagctgccactccggaaccggaggggttctaggtccaggcctcctccttgcgagccactcggtccgcgagctgaaaaagctctgcggtagtctgggactctttggaagcgatcttttcgagcatgcggttgtgccgcacaccccccccctgaacgcgtagatcaccgcgtgtgcagggatgcatggtatggtattgcggacttggcaaaaccgctgaatgtacgagcgaagtgactcatcatcccctcgctgtaccgcgtgcaagtccgcttcttcgcctgggcgcggataagtgccttgaaagttcatagtgaactgttggcataaatcctcccaagagtggaccgacgcaggtggcaggttcattagccaaccccgcgcctgtcccttcagggccatgggaaagaaattcgccatgaccctgtcgtcacccccagcggcctcaatcccggtcgtatagacctggagaaactcggtggggttgacacttccatcatacttctcggtgatggtgggccggaaccttgggggccaacggacattccgaagactcgccacaaaggctctacagccgacaccaccagccgggggcacggagggctggtcctcacgtccatgtcgaggtgacactctggacgaagaggcgccctccgttgcgcgaggagtacgccggctattacgccggcgctcgatgtcgaggcgagcatccggctctccatgctgatcctcccgagtcggaggtgccgacgagggagtggcagccgaatggcgtgcaacagccgccgctcgccgcgccctccgccttgacgacacggagccggtagtggcggcgccggaggtcttggtggtggcggaccgtccaccagcacccaggcgctgctgtgccgtcatgaccaagttggccacgtcgtccagccatcgctgggctggagactccgggtcagggacgacgggcgggtgacgtaggagcgcgccaacagcctgaagcgcgccctgaggcgtgctgccgtcgccgtagacgaggaggcgacgctccccatctcgccgttctc

SEQ ID NO: 16455 - DNA, 485 bp, Oryza sativa
ccccctataaacaagaacaggtcagcatgggcagccttttctagccaccctatgatcctttaacttgttgttgctcatcactagcatgcatgggggcaggctcatccacccctggcccccaatgttgcttcaaaggatgtgtcatgtcctagaggaaaatttttcaccagaatatatatacacctcagcaaaacaatcttgtgagatcctatattgctatcatgctagtatggtttatcttttgccccttgaatggtggatgactctctctatgcactactagaaaaagtatttttcccaggcggggggcaaaacaatcttgtgagatcctatattgctatcatgctagtatggtttatcttttgccccttgaatggtggatgactctatctatgcactactagaaaaagtatttttcccaggcggtggaaatgggtcttcccaggcggacgctggctccgcctatacctcacaatcttcgcagg

SEQ ID NO: 16456 - DNA, 676 bp, Oryza sativa
ctggacagccgccgcgcctccccacccgcccctgccggatctggcggccgcgccgccgccgccgccctcgccggctcagcgccgccacgcttcccctcccgccctgccggatctggcggctgggccgccgccgccgcccccgctggctcggcgccgctgcgcctcccctcccgcccttgccggatttggcggccgggccgtcgccgccgccccagccggcccggggccgccgcgcctcccctcgccacggcacaaagaaagaggggagagatagagaagaagtggaagagatagaggagaagtggagaagagggagccggccgaccttatctcctcatgtgggccccgctgggagaggagacatatatatatacagtggcagaagtcatctcaaacgggctgggacttaaagccgtttgaggtgagtaaacctcacctctgacgggctgtccggctgcgacccgtcacaggtaactagtcacatatgacaggatctgacgtagtgacatatggttatatgtagacgtggaggagaaagtgagtgagtattatttctcctaagtcttgatctatcggttgagatatgagtatcactctacaaaattatcacgattcaatctgatggtgtatccgatcccaatgcccgaaaactacgcctacatggttccttttcaga

SEQ ID NO: 16457 - DNA, 1501 bp, Oryza sativa
atggagcttgtggaggctgcaagtaggaagcatcgcaagaaggccatcatcctcgggcacagccttggagggatggtcgttctagagttcgtcaggagcactccattggcgtggcgaaacaggtacatcgagcacctcttcctggttgcgcctacgctcgctccggggttcatgggccccgtgaagaaccttgcctccgggccaaacgatattctctgcgtcccagatgctacggacttgtccctgcgaccaatgtggaggagctttgaggctagcattgccaactttccatctcccggggtctttgggcacgagccgatcgtgatcacaaaccagagaaactactctgcgtacgatctggaagatctccttgccgccgttggttttggcgacggcatcgagccttttaggagacgaatggttgcgaggatgagctacttcgaggcgcccatggtgccgttgacgtgcatcaatggagtgggaaatagaacgccacggcaattggtgtactgggatggcaacttcgatgaaccggcacaattggtgtatggtgatcgagatggggctgttaatctgattagcatgttagcgttcaacgaggagatgcgtcggcagccaggacagagggggcaattcaagtcgatcaaggtcgaaaacgcttcccatagggggattcttacggatgaatgggcgctaaagagggtcatgcaagagattcttgaagcgaatcgggattcttcgtaggctattgtgcttataaaacttctgtttgaattgatttacaagtatgtacaccggtggttccctaaattgggattctctagtattcttttgtgaatcggggtatgtatagggaagaaagattgatatatgtatcatccataccatttgacacatgaaaaatgttgcatatttcccattgtattaaatatttcttgcccatttatatgcaaatatccttgggtaccactacgacaaaacaatcatccctgtcaactcatttgtgccaataaaactaaaaccgccaaaaataagccatccgtgctggcgtgtaacaacaacgggaagcgataatccctcagagtgttatccaccggtatgtatacatcagtgactatgtgtgccgaatcttcttaccaactgtaacaccccgaattccatataaccgatgagaactgttttgaggaaatcctatgttcaaaactgtattcctttgtgtgtattaagtatctggttctcagggttatagataccacatacctaacagtagttgactaaatctcgacaggacccaccacataccatgtcttatacggaaacaaccttcggatataggagtagttccgcataaggaaggatgaataaagttctacatggaaacgacaaggactactcggattgtatctatattggtttccctagctctacttggacaaggggacacctataggtataaatacaaggcctcctaggaggagaggggacacggaacaatagatca

SEQ ID NO: 16458 - DNA, 1501 bp, Oryza sativa
acaacaacaaaaaatagcaagagattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaaacgaagtcggcgactcatgaaattgattccatcgcgctcgttgataggaaactcgacgcaacccctacctggcgcgccaactgtcgaaacatgaattcggcaataataaaagggggtagcgtacgagacctaaagtggatggatgcagagacaaaggatttagacaggttcaggccctctcaatgagaggtaataccctactcctgtttggggatttgaatccgccgagtgtgtattgatctgacgatcaggttgtctcatgcccctagaggggctccctgccctccttatataggttggggggcagggttacaagatagaaaccataaccaatacggtatcggtttcctaaatctactttacaatcttatcaaaccaggactttaggccgttccataatatacagggaaacgtaatacccaagtcatgatctgttacatatttcatatatataagttatcccctataactagtcggataaccatgccgtgtgggtatggggtacccataatctccacaactacactgtctgcgacggaaattacctacctggcgtgcggcggcgcgtcgaggcaggaacagaaggcgtcgacgtcggcgggggacgcggcgtcgtagaggccgaacgcctcgtacagcgggttggcggcgctcggcgccatgtagccgctgccgtggatgacgtcggcgttgcggcgcttggcgtcgccggggaggtcgaacagggcgcgcacggcggccctcatgccggcctggagctcccgcggcacgccgtggcccgacacgcggaagcagcccaggcgccgcgccgcgtcgcgcagccgcgcggcctcgccgggcgcctcgccggcgagccgcaggtcgatcaccgggatcttcgccgccatacggccctgcgcgtgcgtggtgccgtcgccggtttgttcacgtcgtctgatggagagtgatgggtgtccacggcatcgacttgatgatgtgctctgtcgcgggcgaatgaaccgaattaggctgtgtttagttcagtgtaaagtttggattttggttgaaattgaagatgatgtgactgaaaaattatgtgtgtatgacagattaatgtgatggaaaagaactgaagtttagatccaaactttatatctaaacacagccttattggcgccgcgtactgaccagttagcactcgctgtctgggcactgaatccgtgtgctccaaatgcagacgagcacaagtcagcgagcaaaggctgcttctgtctgttacgacatgataacgtgttccacactttcggttctccactttcgcagaagacgataatagacatcactatgggatttgaga

SEQ ID NO: 16459 - DNA, 1501 bp, Oryza sativa
aatattttcaccaagaaatccaagatggaatagccataaggtacagaggacagaagcagacacttcagtctaactacagatggaaaagctgatcacaccgtccatggacgttccagtgcctagaacaaccatgagatttcaataccaatataacccattgcgcagcctgttacgcatcacaagttttatgaatgtaactaacaatctgtatacgtgtatagcatgtttagaaatttctcatgtcaatttcgttgctttatggtgaataggatgactgttgtctattctctgacccctcttacatcattgaagtaggctccgtttgaacatgcatctgtttctgtttgaacattgaagatcattcgttttgtccgtttagaaagacatgaaagagctggtagcctggcatgtcgtccggcttcaaatctcaaatcccatagtgatgtctattatcgtcttctgcgaaagtggagaaccgaaagtgtggaacacgttatcatgtcgtaacagacagaagcagcctttgctcgctgacttgtgctcgtctgcatttggagcacacggattcagtgcccagacagcgagtgctaactggtcagtacgcggcgccaataaggctgtgtttagatataaagtttggatctaaacttcagttcttttccatcacattaatctgtcatacacacataatttttcagtcacatcatcttcaatttcaaccaaaatccaaactttacactgaactaaacacagcctaattcggttcattcgcccgcgacagagcacatcatcaagtcgatgccgtggacacccatcactctccatcagacgacgtgaacaaaccggcgacggcaccacgcacgcgcagggccgtatggcggcgaagatcccggtgatcgacctgcggctcgccggcgaggcgcccggcgaggccgcgcggctgcgcgacgcggcgcggcgcctgggctgcttccgcgtgtcgggccacggcgtgccgcgggagctccaggccggcatgagggccgccgtgcgcgccctgttcgacctccccggcgacgccaagcgccgcaacgccgacgtcatccacggcagcggctacatggcgccgagcgccgccaacccgctgtacgaggcgttcggcctctacgacgccgcgtcccccgccgacgtcgacgccttctgttcctgcctcgacgcgccgccgcacgccaggtaggtaatttccgtcgcagacagtgtagttgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttatggtttctatcttgtaaccctgccccccaacctatataaggagggcagggagcccctctaggggca

SEQ ID NO: 16460 - DNA, 800 bp, Oryza sativa
aattaatacttctatatctaattatgtactttgaaaaagtgaaaaaaacacaaatatacatattttttcaataatttacgtttatatacctgcacgagatttgcaaaaatatacccgcttcgaggaacggaaacgtgggaccgcgatggtcccgcagttctaaaacacaggaccgatgtcccacggaacggtcgcgcgggaccgcgatggtcccaaaacgcgggagcgaactggccaacgattcattagctgagtcggcactgtttaacaatgtttcggggcgtgtctgccactttacatcactgtgtagacatgtttatggccagttccgcacattgaactggcggtactgccttacaaaattgtgtcaaacaggtctacacagtgtcgatagtggtagacatcgttaaaaatcattggctgcctcgctcgctaattttgagcccccggcaccttcgaggtcccgcgcacccgttttgtagtatagccggtaatgcgttttggagcggtcacgcgttttagagctgcgggaccatcacaggcccgcgtttccgtcccgatatttttgcaaatcgtctgatgtagatatataaatgtaagttattaaaaaaaataagtatattagcaaattttttttctttaaaaagtttgcaagcactcattgtagaacggcacatatttggaacttaaaaggataaaggggcgacatagttcacattttcctagcggatcaatggagttttatcatattttttttattacatttgatttaatgctgattttggcaagaaaaaaattgg

SEQ ID NO: 16461 - DNA, 934 bp, Oryza sativa
aacgaacgcgaacgaaacgtgtatgaacgcgaacgaacgtgaacgaacgcgaacgaacgtgactgaaacgcgaacgaaacgtgaacgaacgcgaacgaacgcgaatgaacgtgaacgaacgtgactgaaacgtgaatgaatgcgaacgaacgtgaatgaaacgcgaacgaacgtgattgaaacgtgaacgaatgtgaatgcacttttactaaaagtgtgagaacgagcgcgagcgaaacgtgtacgaacgagataattaaactattggtgaacttagcatatatatatatatatatgattatatatacttgaaaacgtgaaatacaatatatgttcctttgcgtttagactaatacattttttttgcatgttgcagagaagacgtcgtcgtcgtcgtccctcaagccgaagtggtagctagccctcgaaggaattcgcgcaggcaagtgatgtaaagatgtgattgttagagatataatataagattgttagatttctaatataagattattagattatcagagttagcatatgtgagtgttagagattatcagattattagacttagcatatttgagtgttagagattgttagagatttaatataagattattagaggtttaatatacgaaacttaattagacttagcatatgcgagtgttagagattgttagagatttaatataagattattagaggtttaatatacgaaacttaattagacttagcatatgtgagtgttagagattgttagagatttaatataagattattagaggtttaatatacgaaacttaattagacttagcatatatgattatctagggttctaatacacgacacttagacttagcatatatgattatttgagttttaatacaagattagtagagttttaatattacgcttagcaaatatttcttctatgaacagt

SEQ ID NO: 16462 - DNA, 1501 bp, Oryza sativa
ttttcttcaccaatttcttcgtcaacatcttccacttcaacatcatcatcatcatcagaagaagaaggcttcacagatttctttttctttagtttggggacaatttcaggataaacccggacagggatatcggagcctagagaggcaaagacccgattttgccttttcccgttttgaagtgtcaaaaatttcaaatgctcatccttggtataagggccaagaaatttccgaactgggcggaccatatcctctggaatcacaactacaaggaagaagataacaaagggagaaaataaatcttcttaactaaatcactttttcaagaaaaacaaggttcgcaaaaaaaaatcaagttcgaaaaggaaacttacgatcagacgaaaccacaaatggaggaagactggaagggcaatcttctgggatttctccaagagtgatatcccagccgctcgaaagaggtctaattttgagaagaacaaactcttccaccaggtctcggcagctaaagttcgaaacaagttcttcgattcgaggttgtatggcagtgaactccggcgacaaagagactgatggctcggagacagcttttggtttcttcccagagaacgaaaaaggacaatccttatcattcagcaggctaacagggatttgatgataaaaccacttcgactgccacttgttcccccattttgctcgaatagcagacatagctggccatggacttccgcgcttcggatgaggagcaaagtttacacacccaaacttcgagttctgtttggtgtagtgccgagtacaatggaagtatgcaaagtcttcagcttggggggtctcaccgcagcttcgaaccatccattcgaaaagcccaattcgaactaaagcattcggagtcaattgaggaaactcaagtttgaacaatttcaggacctcgaccaaaaaagtgctgcacgggaatttaaacccggcgtagaagaaatcctcaaacacaagagtgtatcccagcttgggagaaggccttgattctcccactggtcaaattacaacgtttcgaccagatatccaaccaacatcaacaagatcgtttaagtttttgtccttaatcgaagaggcaccaataccacaagaagtattttcgtggttttttgatttcttggacttcgacttttccgcagttttcttgtttttccccatgttgtgtagtgagaaaggaagaaatcaagcaaagcaccaaaactcgaatggaagaaggaagaaagagatttagttcgagtcttttgtgatttcgagttgatggcagaaaaaacgagtggtggcgtaggtcgcgtgatagcgacccctcctggccttatatagcgcagggtggtaagggtcgcgggtttacgagcggacacgaaacccgaagcgacgcgaccccttaagcgcaccaatgaaataccggcacgtggcataaaaaacatttaaaaaataataaataaataaataaaaatgaaaaataataagaata

SEQ ID NO: 16463 - DNA, 1501 bp, Oryza sativa
ggcagtgttgacttggtcttcgtcccacgtggaattgacatggcgcttacgtggcattaaaatttaaaaatataagcagggcccatttgtcattcacacaaaaataattgtaggccccactgacatgtgggtcccacatgtcatcctctctttatcccttcttcctcctccctctcctcccttctctatctatccctctttctcacatgtgggccgccggaccaatcaaaccggaaagccatggcgaccacgccgaccaccaccaccaccaccccctccgccgcctgcctcctcatccccatcgccgccgcatcgcgcgcttccttctccaccctcgccctcccgcgatctccctatccctctcccgctccgccgccgccggttgccgcggccacctcgccaagccatggcgaccacgccgaccaccaccaccaccaccccctccgccgccgcatcgcgcgcttccttctccaccctcgccctcttgtgatctccctatccctgtcccgctccgccgccgccggctgccgcggccacctcgccggcgcggcctcaaagtgcaagggcgcaggagcggaggagaacaagaaagggcaggagcaggaggagcaggagtagtaggaggcgtccgcgacggtggtggacggcgcggaggaggccgggaaggaagaggggggaggaggaggaggggagaagagccccgaggcggtggcagcggtgctgaaggaggcgaaggccgcggccgccggtggcgggtggtgggccggcgtcgcgttggagatgttgaagatcgactggtgtcacgccctgaagtttcccccttttcttgctttaaaaattggttaaataaattgctcgaagaaattgtttaaattaacctagagctaaaaccctaattaataaatgtatttaataatcgatttcggcgtggtgggatttttcttgagtaccccatgtcacaatatattaacaagatttttagtggaattttcagagccttggaaataattttaaccaactaaaaatgagcaagcgcaatattataatccaaggaaaatcctttttctctttttttcttttcttttccctccttttcctttgttgggccgtcggcccatccctctcccgctcggccttcctcttgttgggccggcccatgcgcccctccctcctctctctgggacgtcgacaggtgggccccacctgtcggtcgtctcccacctccagccgttggagccggagctccaactgctgccgccgaaaccgcgcgccgccgcctcctccgcgtctcccgcgcccacgccgcgccgctcccgcgtcctcctcacgtcgccgcctcttcccccgcatctcccggcccgcgcgcgcgctcgagagggtgggattctctctctctctcctccccacgtcgccggccaaatcgggagggttcccggccacgtcctcccctccctcgcccataaaagcactctcccgagccccctctttcattttccctcat

SEQ ID NO: 16464 - DNA, 705 bp, Oryza sativa
tatctatttagttttttttataaaactttggtaaatatataagaaatcctgtcaaaacttggtaatattgtcaaattgtaaaaattttgacaatgccaaaatttggtaatgtttgttttagttataatctgaacagccccttaatatggatccatactccatttgatttcaataagattgtggatggatggacggatcatggatgggttgctttttaatttatgtaaacatcaaaagatgctccccttttgaatggtactactgctagtatgatatagcgttgttgcaatgcatgatccatctatcagaccctagcatcaaggcatggtacttctttttctttttcttttcttttctttttgcactaggatgctcttcttctaccttttcatcatcatacctgatatgctgccctgccctggcctgttgtcaaaacccataccgatgtgtttttctcgcagcaataaaaatatattatgccttttattttatttatttttcacctttatgaacttgcatgcatatcttcatatccttcaaaacggtcctgttaaatattcatgttgatatgtctgaatcattgaccaaacacactcctgaaaagaaatcactagctaataagtatagctattactcctagaaaaccccatcctgttgtaaaaacagcaaaccatgggatatttgatggctttatgccatgtacta

SEQ ID NO: 16465 - DNA, 1501 bp, Oryza sativa
gttttaacttttttttatcaaatttctttaggtttgactaaatttacagaaaaaattagcaacattgataaaaccaaattagctttattgactgtaacattgaatatattttcataatatgtttgttttgtgttataaacattgttatatctctttataaatttggtcaaacttaaaaagatttgactagaaaaaagtcaaaacaacttataatatgaaacggatggagtatattatagaactctaatatgttatacagctcgacataaaaatatgtgtcaaataatcatatacatacatacaccattacacaatatttcaatatacatacatacatacatacatacatacatacatacatacatacatacatacatacatacataatttgtatgatatttaatacatatttattcatgcattctgcagtaaaagtgtgggacatcaactagtataatgcataatatattagatatataccagctgactgacaaagatcgtatcatatattttgttctttttgctttgtagaagtgtgtttgcaaagcactaaaaccacaaaattgatgccatgcatgtgtgccctgcatcaattctcttaagaatcgtgcgcatgcttgtgttatacatattgattattcttccataattgacgagcggtgtgctagctttatttcctgatgtcctatactcctgttgctttcaatcattttctttggtgaaagaaagcaaatgacgcgaagaataaatccgtttggattgatcgaaacttgtctgtgcatattatctctgagctgtgttgcctgctagcagcgctagcgcacgcaaatatactatgttacttggtaattacacgaagacatcattgacttttgttacaacctttgatcattcgttttattaaaaaatttttgtaaatcttaaaaatataaataatacttaaatttcatttagtgatacatcaaacaaaaaaaagacatttacttaaatttttgaataagttgaatggccaaacatgacgtaaaaagtcaacgttatatattaaaggacggagggagtattaaagattacttgaaaaatatgtttgtgcgtcatattaggggacatgagtgataaaagagagtgtgtgatcagtaaaagccgagcaagtcagtagcgtgaaaagtgaaattaatggtcagtaaaagcttagagaggcaatacccagactcgacgtgtgaatcgaacgacatacaaagagaaagctaatgataacaaaacaaaagacacgcagatgaccaagatgcgtgtatatgtgccgattgaaaaaaaaaatgatttctttaagtagataactcctcttgttttaatgtacgatacttttactttttatatatggttgattatttatcttatttaaaaattatgtaattatcatttttgttataaatttacttataatgatgccatatattgaaaaccgggaatagtatattaaaaactacggagagtatatgtgtgt

SEQ ID NO: 16466 - DNA, 1501 bp, Oryza sativa
agccggagcacggcgtcgcgcatggtgttgcccttgtacaagtccatgaagtagggcctgagatccttggagctcatcgtcccgtccccgttggcaccgatgccggacatcacgaaggactgcgagacggccgtcagccgcggtatcacggccatgtccaagaggcccgttttgacgaagtatgtcggcgacgccggcgacgacgcgctcctgccggccaataacgccttgatgttggtgtagtatatttggccgaagccgccggtgttggcggccctgacggtgaaggcgaaggtgaggttcccggacatgttcgacggccgctgcaccttcaccgtatgaccggtcacactcaccaccagcggcctctctcgcccgaccatcttgatggcgtacgctatcatcaccacgatcgccacgatcaccgccaccgcaactacgtacctcgccgccttgatccaccggaaaaatgtactactactccagctcgatgaagatttcgctccgccgcctgccgatgccgtgctcatgcctaaatatatatggatatctacggaacccaagctagcttcactatcactagctacgtactacttcttcagttcagctagcttctatctatggaacccaagctagctttctgttaatatatatagcatctgattccagctatggatgcatgggaaagaagctacttgctccgtccctaaatgttgatatatactattctgtccccccaaaaaaaaatattgatagatattattctgtccaaaaaaaagataaactctaactatgaacggagggtaggatgcatgggacacatattaggatggaggtagtattaggtttagtctcacaattgtaattaataataaacaagtacaacttaaaacatagtttggtccttaccattaggctagtttattgggttgtacaaacaggaaagtgattttatctctcaaggggatatcctctcgtttcatacatgccatctaaatagtaataaatttttttaaaaaaattggcaagatagattaattaatatgaaatgtatcatctccacaaacatacaagttaaaattcaacttatacaagttataacaaaaataataaatataaatgggattgtaccataactattttcagtttaatttgttctttttgttgcaacttgtagaagttgaatttggtcttgcatgtttatggagtgatatatttcatattaatctatatatgttgtcaatttttttaaacatttttataactatttagatgacatacaaataacgaggggatattcacttgagggatgaaaatccatatcctgtacaaacccatagacctttatatttttggtttcggttatatctagggatccgaataacattatggttgattggttatgaatcacattatgggtgtgcatgagacacacatcacgccagctcatattgtgtgtgtgtgtgtgtctctctctctctctctatatatatatatatat

SEQ ID NO: 16467 - DNA, 1501 bp, Oryza sativa
tgtactttgagctggaacgaacggcttgtgtcagttttggccgttggtaagggacaaacaatactggagaagagtattcatttccctcctgcaatatcttctcacagtgtagtagtatggtctaatgcgatccatacggaattgtacacaggagtacatccacatacatagaattgggtggtggccccaaaagtactctccatctacttgtagtagcctagtataatactggaatgtgatgttttactaactttgtaagcaaatcatgcatgtagccatgtaacttaggctcctttggcacatggtaattttcagaaagttgttacattcatccattcatgtaaaatccatgcatttctagtatcttcaaaaggaatatataggagtatatttcacaccattgatgtgtttatcttgtgtcttacaatactcctacctaaactagttcagttggttccagcgggggatgttaatacatgccgcatgagctatcagtcatgattgcagccaacatgtaattgtaatgcttctccaactgaaattgtcgagttgggaggtgaccctgacctgcacaaaaaggtgaaaaaaaagaaaaacaatcttgcagagaaagttctgcaatattatccatcgagcaaaccaaagcacaggtaggagaaaaactcccacatgtacattacctactcactaccggccagatatacatatatacagagtagtgtgtagcctggctaatcaattactaagagaaaaaaaaaacctccaatgttgctgctagcaatcttctacccatgctcatgcaaaggacagctactgagagcaagtttagtagtacaacccactacttactataagccaatattaaagctaacatgtataataggttagctataaggttagctttatttttttttcatcctctctctttatctctctatgaatttaatgcttatttcttggagcttgtgtggagctagctcttgcatgagagccatcactccccacttttctttatctcttccacataagcatttagcttgcttatagctcaccattatcctttctctcagagattgttgcaagggaggaggatatgcattgttttttatctttagttttttctttaagcaaatagggtagtgtagtactttgggtcatggggaacagcaaaaacagctgtctggggttgcatatgattagtagggcaaaagctagtgagtgtgtgtgtgtgtgagagggagagtgtgtgtgcaagagggaggaggggccttttgtgaaaataatgataagttttggggagcaaaaggtgagaggggagagggttttccaatccagcttccaagtcaaaagggtcgcccgggaacgaagaagaaagctcaaagctaagctgggctggctgctgcgggcatgccagcatcattgccgctcttttctgctctgttggcatccgagacgcctcctctgtaaaggcacaccaaagctctcttcttggaccctcaac

SEQ ID NO: 16468 - DNA, 1501 bp, Oryza sativa
tccctccctttattactatatcatgcgtcttcatgagacgatttaatcaaaagaattttgagtatcttgcactcgcatttttaatttgcgggcatactacacgatatgtatatacatggactgtatgataattaactagcaatagtttcttatttactcgagaaaaaaaacatgattcaaaagtcgtaagtacttaatccatcttctactcaaaagtttgtgaatggttttctaagataccttaagaaaaatagaacccttaaattattataaaataacattatccaaactttagtttgccccgaatttatgagacaaaatttctgaacaaacaacaatcttacctttcaaataatataagtgcccgcgtatacgcgcgggccaccttcctagttatataaatgaaaatagaagttaaacttgtataccaaatgcaactaagtgataccccacgctttactataaaatacataaatgaatatatgccaaataatatataaataatgaatgttcaattattatgaaaataatgtgagaaagatgatgtaacatccttgtatgttaagctctacaatgttctcttttagatgatgtatctagtatgagatttaagataatctataatattaaattactagtggataatgatgtgttatgcttgtatgttgagctttatagttcctactaattattattagttggtaccaactatatagaagatatatattctacctttaaaatttattgtaaacataaattaaaagttgtatatcaaattctgttccacttccaaaataaggtgcgtgtaaaaattgtgcaggaaaattcacttggacattaaaaaaggttaaaattaagctccaaataaactatataaaattatgtatttattaattcaaaacttagaaatttattgagaaaactaaactaaggctccacaccaacctccaaccttttagaaatctgtcagcctgtcacatgcgactgccattctggatgatgcattttgatgctctctttttttccgagatgattctggatgacggtggaatgctagttaatcaaaaaactcatcgccacgttgctaatttagctgactttgtcaacttcgtcgaggacacacaacacaaccacacacacaaatccagcgcagcaacagatctattgactatcgaccatcaaggggattggatcgaacacacatacgtggcaaccaagtcttctgctccctgaattccctcgtctagatctcacacgtcacaagtctcgacgacctatagcttgcttcacggacgcaaacacaggggttgccgacttgccgtgctacgacacttcatgcgtaatttctgtgtgctgatcgatgaaccaactgctgtctccgcgttactctacgcatgcatgcatgtatataaacatgcatatggcgcgcaattgttttcgacgattactatatcgcatgattcttctgcatctcctgaaactagcatgggttctgaggcgc

SEQ ID NO: 16469 - DNA, 1501 bp, Oryza sativa
atttctacaggttgtgtgtttctgtcgtttctccttccaacttattttgatggtattgttctgagattagttgatagaagctattttatgcacaattctggtgtttcgtgaactgatgtcagaactcatgagatgtaagtgtaacagctaacaatgctagtgcaatgcccttgccccttgggatcttctatgggaccacaacatcattagaatgtaaattcttacttgattgaaattgctaatgccttgcccgatctggaagtgtattgggtatcttctcaattctcatttcatttggccccttcatttatcattgctgtacattggtagttctgccgatagtgtactactcttatcttcagttttactagtcctactagtggagagtatatgagatgcctcggtggtacgttcatagtttggttccttgcagatacttgcgtagtgccctgtgagttatgccgatcacagaactgttatttttctgtaagagcctgacaggtccttttgttttgccaacaatacagaaagttagtacgtaattttcttcccgatggttaaagtcttaaagaggtggtcaaacaaataaccttgccagtctttgtcgttctgttcagtgttcaccaatccccatctttgcaaaaccaaaatgataagcgcctttacctcccaagcagcattctccaaggcttccatccttctgccacacgtgcacttgaaaaaactgtgaaatctcgagaggtctgagcctgcataaacctcgaaggtctctgcacgtccaagaaataagcagcagattcagctaatttgggctcggaaggcaagttggcaacgagtgaatactgaaaacgaaacgaaacgaacagacagactgacgtcttacacaagcggcctcaccggctaataatatatccaagctttctttttccccgtgtcaagcttgattgatcgcacccctcgttttttttttcctcatcctcaacaaagaaaaacctactccctccgtccaaaaaaaaaaggcaaaccctgggtttccgtgtccaacttaccctgagtttctgtgtccaactttaactgtccgtcttatatgaagtttttttataattcgtattttcattgttgttagatgataaaatatgattaatattttatacgtgacttgtctttttaatttttttaataatttttttaaataagatggacgatcaaacgttgtacacggaaactgggtttgttttttttttttaggacggagggagtaagtgcagggaatagggacggtgggggtggtaggtgccctgtcaatcgtttccgtgattcgtgcttctataaccattggatcaaggggaacgcacatccgctagtgatgctagcgagatccgattgtttatctgtaaccccattttaaaccaagtctgtccacttccttgctgatgatgacatgctgatcggttcatctgtaaacgagtgtatctgtacgcatatacagtcgatattactg

SEQ ID NO: 16470 - DNA, 1501 bp, Oryza sativa
tactccacctgccaatgcacgggaggagaggataggtgggacacatggtatttagtttgttttaagatcaattttatctaacggtgtataatattggacccaccaatttaagtgaaaatcaagggatatatgctatttttttcttagaatttataggattttctctattttattagagcgccacgtggcggtttgagagcgtttgtagaaagttttatggagttttagtatataatagatgatcgcggcgcttttaagttaactcgttcgctaccgcgattgcggcgtgattatcccctcgatcgaattgaacaatccaagtaaaaggtgatccaacacattggatcaccaccgcttttaacttacctgatcgactccaacacgtgaccggacaagagattgggaacaacgtacgaaccgcttttcttctcttcctcgccgatatcgagtaggagaaaattcacccggtacagagatcgacgataatgatccatcgagataagccctgcgcactaatcagatcgatccagttgatcattcatatcgaagtggttatcacctagccgtatctaattatctgtctctaatcttgttacccccaccactgtctcgttggtacgtgaacaagcagcgggccatcacacatcaagccgaaaagacccggcaccgcgcgctggctagctctacacactggtacgacgtagcgcaggcgcgcgcagcccggggcgcccgcgcgcaacgggacaaacgcggcgcgccacctcgacgagcctttcgggcgaagccccccgtacacttggcgccgcgaccgcgaccgcgaccgcgtgcgccgcgctctcctcggccattggcctacctgttccaattgcgcgcgtctccgtctctctccggcgcacccacctttccgccacccattggcgcatgcacgcacgccatcatccggttcttcgtacgaacgagtgaacgactactgcatgtacaccttagcagcagtggtaccaatttcctgcacgaggtggcgatcgatcgaaagaggccaaagagggagagaaataaacgaaaaagaaatccggaggtgttgtacagcagccaacgattagcagtaggccaacaaggaaccggtacgggagaaggagagaagaatatctcgcactcgtgctcgtcaccggcgccacgtgtcaagtggcgatcccgaggcggccggataaccatcgggggcaggggcacagcttttggcgcgggcggattcgtgacacttggcgggaaacaaaagcagctttgctcggtgtcacggtgcgtggggccccggcggttttctttacccgcaatcgcaaagaccacatgttcgcatctcccccggaccggacgtggacacgtcactcctcgcaccggtataaaaggggccgaccgggccgggagccgggagagggatgaatggtcgaacacagctagctagctgggctaggatcgccatggatcggggtgaccaccaccacctcca

SEQ ID NO: 16471 - DNA, 1501 bp, Oryza sativa
accatcatcttcttattccttgatccacttgacttccataagtagaccacatcgacgtcttcgagtttctccatcaagtttaacaactactcaagttgaaggaggaaaggggagagaataaaatgatttccaaagaattctagagaaggaagaaaggaaaattttcacaaataatgtttttcgaaaatttgtccttaaggtttgaccatttagcttatcctgcagtcaagatggctcttataccaacttgtcacgcccagaaattcacaaataatttccgaacttgtttatgcataaaaccctcatccaggaatcagccgaggtacacaaactgacaatttaatatacaaatccatcataataataacgttacatacttacaaaagaaaagaaaaacagcagcggaattacggtctagcgaagctccggctacactcccacaggcagctcaactagggtataagtcaaccgtcttctccttatggatcctttttcttcaactgaggtttgattgattattgcaaggtgagtacatggaatacttcgcaaaccacacagcaaatatgcaagtgtacaaggataccaaaggatggcataatataggctcatttgcaaaagcagcatttagcaaacatttaagagtagtaaaacagtagagtaattaatcatcaatattaatcaacactgaacagcaccccaatgctgcacagccccaaccaaacctgaacaaccaaccccggtcgtacatatcaaacccccaaaccaggaatttgtcattccaaactaggagtcaaattaattgtcacattattatcattaatgagtagcgtgagactaatcacgaaaaacattgctcaacccgcctatgaccgcgggcatggctattcgaatagttttactctggccagaggtgtacaaatttacccacaagacacaactccacaatatgtcaccatatcaccatgtgcccatgctgaacatgtcaccatttgtgtagttgtgacaagacccctcgcataactcaactaaaagcggcgcacctttcctggattgtagtcaccccctcaaaaaccagaggtatggactccccagcgacccccacggacttctcaccgcttcacagtctggctccccacaatgagccttgctacacaaagtatccagccgttgcccatgctgacttgtggttagtacggttaatatctcacaacagtagctcatgaaccgatccttaattgtcatgagcacaacaatccaaacttccaaccgtgtgctcacaacccaccattaatcaagttttagttgactattaattatccaatcacgattgaccatcgtgagctaccattaaatatccatctttaggtaatagtgaaacattaatcatcccaattgtgtgctagtgtttctaagcatggctaagcaattatattaatatctagtcaaaccaatacttgctcaactagtcaaatcataataacccaaggtatcaaggaataga

SEQ ID NO: 16472 - DNA, 1501 bp, Oryza sativa
ggtgtgccctcgtcttctccaccaacacttagacgtttttccatcgagatcgatctcggcttctccttcgccgccactgcctagggcaaccccgcgccgacgccgccgtcgtctctcgccgtcgcttggcggtccttgccgcctccaccgtagacaccgccgccgcatctcttgggtgagagtcgccgctgcctctctctctctctcactctctctcgatctcgatctctctctctctccaaaccgccgccgcctagctcgttgctgacgccactgccacgccacggtcaaccgccaccgccgacgaccgacttcgccgcggccaccaccgccgacgacgccgacgccactgccacgccaccgcccccgccttgagctcaccacgccgccacgccgccgctccgccgccgccactgccgcgcgccccgaccttgccgaacgtgaacgaacgtgattgaaacgtgaacgaacgcgaacgaacatgaacgaaacgtggacgaacgtgaacgaacgcttaacgaacgcgaacgaacgcgaacgaacgtgaacgaaacgcgaacgaacgtgaacgaaacgttaacgaatgcgaacgaacgtgaacaaacgtgaacgaaacgcgtgaatgcacttgtactaaaagtgtgagaacgaacgcgagcgaaacttgtacgaacaagataattaaacgattattaaacttagcatacatatatgattatatatataggttaaaacgtgaaatacaatatatgtaacttggcccatttagactaatacattttcctggtaatgttgcagagaagacgtcgtcgtcgtccctcaagccgaagttgtagctagccatcgaaggaattcgtgcaggcaataatgtaaagaagtgattgttagagatttaatataagattattagagttttaatataagattattagattattagagttttaatataagaatattatattattagagttttaatataagattgttagacttagcatatatgattattacaattttaatataagattagtagagatttaatataagattagtagagatttaatataagattgttagacttagcatatatgattattaaaattttaatataagattattagagtttgaatataagattgttagacttagcatatatgattattacaattttaatataagattagtagagatttaatataagattagtagagatttaatataagattgttagacttagcatatatatatgattattacaattttaatataagattagtagcgatttaatataagattgttacacttagcatatatgattattataattttaatataagattattagagttttattataagattgttagacttagcatatatgattactgcaattttaatataagattattagagatttaatataagattagtagagttttagtattacgcttagcaaatatgacctatagacttaacaaatattttttgtatgcacaga

SEQ ID NO: 16473 - DNA, 1501 bp, Oryza sativa
  unsure (1)..(1501): unsure at all n locations
acacaaggctggcggcggcggcggccgggaccaaagcgacggcggcacacgggccgggcggcgcagggagcggcggcacgcagcgcgggaagcggcgagaggaaacgggggcagtgagggagagggaggtggcggagctcaccgaggggcacggcgatggcgagagcagccggcggagggaggcggcggcgctccataggttgacaatgaggaggggctcccggcggcggaaggcggcgaccgggcggcggacggggaagagcgggacgcggcggcagccggggtgatggcgaacggcgaccggagacggaaaaaaaatggccggtagggtggtgtggtggggaggtggttctggtggtggaggggaaaaagggatgggcggccgggcttgcccttccggtggtggatctaaccgaggcagtggcgcggcttgaggtggttgagnatggcggctanagncgcccgnagccggtagccggtggtgcccnagccgncggtgttccggagttgaaaaggggaaataaagtagaggccgggctgcggcacggcgccgcgaagccgacggtggtggcggattggcgcggcggtgggtggagcagcggtggcgggcggccagagctcgccggaaacggggtgcgcgggagcggcgtggggagggggatagagagcgcggctggctcgggtgaggaggggaaaagagagaggatgctccggggttcgtttttatagggtcggagcggcataaacggggccgagaggggcggcaaccagcggggaagtggggcgccgatggggggtggtggtggctcggtcggcgccggtttttgtgggacgagcggggaaaatggtggaggacgtggaggggatcgtgcccacgtcgttggatgcgagctcgggtgcgggagggcgccggattttgcggcgacgtgggcggcaatggcggttggggttggccggcgagaggtaggaggaggagctgacaggtggggcccacggtcccacctgtcggccggatggagagagaggagggaaaccgggggacgtaaagtagactttcgcaaggcgcgggccggccgagagagggaggaggcgcgcggcccacgagagtggaggggaaggcttgggccaagcccaaaagggaggggaggggattttatttgttttcttttttttaattgattaaatgaactttgtgctattaaaattatttcttgagctccgaaaattcacaggaaatttcagagagtattttagggcaaaagaatattgcaaaatattcccggccaatgatttttaagggaaaattttaattctcccattaattcactcgaataaattgctttaacttttaatataatttcttgaaatgcattattaaatgattttaaaacccgaacgaaaatcggggcgttacaacacacactagatcaatggcaacctggttaacgtctttgtctttagtataaccactctccttctatcttctctaatttgcaacaga

SEQ ID NO: 16474 - DNA, 1501 bp, Oryza sativa
actccctccgtcccaaaaaaagaccaatcctagcaatgtatctggacatgcttgctaggattggtcttttttttgggacggagggagtaaatgtttaatcatgaatatagtgtcattaattgtcaatatttcaataataagtggagtagtacgtcgaattagacaaaccatagtagcagcatttctgtgaaacccaagtacattaattaggcatactggcataagaacatttattcagctggcctgacactgttgaagataatgacgtacgggatgtgataagtgataactgataacactactgccgggcatgaaacctaaaaaaagaagaatcttaccgtagacttctacataagccaaaattagcatcagtcaagtcgaaaccgaaccaataattggcaccaacataaacctcatcgccatcccctcgaggagttcgggtgagaagtacacccttcgtttttgccgttgattttttaaaatatactagcaatgacgtccgtgcattgcaacggattaaggtaattttaatcatgcatactgttggacaaaaataataataatgaaataaaattgcagtgacctttggtcaaaaagataaaaaaaaatataattaattatcctttaattccattagataaaaataatttaatatgaagtaggaaaagttttaaaaagcttaaatagagcaaactaattctgtaaattaaaacaatttttttgacattgaaaaatgtccgtgcattgaaaaaaatataataaatatagaaatattatatgataaaggtttagttttatatgatatagcccaatagtatggatgtcatgggaacagaatcggggcaacttaagggacataaagtgaacttattccgtgtgggcagcttgggaatggcgttcggcttgacgcaggagaagccgtagctatacgatatgatggacagttctgattgattccgacctatataaaagttcaacagcccaaaccctaaccctaaaatcatttcccctcccccccactctctctcaacggtggcagcggcgcctctccccctcccctccccccaccagcgcgccgctctatctccccctcttcccttccggcaggagatggatgcgggaggcaggggtggcgccctcccttctagtgggaggccaccggcagtgccgctctatctccccctcttcccttccggcgggagatggaggcggcaggcaggggcagacagatccaactttatctttttctcttctcccttatctatttttctctctcccgcagccacacaccacttctcttgttatctctttctcctatctcccacaaccgatctctcctacatccacacgcgagcagcgcagtgcgagtgcgagcggcagcaatggcggtggtggccccaactggcgagcagagacatcagcctcgtcgagcagcaggagaggcgatggcctcaccacagcgagtagtgacctcggcctcgtcgggcggcgggagaggtga

SEQ ID NO: 16475 - DNA, 1501 bp, Oryza sativa
ctaatatcatctatgtaaccgcaatggaaatagttgtatcatgttcaaattgtactactatttcttcatgttacataattctccttgtttaagtccatataatgtttctacgaccgagactgcgataggcctatattaattatccgagtactaatacgtcgaataagttacaaaataataccttacttaacatatgaaattgcgaaacaaccaacttcaatacatttttataacaatattaacaagttttaccaataaataattctttatttattattaacataacatagaaaaatcgtttggcggtactttttgcatctgggtcccttgccgccctctactggggcggcaaggggcccaaatgcacaaagtacgagcgcaacctctttatgggcggccaaaattgcaattagccccttgccgccctctgtatgggcggcaaggggctaattacaattttggccgatggcggcagacggcgcggtcgacccgccgtctgccacgtcagcttgccgcccacctctggacggcagggtctatttttgcaattttttttggccgatagattatttctgtaaatattaaaaaaaatctaaaaatgaaaaaaataccccactcccctcccctttcctctcagcccacactgagtttgggccacaactcagcccattcggctatatgttaaaatacatacaattcatttcatgaccagttctataaatttatgaaaatatacttatagccattatatattatatagtttagaactatgcgaaactatacatacatatcatttattaggcttgatattgtatttttttatcccttcatatttcgaaggaaaaagtccactttgactcccttaaatattggccgaatctaattcgtaccccttaaccagaaaaccggataagatggctccccgaactattgaaactgatgcaatttgactccctaggtggttttgcaagcggttttggctgatgtggcgcctatgtgacggtgttgacccggtcttcgtcccacgtgtcgtcgacatgtagctcatgtggaattagagtaaaaacaaaaaaacaaaaatttgtaggaccaacatatcatccacacacacaaaaaaaaaaaagtgggacccaccgacatgtgggccccacatgtcatcctccctctccttcccttcttcctcctccctctctccctctctctctcccccttatctctctttctccctcccgggtctcttttttcaccttgctcggagcggtggtggggagcggcggcggcggcggtcgggagcggtggacggtggtggggacggcggtagggagcggcggcggcctggctgctctaccgccgccgcctcggctccatcgagttcttcccgcgggacttcgacgctgtggagcagcggaggtcttccaagaagtcgccgtccaagaagccgaccaaatcgccaggggcactcgacgggcatccgccgcgcctcgcaccgacgcggattcgc

SEQ ID NO: 16476 - DNA, 1501 bp, Oryza sativa
acgtcaagctagacggtgactgcatgcgggcgtgaactcaagcagatcctcgatcggtggttcttcgccagcttactactccagtactcctacgtgcttgatgctcaagatcatatgttactccctccgttccaaaatgtaaatgtttaaatttatagctaaaaatgtttacattttaggacggatttagtataaaaaaccaatatacgagagtgtttagttcacgacaaaattgaaagtttgattgaaattagaatgatgtgacggaaagttggaagtttgtgtgtaggaaagttttgatgtgatgaaaaagttgaaagtttaaaaataaaagttggaaactaaactagtcatttatccatattcattgtatatacaagaatatgtcacatccaattttttttttaccgagggattaattagcttttcgcaggagacgagtccgaggttttgtcggtcgggtagtggcagttggaggctggagacccgagtcgcgcggcgtcgctggatcgccgtgcaccacagccaccagatcgaccgccgatcagggccgtcgatgggggtgtgcgagaacggcggaagtttgcagtccgaggcgtcgcgtcgcgtctcgcgagcgtagttgccttgttttcatctcaagcgcgcggtgattggtgatcgctcgcagcatgcatgcgttagtcgaggcgtcgccgcgattcaccgactccaactcgcgagcgtttagtgttaagttgctgtgttggtctgttggatggccatggaggcgtggacaatggactgagcagccgaggcagggaggacgcgaggctgcagcgcacgcgcaggcagacagcacaacaatcgccggccaatcgagcgggcgagcgccgatcgagcggcagcggcggcgtggctaactccggcatgcggtcgcgcgcggcaagccggcaaccagcaagcgcgagccggcgagggcgcccctggcaaccagactgagggccctttgattcgcaggatagaaaaaacacaggaataaaaaaaaacacaagaattaaagtagtaggtttctcaaatcctataggaattagcgaacacaagaaaaacaataggagtctttgatagtgctataggaaaaataaagaaaagttcacaaagaggtcacatctcttgctatttttcctatgaaatggaaagcataggattgtagtttcctttcttttctataaatcaaagggacatgtagaaaaaagatccatagaaatttgaatcctatgaaaatccttttccaattctatgaatcaaagggagtttgatcatcaagtaatttgacgaacgaactagactttcatctgatctcatcttatctagtcatctctgattctctaatcaagtgtgtatactgtatgtatgtatgtatgtatgtatgtatgtatacgacatatgtctttttctttattttgtttataaaacaggaactcaggaaggcttttatttcctcaattgctttaattcctca

SEQ ID NO: 16477 - DNA, 1501 bp, Oryza sativa
ataaaaacaaggaactcatatatgtattgtacgccagagtttggagaaaatggtcatgcaaatcttcactaacattggatgaagattcaccaataggaagcctcctaataatgtttctccttcttgtcatctttttcattagtatgcatatttactgttgattcagttgaaaacttcataggaagtgggggtagcttgttcttaagtcaaagccggattatccattatctgctaagaaagaacatgtcgtagttatttgatactaatgttctaaaagagaaacatttgataatttaaacaacgtaactagaaaaataatgtgccctaatcgaatcataacaattcaatctacatctagtgtacatctagctagaatcgttaattttgaatttgagttattaaataaaaaaactaaacgaggactccaagatgaactttgaatttcactaaaatttatgcggttttaaaccaatgcaagtataacatacaattattgattggtaatattgaaattgcctaattaatcaagtcagaactaaactttacactgcacgccaaagtggaaggcgacatatataaggcacttaattataagacaattaggagcatataaatgtaaatgtaaactagttgaatgcacatgctttgctacgggtaatttgacattatatgtggctatctatttagatttggttgatttttaatactaagaagttcaaggggtaatgtgttttaggtttattttcatgtgaagctatgcgtaggtattttatctcttacttacacgggaaatcaattaggacggaattaatttttaatagacgtaatctagtggttcaaaataacggatccactaatttgagtggaactaaatggatagatttttttctcagaatatatatgattttctctaatttattagagcgtcacatgatggtctgaaagcgtttgtagaagtgtcacgtggagcgtttataggatgtttaatggactttaatgtgtttgaaaggagatgaaaagagaagattgagatatacaaaatgaggtgagccattaacatatgatcaattgagtattaactattttaaaatttaaaaatagattgatatgatttgttaaagcaactcttattgaaaatttttgaagaaaattaaacacaccgtttaattactcggaaagtgaagagataagtcttctcttaatcggcagctgccgaacgcagccttaagatatatcttatagatagatagatatatagataatagatagatacacaaaacagcacacgtagatgttttgaaaaatctggcaactgacaaacaagcagtgggtcatatatccagcgcactgctatataaacaccataagtgtgtgaggtggtctgcaaaacaaaagtgcgagacgtgccaagcaaggcgggcggagatcgatcgagatcgaagaattagttgcagtgatttaattgtttgcatggcaccgacgacgaccatgggaagcgcct

SEQ ID NO: 16478 - DNA, 1409 bp, Oryza sativa
attttttcctgtattttgcaatcatctgttttacacttagggcccatttgaatcacaggaatgaaaaaaatggaagaatagaaaaaacataggattctgacaggaattctagtgtaaaacagaggattgcaaaatacaagaaaaatataggaatgaatgtttgattgggccgcaggaaaatcacataaatttgaggagagataaagactcaaagtattctttccatgaggttctacctttgaatcataggaacgaaaaaacaaaggaataggaaaaacataggattctgaacatgagagagatagactcagaggaaattttccaagaggttagacctcttgctaactttcctccaaaatatacataggattacccattccataggaattttaaaggattggataggattcaatcctttgtttcaaagaccttcataggatttttttttccatcggattgaaatcctccaaaatttctatatttttcctacaaatcaaagggccctaatttcctaaaaaaacttgcatgggaagaggcattccataggaatttcataggattccatagaatccattcctttgattcaaagggccatataggaaaaattcctataagaataaaatcctctaaaattcctgtaaatttcctttgaatcaaagggcccatatattcctatcaaaatcctatgttttttcatattcctacgttttctcgatcctgcgattaaaaggaacccttatttcctccaaaatggcaaaagttttgctgttttagggcactttttgccaaaatagatctcaacactagtagcaaaagtttgtaatttggcatttgtcatttggaagtctagagtaacaaattttggtaaaaagtgtgttggaagccgtgctctctctctctctgcctttactagtaaaatggcaaaactttaccatgcatgtaaacaccaactagcaaaacttcaatgccaaatcttttaccaccaaaacttttttaaaaaaaattatcagaccaaattaatctaaacaggccataagaaaatgtactccgtacatgtagtacagatgatctaggcgtgcgtgcatgcatgcgtggcccgccatggacgcgtccaaagatcgcacatctccagaccgtcaaatacagctagctagtaccagaacagcagagttccctgtccacttcgttgtctcgccccgcggtgggcaggttgcgcgccactacgtactgcccaaccctcgccgcggtatcgtaactcgtaataagaggttgagacttgagacggggagacccaaatcgctcgtgttgcgcctataaatgtcgttgattgccgcatcattacttcacaagttcacatctccatccccatcgagttcttcgttttctgactcttgtcagcatggcacgct

SEQ ID NO: 16479 - DNA, 1501 bp, Oryza sativa; identical to SEQ ID NO: 16075

SEQ ID NO: 16480 - DNA, 1501 bp, Oryza sativa
ccgccgatttttaattaaattggtgaacccaatagtttaaaccattagatatattttattttaaaaactaataacttattactctgtgtacgtatgcgggagatatatataacaattaggctagaaaaagaaaaaaaaacataagtagtccctacgtacatacgacttgaaaaaataaataaagcttaaccgctatccatcgaaagttcggaacaaagaaaaatctccgcatggtggtctttcgaaatagtattttcaaaatcccttactataaaaacaaaaaaaaaagcgtatcattcgaaaaagatcgatggtcttttgaaatagtattatataatatttaaagataaatatattactctacaaatttacgtaaatatacgtagttaaactaaatctatattacaaatatgaaatatcccatcaatgatctttgttcgttcgatcttaacatacgaggttgatatatataataattaatgttttgatattttcttatttcacatcatattttagggtgtcaaatatcactcgacaaatattaaatgctaatttaaatttatatttgtgaaaatgaaaacaacacaatttagttgtttcattttacaccgttagattaattgtttctcctatatacggatatatgacaaatatataactgttgaccggaaaaagtactccgtacgtacatatggttgaaaaaaaacaataatgcttacatattgtttgccggaataacataaaacgtatttatgataaagcccccaaaaaatggcagtccttaaaaaataattttctacgaattaaggataaaaatataataatcttcaaatttacgtaaatgtaaatataaaatatacattcaatgcttttaagcattctatcttttaaattattttaaaattatatatccaatttgtgatccggttgtattcctttaaataaataaactactaatatctatagccataaatacattacaattatggaaccaacatgtaataattaatgttacgataataatttcacatcatattttaggtgtgaaaaacacttgacaaatatacaacactaatttaaatgaacatatgtattctccaaattactaaaggtgtctcatgtgattagaaacaataggtgtggaaaacaaaccggacactgaacgaacatgcactacagcacatatatttgtcaaaatatgatacggtactttggagattatcgtggtagtatttagaaaatcaacgtcctggttacgtataaattcttctattgttttgggataaaatttacctccttcgatttatgtgacagagggaatataagtaatataagtctatctttgattagatgaagtagtatcattagttatatttttaatagaaaatatatttcattaatatataataaaattaaaatattacttaaagtcatctatagcatacaaaacaaaaaaaatgttatataaagtttggaaaaattttaaaaaaagaatcacaca

SEQ ID NO: 16481 - DNA, 884 bp, Oryza sativa
catcctgttcgtcagattatcccatgcacaacatgagtatctatctatctatctatatctatatctctatatcttctatactaattgggcactttctatgaactctcatattaatcaggcagatctaaccgttaattaagtagatcagataatcttaaccatagattattaatatctacttaacgtcacggcctcatgggccacgcaaagcccatccaatttttcactaatgtatgtacacaacatatctgccatacgtacttaatataatttttttaaaaaaattgttgccacaataaatgtatgtatttgtacgaattaactactttgccggattcgatagattaattcgaagaaaattttaagaactatatattatatctttactttcttgttcactcacgcttcaattagtttgaatcccataaggtttaatttttttacttatccatgagaattgaaacatctttctaagtgaagaaagtacgtatgcacatattatacttagtacaaacagatagcctacacataagtgaaaacacattcatatctagcagaaacccataaagttaatataacaaacttgtcaaaaatattatcttatattatttgacaatcagaaatatatctatctatctatacctatactaattgggcactctaaagaagctcccacgttaattagaaacatcccactgttgatttgatagatcgaattatcctaactatagattataataaattttaataagcattaattaacgttatgggccttctttaaagcccatcaaacaaccaatactttaatgacctttccaatatctgtctttatctcaacgcctcttcgtttttttgttttgtccacactgcaacgtcgtacaaca

SEQ ID NO: 16482 - DNA, 1501 bp, Oryza sativa
cagttcagcttataaatataaacatttcatatgaaaaatggaaaagtactcatcggtgacgggctttagttcatgcccgatagagattaagtcatctcaatcggacattagtatatagcccgtcactgatgagtcatctgtgacgggcctaattgttatctcaaacgtgcctcaagttggtgcatgccacagatgatggtcatctgtgacgggtcccaacttgaggcccgtttgagatatggaatgttatctcaaacgggcctaaagttggtgcccgtcacatatgatggtcatctgtgacgggccgtaactttaggcccgtttgagatgtggaatgttatctcaatcgggactaaactacggcccgtcactgataggtgttatccgtgacgggtttaagttttatgcccatctaatatgtctgtgcgatcatatctcaatcggacactttttggtccgattgagatgacttccttgtgatggcccgctatttctaggcttgttagaggccgtcacagatagaaagatctgtgttagtgtgttatattttattttatattgctcatttgaacaccgcttgcctgatgtgcataaaaggaaaggttcacattcagtccaatcaacacgggacttcataatgtaactgaacaataatttcataatattctaaacacacgcacatcaaactctccaatgccggacgattcaacgtggtctataaaagggaaatcagagagattaaagattagataataatggagatggaacaggattaatcgaggagtggttgcaagcatcagagtgccatgttggaatgagatgcagtcaggagtcaggagaaaagcgcgattgctaatcggcgcgcgccgcgcgcgcatttctggcccataaggcccagcgccggcgcgcgcgcctcccactctttttttttttttcattttttacccattttttttcgctttttcctttttttgtgattatttttttaatctttagcatattttgagtttgaaagttttaaattttgagttgaaaatttttaaatttgaacttgaaagtttttaaatcttgacttgaaagttttcaaatctcgatttgaaagttttcaaaattttcaaatctggacttgaaagttttcgaatctcgagttgaaagttttcaaaattttcaaatctggacttgaaagtttacaaatctcgagttgaaagttttcaaaattttcaaatctggacttgaaagttttcgaatctcgagttgaaagttttcaaatctcaaattgaaagttttcaaatttttcaaatctggacttgaaagttttcgaatctcgagttgaaagttttcgaatttgagttgaaagttttcaaatctgagttgaaagtttttaaaatttgactttaaaatttaaatcgaaaattttcaaatgtaacttaaaaaattttcaatctattagtaaaaacatctcctgaatctttcctaattactatctttagtgttaagtata

SEQ ID NO: 16483 - DNA, 1370 bp, Oryza sativa
cctgaggcttgcgtggcctattaccggtccttgaatttctgaatgtcattactgtgagctagtggaagtaaaattgtgtgtgaagctgaatatccttttggtgttcaggcctaagcttcgggggccaaatcacctgtagtgtctgcagatcaaggtttttgcttgtgattgtacatgtgtgctccctggaaattttatcgtactagatgcatatgctagtttgtccaccattttcctgatgcttcttattcataccactcttggatacacagtggaactcaatctattgttcacgccttctgtaatcgtattcagctccatcctttttctgttgcatggcttgcaattttgtgatggatactaagtgagcagtgacattgtctttcaatggtaaagttacactcatcgatcaaaagatgggatgatggatatacataaggatattatccatttcacaaccatgtctttttccacattccgagatcaacccaaaacaacaaaataagacatgcgtgttacagtaacaacttcgacttcaaaacgttactttataccttgcacatcaaaaccacttagtgtaaaagaagagacttgaatattttttttaaaaaaaagtaaaaaacatacaaaaaaacagttagaaatatatatatactgtctggagttagaatatcttttgagttgagggtaaaaattatttacgcatcatcccatcttcgtactagatttttgaagttgtagctagctgttgatctctatgcttcacaaactatactatcttgtactatgttgtaactgcatagttttattcttttatttcaacttgtggtgttaaatgtaggtaaatcgtgaattttgcagcttaaaagaaacatattttttttgcatttaacgaaaattagtacatgaagtattccacagtttgggtgagttcctttcactcaaacagagccaagagtagagattcagatcagctgcaagactaacattgctgaaagttagcacacatgtactgttcactacttaaaaaataatttttcccgacacttggattttattttttcaagtggactaaaaatattctcgcttgtgaaaatatcagaagttctataggtctagccccaactgaaaaaaataatcaatttatacaagtgggatctaaagaagtttgcctgtgaaaatacccttcattttcgcaggtagacctccttagcctccacgtgcaaaaatcaatggcagtcgggacctaaagaggcccgccagcaaagcgtggaggcacttttttatccagcatcgccagccaccgacaagcaatccttctccctcacctacgccctccctcactcaatctccctcacacctctactagg

SEQ ID NO: 16484 - DNA, 1501 bp, Oryza sativa
caacctgtgatgtttcgaggatcggataatcaggttgcctatctcggatttgtttgcgttggagcaaggcaagttattattccacccctttgagcattattatcctatattctatatctctattattccatgcattagccattcatgattttaaatgcataacttgaacatatagcaaaccagatatatgctagattttgcttagccatgcctagttagattgcataaaatataatgaacttagattggaacagtacggtagaaatggttgatttccgggtggctagtactgttccaaccgacataagattgccaagtacatgtgaagaacgaacgagtacgaccgcaattctagaatggggacagacttagcaaagtaggttatctaacaaaggtggtacctctgtatagtggttcttctttaagtcctcgcgcaggaggcaaatttacgccgagcagggcgattataatatttaccgaggcgcgggtaaatatattgattattgcgcgctgtgtgtgtattgtgaaaacctggttgggacgacgggggtctctcaaccagttctctctaaagacctcgggaacgccagaactcctctcgctgctgataacgttacgttcagagcgcatgaggatgagagttcatggaacaggtgccactgatgttagtaaccgaaaagctttgccatgactaagctgatgaatattagcatgtcatggattgcgggtaaagcgtacatctactgcagtatgagtatctctgaaactattcgaatagccgtgctcacggatattgagcatcgggactcactatggcatcttggttagaaatataactccagatttattaaatactgttgcatttcaacacattatagactttctccttctaatttctcagctttctgcaaatagatctagctctactcaaatactattatttcatacattcatacttaaatataatagcttgctgagtacgttatactcacccttgcttcaacccctcttctttcagagttaatttggagttcttgccgaagccgaaagttcaatcatataagttagtttcatttcaacctagttttcaagtctagatttgttagatggtttaagtctatagtaaaaccacaacttgctgagtacgttatactcacccttgcttcaacccctcttctttcagagttaatttggagttcttgccgaagccgaaagttcaatcatataagttagtttcatttcaacctagttttcaagtctagatttgttagatggtttaagtctatagtaaaaccacaatattttaacctagttttcaagtctagatttgttagatggtttaagtctatagtaaaaccacaattttaaaacattaggattgagtcattttatagcttctgttgtattagttagccacaattttgtaaattcccctattattttgtaatataaactccttccgaatcgaatcattagttttgggaccagatagcgctatttg

SEQ ID NO: 16485 - DNA, 1255 bp, Oryza sativa
tgcgcccgcccccatcgccgccgtcgccgtccctcgccgccgctgccgccgccgcgcccgtccaccaccgtcgccgccgccgtcgtcgtcgccgtctacaagggacgactgcaggtggccggccgcgcgtcgggatgctcctctccccaacgggatgtccagttatatctagcaggaatcacctgatacctggtaggtatcatccgatacctagtaagtatcacgtgatacatagcagaaatcgtcggtacctgacatgatacctcgcgagtatcacgcgatacgtggtagaaatcgtctgataccttacaggtatcacatgatacctcacgagtatcacacgatacgtggtaaaaatcgtctgatacctgataagtatcacatgatacctcacgagtatcatacgatacgtggtagaaatcgtatgatactgtaacaccctaaaaaaaaaaggcaggcaagctagcagcagcagctgggccaggctcggtagcaggccggcccaagcggcagtagtagcaggtcgctacagtaccgtcgtggtactgtagcagccgattagtaccacctcgcctaactagcttgaggagcaccaagatataaggacgagagcctagaggctgttaactctgattctggaatttttgctttaaagcgaatttttgctttaaagcgaggatgaaaaacgtagtgagttgcagtattaggtgtggtccaactaaatgagccgttttcgggccctgcacaaatggtatcagagcagactctcgcggttgcgcgtgcgggcatatagcgcatgtgggctccgtgtgaggcacatggcatatggcgccggcattggacggtacggtcgtgcgccaaaagagggcggcgtgttcgacagttcgacggggtcgtcgaacccctgagggtgggtggaatgtaacaccctaaaaaaaaaaaagaaaggcaggcaagctagcagcagcagttgggccaggctcggtagcaggccggcccaagcggcagtagtagcaggtcgctacagtaccgtcgtggtactgtagcagccgattagtaccacctcgcctagctagcttgaggagcaccaagatataaggatgggagcctggaggctgttaactctgatttcggaatttttcgttaaagcgaggaccgaccacaaatagcgctatctggtcccaaaactaatgattcggaaaccgacatgtttatactgtatcaagcttcggaaaccgaccacaaatagcgctat

SEQ ID NO: 16486 - DNA, 1501 bp, Oryza sativa
gagggtgtcgacgtacgagtgctcgaacgtggtctccttcttcggctcgccgttggcgccgccctgccgtttcttgtactcccgccgcgcgttgatcagcggcacgaacagctccgtctgccgccggcggagggcgtgcgccttctgaaggcgcccgcgcaagaggtgcttggtgaccgccgggaagaaggcgaagacgggcatcttgctcgacaggtagaggagcgcgtcccgctgcgcgacggcgatcgcgcgcaccgcgtcctcgtcgagccgctcgccgaagcacatgagcaccaggaggcagaacatggcgtactggaacgtctccacgacggcgtgtggcgccgccgcgtcgccgttctcgtcccgcagcttctcgacgagcacgcgccgcacccacgcgcgcgccggcgcgaacagccgcacgcgcgacgggtgcagcgtctcggcgacgaggttgcgccgcaggaggcgccacacgggcccgtagctggcccgcgagatgaggttgtcgctctcgccgagcagcctcgtcgacgccatggcggggcgatcggccagggacgcccccttctcgacgagcgccgcgtgcgcgaggcggcggtcggcgacgaagacgagcagccgggacgcgacgcggagggagacgacggggccgtgccgcgcgatcaggcgccggaggaggggctcggcgtcggccagcgaattggtcagccacaccgtgctcccgagcaacggcacggccggaggacccggcgggaggcggccgcgcttcccgccgccgcggccgccgcggcgggagaggatgagccggaggaaggggatgaggacgaggattgcggcgacggcgacgtgccacgtgtccatcttcgagtgagcgcgagcaccgcgtaccgtgtggctacttcagtgggactcattttatatggttaacacgtgtcgtaattagcacgttattaggaggtttttaactgcttgtgtttaagtaaattcggttgtatttatcggtttattatgctttatgccaccgtcgcgatctcgattcgacttgcggacgaagtgaacggaagggtccacctccgctgacgtcagggatgatgatgaacaggaataaatacgaagaaaaaaaattctagaatattttcttatgcgacaccttgtttccacatgactcgtatgatccaaggtctaacgacatgttcaagaaaagagcagataaaagaaaaccaattctgaatacgatttctctctcgagaaaattgcatccaatccaacaagtcatagtttgttcagacttcaggactctaacacataataattttgaattaagatttgaaaattacatccgaacaacccgtagtttgttcagactcttaaactcataaaattatccaaactcaatcgtattcagcgttgacttgatgcgtctccctataaatgtaaagccgttttgtctcacccgacgtacaacaacgacaccaatcgacgacgacgcaga

SEQ ID NO: 16487 - DNA, 1501 bp, Oryza sativa
tatctttgaccttattttttctattataatatatataataaataaatgcatgtttacttttattatagtgctttaaaagataaatctatatatgttgttctagttcctttaaactaaatatttttaaagttattgatggttaaagttataaaagtttgacctcacccttgtccaaaatatcaattaatatgaaactggagggagtatcatcttgtagtttggattatcctaataaatacaatgcatgcatccaatagaattagagaacatgagtatataggatttaaaaaagtaataatttaatggagaaggggtaatagttaattgcctacatgcatgcatgccttatatatggaacatctagaaaaagtggttgtgccttatattatgtaatggaaggagtaatcatgttttatcatctcacaacaataaaaatactaattataaaaaaattcatataaaacggacagttaaacgtttgacacggaaacccaggtttatccttttgggacgaagcgagtatagctgagacttgccggtccattctggaggcatttggacactatgctttcatagtcaaacaattacgtctgcttgacagatcagaagattctaacgtatatactacatccgtttctaaatatttaacgctattaacttttttaaatatatttaactattcgtcttattaaaaaaattaagtaattattaattttttttcctatcatttgactaattgttaaatatactttcatatatatatatatatatatatatatatatatatatatatatatatagttttagatatttcacaaatttttttaataagacgaacggtaaaatatgtgctaaaaagtcaacggtgtcaaacatttaaaaacggagggagtatttatcagaaattctaccatccaccgaggtatttttacttagatccacttatagcatgacactgatattttacttatattaaaaaacggatggagtacttatatttttactaattttttacttacattgatgtatcagtgtcatgctataggtggatctaattttttttataacttttatctacctaaatcaaacagttgagataattgttagtaaaaatttaataagaaagaattaatacgtgtagcagtgctctaaataatattatatctttctttgtagaagcatggataccaatagaagtatctaatagcttaaggtgtaaatacacctgtaccttatttaatactagccattcatccatttcgcttttccaatcccacctcactttcatctagttaaatcaaacggttgagaaatttgttagtaagacttttgtaagaaaattttagtatgtatagcagtgctcttcgccaaacacaacctaaaaattctttccttctttcaccaagcttccatgcatccgggcgagccgcccaacttgatcggagtcaagtggccgagtcgccgctataaatttcggcagccaccaaaacatagccgccat

SEQ ID NO: 16488 - DNA, 1009 bp, Oryza sativa
ggctctcgtcttgacgggacggggcgaggcgtgcgtcagaccaccagtcgccacctaaccgttgatccgaccggtctgtgactggtcacagaccggataaaagagcgcgctgcattgcgctgcatgcaacgtgacacgcttgaccagaccgcaataaatgcggttaggtgagccctaccgtgttcacccaacctatgtacatagtgcaaaccccacagggggtcggggcacctcggccctcggggtcggggcaggagcaacccgaccccccctcggggaaatcaggaggaggacggacacctcaccctcgggcccgacgtccccgaaggtgccaggccacgtgggcgattccatctgcctcaagcctccgggcgcaatactcccggtcccatatcaccgacagtagcccccggcgttatgtcagggcaatcatccttctcaagggaagcggtcgggcatgacgccactcataaagcctggtgacaggtgggaccggtctccgtgattgggcagaaacccaacggtctcaaaccacgcatatcggtaacggtgtcttggccgtcagtcatgggcggtctcttcaagactgccacatcacttgagcagcgctcgaatctgggcgtgtagattcgtttcgtctggagatatggtaacgtcgcttcggtcagcgagcgtaattaacgcacacacgatacgatctatctcgactgccacaaccgcatatctaccttatgcgccgtaagcgggcgaatggaatttagtggaagcgtgggcgcgagaaacgagggagcgagatagcgagtaacgagggagcgagatagtgggcacgagaaacgaggagccgggctcagcgatggcaagggtataaagctatcgaggaaaggacttgctcccttccttttcgccactattcccctttccttcgccgtttgcgcccctaactctctctttgctgcgcctcaccttcgccacacacactcgttctcaaccctctctttctccgacgaca

SEQ ID NO: 16489 - DNA, 1501 bp, Oryza sativa
ccgactggtcgtcgtctcgaccgccggcgattggcggggagaaggtcatcatcaggcgaggtgctgcggatcgccgtgccgcggaagaccgggttccaggctttcgtcgacgtgagaatcgacccggacaccaagaggcagaacatcaccggatactgcatcgacgtcttcaacgccgccatggctagagtgcggcctcgccggaagtacgagttccacgtctttgacggatcgtatgatgatcttgtacgcaatgtatcttcaggggtaagccttaattactcccacgaacttgtttatttttagttgaattttttagtccttaagaaattaacttgagatacctaaattttacacgaggggcctcatcttttcacttatgcttatgtttatcagctaaaatttgaaatctcaaccttaaatttgcaactgattttagggttttttcattgaagtttatttttcagcctttgtttttatattgttaaaaacacatataaaaagttttattcacaaattaattttcgtttacaaatatgccggggctgtaaaatttttggtactacatgtaaaaaatatgatagctctccagggtaccttattaaaaattataaaattatgttatctatactccctccattttaagttatttgttcattctagttttgtagtcctaagtcaaactttggtctttgactatcaatatttctaaaaatctaaaatctaatatagttaacacaataaggtttatgtttccagatttaacttgaataatactttcataatatataattcacatgtgtggtaaattattacgattttacagaaatcagttgatgttcaaagataaacatatttggaattaagacaaaactaaaacaataattaatttaaaattgagatagtagtaaaaacaatagttttatgtttctaaaacatttattttttcctaacaaggctgattatattaaatataagaaaactaaaacaaatcaaaggcataagcttaaccaatttaccaggaaaagagcactttatatttttcacttttatatgggagatattagatttaaccgcattatatatcatttgtaattgaggaattttaccgaaaattttatagaaaataattagtaaagtccgtatgttccttgggaaatctaattaagaagtatcatataatatcgcagcctcaacataagagcatacaaattgtaaaacaaatcagtttaaaactagagtttgtaaagtcaaattataatgaattgaaattgtatatttttttataaaatacaaacaaaatgactcattcaattgctataaatatattcgcatatttaggtataaagatttctggaactagaaatagctagctttaaaaaaatatatatatgtgccaattgtcaaacagggactaataatttacgccaagtccctttgaatgacatttctaagaattctcgctgacatacatcttctgtcttatggtatcttcagaagt

SEQ ID NO: 16490 - DNA, 312 bp, Oryza sativa
acacttatcttctcctcttcgccgctacttgcacctccccaccacatatctgctgctcttcgccttcccgtcagcaagaacagctttcacaagctcttcagcctccctccccaggtaacaactgcagcttattatcttcagtaatctccatatgttcattcctatccctcctctccctatacagaagtgggtcagatccaaacatctgtaatagaacaatataggaaagtattagagcaaacaaactaaacatttttttgatctctgcaatgggcacgcgttaaccaacaggtcttctatttctttcctaga

SEQ ID NO: 16491 - DNA, 961 bp, Oryza sativa
gatttcatcggaatataattaatgtagcatgggagaatgtgtgcatgctaagggtgtaattggcatggtgttttaatcgatatatacattgtgggagaatgtgtgcatgatgtcttgattgatgtgatttaaattatcattggccttggcgtataaacatatatgatgatcaatttgggatggaaggagtaatgaacaatgaatcccagttctagccaggcaaaatattcttagaatcatagaaatggatggggtattacatcttcgattaaatttcacaaaactacagatactatgaccaaattatcacaaaactacatatttaactcagtgtatcacaaaactacacatttaacatcaaatttatcataaaactacacatttaagatgaagtgtcacaaaacacatgtttagtaactaaattatcataaaactacgggtttagaaccaatttaatcacaaagtaataatgtttatagctccaccataacaatggtgctagggatttaaactccaaaagttgtagttttgtgataagttcaatattaaatatgcatttttgtgatacttaacctaaaatctgcagttttgtgataaatttggtactaaatgtgtagttttatgatataactccttaaatctgtagttttgtgataatttggtcaaaatacctgtagttttgtgaaatttactctacatcttctgataaaaaaaacacatgttaaaacatggcctgccctgctatcattttttttcttctgttactagttcctgccaagatttcattcaagtgacagtatatctgctggaacttgacctctctcattttcaccctctctgctagttgtatgggggcattaaaacattcacagtggtgctgttttatcttcattctcgaatgtgactaatttcgtttatacttatgtgtatgaaataacttggtgtgtgttcctattgcagt

SEQ ID NO: 16492 - DNA, 1501 bp, Oryza sativa
aataactcggatacggaaacgaatacgaattatcgcggatacgaataaggatcgaatatgatcggacacgaatacgaaaacgaatatttctcggaatatagagaccactcaaactgctcgtagatacaaatgcaccacatatatttatctaatttaatataaatatcatcgttgtaggacgcatcacagattaaacaaagtgtatcgtgttcaaatcgaaacacgttgaaaagttcaacacatattgagttctagttctataggtaacaaagataagatcaaaatagtaattagcccaaagcaattttcagtacacttgcagtctgatgcatgaaaactgcaacatcattattcatccatttcatccatcagaatatcatcctattccatgttgtcggtgacatggggccggaggtatcgtgactagaggcttgggtagccgcggtcacccacgtggcctgaccccctcgggggggtcgggcccgaaggtgacgtggccacccctccctctgtctccccgaggggtcgggccgctcccgtttcggccccgagggctggggcgccctgaccccctgtggttttggcgccacgtgtgtgggttaggtgagcacagcgggttcacctaaccgcatttatagcaggttggacgagcgcgccacgccgcatttaatgcggcgcagcgcacgcttatccggtccgtgaccggtcgcggtgagtgaccggtcacagaccggtcagatcgcgggttaggtggcaataggcggcctgtcacacgcctcgccccgtcccgtcggaatgatgaaagcttcctggctctcgtccctagccggagccggcatgccaactccaggagttggtatgtcagtcccggtcagatccattccaggcttcagtgcaagtatggcaaggaagtcgctggccattaaatgaaggttgaaatgggcgtccaccggaaaagcgggcgagcggggcaggaggcgtatgctctgcttgtcagaggtcatttccggctgtagactagccctcattgtaaaaagcatgtttcccttcttaggcagctagaggcccatgtggtgacccctgaccagataaaaaggagacccaggcctaagaaagaaaaaaaaaagaggagaagagaggaggggagttgggactctggcgaatggtttctagagcctgaactctctctcgctctcggctctctggattccttcactcacagatccaccagaacacaggagtagggtgttacgcttctcagcggcccgaacctgtctacgtcgcccgtgtcttgtgcatttcctttctcgctgacgttcctcagatcgagggcgaagaacctcacttagcgtccccggccgaaccggcaaaggggggcctgcgcggtctcccggtgaggagccccacgctccgtcatctggcgcgccaggtagggggcgcgcgtgtctttctaagcccttgtcctctttcgtgtgcgccaagcttctcccgctcagcccaa

SEQ ID NO: 16493 - DNA, 1501 bp, Oryza sativa
ttcctcgccgaggggggtgtagaaccaatcgctcttccagtcgtcccactttttgcggaggacgcatggaatgtagcggttcagcacctgaccccgcggctggaagtagcagccaccgactgccgtcggcggcgacaccggctgtacggtgaagaaccaccggaacagccggagagatgggcgcaccctgataaacatctcgcacaggtgcgcaaagatggccaacgtcattatcgcgttgggggtgaggtgcgccatctggagatcataaaactccagaatatccatgaaaaaaatagagaatggcgggaccagccccgccattgcgaaagagaggaagaagacggaccaccccgggtagtgtggcgccgggcgtcccttgcccagcgcgaccacctcccgaccggtggcagattccggcatgaatcggcgcggcagcccggcctgcctctcgctcacgatgcgggaaggcggcagcacgctaccgtcgagcggtgcggagccccgtgccatgacgccggcggaggaggagcttgagagcgagcgagtgcggcaagggtagggcaccagaaacgaagagttagagcacaagtggcgaaggcaaggggaagagtggcgagaggaaagaaacgaatccctccctcggcgtctttacacccttgaaaacgctatgcccggctcctcgattcccgcgcccactacctcgcccccttgtttctcgcgcccacgcctccactaaccccgctcgcccgtttgcggcgcacgcggcagatgtgcggccgtggcggtcgagatggggcagatcgtgcgcgcattaactacgcccgccaaccgtgaaatgcgccgtcatcatgtctccaggcgaaacgaaccggctcgtcccgattcgcgcgctgctcgagtaatgtagcggtcttaaagaggccgctcattattgtcggtcggttttcccttgccgatgcgcgcgatttgcgaccgctgggtttctgcccgcctgtagggaccggccccacctgtcaccgggcctaaggagtggcgtcacgcccgagcgcttccctcgaggggggcgatcgccctggcgtaacgccgggggctactgtcggtgacatgaggccgggggtatcgtgactagaggcttgggtagccgcggtcacccacgtggcctgaccccctcgggggggtcgggcccgaaggtgacgtggccacccctccctctgtctccccgaggggtcgggccgctcccgtttcggccccgagggctggggcgccctgaccccctatggttttggcgccacgtgtgtgggttaggtgagcacagcgggttcacctaaccgcatttatagcaggttggacgagcgcgccacgccgcatttaatgcggcgcagcgcacgcttatccggtccgtgaccggtcgcggtgagtgaccggtcacagaccggtcagatcgcgggttaggtggcaataggcggcctatcacacgcctcgccccgtcccgtcggaa

SEQ ID NO: 16494 - DNA, 1501 bp, Oryza sativa
agccgccgccgccagatctcccttcatgcatctcgatctctccgatctcgatctctctccgtcgcgccgcccgccacgagacgccgcgccacgacgatgacgcgccacgacgacgacgcgccacgccgccgccttcgccgccgcgcaacgccgccgccgcatgccaacgccacgccgccgccgccgtcgccacgccgccgccgccttcgccgccgcgcgcgcaatgccgccgccgccacgccacgctgccgccgccacggccccgcaacgccacgccgccgccgccgtcgccacgccgccgccacgccgccgcgccaaccgccgccccgatgccgccacaccgccgttaacgaacgagaacgagaacgatcgaacgaacgagagcgagaacgaacacgtcaacgtacgttgccgcgagaatgtgaacgagaacgagaacgatcgaacgaacgagagcgagaacgagaacgatcgaacgaagacaagcgagaacgagggaacgaacgtgaacgagcgaacgaacgaggacgaacgttaacgtgaaatgcaatatatatatatatatatatatatatatatatatatatatatatatatatatatatgttactttgcatttatcctaatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 16495 - DNA, 1501 bp, Oryza sativa
cggccgagcgccgccgcgtagccgtcgacgaaggcgccctcgatgtcgcggaacgtgttgatgacgaagccatcggcggtgcgctcggcctcgaccgcgtcgcgctcctcctcctccaggccaggccactggaagaagcggcggaacgtggccgtgtagacgacggcacgcaccgggaagtccggcacctcgaacggctccagctcgccgtcaccggcggcgagcgcgaggcggccgtacacgccgtgcttgctcaggttgtgggtggcgaggaggaagtacgccgacgggcagtgcatgacgacgcgagcgatgccgaggcggtcgcagacgggcgccgtccacgggttgcagtagtcggcgacgaggcagtccgggcggcgaggcagcgcccggacgagccgctcgagccgcgccgccatggcccagatggccctctgcagggacaggtacatgccggggtcggcgtccgccagctggtccatgttctccagcccctccggcacgccgaactccgggccggggaaggcgacctcggcgaggtcgacggcgaggccgtcgcggcgggcggcctccacggcggccccgttgcgcgcggcgttgacgggcgtggtgacgacggtggcgcgcgcgccgcgggcggcgagaaggcgcgccacctccaccatggggatgatgtggccctgcgctatcagcggcaccaccaagaaatggagctccgccgccatcccgccgccgatgagtgtgaggaagcaagcaagttgcagtgtgcgtatacaagtcgacgcgacgaggacgacgcctgtgtcgaggcgccgcgccgcggcggcagaagcctcctggaaaagtcgggagggaggggtgatgacgtatgcgcctagcgaagcttcgtcgtcgcccgcctcgtagtcttcacagctgcctctgtcacgtggactcgtggctcccaagtccaatttcaacaagaaagttttttttaaatgcaacaaacaagaaggtaattaattgagttttaattatttcaaatttaaacaaggatttctttgatattttagagcagtttttatacagaaagttttcacacgaaacgtactgtttagttgtttgaaaagtgtgttaacaaaaacaaggtgtgtttagttcacgctaaaattgaaattttgattgaaattggaacgatgtgacggaaaagttggaagtttgtgtgtaagaaagttttgatgtgttggaaaagttggaagtttgaagaaaaaaattgggaactaaaccaggccaaagataagattctgcgtactggcctgaaggcatatatattgccctctttgtttaggcttataagccaacttataagttgaaaagtctaagccaaaacaaacaagtagctttttcatttggcttttttgaagccataagctattctaacactattaagccaaaagctaggttggagaagcttttttggcttaaatgagatagatgtatgactccactactaaactta

SEQ ID NO: 16496 - DNA, 1501 bp, Oryza sativa
agtggcgaagtcgcgtgtcctccgacctccctgagcgcctcccccgcccaagatttcggcgagagggggacggtggggtgcgagcccgacggcgcgggttctgctccccgtcgacaccgctagcgttcggagagaggctgtgcgccactgcccgttcggccattgggctgagcgggcgaagcttggcgcacacgaaagaggacgagggcttcgaaagacacgcgcgccccctacctggcgcgccagatgacggagcgtggggctcctcaccgggagaacgcgcaggcccccctttgccggttcggccgggggcgctaagtgaggttcttcgccctcgatctgaggaatgtcagcgagaagaagcgcacaagacacgggccacgtagacaggttcgggccgctgagaagcgtaataccctactcctgtgttctggtggatctgtgtgtgaaggaaaacagagagctccagagccagagagctctagagcgagagagagttcaggctctccaatcaagtggccagcctctcacctcccccccccttttttctctccttaggcctgggcctcctttttttatctggttaggggtcaccacatgggcctctctctgcctaagaaaagaaacatgttttttacaatgagggctaatctacagccggaaatgacctctgacaagcagtacacacgcctcctgctccgctcgtcagctctcccggtggacgcccgtttcatacttcattcaatggccagcgattttcttgccatgcttgcactgaagcctggaatggatctgaccgggactgacataccaactccaggagtcagcacgccagctccggctagagacgagaaccaggaagctctcatcattccgacgggacggggcgaggcgtgcgacaggccgcctgttgccacctaacccgcgatctgaccggtctgtgaccggtcacataccgcgactggtcacagaccggataagcatgcgctgcgccgcattgaatgcggcgtgacgcgctcgtctaacccgctataaatgcggttaggtgagcgccgctgtgctcacctaacccacacacgtggcgccaatcaccacagggggtcggggtgccccagccctcggggccgaaacgggaccggcccgacccctcggggagacagagggagaggtggccacgtcaccgtcgggcccgaccccccccccccccccgagggggtcgggccacgtgagtgatcgcggctacccaagcctctagtcacgatacccccggccccatgtcaccgacaatcgtttactccgacaatggtgggagtgggataacgggacatggggtggggtgggcctgggctgggacatggggtggggtgggcctgagctgatgcatgtttggcgcttgtaatattaggagcgcgcctaatagtagaactacaatttaatgatagattttacatcaaggaccttagaagtttttggccatgctcaacacttggataggtttaac

SEQ ID NO: 16497 - DNA, 1501 bp, Oryza sativa
agaggatgagacgattggaaaaatagcaatatttatattagttaagatatgactagaaaatgggcgtgcttgtgatttttagcccgtaggtattgctaagtgctagtatttcaagatttatagtgtcatattattttaggaattagtttagttatatattgggttaaacctatccaagtgttgagcatggccaaaaacttctaaggtccttgatgtaaaatctatcattaaattgtagttctactattaggcgcgctcctaatattacaagcgccaaacatgcatcagctcaggcccaccccaccccatgtcccagcccaggcccaccccaccccatgtcccgttatcccactcccaccattgtcggagtaaacgattgtcggtgacatggggccgggggtatcgtgactagaggcttgggtagccgcgatcactcacgtggcccgaccccctcggggggggggggggggtcgggcccgacggtgacgtggccacctctccctctgtctccccgaggggtcgggccggtcccgtttcggccccgagggctggggcaccccgaccccctgtggtgattggcgccacgtgtgtgggttaggtgagcacagcggcgctcacctaaccgcatttatagcgggttagacgagcgcgtcacgccgcattcaatgcggcgcagcgcatgcttatccggtctgtgaccagtcgcggtatgtgaccggtcacagaccggtcagatcgcgggttaggtggcaacaggcggcctgtcgcacgcctcgccccgtcccgtcggaatgatgagagcttcctggttctcgtctctagccggagctggcgtgctgactcctggagttggtatgtcagtcccggtcagatccattccaggcttcagtgcaagcatggcaagaaaatcgctggccattgaatgaagtatgaaacgggcgtccaccgggagagctgacgagcggagcaggaggcgtgtgtactgcttgtcagaggtcatttccggctgtagattagccctcattgtaaaaaacatgtttcttttcttaggcagagagaggcccatgtggtgacccctaaccagataaaaaaaggaggcccaggcctaaggagagaaaaaagggggggggaggtgagaggctggccacttgattggagagcctgaactctctctcgctctagagctctctggctctggagctctctgttttccttcacacacagatccaccagaacacaggagtagggtattacgcttctcagcggcccgaacctgtctacgtggcccgtgtcttgtgcgcttcttctcgctgacattcctcagatcgagggcgaagaacctcacttagcgcccccggccgaaccggcaaaggggggcctgcgcgttctcccggtgaggagccccacgctccgtcatctggcgcgccaggtagggggcgcgcgtgtctttcgaagccctcgtcctctttcgtgtgcgccaagcttcgcccgctcagcccaa

SEQ ID NO: 16498 - DNA, 1501 bp, Oryza sativa
ggcggcggcgctaaagcggcggctaggagggagagggaggggaaaagaggggaggggggtgcctcaccgagggtggccggcgcggaggaagacgatggcgaacagcgacggcaagccacgggaggacgacgtcggcgggcggacgagcttcggggtgccctaaggaaggagaagagagggattagagagaggaagatggaccacggcaaccggaaaccatggccgaaggcggcggtggaggtggtgctcacccgagtgcgagggaacgagggctccggcgacgaacctcgacggaggaggggtggacggggtggatctcggccacgcgaacccgacggcggcgacggcgcggcctggcggcgaccctaacggcggctagcggcggccggagtagcggaaaaggcggcggcaaagggttgcacggcgcgggagcgatgggaggctcgagagagtacggcggaatggggaaaaagtgagaggggacgacggcgatgcttaaatagggggagaggggaccggacgtggccgggagaggcgggaatcgccggccgacgtggggggtggcggaggagagagaggcgggattcgaaaatcgaatcccggccatctcgggcgcgggcgcgagcgggagagagagaggagtgggcgcgggagacgcggcgcacgcgcgggcgtggtcgacgtggcccggaggaggcggagacgtgggtgcggcggcggttgcgggcgcggcggcgcgagcgagatcggcgggaggtgggggaaggacccgacaggtgggccccacctgtcggtgaccccggagaggagggcggcgggacggcctggctgggcctcggcctgcggccggcctagcaaggaggagggggaaggaaaggagagaatgggccgacggcccattcgaaaaaaaggaggaaaaagagaggaaaaaagaaaaagaaaaaggaaaaaaaaggattttccctggaattaaaatattgcttgctcaattttaattggttaaaattatttctagagctctgaaaattccactaaaaatcctgttaatgaatttcgacatgtagaactcaagaaaaattccacatgtcaaatctgattattatttgcattaccttcttagggttttctcttgatttgcacctgcattttcttagggtcatttataaattaaattttaggcttgggaggagaactttggggtgtgacaaccgccaaggccaggtcaagctcccatgacttggaggaaattcagaaccgaccatccacgcaaggccgtgatggttgttgaagaagttcaagccctccgcaaggagttcgacgcccagcaagcaagtagccatcaacagcccgttcgcaagaaggtcagaaaagacctttactgcgccttccatggacgctgttcgcacaccaccgatcaatgccgaaacattcgacagcatggcaacgcgcaagatccaaaaccgcaacaaggagtagctgttgaagcacctcacgaagctgt

SEQ ID NO: 16499 - DNA, 1501 bp, Oryza sativa
agactcaatcaacataatggcaaaatatcggaggcgactccccgtcgggcggccgatagggaggggtaaaatcggggcgctgcagcgccacgtatgcgtgaaaaacactttaaattattttttcttttaaattatttatccaaatcatgatccgattgcaccattaaattcgttgcaattaaatctttaaaacaagaccacacatggatatattacaacgaaatttttttagcttattattgaattatttttaaatgttgcacgatgttccaccaggttgtcagggttatggataccacatacctaatagtagtcgactaaatttcggcaggacccaccacataccatgtcctatacggaaacaaccttcagatataggaggagtttcatataaggaaggatgaatagagtcctacatggaaacaacaaggactactcggattgtatccatattggttttccctacttctacttagacaaggggacacctattggtataaatacaaggcctcctaggaggagaggggagacggaacaatagatcaagacacaagatcaacatacaagccaacatgcgccaagacaagacgtcggatatcgacttcagagataagcatggctagtcccctacggtgtctatgatactgatatgagagatgtagcgctgtctttgatcttgctgaatgcggattcgaggaggaaggctaccctgttgtcgactacgagtcagcacttcagaccgccaagtcgacaacagttagataggctaccccaaatattgtactggtgtgattatggtgaataagagcaacgaccagcttcggccaacaagggtagggttattacctgacaattcaggggtccgaacctgtataaaaatcctcgtctccgtctcttttacctcaatcttgcatatatccgagtaccaacgatccccatactatgaaaataccggaatcgcgacatcaaacgtcgacacacgtcgacacaggtatatcggaattatttcactaagtagataaaaaatgttttaatcgtttaaatcagatgttgttttaccttatataaaaacaatgtttcagcaaatagtgaaaagatgtttcagtttactgcaatatttgaaccatacatagagaaacaaaaaatgaaacgaatttccttaatagagggtttccaaaataggtgggtgatttgttgtaaaagaatgtttcgttcactgcaacattagatcatacggactcaaacaactcaaatagatatcccagtagctgcccaagattagatggaaacataagcatagtaggaaacgtaaatacgttatctgcttgtctcgtctgtttgccatgaaaataggaacgaaaatatttaagcgaattgtcgaaacatgaattcggcaataataaaaggggtagcgcacgagacctaaaagtggatgatgcggagataaacgatttagacaggttcagaccctctcaatgagaggtaataccctactcctgtt

SEQ ID NO: 16500 - DNA, 1501 bp, Oryza sativa
agctcgccaaccgcatcgaagcaaggaaagggtaatggtggactctgtgtatctcgctgaacaaggggagaagaggcaatagtgcatgactagcttggattagttttttttttttcggggaagagctgggaattactattgctcaaccgacagactagcttggattagttgacatcaccaaaggaggtagcagctaggatggcaaaggattgaaggccagcgtgaacttgggtctggcaactagacaaggagtggcggatgaggggcaaatgatgcaaaatatggcaaagctaggagtggaagatagatgtgcctcgatccggagcccaaggaacgggtctatgggaggatagaggcgaaatgtggtaatataggtggagtggttggagtgggagcacgttgatcttacctaatatgttgttcttgatatgaatccatgacaaatatgatagggttaattggatccatgctattataacgttgccacttttgagaaatgtcactactattcgttaaattagaaacatgtcattatgaatcagctgattttggaaccatgcttctctctgcaccccaagcctcttttgttgacttgaatagacatagttgcccctggttgaatcataggtcgatggcgatggcaaggtggggaagacgacggtgaccacgatgaggagatctggcgaaagcaaggtggggaaggcggtagtggcgaggtcgacggagacggcaaggtggggaagtcgacggcgatggcagcgagatctggtgaaggcaagttggggaaggcggcggcagtgaggtcgacggcgacgacaaggtgggaaagatgatgacgaccacggagaggacggtagctcaggaagacgacgacaacgtgactacggtgagggctggagcttgggaaggtgacgatgacttctcggggccctagattcgccggcgagcaggctggatctagccagcggcgcggtgccgatatgggagaaaagctacggagctacaccggagaagcccgctgccaagctcgcgcttgccgctgccgtcgccgtctccaccttgccaccgccattcctgaccttaccgttgcgccgagctcacgcctgctgcagacgttcctgacctcaccatcgccggatctgctggcgagcttgcgctgctgcttcacgccccgtcgccaacgacctcgtcaccggcgttgctcgtagctccgccatcgtcaccatcgccgcactctctggtagggatagggatataatatgatgcaggggcattttagtcaatacgaatatacggaacaacaaatacggtcaacaaaggggcttggggtgtagagtgtggcatggttccaataatcatcatataggtttatgcaccaagaccaagaataatttaaatcgcatcaatcaaaacaccatgcaaatattctcccacaatgcatgcatcaattaaagcaccatgcctagcatgcacacattctcccatgctacatgaattgtat

SEQ ID NO: 16501 - DNA, 1501 bp, Oryza sativa
  unsure (1)..(1501): unsure at all n locations
agagtgcggcgaaatggggaaaaagagagagaggagaacggcgatgcttaaaaagggggagagggagccggacgtggccgggagcggcgggattcgccggccgacgtgggggagtggggaggagagagaggcgggattcgattttcgaatcccggccatctcgggcgcgggcgcgaacgggagggagagggggaaaggcgcggacgactcggcgcacgcgcggacgtggccgacgtggcccgggagaggcggagacgagggcgcggcggcggtttcggcgcggcggcgcgagcgagatcggcgggaggagggagacgggaccgacaggtgggccccacctgtcggcgaccccgagaggagggaggcgggcggccggctattgggctgggcctcggcctgcggccggcccagcaaggaggaggggggggagaaaaaggaaatgggccgacggcccatttcgcaaaaaggaggaaaaagaggggaaaaagaaaaagaaaaagaaaaaggaatttccctggaattaaaattgcacttgctccattttaattggttaaaattatttctagagctctgaaaattccactaaaaatcctgttaatgaatttcgacatgtagaactcaagaaaaattccacatgtcaaatccgattattaattgcattattttcttagggttttctcctgatttcaccaacattttcttagggtcatttataaaattaaaatttggctagggaggaaaacttcggggtgtgacagccggggagccgtcgccggaggggagccgtccacgtcaccgccgccgctgctgccctcccccggcctccctccagccggatctgggaggggaggccgggaaccacgtcnccgccaccgccgtcgacctcccccggcctccctgcagtcggatctgggacgggatgccgaggagccgccgccgagtccgcgcgccgacgccgccgctatcgccggtggagggagggaggggaggggagggggagctgagaagccagtggagggagagagagagagttgagaagataagtgtggggaaatgagttgtggggaggggttggaggagtagataagtattaaagtttttttatttttttgggtaggtacgatttttgcaggcggaccacataaggtgcgcctgcgaaaatagattttcgcaggctccgcttaggtggaccgcctacgaaaatcgccgcttaagtggtccgagcgaacttcaccccgatttatatttttgtaggcggtcatttaactccaagggtcatgtccgcttgcgaaaaaaagaccccatgtcgggaaaaatgctttttctagtagtgcgtgactattttatcgatcatggatatcctccttcactctctccctattctaagtatagggtaaaagatacaataaaagatacaatagagcatattgtaatttagctcaacttggtgtgtgttggaatgaaggatgagaagtccttttatagcttgagaatgacggtt

SEQ ID NO: 16502 - DNA, 488 bp, Oryza sativa
gtacccacgaattcagaaccccagagtccgcacatcctcaaatacaaagcacttccctattagatgtaggttagacttgccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatcttt

SEQ ID NO: 16503 - DNA, 1501 bp, Oryza sativa
ttaagagcgaatttctcgtgtttcatgtacgtaaattaacaaggggcacacgtacgtagtaggaaattaacactctctacggggccggccggggatgcgagatctccccgccgctagctaggaaattaagtactccctccgtatgtatttttaatgtatgacgcagttaatttttcgaccaatgtttaattatttattttatttaatttttttttaaatatgaaaatatttatgtcatgcttaaagaacatttgatgataaatcaaattacaataaaataaatgataattacataaattttttttaataagacgaatggtcaaatgttggaaaaaaatgaacggcgtcatacattaaaatatagaggtagtagtagggaacgaggacgcttgtacatttggataaattaatcaatccttttgcttaattacctgcatggttggatacgttacataacactttacactatacacacagaggcctcttcatttgcaagcatacatgctaatatatggaagtggatttttatccttcgagaagatatcctcttaaatttaaataagaggatatcttcttaagagagatgatttgagtttggatacgtgacataacactttacactatacacacagggatctcttcatttgcaagcatatatgctaatatatggaaatggatttttgtccctcgagaagatatccttttatttttaaataagaggatatcttcttaagagagatgatttgagttttctaatatacacttcttctcgatatttcaattcaaaaataaaaaggaaattaaattacgaaggaaaaaacggtgcaggtagaagggctagaacccgtcacctattgagtacaaacctaacaatccatccactacagcaagcaaacaatactgttaaggtgctcacttatgtaacattttagatggatgggagctcagcgccccaccaatgacgtggtgtccaactcagataggctttagcgccaaaatttatggcgctgaggttttgacctatttttcaataattttttgacacggactaattttcaaataagtttttaaaaggatcaaattgtcaaaattacggtgattcaagtggcgattaatttgatccgaccaaaataaaaaaaaagaagttaatagagagtaatactaattgatatgggctaccaatgttatcttgctcggcccttgtgcggcccaacataattatgaacgtgtgttctaatatgtttctgattcggaagtcggaacgcgtactcacgagataaaatagagagagaagcctagccgccggtaatccctagctagaaccacccctccgcaaatcaaattgagatcgaggtgtcgagcgatatggctggagacactattacagacccttctatctgtgacgggctctaacatgtctggaaatagcgggccgtcacaagaaagtcatctcaatcgggcattttagcctgattgagatatggtcgcacagacattagat

SEQ ID NO: 16504 - DNA, 1501 bp, Oryza sativa
ctatctccaaaccaggaatgtaccattccaaaccaggagctaaattaattaccatcaattaccacattattattaatgagtagtgtaggactaatcacgaaagacattgttcgacccgcccataaccgcgggcacggctattcgaatagttttactctggccagaggtgtaccactgtacccacaagacacaactccacaatatgtcaccatatcatcatgtgcccatgctaaacatgtcaccatttgtgtagttgtgacaagacccctcgcatatgtcaactcaaagcagtgcaccgttcctagatcgtagtcaccccctcaaaaaccagaggcatggactccccagcgacccccgtgggcttatctctgccacttctcagtctggcactccacgatgagccttgctatgcaaagtgtccagccgttgcccattctggcttgtggttgacacggttaatgtttcacaaccgaaactcgtgaaccggtccttaattgtcatgagcactaccatcaaaaccatgtgctcacaacccaccattatcaagttttagttggcacattaattaattcaccaatcacgattaaccatcgtgagctatcattaaatctctaccattaagtaatagtgaaacattagttatcccaattatgtgctaatgtttctaagcatggctaagcaattatatctaacatctagctgaaccaatatataaagctcaactagtcaaattataataacccaatgtatcaaggaacagtgtaatcaatgcaaattggccatacaaaggaataagttcacaccacccggtgacattcgaaaataaatgcacagttgaaataaataaagaatttaaatatacgatcaacatggtcaaaggaattgtgtttgggatctgtgtgacttgccttgcaataacgggtcttcaattagtcttcttgaacacttccggcgcactcgagaaccttcgaaacgacggaaacgacaagctaacacgcaaaacgaggaaaaagactaataaaaaccaaataaacaatacataagaagtaaacaaacatgtagataataattttagatgaattaggagacttgaacggcctcactctgacttcatatgaattaattatgaattttacaagatttaatctaattaaagcccatttaaaaaaattaaataaatttaattcaatttatggataattttaatatgtagatctttattttatacaacttttgcaacttgaaccacattaaactgagttacaatgaattagttatgaatttttaaagattaaaccggattaaagcatttatatagattttaattgaattatgacgcaataatgaattatttttgaaaagcaaaagggatttattgcgtcatcaaagatggtccacggtagaccgggtgcatagaggcggtctacgaaaccaacggccgagatctaatctaaacaaaatggacggccaagatcgatctaatccaccacgggtctacggc

SEQ ID NO: 16505 - DNA, 1501 bp, Oryza sativa; identical to SEQ ID NO: 16504

SEQ ID NO: 16506 - DNA, 1501 bp, Oryza sativa
aaagaatactccaatcctcttctgtttcctgggcaaaaatgtccgaatttacaattaattcggcctttgaatcaattgcggcgtgcccctagctctctgtccagaaacggtcagaccggctgtgcaaggccagtcagatcgcccctagtctgtgattttgccaatttcgctcaaagatctaaaatcaagcaccagctcttctaatatcaaaaatactccctcttcacattatagccagatgcttgctgtgctaaatcatttgccctaggattatcatgcctaccaatatgtctaatagcaaaattatcaaaactggcaataatatccaagcattgatcaagataactatttagtgatccgtccaaacagtaagctccggcaacttgttgcaccaccaattccgaatcaccaaacgcttccacgtgtttagcgccaaccatctccatcacttgtaaaccaaataataaagcattgtattcggcttgattatttgtacaataatattccaaatgaaccgatgcctcataacacatgccattaggtgaaaataaaactaccccgatgccttgaccctctttgcaagaagaaccataaaaataaatcttccaaggtataacttcaattaagattcctcataagcaatatccacatgatggtctactataaaatcaactacaatttggcctttcaaagatttcaatggtacaagttggtatcagagccgaccttgaccgtaggacaagccaactggaaaacctaagagccctctgaaccctttttcatatgcacatgcctttttcacttggatttgtttcgggaaactttggggtttgatcttttgattttgggagaaaatcttggtcgcctatttaatcggatctcttgactagggacagtccagggttttagcaaaactttatttggaatttatttggcagccagtcgggaattgttaggtggtatgcattaagttgtgtctagattcgatgggatgcagtctttatgcgcatcattattatcatgcatttatttcatgcattaagttattgtttagtcagttgcattagtgtcttttgtctgggttcatgaaaaatgttccatgcataaaaatcatcatgcttggctagttgcttgggccatttgttgctttgtttaaatttggatttgagcatgcattgattcctatcccttgtctaccttagaagtcaaacctgttcttcgatcgcaagcgccgctccgagcttcagagtcgccgcccttagctttatcgtcttcttagtctgtttgcgtgctagtttttgtgtttaggtttgttgcttgtgggttagtcggcggtcgatatcatgtgtgagtggtatgacacccttaattaggaattgcgtgcctctttttcagtgttttaatcaagattaagataactgcacttaattttataagaaagattagtttccgagccatctgttttcttcctttctcttatttctacctatcctcatccaga

SEQ ID NO: 16507 - DNA, 1501 bp, Oryza sativa
cggctgtacagatctaatctccaaaccaggagctaagcaaattattaccagtcataacatcaataattattgtgagaggtgtgagactaatcacgaaaaacattgctcaacccgcccataaccgcgggcacagctatccgaatagttttactctggccagaggtgtaccactgtacccacaagacacagccccacgacatgtcaccatgcgcctcaataccaccacggtacctcggaaaggagctgtgacagtacccctcgcataacacaacccaccacagtgcacctttcctggatcataatcaccccctcaaaaaccagaggcatggactccccagcgacccccgtgggcttatctccgccacttctcagtctggtgctctgcaatgaaccatgctatacgaaatgtaaagccgttgcccacgctggcttgtggttggcacgattaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataataatgagtcataagttatcccaataatgtgctaatgtttctaagcatggctaagcaatcatatctaatatctagctgaaccaatatataaagctcaactagtcaagttataataacccaaggtatcaaggaataaagtaatcaatgcaaattggccataacaaaggaataagttcacaccacccggtgacatttgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaaaccaaataaacaatacataaaaagtaaacaaacatgtagattataattttagatgaattatgagacttgaacggcctcattctgacttcaaatgaatttattatgaattttacaagattaaatctaattaaagcccatttaaaaagaattaaataaatttaattcaatttatggacaattttaatacgtagatctttattttatacaacttttgcaacttgaaccacattaaactgagctaagatgaattagttatgaatttttaaagattaaatcggattaaaaacacttatattgattttaattgaattatgacgcaataatgaattaattttgaaaaggaaaagagatttattgcgtcagcggctagggtttcggtggaccgggcgcacgagcgacggctcacgggaacggacggccgagatcgacttgatccaaaacggacggccgagatcgaacggtccacgaccggctcacagagaacgacgacga

SEQ ID NO: 16508 - DNA, 678 bp, Oryza sativa
ctgcagttggtccgttttgcttcactggtccgttctgtactccagtgatagaatccaccgatccactttcatcctcctcatgttgtatgttcctaagcacaactaaagtagaacacttaggtagtataacattctcagaagtactgaaattaaaatcagttaggaatgaattcacctgaacttgtagtttcttggcacgacttcttgtaagtggaccttgaattgtatcctttgtgtttgatgatggttgcttggtacttgaagtagcatgcacggttgggatgtcctcatcatcaaccctagatgctgatgcaataaatcccttttccttttcaaaaataattcattattgcgtcataattcaattaaaatccatataaatgctttaatccggtttaatctttaaaaattcatatctaattcattgtaactcggtttaatgtggttcaagttgcaaaagttgtataaaataaagatctacatattaaaattattcataaattgaattaaatttatttaattttttttaaatgggctttaattagattaaatctagtaaaattcataataaattcatatgaagtcagaatgaggccgttcaagtctcataattcatctaaaattatgatctacatgtttgtttactttatgtgtattgtttatttggagtttcttagt

SEQ ID NO: 16509 - DNA, 1501 bp, Oryza sativa
cggggagggggcatgttgggccaaactcggcccaacggcttaaaggaggagttttggaactttttaattaaaaaaaatttgtgaaatgttgtttaatttattaaaaatacttcccttgctcaaataattcccagaaaaatctagaaaatagaggagcaagtgtagtatttaataaaattttatctagctcatttttatgttgaaaattttcctagattattagggtttagcttgtcggcttttaatttaaatttctaaaaattccaattaaacaacaatttatataattaggatttttagggcgtgacaaacctaccccccttaaacggaatctcgtcctcgagattcagaagaactggcaaagagatgcggatgagctgacttcaattcatcttctcgttcccaagttgattcttcttctgaatgattgctccactgaaccttgcagaaccgtataacgcgattcctggtattcctctcgcttacttccaagattctgactggcttctcaacataagttaaatcttcttgaagctctatacgatcaggatctgcttcctccgtaggtacacgtaaacacttcttcaactgagacacgtggaacacgtcatgtattcccgccattgacggagacaactctaactgataagctacctcacctcttcgactcacaatcttaaaaggtcccacgaaacgcggtgccaatttccctttggtttgaaaacgatgaacacctcgtaacggcgtaacccgaaggtatacataatctccttcttcgaaagccaaatctctgcgacgattgtcggcatagctcttctgacgtgactgagcaacgcgcaacctttcttggataatcttcactttttcttctgcctctcgcagtatgtctgtcccaaaaacttgacgttcaccggtttgatcccaaaggagcggcgtacggcactttcggccatataatgcttcatacggagccatttgcaaactagcttgataactgttgttatatgagaattccgcgtacggcaaattcttatcccaacttccaccaaaatctagaacacaggctctcaacatatcttctaaaatttggtttactctttccgtctgaccatctgtgtcacatcctgattttcgtttcaggatttataaattatttaataaattattaatagaatttatattaaatgttctttaatttacaagtgaagttaaatgtgggaaataaaatttcttaaatctaaagcatggatggatttaattttggttaaattctccatggttaagtcaactctctgaaattttctcggatttttcagagctcaattcttaaataatacaaagaacagttcagtaattatttgatcattaatgatctaagtataattgttaagagcttttcttgtttaaaaatccttaaattataaattgttgtttaaaaggaattattagaaatgattttaaaagtctaaaagagaagatctaattttaatttgcaaaatct

SEQ ID NO: 16510 - DNA, 1501 bp, Oryza sativa
cggggagggggcatgttgggccaaactcagcccaacggcttaaaggaggagttttggaactttttaattaaaaaaaatttgtgaaatgttgtttaatttattaaaaatacttcccttgctcaaataattcccagaaaaatctagaaaatagaggagcaagtgtagtatttaataaaattttatctagctcatttttatgttgaaaattttcctagattattagggtttagcttgtcggcttttaatttaaatttctaaaaattccaattaaacaacaatttatataattaggatttttagggcgtgacaaacctaccccccttaaacggaatctcgtcctcgagattcagaagaactggcaaagagatgcggatgagctgacttcaattcatcttctcgttcccaagttgattcttcttctgaatgattgctccactgaaccttgcagaaccgtataacgcgattcctggtattcctctcgcttacttccaagattctgactggcttctcaacataagttaaatcttcttgaagctctatacgatcaggatctgcttcctccgtaggtacacgtaaacacttcttcaactgagacacgtggaacacgtcatgtattcccgccattgacggagacaactctaactgataagctacctcacctcttcgactcacaatcttaaaaggtcccacgaaacgcggtgccaatttccctttggtttgaaaacgatgaacacctcgtaacggcgtaacccgaaggtatacataatctccttcttcgaaagccaaatctctgcgacgattgtcggcatagctcttctgacgtgactgagcaacgcgcaacctttcttggataatcttcactttttcttctgcctctcgcagtatgtctgtcccaaaaacttgacgttcaccggtttgatcccaaaggagcggcgtacggcactttcggccatataatgcttcatacggagccatttgcaaactagcttgataactgttgttatatgagaattccgcgtacggcaaattcttatcccaacttccaccaaaatctagaacacaggctctcaacatatcttctaaaatttggtttactctttccgtctgaccatctgtgtcacatcctgattttcgtttcaggatttataaattatttaataaattattaatagaatttatattaaatgttctttaatttacaagtgaagttaaatgtgggaaataaaatttcttaaatctaaagcatggatggatttaattttggttaaattctccatggttaagtcaactctctgaaattttctcggatttttcagagctcaattcttaaataatacaaagaacagttcagtaattatttgatcattaatgatctaagtataattgttaagagcttttcttgtttaaaaatccttaaattataaattgttgtttaaaaggaattattagaaatgattttaaaagtctaaaagagaagatctaattttaatttgcaaaatct

SEQ ID NO: 16511 - DNA, 348 bp, Oryza sativa
ttttcaaaaataattcattattgcgtcataattcaattaaaatctatataaatgctttaatccggtttaatctttaaaaattcataactaattcattgtaactcagtttaatgtggttcaagttgcaaaagttgtataaaataaagatctacatattaaaattatccataaattgaattaaatttatttaatttttttaaatgggctttaattagattaaatcttgtaaaattcataattaattcatatgaagtcagagtgaggccgttcaagtctcctaattcatctaaaactattatctacatgtttgtttacttcttatgtattgtttatttggtttttattagt

SEQ ID NO: 16512 - DNA, 1501 bp, Oryza sativa; identical to SEQ ID NO: 16504

SEQ ID NO: 16513 - DNA, 1501 bp, Oryza sativa
tgaaaatacaaagccaaagaattgaagacaaaatataaagctaataaaacttgcagtaccatgattagtagacagaactttatttaaatttaatttgaattggcaaacgaaactaacaaaattgacaaaatttcagaaatcgtcaaccattgctaatcttgttcaactttatctcaaaactgaaaactgtcaaaactaagtattgttcactcaaaattttgtgatgaggcattctaattactgacaaaactaacaaaaccatatgtactattaatagattacaaaactacaaaataacaaaagaatatttcaaaaattatctactgctagagaaaacaaaaaacataaatcatgcttcgtattcgagcaggtactagtaacaaaggtaacatcccaaggctgaaattttgataatatagctacatatgatcagtgctaacttttcgacacatatgtgccataaggaaataagtatgtttggagttgggtcagaaacatatataattacaatgaatttgcctttaggaggagagcgttgtggtgaacatcacccagttgtgcggcatcatgtgcccattgaacactaggaccacaacgaaaaagagatctgactattagtgcaatctaatagtaaatataaacagagttgaaacaaagaaacatcatcctccataaccacatcaaaccacagaaaaagcaggaaaaatagaaaaaaaatcagatttactgaattttcagaccttggccatcagaaaaaggaattgacataggaatgcacgttcaaaagagatgagctgctgccttgtccattaatggtgaaaataacgttagactcaagaacaaatgggatatatcaatggatgaaattcttctgtgctaataaaatgaaattgatggcaacaaacctgcagctgaatcccatgagctcctttgcaacaaatcccagcaaatatgccatgcagtagaatggcaaaaggggatgcaatatttgtacatttcacttttagttaccaagacgtatatatattcaatcgcaagaacaagaacctcttttacaaacacacaaactacataataattgttgctaattgtgcatcataatgccaataacaaaaacaaattagtttagtacatatagagtattgtgaaaaatctatcaaaaccttcatgcagattttctgaaaatctgctcagtacccacctagcaatctgatttgattatgctgccctgttatgaccgccattcctaatggatggatcatttatgccgccaatatattataactagtataatatgccttgaagcacgaaagatcaaaataattccaatgattacattttagggctattagttggaaaacaaaattcagaaccatatatctctggaaacaatgtaaacaacatatatagtagagttgaattaaaaatgcactttagtttggttggtttacccctgcaaatggtgataaaattgacgagcacttgaaaattgatggaaaca

SEQ ID NO: 16514 - DNA, 488 bp, Oryza sativa
catgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcaga

SEQ ID NO: 16515 - DNA, 1501 bp, Oryza sativa
acctccacaccaactgcaagacccaactttgttagctctccattcttccatctttacaaatacaaatcattgactcgtgaaatgaatggataatatatgctatctagtaccatgggatcaacaatgccggtgccgtcctttgccgcctcggtgaagtcgctgccaaacttgtccgcaaggatggtgcgcgcgaacggcaactccggcaattcgccgcaccaaccggcggcgagcatgaccgacgcggccgcctcacgtatctcatcggtgcactcactggacacaccaaatacaattgtcatgtgaccggaaaagagatagaggacgcgatcaagtctagtgtgaggaaatgaaatgtatgtacccaggcttgtccagctttgcagcatgctcgatgagtcgcttgcaatacatctctatcatttcgaacgcctctaacatgttgtcctcccctatgacttgctctgcctgtgaggagagagcaagacattgctggcattagcacgcctcgccttggagcaatgtggatccctctcttcatcagagaaggtcgtagacacttacccggtggatggcgcgatcgaggtggtcgagggtgagaagctggcgaacatcatcggtggcaatggatttgcgagcgaggtggggccggcgagcggtggcgatgcgcaagacggcgagccccaggagggtcttgagcttgctcgtctgcttggaggtcttccgatggaggaaccccattgttaagttatcggttctcggcggcgttcctgtcctaggctgttggttatatgaactccgaccttatcagttgtatggtcagttcctttgcgtgggggaaaggaaggaggaggagaatgcgagttgcttgtgtgagctgatggaggaagtctgcatgaaggggcaagggttttgtagggccatgttgcttctgttctgggtagtttaacttttgtgtttgttgcttcactttggtgtacatgaactgtcgtactcctttcttgcatatggaaaatattgggtgggggagcaattgagcatctcctagagaatgtcaatgagcaaagcatgcagaatgcaatgagaagacagcgagccaaacgtgcttacgtgcaaagaaatttaccgtatgtaaaacgcaaacaacatgcagaaacaccaaagccagggtaatgtgctgctctgcttcaagcagttacgaaaggaagcacaatttgtgcgtggtgaattttattttaagatggtacagtgaagacgagcaccgcatgcacggctgagatagcaactagttcagtagttttactcgcagataacaaagccattacacatctaggcacttatgcagagtgccatttttcaggtgtagcgcagcagcagcagcagccgtgcatcgatccaaactttgtgcaaatagcgtgcagagttgtgcaattcatcgatcaccccgtaaagactcagttaacccgtctcctttcgcaaaacggtgattacaactcctttg

SEQ ID NO: 16516 - DNA, 1501 bp, Oryza sativa
gaaagtagcatgttcataaaatctcaataaaccaaaaagatacattcaacaatcactgataaatcagccgaagcatgaaattttgtttttattgtagacccacaactcatagcctagagcttttgagaagtcagaactaagtcagtcgcaagtcacaacatacagcatcaggaactaaattagtcgcaatacaccacagtacaactccatcagcaacaagccacacaaacaaaaaattacgggcaaccaaatctcacagcagatcaggacccgtacctccccggtggccgcgaagcagttgtagatgtagctctcgtccatccagggctgcaggtcgccgatccagagcgtcttcacctcgtccgcggccgcgggggcgggcatcgcctgcggcggtggcgcggcgtagtacggctggggcgggggcacctgcccgtagtgcgcctgcggcgggggctggccccacatcgccggcggctgctggggcggcggcgcgccgtactggtgcggcggcatcggcggcgggatcgcgccccactgcggcggctgccccgccgcgccctgtggcggcggaggcgggccgcccatgccgggctgcggctgcgacggcggctgctgcatcaatgcgacgagatgccctagctagcacgcacgaacgggagagagagagagagagagactgagagagggggaggagacgtggggggatgcagggttcagatatggccgagaccgagagagaccacttcccgtgggccgtgggaagagcccgtgatttgctcgttgcccgaaaattccttttttttttgtcagcttggggaaaaatgctcctttgctgcttgattggcttttttttattgttttctgcttgattggctttttttgttttgttttcaccagaaaattgagtgtaagtataagtgtgtcgtatattttatttgttttcaaatataagtaattatatttttaaaatttatatgcagtataagcaatttaaggacattgatccctgtacttaggaatctatgcattttcaagtaatcaagtgtttacaagaggaatctaagtagtttaggttactttcgaatagatgtttgggtttagcttattgcaacacgcaaaatgagataagttattaagtattaattgttataagcttataattgatttttttttgaaaaaataaacttgttatagaaaacttatgcacgaaactaccgtgtacttcctccgtccttgaaaaggctttgacactaactaggataatgaatcacttagattggttttttttaagaagaagtagtttgaaaagtgtaccctcgataatctttgctggggaaactaaaaatactaacgaatagagtagttcagtcgtattcaatataattgccatttttctcactttcttttgcttgaattatttctgttaccaggaccgctccacgattcggacaccttgtgcaaaatctccttggtcaccgaagcgccggtcgccatgatg

SEQ ID NO: 16517 - DNA, 1501 bp, Oryza sativa
catcgctccctcgggtgccaatattggcattaattgacaaaagttcgccgcacgaatcaccaagtgagtttttgccatgtatgcacccaatacactccaatatgtccaaaaatcatgttttggcgttttttgaactttttgattccggtcaaaaacatcgcaccctcgtgtgccaatatttgtattaattgacaaaagttcaccgcgcgaatcacgaagtgagtttttgccacgaacgcaaccaatacactccaaatatgtccaaaaatcatgttttggttctttttgaactttttcataccggtcaaaaacatcgcaccggtgtggtccaaaatatgctaatattggcattaattgacaaaagttcgccacgcgaatcacgaagtgagtttttgccacgaacgcacccaatacactccaatatgtgcaaaaatcatgtcttggtgctttttgaacattttcattccggtcaaaaacatcgcacccgtgtaggccaaaatatgccaataatgacattatatggcaaaagttcgccgcgcgtgatgtgaccatgactactatagatacaaccgtcgttcacatcaagatcaggccgtccaagttctgcaatccagttcagccacctgcaacagaatcgacttcagacggccgccaaatatgcatgcgagctcccttttgggtccatgagtacttgatggaaagctctcggagtcatctttcaaatggatccagcttcatcaccaaattccatcccagtcggccgaaatcacaaaaagaaggtgctgcgtcacctataatgggcttgtaacttcgtctgggaccccggcccaagtggggcccaagtggggtgcgccccaaccaggtggagcacgaccctagggttcccttaggtcgtcctcccaccttcttaaatagttaggttcccctttagagtttctcggggttttgatagattaaagtttagccattgctacttgcttacagcgcgcgtgtcggctagaccgtccgtctgcttgttcttcggaaccccaacttatcatttgtattaaattcctatttgcaatatcagattgctttttatcttgttcttgcttgtttcttcgatttgcttgcaggaataaggttgatctgcaccggcaagatcaacaacccacagagaggtgtatcgatcgctaaggcgcaacacaacgtctcgtacggttgtagtcggatcgtcaacgtttctcccaaattgtagttatcacaactcaccgaaagatcgggccaacaaaagccttgagtgttgagaggaactccgggtccatcagcgcgaatcacgaaatgtgtttttgccacgaacaatcccgatacactccaatatgtccaaaaaccatgttttggcgttttttgaactttttgattccggtcaaaaacatcgcaccctcgtgtgccaacattggcattaattgacaaaagttcgccgcgcgaatcacgaagtgagttttttccttgtatccaccca

SEQ ID NO: 16518 - DNA, 1501 bp, Oryza sativa
gcgcgggagtcgccggcgttggcgacgacgacctgtgttgggctaacgacggcgacgacggcggtggaacccgcgtggtcgcgacgcgaaggcgtctgctgctcgcacgggcaggcgggctcgtcgtcgctgcgggtggacgcccggttaccgacctccccatccatccgcgcgaagctcttctccatcacatccctccaaggcgccacttcgccggaggcccccttgttgtgctcctcggcgacaatctcgtgcatcctgtcctggcacgtcgtcgcaacctaatattcatagaactcgaattagcacgctgaattacatgtgcacagatcactatccggttcgcacatttagacatcagcaaacacttacatgggagcagccatggccgtcgaagacgccgtaaaaatggaacttgccggatgccggcaagaagtccggtctgatggacacggcgtcttccatctcgcgacggcggccgcacacagcggtgaccccatacctcgggaactcctccgtacggccacaactcggccgctcagacgccgaatcctcgtcaggacgcggggcgccagacgccgtgcgcgccagcctctgccgctttccagggcgcccatcctctccggcctgcagctcgagatcacttgcgatgcggatgcgcctcatctccatcctgcggcgccgcctgtctatcgccgaggagacggctgcggcggccgaggcggagaccgctgccgcgacagcagccgtggcagtggccggcggcgacatggcctcctcgcagcagatctcggccatggcaagcaactactccaattactcctccttcagaagcacagccggccgcgcgccacccaactccgacggctcgctagattttctccgcgctcccaccaagtcgccgtagccctcggaaaacgtgaggcgaaacgaagcaccgtctcgcacgcgaaacaagcgcctccacggctccacctcacctcacctccctctcgcacgccttcgggttcggccccccttctcccgcggtatggtaataacagcagctgcagcagcagacaagcagtagtagcggaggcgcgaggtgaggcgacgacacgcaagcacgaaggcgggggtggtggggggagtagaagagaaggtaggggggaggagaggaggaggaggggaaggagggcaggtgcccgtcgccgtcacgggcagcgcccgacaggtccagttgttgtgacgtgctcccgttccggggaatctgagccgtccatctccacctgatctcgacgcgtggccacgccccggcccggcccgcaacacgtggaaggtatccgtgcgccggggcccacccgcggtagggtccaccaggcggttgatgttaacggcgatcacgacgccggtgttatcgcctaaccccgtgctgccaacacgtggcgccagcccgccttcagacaggttatttattgatgcctggtggggcccaccccacatggggtctctctcatgggcg

SEQ ID NO: 16519 - DNA, 1501 bp, Oryza sativa
ccccattttttccctctctctctctcgcgttcaaacgggcggatttgcccccgcaaatctcgtcggcgccattgatggcggccggacctcccgcgccggtgtccttcccctccggccgctctctcccccttccaaccctatttaaaccctccccgcgcctccctcgcccgtttccgccccttgccgcaccgtctccccgctggaatcgagctcgcgccgtcgccctctctctcctccgtcgccgacgacctccggccggccttctccgctcgccgggaccgtctcccgccccggcgtcgcctcctccggcttcgccgcactgccgtcgaccccgtccaccccctcgccgagtccgccgaccgccgaacgccgtcgaccccatcgacccgagccgcgtcgccgccttcctccgctccggtcgcctttttcgtcgtcgccgtcgacctagggtgagccgtggaccgccgcctcttttcctccttcccttcccctctctcggccgccgctccgccgtgcctatggccgccgccggcgaccatagggacgcgggcgccgcctcccgccggccgcgccgagtggccgccgcgtggggcccggccgtcagccgcccgcgccctcgagtgcggctgacgcgtggggcccacggcgccggccggtgcgagcccgggtgcacccggtccaccgtggaccgtgaggctgccgcgtgggccccactcccgtggacccggtccgcgcgccccctcccctcggctgacgcaataaaccctttttaaattaaaatttaaatgaagaaattcgcaaatattcatttaaagagcatataaacttcaaatggccataacttggccatttgaactcggaattggaccgttcaagtctcttttttttccttaagaagtcaagaacccatttttgtgctttgttcctacttgttatatggagtttattagagtaaaagcccttttatttttccgttggtcatgtagacgttgcagcttcggaagatccgctcttcgtggaggttgaagccgacgtttgggaaagtgagcaaggcaaatcacatcatccttgaacatattgaatcccagtttataaaattattttgatttaaattattgcactatcgctttatttaaattctcgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggaatactcttatcacctggacactatggaatggttggattattgtggaattggattcacacctccccctctattcaaaaccctcaaaatgattttaggctgggcttggggtgcatggttttgatagtagcacctcggccatataaggaccggt

SEQ ID NO: 16520 - DNA, 1501 bp, Oryza sativa
atactcgtcttttaatatttctttttttttaattctgaattttttgtaaattatatttctatatagactctatactcttcttccaatattatttatttttatttctgaatttttattatttctaattgtatttctatgtggactctaaactcatctttcaatattctattacttcctaattgtatttctaacctggactctatactatacttctaatattccttatttttaattctgaatttcagttattttctaattatatttctatatgcactatatactcctcttctaatatttcttatttttaattctgaatttcagttatttcctagttatatttctatatgcactatatactcctcttctaatattccttatttttaattccgaatttcagttatttcctaattgtatttctatatggattctagtctcctcttctaatattccttattttttaattccgaatttcagctatttctaaattatatttctatatggtttctgccttttctttttctccgattaatgtgagaatttctatgccatgagagcgaatgtggaggctcctttttctattcctttaataatataactagctgggtggcccgcgcaattgcgcggctagcacccaaacaaaattatatatattttttatgattttactaaaaatttattaaatagctatctcattgtcttaagagtttgaaagaccaaaccttatcatccccatgtttctaattatatagttttctaaaagtcacaccagatactaccccttatgttatctccttctttatttgcttgctcgatctaccactatttctattcattctccttagaaacttcaaacattggatcttataggttttagagtttattttcacattgagtttcatttttataatttctagacgtcccgtcaaacgttgccattatactcctctatgacccgtctactgtctcttctctttattgtcattgagattttaaaattcgaacataattatcgtttgggttcattttttactttctagaagtcccgccaaaccgtcagtgactttgccattgttcttctctacggctcgcccgctgcctcccttctttattgtcattgagattttaaaatcgaatatgactatcattgttttttttactttttagaagttccgaaacttcaaaaattgaaccttgtagtttatagagtttattgtcttgttgggttttatttttttataatttttagaagtcttgtcaaactatgccactatgctcctctacggcccgtccgccgcctactctttattgtcattgggattctaaaaattgaacataactatcgttggaattcattttttattttctagaagtcccgtcaaccgtcggcagctctgcaactatactcctatacaccccgtccgctgctgctcctttttattatcattgagattttaaaaatcgaatatgattatcaatggggtttattttttttactttctag

SEQ ID NO: 16521 - DNA, 1501 bp, Oryza sativa
acgtagcttgtcttacttaaacttttattactaacaccatgtgttacactgtgagtacatctcgattttttattatttctatctacttacaaatggttgagcttattgtttgtaaaagttttgtaaaagaaatttagtacgtgtagcagtgctctaatttttataagtaggtgaaagcccgcgtattgctgcgggaatttagtatgtttgtgaattatgtgaattattatgtgatatacattgaaacattatgtgaattatgttggatgataatttaatatgtttgtgtttgaaaagctcttaaattataaaaactataaagatatagcatgtttgcatgatgtttaaatgtgatgattgttagtggatgatgatgtggtatcttgttaattagtggatgatgatgtagcatctttgcatgaagatatacattgaaacattatgtgaattatgttggatgataatttaacatgtttgtatttcaaaagctcttaaattataaaaaatataaagatataacatgtttgcatgatgtttaaatgtgatgattgttagtggataataatgtgacatcttgttaattagtggatgatgatgtggcatctatgcatgttaagcttaagataaaattttcaccttcctatcaacagaagacgaccaggcaaagttggcatcacaagtttcttagtagtattttcttttttttagcaagagaggagatcctctcctgttcccattagcagaaacgatacaatatcccattggagttggacacaaccaaagcaccattctgttgtactccgttttcctgtgatgatgccatggcaatgtcacgaggggaaaaaaaattcaacaaaaagcatccaatcccttgtaaatacttttacttctacttcatataatgaaattggcccggtcttatgtcggtgcgttaaaaaaaaaagaaagcatccaatccacataccaacgcaacaaaagcaaacaccgccggccgcagccgcaccgcacgacacgacgagacgtgagggccggcgcacacgacgcaagcagcacgaacggataagataaaaattgccctcaaaaagaaaaacggataagataaaacagataaatatactatgcgtgccaccaaacaggcaaacaaaaaaaaaactacaaaaagcacaggagatttctatgggattcgtctagaaagctacgattcctagttcctacccttcccggtaacttatttatcctcccaaatcctctccaaattcaaacccaccatttccttttctttaaaaaaaaactttacttaaacgctagtagtacacttccactagtgaaaaaaagacgaggagtcggagtcccccacgcttcgtcctctgcttcccacgcgccacaaatttcttcgccttcttcccacgcaacgcctcgccggagaaacaggagacgagtagtagacgactagtgcgagccaagggcatggcgcggcagcagcagcagcgggaggaggaga

SEQ ID NO: 16522 - DNA, 1501 bp, Oryza sativa
tggccgtcgtcgagctgctactgcacaggttgacaacgacgatgagcgacggcttgtaaatacatagtacaatatgtacatgagcaatccaggaggcgactccaccaggtctgaaccaccttcctagctcaccaccttgccaccatcggcaacgtcacccacccacttccgatgcctgccctctcctctcctctcacattctttttctttctctctctgcctaatacagatatttttcttctatgaattcaattcatattttctcgatccataaacactgacggcaagagcgagccatcacagacgacactcttgctccatgtgggcatcggttggtgcctagagagctgatttgataggatgaggttggtcggtttgttttgaacgtggactaatcaacgtgaagcagggaagcctttagaggaggttggcttgttcggtttagtaggtggttatagaggtggtattggccggacacaatgtacggttttttcctaacaaactaagcactgtatgttttttttgcataatgtatggtttgatattttttttcttaaaatgttatatcttctttaatataataaattgccacaccctttttaaaaaacctgatatgtgtccataggacctagccatgtgaagtctacatttgacaaatcaaattgatcaggtctgggccaggtgtactatgcccaaaattctgtcatcatcaaatccaaaaagcaaggaacagtctcttatcgatctgtagttctctacttaatagagttgatcacttaggttaggtatatagaatagtaaccaccactaccattatagtattacactatagtactactacatcacaaaggcattagacattaattaggagtaagagcaaatcttgtggagaacctttttgtgactgtgtcgggtaaccggcatgaactcaacctgcggcgtgcacaggacacagtgtgatcagatcagataatcagattagcagcttagcttagcttagcttgcttacgtccacactactttactctccgttggaccaaatcactaaactttgtcgtaaactcgtactacctccgtgccataataagtgtagccataagtttccgcgtccaactttgatcgtccgtcttatttgaaacttttttataattagtatttttgttgttatgagatgataaaacatgaatagtactttactcgtgacttatgtttttaatttttttaaaaaaattttcaaataagacgaacggttaaagttagatgcggaaaaccatggctgcacttattttgagatgtaggaagtaaggcataccgcacaccacgtcctgggggtcaggcagtcagcctagtgaaaaagataactgtgcaagctagcttctcgctctcgcgcctataaattgggcgctcgccgccggcctcagagtgcacacacagacacacagacgcactcacacactcagcttaagcgagcgagcgagtgaacgagagagagagacagaga

SEQ ID NO: 16523 - DNA, 491 bp, Oryza sativa
tacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcag

SEQ ID NO: 16524 - DNA, 1501 bp, Oryza sativa
aaaaattgtaggcaaaatttgcttcaggacatcgaaaaaaagtgtaattagttaggggacaccgtaagaacgcgtatttgctgtagggcattgcaaaaaactagtaattagctgttgaatacccgcgggattattttattatatccggacgaattggagagagaaacagatgtgtaagtatgattctaccctttaattttttcctttttctttattcttccttattcttttctccctctttcattctttctctctttcttttcttctctttcttcaaccaagcccgaggaagagggagagcgccggcaacggcgtgcgggtcggtgcggtgctacgcggcggaggtagcgccagagcaggaggactctgcaaggtatgctctccttctgctccgtctccgtggtgcgcgcatcgttcggtgcgcgatccgaccactaggacaaagtccctgcacgagctcaacgaggcagtgctgcatcgcaggtgagaaggtggcggcggctgccagggcagtgtagccgccgcttcgttcgcccatcgcttgttgctcctcccagactcgcccgctgccaccgctcctcctaagctcgcccgccgcatccgcgaccacgatggcgtgccactgctagagcgagatgaggacctgctcagtgtggggcccacgttggactaatttaagccaaggaaaaactggttttaaatgattatttctctctcctattccttcgaaaataataaagtaatatcacggggccagcagctaattatctttttttcgatgccttacaacaaatacgcattcttacggtgtctcctagctaattacactttttttatgtcatgtagcaaagtttgccaaaattgtattggttgatgtgtattgaagtaataaactttctggatttgcggattggtggaaggagttggtttattttgggacaaattttaaactctaggagttgatttattttgggacggagggagtgttaaaaaaaaagtaatgttagattgtcattgggcaccgggccgtagcacattgataaagggcctcctaccaccatacggttaggcccgggaacttccaattcccgccgtttcgatcgagagagctttgggccgatgacttccggccattccatggcacgccgagctgccacgctcgcgtcgcgtccagatgcgcgcgcgcgcatatatcttctccccgctcaccacagccattcgtccccgggcctcgccgcgccgcgccacgccacgcctccgcccgcgttcgcactgactgacctgtcacgcgcgcgcgcgggggggagagcgcgaggaggaggagaaaagatcttcgcgcccccccgtcttgtcctctgtggagccgaggccgaggccgagctgagctgagctcgcttccgtgctcggccagcgcacccgcgcacgcaagcaagcaagcaaccgagcaagaagacctgcgctgcgcgcgcgcgcgctgacgggcggaggcgaggcgaggcga

SEQ ID NO: 16525 - DNA, 1501 bp, Oryza sativa
tgcgtaatacgttatcagcacgagagaaatactagtatgacttacattgtgaaacggaggaagtagattttataagctcattcaaatagtagtataaaattaacgattaaaattctaaaattttcgatcatttattcaagatggaattcggttacgctgaacgttaaatattcgtggtcggaaagggcgcgtacagttcctagatcggtcgcacggcccagtatccgcactacaaaggacaccagtgatccgaagtgtagcccacgaccacgatccaatgactactttagtgctctctacgctgccgccccaactctcagtgcatcccaccggcgaccacgtggaagtgaggaagagagatgcggcgagccaaggcgaaacaagaggatcttccatctgggtgacgatgcttccgacggcggcgacgaggaggacagctcgaacctgtgcttctacttccccgtgcaccactactccgacagcatcccccttcaccctatactgtacaaggtggatccccccatccctcgacaacgacgacgaccacgccgccgctactctttccaccgggtcgctgggctccttgatcgttggagttggatactgttccgatggttccggaggcgacgagaccatactgttcaacaccctagaccgagggagaaaattgcaattataggactccaaacaatgcgcttcgcagttataggaccccaatcgtcgacttcgctaaaacgacccttgaaacgttggcactttattttacatgacatttggtccttttaatcacttttctcaactaagatacatgtattttgccctaaagtgaccgtattgcccttctgccttctgtatacttgatcgatggtatcttttcatctcatccgactccgccgttgttcctccttccctccccacgccgccgttcctcctttcctcaccacgccgccgttcccttcccatcctcggctcccatggatagagtgtcgccgcccgaagatggagatggacgcccgatcgccatggaaggccaagcagtcgaagacctggcggcctctgccctagccgctcggggtctggtcacggcgcctggtggcctgggcgcgccggctgatgccttggctgtggcagccaatggccatgtatagtagaacgccaacgctagtgctgtagccgctgctagaacattgctgcccaatgctcctcttccagcaatggagttcaaccttcctgttcttcaagtgcaaatgtattggttgcactagatttctgttttttttaccacgatagtagtaggcagtagtaaaacttgatttcacttgtttaggtcccaagtagatcatgtggaaaatatggaaagagttgattggataacatacacatggtcgagacacatgatgatgaaggtcgtattgcacttatgagtcacagatttgtgagcttttaggtgtgatagaggaggacacaacaaatatacctgcacagggctttgattgtcgaa

SEQ ID NO: 16526 - DNA, 1501 bp, Oryza sativa
tatgaatttgctaactcaatttaacttctcaccatgtacggtagcatgcatgcacatcttgtttgcttgcttgtcatcatgtacagtagcatgcatatacatgcattcgtacagtgcgcatgcacaatacaagcatctgagtaatttcagcgcggcggctgcaaacgacgtgatggcctccggggaatgatgaccttgggatggcttggtcggcagctccacggcagcatagtgacgccggcagcgaagccgatgaagagcacgtgcggaaataggcagcgccggtgaggatgatattcaatagacgttggcggcgacccgcagaggctacaacgagcgtgggggacggagggcgtcaccggccgattagtagagtctcagtgggacatccctgcccaccaagggcgcatcatgacaggtgctggcaacaggggtccgacgatacccatcgcgacttgtggatgatatgttaacgacctccggatatcggcaactagcaccttggcgacctggcaatggccttctccggcgggcagcggatgatgacggggacaagctagcgttagctggcaacgcctcgccgtctatggatttgggcggctcagcggtgtccacggcaactccagcgagatggttcgggacgcagccagagctgatgacgccttgcgggcaccgagtagtggcgctccggccggcgttctcttcaagcagcaagacaatgtgtgtagaggatagcagctttgatgagggcgagcggaagtcgacgatgttgcggagaagaggccgcgaccggcaaggcgacgacgtccgatccagcatctcgacgacatcacatcgccaggtaaagacgtcgtgggatagaggttgcggccggcgaggcaaggacgtcgcggcagcaggtagatgtgtcaccggcgaccggcgtctccgacgagagggagcgacgcgatctccggctggcggtgcctccgacaagcggagaggacgctatatccagcgggccaggcagcaccggaaactctccatgtcgccatcttgtgcatgcatgctgatctgaacagaaagagaaggaaaacaaaagaaaactaagaagttaaactcgtggcgatggctgagtacgtgctccggcgatcgtctcctcctccgcgcgcctccttgccagacgccgaggcactgcggccaacgtcaccggccgccgagcgcacaagttcccgccggacgccgagatacggcagccgatgtcgccggccgcagagcacgcacgttcccgccggacgccgagatactccggcgaaaacgacgtgcgtgatggttcccgatgacgatgagcaacctgtgtccgctctccttgtccttgtgcttctctgtgtttctctcctgtgtctctatgtatgtctctctatggactactgccaaggctgggcacggcgcagcgcctgccggcggcggcggcgtgaactgcaggccctcggctcgtgcctctgtactctctccgctgtcc

SEQ ID NO: 16527 - DNA, 1501 bp, Oryza sativa
aaaaaaaaattgaaaacataagtcacgagtaaaagtactattcatgttttatcatctcatagcaacaaaaaatgttaattataaaaaatttttaaataaaatagatgatcaaagttagacggggaaactcatggctgcacttattttgagacgagacggaggtagtaggtttttttaatagaaggagcacctgtagtctgtcccgtcaaatcttgtacaccagcagagtactcctatctgacggagtaaaattcagatgatcgatggagaggagttgaggtgaccccgggcgatcacgtcgaccggcggctggccgggacggcacgcaacgcaacgcaacgccttcacgtaaacaccaaatgaacgcagggtgtgttttagtaccacgctaaaactagaatagaattttactagtttgaagaaaaaaaagttagaagttcacgtagtatgtagaaaagtttggatgtgattaaaaagttggaagttcaaataaaaaaaagttagtaactaaaccaggctaggccgtagtatactcctgtgctgtatattatacgtacatacgcctgtactgtacttacgtacatatacaccctcgatctgtgggaacatatgcatgcatgcattcccaacaaattttcatgtccttttacgtacagttaaagagataaaaacaaaaccataaggatttaggaattatttggactaatttaatttagacgagaaatattcatagtttttgcgtacttatggaattacgtatgcgtccaaatgaatggaattaggggatctaaaaacttggcccagtacaagatcgaggatggactgatgcatagtatggcctggaaatgggaacaatattttaactaacctaaaagtatactccctccatcctataaaaaaataaatctaaaattagattaagtcacactcaatagtggatttgtttttcttacggagggactactatgtagtagtcatgttttttttactcttaatgagtgatgaagtattgataattttgtcctgttgttcaagtttaatataattcaagtagaattcaattatgaattccacaaaaaataattcaatcatgaatatacttagatactggtaaaattaatggagctaaccagtagttactccctcccgtcgtaaatattctatgcttaggataagatttggaccatagggtttatattaaaataatttcataatatccagcgaatttatgatattgtatttttcaagataaatatatgaatacattttttgtgtaagctaaatatttggaagttattgatggtggagaattttaaaagtttgaacgaatcatgtcttaaacattaaatatttatgggagtcttacctgccgtgatatttaggtgggcaagttgtaaatcgtattggtgtgtgatgattttcatgccgaccattgcccataaaccggaggatcgaggctgtcaaaaaaaaacctggaaaattgcggttgttgattgagtta

SEQ ID NO: 16528 - DNA, 1501 bp, Oryza sativa
ccacgtggaagatgatgtgctctgaaaacttttgatctggactatcaactgtggagttggcacgtctttgcgtcttgtgtttattggcaaaatgggttgtcgtgtcttaagggataagttataacaatatagcaaactgcttatactttggtaaaattttatcgattttgtcacaaacttttaaggtaaaatacttttcgcagactaaagatgtataagccataagattacaaattatagacttaaaatcgatttacagaaaatctacttattttagaaattttatgtattagttttatgttcccataaaaatatgataaaattggttgaatatgggcacttaaatattaattgctcaatccattatttggtactccctccatccacaaaagttagacctatttcatatttgactttttccaaataagttattcctatttgtagtctctatgcattcaagacttagatgaagagataaattaaatgttttattagaatccaaggagtcatctaaatactcattgattacatgcttgcattcactctttgattttataacatcaaaggtaatttaatttctccttggtctttgtgacaatagtaatatgtgtaacttttgtgcatggagggagtattatatagtttcgtcatgatagtcttatacacgcatatttaaattagagtagatttcaccttcgaccttctttagttaaaagaaaccttggattccctttattccattttttttacaatggatctaattttcttaccttttagtttcaaattggatacatttcttctcttgtttccaccgccatgccaaaatcatcatcgtctactagatgaaaacaatgttgagaaaaaaaaatcaaagtgaaaaaaaggagggcctaaattgaaaatatgagttaaacggttcatattttgagacttatggtaacaaaatacatagagttcaacgtgaaattcactctaacctatgaaattttactccatccagtgttatcatcgcacgctgcaaaaggtagggagcaaaacaaaacaaaacaaaaataattccaaacccgtacgcaattttttaggcctgcaaaccacgacaattatccccctaaatcctaaccaccgcatagtcaagcagaaaacaataaattagaaacgcgtggatcagtgacagacatgtgggcccgaaacagcactgcgctaattaatcccactttttgcagaaaagaccctgccaggtctcccaccatctcatttcagtcctccccctgaccccctccccctctcgatcccttccttccttcctcccccaatcttccaatccgagagaggcgccgcacgcgtcccagatctatggttcgcgcgcccactccactcctcccccaccgccgcgccgactcgccgccgcaccggccctccgccgcggccgccgaagccgcctggccccgggagtgaaccgaaccccaggaggaacgcgaggtgaaccgggcgccggaggcgg

SEQ ID NO: 16529 - DNA, 1501 bp, Oryza sativa
gagttccggcggggaagacgaagcgccgcttagacttcgggattttttgttaagggtttcgggggtgctaatgggcctaggcctgaacagtacttcagcccaatattattaacagcgtggcccgttgtgctccttagggacttaggcatttttgctttggcaatttatgctcgcaatggtgtggcccaatgctgataaaatcctttttaatgcggttatataattctttggaattattgcaatgcaaattgaaaggtacccgacagaaaagtgttatactatttttgtaagcttttttaggctgcaaaagctgtctgggttgatttaagatgacttgtttttacaatggtcattctcttggcgtgttatatgcctattttaattatggtgagagtcatagcctaggctattagacttattaattaccataatttttataacatttgatggattatctttagagttttttactcggatgtttgttaaatgtgttcatttgtgaaccttttagagtgttattcactcggatttttttactatggctggaaagcagtcggctgaatgtcttgttggacgccgcatatgcttttgtcatatgatgcatgattatgcaattattttattcttgactacatgtttagtttgttaactaatcatatagtcgggggctactgtggagattatggataccccatatctacacggcggttatatttagactgaatataggataccgaatatagatagaatatctttatttgtatctcgggtttgtttcttaacttgtacgtcaaggaaatatcctgagatttagtcggttacgattgtattttatttgtattctcgtattctgataaggatatgagttataccttgtaatacggactccttcccctatataaggaggggtccgagtccttcctgggacaccaattctctttgagatcatacattcaataatacactcggcggtttccaccccggacaggagtagggtattacttcttgaataagaaggcctgaacctatataaatcgtttgtctccaaacccatccacttttcaagcttgatagccacccctttttagtattgccgaaatcttgtttcgacagtaacaaactcttggtctatctgcaattaattgagcaaattccactgtcatggccaatgaatttgggctattttgaagagacaatgcaattaaattccctctctgctgctgtcagacataagaaactctccaactgggtaaggtcaacctgctgctgctattttgtttagttattttttccatcgacattccagttgagaacactgcatctctgcgctcatctccatgttctcctcaactaatcagatgttgcatgatcaccatattgcatgtatatgcatgcatgatcagttgttcacaaattataattaaccactacatgctaaaaaattcccaaattatcagtatatatacatgcacccatcaacgttggagttcatccatccctc

SEQ ID NO: 16530 - DNA, 1501 bp, Oryza sativa
atgcagtgttctcaactggaatgtcgatggaaaaaataactaaacaaaatagcagcagcaggttgaccttacccagttggagagtttcttatgtctgacagcagcagagagggaatttaattgcattgtctcttcaaaatagcccaaattcattggccatgacagtggaatttgctcaattaattgcagatagaccaagagtttgttactgtcgaaacaagatttcggcaatactaaaaaggggtggctatcaagcttgaaaagtggatgggtttggagacaaacgatttatataggttcaggccttcttattcaagaagtaataccctactcctgtccggggtggaaaccgccgagtgtattattgaatgtatgatctcaaagagaattggtgtcccaggaaggactcggacccctccttatataggggaaggagtccgtattacaaggtataactcatatccttatcagaatacgagaatacaaataaaatacaatcgtaaccgactaaatctcaggatatttccttgacgtacaagttaagaaacaaacccgagatacaaataaagatattctatctatattcggtatcctatattcagtctaaatataaccgccgtgtagatatggggtatccataatctccacagtagcccccgactatatgattagttaacaaactaaacatgtagtcaagaataaaataattgcataatcatgcatcatatgacaaaagcatatgcggcgtccaacaagacattcagccgactgctttccagccatagtaaaaaaatccgagtgaataacactctaaaaggttcacaaatgaacacatttaacaaacatccgagtaaaaaactctaaagataatccatcaaatgttataaaaattatggtaattaataagtctaatagcctaggctatgactctcaccataattaaaataggcatataacacgccaagagaatgaccattgtaaaaacaagtcatcttaaatcaacccagacagcttttgcagcctaaaaaagcttacaaaaatagtataacacttttctgtcgggtacctttcaatttgcattgcaataattccaaagaattatataaccgcattaaaaaggattttatcagcattgggccacaccattgcgagcataaattgccaaagcaaaaatgcctaagtccctaaggagcacaacgggccacgctgttaataatattgggctgaagtactgttcaggcctaggcccattagcacccccgaaacccttaacaaaaaatcccgaagtctaagcggcgcttcgtcttccccgccggaactctcgccatttcccccattccttgctatagtacaaagctgcgccggcgaaactagggttcaccattccgctccaatccacctccaaaagttcaccaaaatcctccacgcaactcattgcttcaattccacatctctccccagccatccctcgaatcaaatcaactcattcggatcaaatcga

SEQ ID NO: 16531 - DNA, 1501 bp, Oryza sativa
ccggctgaacagatctaactccaaaccaggagctaagcaaattattatcaggtataacatccataattattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatttccgccacttctcagtctggtgctccgcaatgaaccatgctatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgagctaccattaaaccatcattaaataataatgaatcataagttatcccaatagtgtgctaatgtttctaagcatggctaagcaatcatatctaatatctagttgaaccaatatatataaagctcaactagtccaattataatcacccaaggtatcaaggaataaagtaatcgagaacaaaagggccataacaaagaataggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaacactcccgacgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcaaatgaatttattaagaattttacaagattaaatctaattaaagcccatttaaaaagaattaaataaatttaattcaatttatggacaattttaatatgtagatctttattttaaacaacttttgcaacttgaaccacattaaactgagttaagatgaattagttatgaatttttaaagattaaatcggattaaaacctttatatggattttaattgaattatgacgcaataatgaattatttttgaaaaggaaaagaaggattattgcgtcagcggctagggtttcggtggaccgggcgcacgggcgacggttcacgggaacggacggccgagatcaaccctatccaaaacggacggctgagatcgatcggtccacgaccggctcacgggaaaagggacga

SEQ ID NO: 16532 - DNA, 1501 bp, Oryza sativa
cccggctgtacagatctaactccaaaccaggagctaaacaaattattaccagatatagtatccataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtgcccgaatagaggctgtgacaataccctctgcacaacacaactcaccacaatgcaccattcctggatcataatcacccccttataaaacaaggcatggcctccccagcgacccccgtgggcttatctccgccacttctcagtctggtgctccgcaatgaatcatattatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtggcttgccttgcaataatcggtcttcaattaatcttcttgaatacctccagcacactcgcgaaccttcgcaacgacggaaacgacaagctaacacgcaaaacgaagaaaaagactaataaaaaccaaataaacagtaatataaagtaaacaaacatgtagatcatgattttagatgaattatgagacttgaacggcctcattctgacttcaaatgaatttattacgaattttacaagattaaatctaattaaagcccatttaaaaagaattaaataaatttaattctatttatggataattttaatatgtagatctttattttacacaacctttgcaacttgaaccacattaaactgagttacaaagaattagttatgaatttttaaagattaaatcggattaaaacatttatatagattttaattgaattatgacgcaataatgaattatttttgaaaaggaaaagaggattattgcgtcaacgggctcgggttcacggtggaccgggtgcacggcggcggctcacggaaacgaacggccgagatctaccctatccacaacgaacggccaagatctaaacggtctacgaccggtctatggcggacggcaacga

SEQ ID NO: 16533 - DNA, 1501 bp, Oryza sativa; identical to SEQ ID NO: 16532

SEQ ID NO: 16534 - DNA, 1501 bp, Oryza sativa
aaaccccccggttgagtcaagcgacgggagctgcgtcctctcgcgaggcgatggcgacgacccgtgctccgaggcggaagaggcaagctcagcaccgttgtacgagctcgtcgtcccgaggcgacggcgcggcaggatcccgcgcggagagcgcgcgcgcgggaaatttccccgcgaaatccaggttcgtccaactcccctcccactcccccaatccgggaaatttgctccagcatatagcgcagcaatctctcccaatctcccactcccccaatctccaactcccctcgcttgatttgggtgctgctgagatgtccacggcggctgcaggtaggaagaagaagggaggcacacctgaggcctcggatgcggcggcggcagccccagctcgtttggaaaaggcattctacaatttaattacttgactctaaatttttttgcatcatgcagcattttatcctaatgatattgaggttatattcaacttttgagagaaataaaaatctgatggttgtttatattatgaattgattgtggattggatgaagctatctctagatgttactctgtttatactacctgattattaatgtcagtaatcccttcctttgttatatggttacagtagttagctagaaccctgtaactgaaatgaactagctgccatgagataattcgcaaaagcgagccaaactcaaatgcagagatttagttagctagaaccctgtaactgaaatgaactagcttgttcagtgatacactatactactgatatggagtatatataatctagggaaaaagatgagcatattagccttttattgcattccttttctttttgtactctctctatacatatatgtctctatacatatataatctagggaaaaagatgagtatatataatctttcagcaggttcagtgtatgtctctatacatatactttgatgagaatctgcaaatgatcagaaaggggaaatttaggaaataaattcagagcttgatcattggaggtatatactgggagctaaatattgatttgattgtggtcatggctgggaggtatacatcctggtagatatatacatcctgtgaggtcagttggaatgccgagaggtctcattcagtttcagtttctgaattaatgtgaatgtgatttgtaaatgcgaatgtgcacttcagtttctgttggaatgtgaatgtgcatgcttcaggttcagttgttgcaatgtgaatgtgcatgcttcagtttcagtttctgttggagtgccgagaggactaatttgcttatgtgaatgtgaatgtacccttcagtttctttctggaatgtgaatgtgcatgcttcagttacaggcattatgtatatgtgctcctttattatgtgaatgcttcagttatgtgcatgcccgtttctgtgaatgtgaacgtgaattcaagcctcaattttatactataaaatggaaccatctactccttttcattatgtatatgtgctccttt

SEQ ID NO: 16535 - DNA, 1501 bp, Oryza sativa
gcgccctcgtcttcttcaccaacacttagacgttttcggccgatcgatctctctcggcctctctccttcgccgccactgcctagggcaaatccccgcgccgaccccgccgtatctcgccatcgtctcgagcttgtcgtcctcgccgccgcctccgcctccgcctcctccgctgccgccgcatctctggggtgagagccgccgccgccagatctccccttcatgcatctcgatcgatctctccgatctcgatctctctccgtcgcgccgcccgccacgagacgccgcgccacgacgacgacgcgccacgacgacgacgcgccacgccgccgccttcgccgccgccgcatgccaacgccacgccgccgccgccgtcgccacgccgccgccgcctttcgccgccgcgcgcgcaatgccgccgccgccacgccacgccgccgccgccatgccacgccacgccgccgccggcacgccacgctgccgccgccgtcgccacgccgccgccccaaccgccgccccgatgctgccacaccaccgttaacgaacgagaacgagaacgatcgaacgaacgagagcgagaacgaacacgtcaacgtacgttgccgcgagaacgtgaacgagaatgagaacgatcgaacgaacgagagcgagaacgagaacgatcgaacgaagacaagcgagaacgagggaacgaacgtgaatgagaacaagcgaacgaacgtgaatgagaacgagcgaacgaacgtgaacgagctagggaacgtgaacgagcgaacgaacgaggacggaacgtgacgtgaaatatatatatatatatatatatatatatatatatatatatatatatatatatatatatatatatatatatatatatatatatgttacttcgcatttatcctaatacatctttttgtatcttgcagaaaagacgtgttgtcggagtcgtccgtcaagcctgagtggaagagctagtcctagaaggaattggagcaggcaagtgacgtaataatataaatgattgttatatttgtaatgcaattaattaagattattagacctgtaattagacttatcatataagattgtgtagtgttctaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtt

SEQ ID NO: 16536 - DNA, 1501 bp, Oryza sativa
tgacgacgaggcggaggtagaagacggaggcggcgtgacttcgtgggggcccacatgtcagtgtgatgggtggctttcgggtggtggtgaagtgggcccgggccaactggcccaactgccagtccggtagtcgcggagatagtaggctttgggtgggccccacatgtcagtttgatggggggctttcggttggggtgaagtgggcccaggccaactggcccaactgccgctccggcgacttggaagttggaggaggagcgccgtcgagagctgacgtggcgcgggacctacagtagggaaggggcccacatatcagtgaagtcgcttctaagctttgtgttccactttgcttacaagcttcattcagccttcagatcctttcaaaaaaaggaaaatgaaaagtttcaagttttgttctgaattagatgacgctaatgcagctaaagttgttgcccacaagcatcattttgtgcaaattgtgcccacataccacattggcaacattcatcaagaagaagaagagtaggcttctcgccaatatcctgattgctgacttgttgtgaccagaactctctcaagtggacaacaattcagccgtagttgaacgtagcttaactgtttagatttcttgtggtggaactagctcatccgagttcaaatcctagatttaacacgagtgctcgcatttacagctaattattcttttagtggtaggaggaactcatatagatatcatatagatatggtgtgtctgcgcgcggcgttgtgaatgcctatgtttctaaaacggatttgctatacaactggcgacagttaacaggaggtgaaaactttcaaattttaagctgtctaatatgctttgagatttgtgctagtgagggaaccaactggcgacagttaacagggggtgaaaactttcaaattttaagctgtctaatatgctttgagatttgtgctagtgagggaaaacggcttaaaaaattcaaacgcgtgctgtagggatcaaacccaacacctccaacttggaggtttgttcccctaaccagttctcccatcaggctattttgagttacactcgagttacatattagttatatagtagttatatagtagttacaatgtaattatatagtagttatatttgaaattttttcatcccaaaaactatcaatagttgtatagctactcccatctaaaaaaaagcataatgcttatttggtcaatcttttcggctcacacgggattcctgcgatgtacatgggccgcactgctgctagtctaccagaggtccacgcatccatctgggccgtatccttgttagccggcccagggtgaccatccctgggccggaaggtggcacactccatcagttggcccgggatgggattcccgttgaatagtctgaatgctactcctactagtcatccgttttttattagaggtagatgaaatttgaccattatttctaagcgtgtcaaaccaaacatattcgaatgcaaga

SEQ ID NO: 16537 - DNA, 1501 bp, Oryza sativa
tgccaccttccggcccagggatggtcaccctgggccggctaacaaggatacggcccagatggatgcgtggacctctggtagactagcagcagtgcggcccatgtacatcgcaggaatcccgtgtgagccgaaaagattgaccaaataagcattatgcttttttttagatgggagtagctatacaactattgatagtttttgggatgaaaaaatttcaaatataactactatataattacattgtaactactatataactactatataactaatatgtaactcgagtgtaactcaaaatagcctgatgggagaactggttaggggaacaaacctccaagttggaggtgttgggtttgatccctacagcacgcgtttgaattttttaagccgttttccctcactagcacaaatctcaaagcatattagacagcttaaaatttgaaagttttcaccccctgttaactgtcgccagttggttccctcactagcacaaatctcaaagcatattagacagcttaaaatttgaaagttttcacctcctgttaactgtcgccagttgtatagcaaatccgttttagaaacataggcattcacaacgccgcgcgcagacacaccatatctatatgatatctatatgagttcctcctaccactaaaagaataattagctgtaaatgcgagcactcgtgttaaatctaggatttgaactcggatgagctagttccaccacaagaaatctaaacagttaagctacgttcaactacggctgaattgttgtccacttgagagagttctggtcacaacaagtcagcaatcaggatattggcgagaagcctactcttcttcttcttgatgaatgttgccaatgtggtatgtgggcacaatttgcacaaaatgatgcttgtgggcaacaactttagctgcattagcgtcatctaattcagaacaaaacttgaaacttttcattttcctttttttgaaaggatctgaaggctgaatgaagcttgtaagcaaagtggaacacaaagcttagaagcgacttcactgatatgtgggccccttccctactgtaggtcccgcgccacgtcagctctcgacggcgctcctcctccaacttccaagtcgccggagcggcagttgggccagttggcctgggcccacttcaccccaaccgaaagccccccatcaaactgacatgtggggcccacccaaagcctactatctccgcgactaccggactggcagttgggccagttggcccgggcccacttcaccaccacccgaaagccacccatcacactgacatgtgggcccccacgaagtcacgccgcctccgtcttctacctccgcctcgtcgtcacaagtcacaagcacaagaggcgaaagcgcggcgccgtcgcggagaggagaggagggcgacgagggggaggcgattcccaaaccctagctaccctcaccgccgccgccgccagcagcgatgatggcctacgcgctgcgcggtg

SEQ ID NO: 16538 - DNA, 1463 bp, Oryza sativa
caaattattactaggtataacatccataattattgtgagaggtgtgagactaatcacgaaaaacattgcttaacccgcccataaccgcgggcacggctattcgaatagttttactctggccagaggtgtaccactgtacccacaagacacagcctcaacatcttgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatctttaaaccatcattaagtaataatgagtcataagttatcccaataatgtgctaatgtttctaagcatggctaagcaatcatatctaatatctagctgaaccaatatataaagctcaactagtcaagttataataacacaaggtatcaaggaataaagtaatcaatgcaaacaggccataacaaaagaatagattcacaccacccagtgacattcgaaaataaatgcacagttgaaataaataaagaatttaaatataggatcaacatgctcaaaggattgtgtttaggatatgtgtgacttgccttgcaatattcggtcttcaattaatcttcttgaacacttctgacgcactcgcgaaccttcaaaacgatgggaacgacaagctaacacgcaaaacgaggaaaaaggataataaaaaccaaataaacaatacatataaagtaaacaaacatgtagatcataattttagatgaattatgagacttgaacggcctcattctgacttcatatgaatttattatgaattttacaagattaaatctaattaaagcccacttaaaaagaattaaataaatttaattctatttatggataactttaatatgtagatctttattttataaaacttttgcaacttgaaccacattaaactgagttacaaagaattagttatgaattttcaaagattaaatcggattaaagcatttatatagattttaattgaattatgacgcaataatgaattatttttgaaaaggaaaaggaggattattgcgtcagcgggtcgggttcacggtggaccgggtgcacggctgcggtctatggatcgggcggccgagatctaccctatccacaaagaacggccgagatctaaacggtctacgatcggtataaggcagacggcaacga

SEQ ID NO: 16539 - DNA, 1501 bp, Oryza sativa
accatcctgaacaaccatacccggctgtacagaactaactccaaaccaggagctaagcaaattattactaggtataacatccataattattgtgagaggtgtgagactaatcacgaaaaacattgcttaacccgcccataaccgcgggcacggctattcgaatagttttactctggccagaggtgtaccactgtacccacaagacacagcctcaacatcttgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaatagtagctcgcgaaccggtccttaattgtcatgagcacgactctcaaaaccattatcaagttttagttggcaagtaattaattaaccaatcacgattgaccatcgtgaactatctttaaaccatcattaagtaataatgagtcataagttatcccaataatgtgctaatgtttctaagcatggctaagcaatcatatctaatatctagctgaaccaatatataaagctcaactagtcaagttataataacccaaggtatcaaagaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttctgaacactcccgacgcactcacgaaccttcgcaacgacggaaacgacaagctaacacgcaaaacgaagaaaaaaactaataaaaaccaaataaacagtacatataaagtaaacaaacatgtagatcataattttagatgaattatgagacttgaacggcctcattctgacttcatatgaatttattatgaattttacaagattaaatctaattaaagcccatttaaaaagaattaaataaatttaattctatttatggataattttaatatgtagatctttattttataaaacttttgcaacttgaaccacattaaactaagttacaaagaattagttatgaattttcaaagattaaatcggattaaagcatttatatagattttaattgaattatgacgcaataatgaattatttttgaaaaggaaaaggaggattattgcgtcagcgggtcgggttcacggtggaccgggtgcacggctgcagtctacggatcaggcggccgagatctaccctatccacaaagatcggccgagatctaaacggtctacgatcggtataaggcagacggcaacga

SEQ ID NO: 16540 - DNA, 1501 bp, Oryza sativa
gtctcttcctctcacgctgcaatgcgctcacgacacagcacccctacctagtacctttctcaaatgtcagcgagtctctccctaacacaatatgatacggagtcaacaatctttaaccataccgttattacctctagtcaacagtatatgattcaaacaagccacaaggagaaacaatatcgtaagacaatgtgagtttttaaactaagaatttgagaaattattgatggtagaaatttcaaaagtatagttaaatctagtcctaaacgtcaaatattttagaagcatacatactgttgcctaatgtgacatgaagttacgcattaacatatgacatgaagttaagcattaacatactgttgcctaatgtgacatgaagttacgcattaacatatgaaggtgatatcgtatatcataaattgctacaatgatatagttatcgcctacaaacttgctatgtaaaaactcatttctttaatactatcaataagaatctcttgatttttcaaaagagaaaatttatctcatctctgacatttggcgaagagtgtctcatcattttgttagttggcttaggaagaggatcctctaacttacttccctctgactttgagtcactgagggaagtaagttagaggatctcaatccgttgggttatcaaccatgcacaaccatgatctaaattttaaaaacttaattcaagtttattttctgttttttttcaccataattttttccatcatttaattttaagtccctaaaaatatagttataaaagtttactcataattaatacttttttattgactcatttattattttcatggtttatcattcgtagagtaaacgaccgaaagtgagaagcatacgacacacaagatttatccatgtaacaaaagagtttatcatttatttgatcgatgattctatgcccttgtttagtcctcaactttttttttcaaacttccaacttttccatcacatcaaaacttttgtttagttcccaacttttttttcaaacttccaacttttccatcacatcaaaacttttctacacatataaacttctaacttttccgttatatcgttccaatttcaatcaaactttcaattttaatgtgaagtaaacacaccctatatatcaatgtgttggattaaagctggacgaaggattgaattgtgaaatatacaaaacaaacaacttagctgcagtcaagagtgtgggggtaaaatcgagagaagccaaatttggaagaggaggaatcatcaaaggagtgtccatctcctttgcaagaagcagtgatgtgatgatggtgaaatggaagaagttggcgtttgggaaaaaaggtcgctttcgaggtcgagcagagaaaaaagggaggcctttgcgaggcgaggagagcgagacccctgtgatcccaattaaccacccgccaccgccacgccgccggcgaccccctcctcggcgagatcgagatcgagatgccgcccacgccgccgc

SEQ ID NO: 16541 - DNA, 472 bp, Oryza sativa
tcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctcca

SEQ ID NO: 16542 - DNA, 491 bp, Oryza sativa; identical to SEQ ID NO: 16523

SEQ ID NO: 16543 - DNA, 1501 bp, Oryza sativa
gttaggtgagccccgctgtgctcacctaacccatacacgcggagcaaaaacccacgaggggtcggggcgcctcggccctcggggccgaggcgggtgcggtccgaccccctcggggggactaagaggagggcgaacacatcaccctcgggcccgacgtcccccgagggtgccaggccacgtgggcgattgtgtctgcctcaaacctctagtcatgatactcctgatcccatgtcatcgacaaggccatccgaatgtattaaggagtaaaagttacaagaaaaaacaccacaatgcaccaaggtgcatgaccacacaccatacactacccccaagcacaaaccactgagggtgaagcctagcaccaaacgaccgccactaagtgtgaccaaacgccgctaggcctacggcagcaacacatagatgagacttcgaaaacgatgccaccaaggtggtcacgacatgtaggatgctgccatcgtccatctaaaaagatgtggttttcacccagagaaactcatcaagaaggggagagggtaacccttgacagcgccccaaggaggttacgacgcccgaaggcgtagccgctgccggtccggtgaaccaccggactaggcttccgcctaggaccctatagccttgatcgcagatcaccgtccaccactcagaaccaccacacagacaaaaggtagcacgtagcttccaccgcaccgcaccgacgccccttcgtcggccgactccatcgaaccaccatccctgagagctggcccaggacccctccgttccaccacccgccggccgccttgccagttttggccaaaggagaacccgggactgggtgacattgcttcggcagcctgagcttcccccgctggcgagctgctgtctcaatccaacctagaaactccccgcaaaagaaggggatgagctctaggaagggcgagggtgccgaccggcaacgaggaagacaacccatcgactccagctccctttgcactaccatctgggcctgcgccaatgccggatacgctgtcgctccggctccggcgccacccacctgcaccccctttgcctggtctccgcgcccctcctggctgcgtcgcgccgcccagctggccgctaagggcaccacgacggccgcccggctaccgaggcctggccgcgccatgggacagctcgcgctggcaccagcgagccacggccgtcgcgctgttgccggcgccagcgagcacaaccgccagctccaagggccgagcatgccactgagccgccgccgctgccgcccgggccggctgcacgtcaccggcgcacacgaccgcacgccgccacgctccgcctccgcgcccgaggcagccccatgccattgccgcgcacctcgcccgcccgctgccgagccgccaccgcgcaccttgctgagccgccaccgccgtccctagccgcctcgtgccgccgccacgccagatccaggcgcgggatggccggatccggccttgggggcgccgga

SEQ ID NO: 16544 - DNA, 1501 bp, Oryza sativa
cagctcagtgaaatcaggcaaaatttgaacaagttttatccatttaagagccagaagtgctttgttcagaacattaattaagcaagacaagattgatcatccaatacaaatgcacagagctgaaattctaccttgcaaacggcgagcaccgagaacctcggcctctccgccgccacggcgacggcgcccctctcgccggccaccgccgcctcccggcacagcctccgcgccacctccctcgccagcaccgcctgcgcgcgctccgcccgcagcgccgccacctccctccgcatcgccgaccagtccacctcgagcgcctccaccctcgcgtacagattctccgtcacctcggcgccgcaatccgcggccggcgccgtcgcggccgcgtacgcgaacaccttctccgacggaggcggcgacgcaaccaccgagcggctctccctgtctgcctccgcgtccaggtgttcgacgggaggctgcagctgctcttgctggttgcttccgtcgtcgtcgtcggggtcgatgccgtgggcgtggaggagggagaggtaggaggcggcgagcgcggagagggaggcgagctcgtcctggagctccccgtcgcggtcggcgcggccgtcggcgaggcggcggaagtggcgggcctccaagagcgcggcggccttctcccgctgcagccgctcgatcatcagcatcgcctcgctcgccgccgtctccgccgcggcgcgctccgcgtccagctcggcgcggaggtcccgctcctccgcctcggccgcctccttctccgcccgcagccgctccaccgcctcctccatctcctccacccgccgcccgagctccctctcctcctccgcctccggcacgcggcgcctcaccgaccgcggccacgacgacgccgacgtcgacggccaagaggcggtggcgataggatccatgggagcgtgcaggtgaagccggtcgacgcgcgcgcgcgcgctcgggaagctaatggaattacgcgggttaagctttggaatgtgccgtttggatagcttggatttgattagaactatttgtgcgagctcactgttaggaatctctcctcactctctaggtgttaatcacaaacactcaaattttctttctcgtggacacactcacagaagaactgaaagaacacactcaagcttttggttgacgcagccaactagctcacatcgttttcttgtttatatagactcagtacatgcaaagagataacaatggccaaacccactaagccacaactcacgccatgcacacaaacgtgggatgcccatgcactaagtaactaactaatcctacttatttgccaagaaatccctttacatgattaccactaatcgcagcacatgcagctaatcactagcaacaactaaatctcatgcacagctaggaccgattcactcggctaatactgaccttgcctttcttgcaattcggctacttctcgcagcactccacatgcagttgagcttggtct

SEQ ID NO: 16545 - DNA, 1501 bp, Oryza sativa
gaactcttttctaaaagcaactaagtgagtgcttctcaaacgacacggatgaggcagtgtgtctcgtccggtcggagtatgtgcaatgtatcagtctttagatttgaacaagattggcacccggccaaaggccttttaaacggccacccgggccaacacctttcaaacggccacccgggccaacaacttttcaaacggccacccgggccaacaactttttaaacggccacccgggcctagctgatcccgtcagctgcggattcttttcaaacatcgaacccgatttcataacagcaatttcacaagcagtagtcaaacaaaactacgctaggaatcacctcacatccgcccatgaccgtgggcacggctgttcgaacagtttgttaacctctgcagagggggtacactttacccacacgacattactaacccgggtcacccagcccgtggggatcagccacgtcgggagacctccaagctttcatgacaaggcatttcgaaagccgatgcaggtttgccatatgccgacgagaggggtcccagaccaacaacaggttaggtcccagaccatactgtgctaggaaacccaggggtcctccccgacaccaccccggcgaatccacatgtctctcggcatcaaggctcccctgataagctagttactcagccaggggtgtcccattccacccatgtggtcgtactggtcttatgttgggatgaaattccaagggatcggtccttacgtgcaagagcgggaaaccgtacacccgatacgtttcccggtccgcagttttggaaattcatttagttcgcaagcaccgacccaggcgtcgggttttccaagtcttttgtaaagctccagttttacccaagttgtactcagattttaagtttgaaggctaccgtcgatactcgtacagagtgcacgaatatcgcggtacaactgggtggttacaagggacatggtataacaattaacagagggaggatcaaatgcaatcaattaggtaggtccaccaatctgccttgcagatggggcaaaagattaagtgtgatcctatcaatgcataatattttgcaagcaacataattaaatttcaaatataggctcaagttgttcaaaggtggcttgccttgctcgagatctggagcttgatcctcgaaatcctcgcactgcgggtcttcgggctccgaaactacacgcgaaacgggacaactcaacaaacggcgagaataaagccctattaatgacccctaagcatgccattagatagatctcgagatttgggaaattttggaagttgaacggagtcaaacggagttttggttggaaagatattgaatttctaagattattggatttttggtctaaaggaaaaaggatttaattaaatcctttttggaaaaaggaaaaggaaatgatgaagggagggaatctagactttcctcgggcggctagggcgcggcccaaaggtattcggctcggtccggccgagctaaa

SEQ ID NO: 16546 - DNA, 1501 bp, Oryza sativa
ctggtttggatcctcgttcccctcttcttcattccagtactggctgcttccctccgcgattgtatcgtacaatatctgttcctcatcgcggtcagccatctgttgatacaagaaacatctgctaagtcacgatacatttatgttttaacaatctaagtcatgtatgctaagtgtaaatgtcgtacattagaaccctacacaaccttacgtgctaagtctaattacaaatcgtgatataagctaagtcaaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccacttccgtagtcaataattacatactaagtgtaattacaaataaagtaatcttatattaaaactcaaataatattagaacactacacaatcttatatgataagtccaattacaggtctaataatcttaattaattgcattacaaatataacaatcatttatattattacgtcacttgcctgctccaattccttctagggctagctcttccactctggcttgacggacgactccgacaacacgtcttttctgcaagatacaaaaagatgtattaggataaatgcgaagtaacatatatatatatatatatattgcatttcacgttaacgttcgttcacgttccctagctcgttcatgttcgttcgctcgttctcattatattcacgttcgttcgtttgttctcattcacgtccgttccctcgttctcgcttgtcttcgatcgatcgttctcgttctcgctctcgttcgttcgatcgttctcgttctcgttcacgttctcgcggcaacgtacgttgacgtgttcgttctcgctctcgttcgttcgatcgttctcgctctcgttcgttaacggcggtgtggcggcatcggggcggcggttggcgcggcggcgtcgcggcggcggcggcggcgtggcgttgcggggccgtggcggcgacggcgtggcgtgacggcggcggcgtggcgtggcgccgacggcattgcgcgcgcgacggcgaaggcatcggcggcggcggcggcgtggcgttggcatgcggcggcggcgaaggcggcggcgtggcgcgtcatcgtcgtggcgcgtcgtcgtcgtggcgcggcgtctcgtggcgggcggcgcgacggagagagatcgatatcggagagatcgagatgcatgaagggagatctggcggcggcggctctcaccccagagatgcggcggcagcggaggaggcggaggcggcggcgaggacgtagctcgagacgacggcgacggcggcgtcggcgcggggatttgccctaggcagtggcggcgaaggagagaggccgagagagatcgatcggcctaaaccgtctaagtgtt

SEQ ID NO: 16547 - DNA, 1501 bp, Oryza sativa
agaccttcagaccgccatgtcgacaacagttagataggctacccaaaatattgtactggtatgattatggtgaataagatcaacgaccggcttcagccaacaggatgtagggttattatctgacaattcaggggcccgaacctgtataaaaatccctgtctccatctcttttacctcagtctcgtgtataccctagtaccaacgatccctataccatgtaaataccagaattgcgacatcaaacgtcgacagatttattcatatttgttttcgtatccaactaaaaatatgaaacaaatatgatacgagtattatttgttaatatctgctttgtttgcatccctaagtaagtaagtaatgcaagtgtagaacactaaaacagtgtgctttgagttttcataaaagtaagtcttaagtttagaaattgttttacttcatcctcataaataaatttatttgatagcctcctaagagattggaatagaatctagaaatttgtagtctcattggccgtgctagttttgggatacaatgccttaaatctttagtctcacaataactccggtgttaaatttgtagttttatgaagcatcttttaaatatatagttttatgataatttgataaaattatcaatagttttgtaaaaatttgtaggtgataggtgatgtatgcccccaatttgtaagccgtcccgtcaaggcgtcaaccatcaatatccgatgtgggaataaatgaacaggtatacatttataaaaagctctcttctttaaaaaaaacgccttcaaagtttattcaaggtagaaaacaattggatatgtaataatgcaaactatatcatcatcatcatctgatcatgtaagttgcaaccaactatttgatcgatctcacctccatgattatctttgtgagaggcagccatggccatggccatgcttgcattgcatgcaggagaaggtgtggggaacatgtctttagggctggcaggccaaggccaaggcctaaacataaacaaagagaaagagaggaatcaagcgaccaagtcaaccattgcctccatattttcccttcaccacacacacacgcacacacagagaggaggacgtgcatggcatcatatcaatctctgcaactgcaatcgccttaaattatctctcctcctcgccgcgttcctctcgcgaaacgcagcgcattgtccgctcctcctccgatccctagcaaaagcttcctagctagcttgcctaccattgccatcctctcccctccaacctctccctccattcgcattaccgcgcaaaggaggaagaagaagaagaactcactcgcaggagcaccaatggtgatcgatctcctctttctttctctctctctctctctctctcgctacaaattaagcacaattgcaatttcagtttcttgcatggtcaatgatgaattgcaattaatagagtgatttcccccgcaaaaaaaaaattaatagagtgatttgatttgagaatggc

SEQ ID NO: 16548 - DNA, 1501 bp, Oryza sativa; identical to SEQ ID NO: 16547

SEQ ID NO: 16549 - DNA, 1501 bp, Oryza sativa
gaagatacgtttagccctgttgttaaagctgctactatcagaataatactgtctttagctgtatccaagggatggagtcttagacagttagatgttcaaaatgctttcctacatggatatttagaagaagaagtatacatgttacagccaccaggttttgaggatcctgctaacccacactttgtttgtaagcttgacaaagccttatatggactaaagcaagcgcccagagcctggttctcaaggttaagtaagaagttggttgatcttggttttcagggttctaaagcagatacctcattattcttttcaaacaaaggtggcataattatatttgttctggtgtatgttgatgatatcattgtagccagttcttcagagagggcaactacagctttgcttcaggatctaaagggggaatttgcactcaaggatcttggtgaccttcattattttcttggaatagaggtaaataaggttcagaatggtattgtgttgagtcaggaaaaatatgcaactgatttacttaagaaggttggtatgtcagactgcaaacctgcatgtacacctatgtcagtaagtgagaaactctctcttcatgaaggttctttattaggtcctgatgatgcaactcaatatagaagtattgttggtgctttgcaatatttaactctcactaggcctgatattgctttctctgttaacaaagtctgtcaatttttacatgctcctcacactgtacactggatagcagtaaaaagaattcttagatacttaaagcaatgtgctcagcttggaattgagtttcataaatcaggatctactcttgttagtgggttttctgatgcagactgggctggtagcctggatgacagaaggtcaacaggaggctttgcaatatttttggggtcaaatctggtttcctggagtgccagaaagcaagctacagtttccagatctagtacagagtctgagtataaagctattgcaaatgctactgcagaaatcatgtgggtacaaaccttacttgcagaattaggaattaaaagtcctagggccgcaaaaatatggtgtgacaatcttggagctaaatatatgtcagcaaatccagtgtttcatgccagaacaaaacatatagaagttgactatcactttgttagagaaagggtaagtcagaaacttctagagattgattttgtttcaactaacgatcaagttgcagatggtttcactaagccattgtcggtaagacttctggagaatttcaagagcaatcttaaccttgtacggtcaggattgagagagggtgttagttagctagataagctcggatcaggcttggccgatccagatcaggctttgccgatcctcatccatgcagtaacaaacttggtttgttatagatatgcatctgttaggtagtttgttactgcatatatcgtttctttcatgtaatccggctgggattgtttcctggccgcgctcttctgtacaaagccac

SEQ ID NO: 16550 - DNA, 472 bp, Oryza sativa
accccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatcttt

SEQ ID NO: 16551 - DNA, 1501 bp, Oryza sativa
acaccgattgtgttccaagaatggatgatcttggcaatggtgagaagatgcatttgatgatgcatttgcttaaggccggtgaccggtatggattggagaggctcaggatcatgtgcgagagatttctagctacgaacctcgacacggagcatgtatctgcgatactgggtctagctgacttgctagatctcaagaagctcaaggaagcttgcatggagttcatggtcccatctgagagaatggatgccgtggctgcaagtcaagggtaccagcagctgaagagagcatttccctctctggcgtttgaagtgtgggagaggaggagccgtgttcgcaggaattaattaacatcttcttgattcagaagatatatgtgcgcgatgtctggagatttcctttttggttatgtttgttttggtacatttgatgatctgacgaatgttctctcaacaatgtgatgactgatacggtgcacgcgtggttgcaccttaatgtaatgtggctatctggatcatgcaaatggttttacctttagatcgagttgttttttaaaccttactctcttaccaactctcttaagtttttatgctagaaatttgccccatcactcctttttatcttaaattgcccatgagttgctactcgtgttttgatatcttgtgtgttcactttgatactatttttaaccttgctaaattttgtcattattaaaattcggcaatgtagcaaaccaaacacactatcaccaacatattcctcccaaactgtagtagttttattaattttcgctataaaaactctaaataaatttggtaatgtgcctcaaacatttttttttaaaaaaaatgtgtctcagaaaatgtgctcaaacatttagtttgtctttagcactaccagagtgagacacacacacacacacattttggttttccatcgaattattatccaattccatatgaatatcgatctgatcgaacttgtttgattaatctattgcaaaatacttggagtcctccgtgtcgaatggaccaaatctccatatatatagccgcatctacaaaccacttttttatgagaaaatgtgacacacacacacactttgctttcccgtcaaattcttatccaattccatctgaatatcgatctgatcgaacttttttgattaatctgttgcaaaatacttggagtcctccatgtcgaatgtgacacacacactttgctttcccatcaaattcttatccaattccatctgaatatcgatctgattaaacttgttcgattaatctgttgaaaaatacttggagtcctccatgctgaatggaccaaaactctccatatatagccacatctacaaaccacttttttacgagaaaatgtgacaaacacactttgctttcccgtcaaattcttatccagatccatctgaatatcgatctgatcgaacttgtttgattaatctattgaaaaatacttaggagtcctcagtgtcgaatggaccaaa

SEQ ID NO: 16552 - DNA, 1501 bp, Oryza sativa
aaaattacacgaaaatatccgctagttgtaattattgtagctcgagtacatttcaatcatattagcttaactagtcgcaagataaattttagattttctcgcattgccgccgctagttataacggcatttcattctagaaaccagactagaaaatcattacaatggagaaaaaccttagatgtggtgcatgacttcactcacaaggtctaaattctgatgttcataattatgcatgtgtggatacttaactgagattgtggatgtatcaacaggctttcatctctccagttgtatgttaaaaggatgtactcgtaggtatgtgcatgtgcagtgatgcatgtacgtgcatatatattccatataattgagatcacctcgatgctttcatgtgcatatgcatacttttggacaggggcagacccaggccacgggtcaatgcctaggatttggattgaaatctcactacgtagtacaaaattccatcatgtaagttcaatcttaacccaaagtgcaatgggctagcctaggccttgaccaaggctgggtcagcccctgcctttaaatcataatgtagagcctaaatattctttctcttacacggttcccacatagaaaaaaaaaacatgagcaagtaggagtgaatcgctgggcaaatctcctttggcagatagggatgggatcaaatggaagcatcagccatatccatatccaatccatccctctgccaatggagtagttgccctgcaatgcacatccacaggctcgatctcaaccattttcctcatcagaatgcctcagatagtagtagcaagtagtattacatattgtacatattgtgattgctcgagatcgtgttggtgtgatgatgagcgaaggggcgacggcggtggcagcatttatttgctgccggaaacggcatatccggcagcacaatgctttgctgcttctccagctgaattcgagagccctttcccctttcgtcgtattgatatttgacggccgatgcggcgatgccatattgccatggaagaaaaaaaagggaaaagaaaagagagggtgaaatgccaagaatccgagttagctttattccgattttggagatagatctcgcgtctttcctggacagcctacgtggaccctgtgttacgcgacgagaggccgctgctgcatgcgatgcccagcgtttgttctcttcttgtctgattttttctttgtaaaaatattttgcagtccagacagcacatagatagagagagaaaggtaggctgccatttgtgctgtgaacagttttgcagaatgcgatgccattgttctttcgcaccaaagaggaattgccacttgcgatctcaggatgcgatgctgcctatatatctgtcgaaacatgaattcggcaataataaaacggggtagcgcacgagacctaaaagtggatggatgtggagacaaaggatttagacaggttcaggccctctcaatgagaggtaataccctactcctgtt

SEQ ID NO: 16553 - DNA, 1501 bp, Oryza sativa
ggcctaggctagcccattgcactttgggttaagattgaacttacatgatggaattttgtactacgtagtgagatttcaatccaaatcctaggcattgacccgtggcctgggtctgcccctgtccaaaagtatgcatatgcacatgaaagcatcgaggtgatctcaattatatggaatatatatgcacgtacatgcatcactgcacatgcacatacctacgagtacatccttttaacatacaactggagagatgaaagcctgttgatacatccacaatctcagttaagtatccacacatgcataattatgaacatcagaatttagaccttgtgagtgaagtcatgcaccacatctaaggtttttctccattgtaatgattttctagtctggtttctagaatgaaatgccgttataactagcggcggcaatgcgagaaaatctaaaatttatcttgcgactagttaagctaatatgattgaaatgtactcgagctacaataattacaactagcggatattttcgtgtaattttttcgtagagcaagatttcaaaaagttgagttgtattttgagatacaactcttaggtccctcaaatatttggattgcaatcaaaatctataataatataatttgattttgattttgagattattctttgttggtcatatctctttttatgattgctcatacaaataaaattacgagtaaattttataaaactacagtactttgatcgaagtattataaaagtacagatttaaggcgtcgtattataaaactacatatttaacacaaaatttatcacaaaactatagatttaatactagagtatcacaaaactacatattttacagcttaaattcctaccactactgctatgttagagtgataaatgtgtagttttgtacttaacatgatgcaaaacatgaactgttgtgataattttattactaaatttatagtttggtgatcttccaccttaaatatgtagttctttgatgaattcggtcctaaatctgtagttttgtgatacacctttttaaatctatagttttataatagtttgtcaaagtatatgtagttttttgaaatttactcaaaaataccgaataaaatgttcttaccattagaacatttaaaatcccaaaaataatccaaaactcatcaagcgggcacatttgtacgtggtagaatttgggcttttggcccattttgtggttgcatcgaagcattgggccattcttttcgctgtcgttcaaaaggccacttaccacaattgggcccatccagaaacctcttggtcgcagccaccgcctagggttgcgctctctcttttatcccagcgccgccacgccaccttccctcctccctcctcgccgccgacgaactcccggccatctccgccatggtcgcctcctccctccctccttcccgactcatcgctgttcatctcctcaacctaacacccctcttccgcgtgcgtgtggtgagttgtggtgc

SEQ ID NO: 16554 - DNA, 1501 bp, Oryza sativa
aaaattacacgaaaatatccgctagttgtaattattgtagctcgagtacatttcaatcatattagcttaactagtcgcaagataaattttagattttctcgcattgccgccgctagttataacggcatttcattctagaaaccagactagaaaatcattacaatggagaaaaaccttagatgtggtgcatgacttcactcacaaggtctaaattctgatgttcataattatgcatgtgtggatacttaactgagattgtggatgtatcaacaggctttcatctctccagttgtatgttaaaaggatgtactcgtaggtatgtgcatgtgcagtgatgcatgtacgtgcatatatattccatataattgagatcacctcgatgctttcatgtgcatatgcatacttttggacaggggcagacccaggccacgggtcaatgcctaggatttggattgaaatctcactacgtagtacaaaattccatcatgtaagttcaatcttaacccaaagtgcaatgggctagcctaggccttgaccaaggctgggtcagcccctgcctttaaatcataatgtagagcctaaatattctttctcttacacggttcccacatagaaaaaaaaaacatgagcaagtaggagtgaatcgctgggcaaatctcctttggcagatagggatgggatcaaatggaagcatcagccatatccatatccaatccatccctctgccaatggagtagttgccctgcaatgcacatccacaggctcgatctcaaccattttcctcatcagaatgcctcagatagtagtagcaagtagtattacatattgtacatattgtgattgctcgagatcgtgttggtgtgatgatgagcgaaggggcgacggcggtggcagcatttatttgctgccggaaacggcatatccggcagcacaatgctttgctgcttctccagctgaattcgagagccctttcccctttcgtcgtattgatatttgacggccgatgcggcgatgccatattgccatggaagaaaaaaaagggaaaagaaaagagagggtgaaatgccaagaatccgagttagctttattccgattttggagatagatctcgcgtctttcctggacagcctacgtggaccctgtgttacgcgacgagaggccgctgctgcatgcgatgcccagcgtttgttctcttcttgtctgattttttctttgtaaaaatattttgcagtccagacagcacatagatagagagagaaaggcaggctgccatttgtgctgtgaacagttttgcagaatgcgatgccattgttctttcgcaccaaagaggaattgccacttgcgatctcaggatgcgatgctgcctatatatctgtcgaaacatgaattcggcaataataaaacggggtagcgcacgagacctaaaagtggatggatgtggagacaaaggatttagacaggttcaggccctctcaatgagaggtaataccctactcctgtt

SEQ ID NO: 16555 - DNA, 1438 bp, Oryza sativa
cagtaaggcggcagactaaccggtgggagtacaacggtctaaccaaagacaactcagcagtctgaccgggcaggctacggcggtcagaccggcggcttaggagcggtgtgaccagcggcgattggacaacgtcaagatcttcttcgatttgagggtaacttttatttccgctaaaagtttttgggtttttgattttccctaccattcaccccctctggtaggcttggttactcatgttcgatcctacacagaccacctatacacctgtggttagaccgccacactcccgccagtcagactgccgccttgccagcggttagaccgtcgggatcataaaacacatgtaggtggcatccagccggtctgaccgccaggggtcaatagcaacatcacttcacaaaaccaattatcacaagaaaccaatctttcacacttgaaatatcgccaactaccaatgttttcatcacacaaaatctaagtcaactacttgattttatagagcccaaatcctgcagcagccattgatcgatacgaagggatggactgagtaatttgtaacacaaattcgaaatgtacacgaaatcaaagacatctccttgtgtgtagcttcgaaattgttatttatgtatgcattgagcatgatgcatggtggaagccaaatataatgctcagattttagctttttcatcttgccgcatgacagtcagaagctggagatctaaaggttgagaaacgctgaaatggagatggtggctaaaatgttctgcatacaacaaccaatggaggattccttatacgtctgcaaaattcagggcatatgcatgatggatgtttttttccctgtactgtatgtgctcgcatgaacattttaatttgtaggcagaatttgcaattccatagatagatttcagcaaaaccaagaagtgtgatttgattatattttgtgtcacatcacaatcatgcagacatcagtggtgtagttatggccatccttttttttccttgtaatactaatgtgtagcaactgaaaatagcgaagtgttttaacctttctggccaaaaaaaaaaaaaaaccttccctggtcatgctatattgatctcatttgagcatcatgatgtacagggcagtatctccaattactaactttttgcggtctgttaaaaacagaggaaaggcgaaaatttaaacagaaaacaatcgtttatgagtctataatattttcttcttccagttccttttgaagtctgcacattgattgaaatgggtgtagctacactgctacaggaacaactttcgtcttccttagtacttgaaagttgcttccacgactaccacgaacatattgatttctgcaattatgagtctattgatttctgcaaaaatttaaacagaaaacaatcgtttatgagtctattgatttcttcaacgaaattgcta

SEQ ID NO: 16556 - DNA, 1501 bp, Oryza sativa
cccagtaaaaaaatgacacttgacagaacgtttgattattaacaaattccaaattgttttgtatgaaaacataattaaaatggtatatttggatttgtatggataagtacttccatgatctcataaaattattactcccttcgttcctgagtagttttcaccatttgctagcacagtttcaactttgaccccctaatagcttttaaaaggttagtctatcatcacaatagaaagcttaatgtgtatgtttaggatgtaaaaatttgaatgtgaacactgtccggtgataaatatttaggtaaagagggagtatatatagtttacaaatttccaacagaaaattacttgaaaataaaaaaaaaagatacaaatgttatgtatttatcaccggaggtcctattaaacgaaagagtcgccatacacaacgaagaatcacccagagtgtgtgagctgatgaggatcaacgagagcatgtgaacatgtgaagtgaagcagatcagcagagatttgtcgagatttattatgtgtagctcatcccttaaaaaaaaagtgtagctcacaagtaaaacgaggtcagaacgtctcctatataataactgtgcatcaatcgtatctgaataatatctttctgcgaataatcaaacatgtacagcgcgttgtgtacgtatttcactcatagcatccattgaattggattcgtcgttcgatcgttgaccaccgacatcagtagaatccggagggcttggtataataggggttgtaaatggcctatgtattctttctcaactcatctcaccacttaaatatggtaagaaaaaaagaaaaaaaaagaaaaaagaatatggtaaattttatccagttctattatttacggtgttttcctctcaaaaaaaatatttacgatgtttatgttattggacttgttggaatgtgataaatctgaacaacgtaagataaaccttgctccattctcgatcttgtccaaggcgtcattagttatgagagggttttttatgaaccgtttcaaacggattgagagactctataacttactttcctctgacatagatcgatatctagaccctctacctgtagtaaccgatcgaagggtacaccatttgtgaggctggtctgagctgggtgacagtagtagaacaggatttaaatcaggagcctctgccattggtttgtgaagctacatcgtttggctagagtaattaaacaatacaaaatggtagggtgtatcatatctgtcggtcaagcatgcatggcgtccaaccccaccagtcgtcggtcaaccatgtctgcttgctgcaggatttttataattatattggatatgcatgcatgcattcatctgaccttgatcccgtcgtcgtcagcttaatcatgcataaagatgaacattacatgcatgcatggtaactatataaactactataccttcacagctaatgtatctactacatctaaaaacagctagctaattaactcaccatca

SEQ ID NO: 16557 - DNA, 836 bp, Oryza sativa
gttttatagatggagtggtagctggtttataaaccagctaccactagctgtgtagctgtgtagttacgtcctttgtatattattaataattctatagtagtacttgcctcatccaaccacccctcatttaattttgacctaattatactccaaccatcttcccactctagacataacctttttaattaaaggtatcatagtttttcctttgtccttaattcatgatcccttatattatgggatcgagataataattgttaagagtgtcatttatagacagatttcattggtttgtttgtacatgagtcgattaatttagctttgtatatttgtaaagtattacatactcaaactttctaatatgattatttctatgtcgtggggcactctagaagcatgtctttgctttctatggtttagcagttatacgaaaaataactcaatggcctttattttaattttttttacgaatcggagagagtttttttttggaaagagtgttttcttcacccctcctaaattgcagccaagggttctatatttcaaactgaaatttctgaaagtttgggtatttcacctccccaataggatatcttacacccctggccccctagccaaaaaatgtgcaaatttgttttatagattttatttgaaaatttatgtatttttttattttatcagtcctactaaaatgttcaattttttttcaatttagcatgggttttgaattcaacaaagtttatcaattttggattttttttttaatcaaatttattatgtccattttttaataaattttggggatttccatatgtggaccccgtttttataacagg

SEQ ID NO: 16558 - DNA, 1501 bp, Oryza sativa
atgggctgggttattaattcaagaaaaaagtttacttaaggtccctcaagttgtcgttgaattccaaaatgtccctgaatcagaataacagacataacacattcctaatcttgcaaaatcagatcatattgatcctaggatagtattgctcccagttttgactgacgtggcggctgagtcaacgtgggacccacatggcccccgattttccacctttctctcatctccccatctcgatccaggcctccaacctggaagggggggggggggggataatggggagaggtttgacagtgcgacttacgggagaagaggtgtggtcggcctcctggtctagggctacacccgtgctgtgtgtgccgcctcgcgcatcatgctccctgtggtctcagcgtccctactcgtccgcctcgactaccaacacgtctccacctggtgtgtgtgtcctcccagatttccattgctcttcaccaaagcctcgccatcatcctctctcccgcgacggcaaagcactgcatcgtcatcgggcacaactggtttgccttctacgacgacgaggttgcccgcctcgtgaatgccctcaccgtcgaggagattcccttccattcgttcctcggaaagaatgtggtagtgttgaaggtcgtgttcacgccaaacctgatgccgagcggcttcactgtggcggccatcaccaaccacggttgagtcacttacacgactagtgggaacatcggatgaacctatgtcgagtgttcgcatcttggggatctcagctacggacactactaactcatgggaggcggcaaattgcatgtccttcgcctcaccgtcggctatcgttcccagtgaaaactggcatccttcgaccactgtttgacaagcctagcaatgtgttctatccggtggaataagattgggttgctgacacatagggctagcgtgggttccacgctgaatcaacagtcacgtcagttaaaaccagaagcaatattgtcttgggacataatgtggcccggttttgtacgattagaaatgtgctatatttggtattccggttcaaggacgattttgaaactcaacaacgaggagggatgtgaagtaaactttttccttaattcacaaacccaaagagagggttgggctgtaactcataaaactgaagattgggttgggctgtaagcctgaaactcacaaactgaaatggagatgggccatggccatatgactttttttcggttttagattttttaaaaaaatatttacagaaataatctatcggccaaaaaaattataaaaatagaccctgccacccacctctggggcggcaagctgacgtggcaaacgggggaggaacgggcggtgacggagggagggttttttgcaggaaaacccttgccgccctctggtggggcggcaaggggcccgaatgcaaaaaagccagtcggggccggctattttgcaggcggccccttgccgccctctggtcgggcggcaggcctcg

SEQ ID NO: 16559 - DNA, 1501 bp, Oryza sativa
agccgccaccaccggggctggaagcctggagcaggagccgcaaaagttgttgccgtacaggggaagaggagagagagagaggtcgatcggaggctgacctggtggagcccatggcgccgccggagccgggcggcggcggcgaagaatggcgcggcggaggaggagaggagaggaggcgtctgaaattttgcgaggcggcgacgactcgggagtaacggaggagggggggattcgctttaaaatatccggcggcctctctctctctgacgggtgggccccacctgtcgggtctcgggcgcagctgcttcgctgtggcttcctcgacaccccgagccgcctggtacttcgtgccgctgacctgcgggacccacgtggtaccgggcccacgtggcggtggcgggggataaggctgggcgttgccctggtcgcgtcgactccgcgtggcgtttggagttgggcgagccgtgcgaatgtcgtggcgttgactggagcccagcgatagcagtagcaggctttgcgtgacctgaccatggaggatgggctttgacctcattttgtttgcttcagattcagatttgtttcacacatctctttcatcttgcgtctgattatgaattactactactgtttagtttaggttaggacatcaggtggaagcaaattactttgaaatttaaacaagtagtaccaagattagtactaatccagctatagaatggagtggcaggaatctgtggaggttgacttaacattggtttagtattttctttccaatacaaggacgttatgagctaccacatatgccatagattccattgattatactgtcctaacatcagataaacacgacgtcaatcatatgcattatccaaatctcagttttgctttgcttgtgctaactatcttctgttgagaatggatacatacataccaaagatgtttgtttggttaagttgcagtattaattaggtcacttaataattgattattagttgtacaagaaatgtcatactattatatacatcatatttttgtttaatttaatgggggcgcagaacgattgagtttggttttgaaggtgaaattaattactccttacaattcatcaacgatgcatgtaatagcaagcactaaagttctatttaaaaaatccatcgcatacataaccggtgaatcaataaaagtagaaaaaacaacactatggtatcattcactgttttatcagcatgggaaaagaaaaggaaaaaggaaaaggagaaagaaaagctttcctggaggatctcgtcgcagcgagaagcagatgtcggcggcccatttacacgggcctctcatccggcccacgaaccagcccaattaggaggcaggcccgacacgatacaacttatcgtctcctcttcccctctcgtctcgtgtcgtgtcgtcttctccaacccatccaaaccaaagccgcggcggcgcgaggaggcagcgagagctagggtttggggcggcggaggggaga

SEQ ID NO: 16560 - DNA, 1501 bp, Oryza sativa
cagaggcattctgcgattcacgtggcatgtcgacatatagtaattcttccaatgtaccactggcatatttaatttggcataatcgtggtaacacctcaacggtggtctctgttaaggtagtcacgtaagtggatgtaaaaagcagattaacagagaaacatgtgcaaattaaaatgatgcttaccaaagcctcgcccaggcttccgattgcatatctcacaatgccatacatcctacaagggcaaatatagaaatctttaacgaataatttgaaaggaaattaaaaatatgaggcgctacttcacatctgccaattaaaataatagaccagaagcattaatgaaatatatgaaaaacagaatggatattccagatttaaaaaatgacaagtcagcaacggctcatgaaacctgagggaaaactccagtagtttgacgaccacttccatagagagatacacaccacctttttttagcatttggagaaaaatactcattgacaaagtttctccagtactcgatattgttatcctgcatcaaaaggaacaagtagagacacaaaactgtaagcccatggccttcactatacactaaattaattgtttggaaaaagccgaaaacttacctgtggcctgttttgttgatgatacatgtaatgagtcaatctctttgcacaggttcctggctcataaggagccgattttcctggagttctcatgtttagactctgttggcgaagtagctgctgctgttgctgctgctgctgttgttgctgttgtaattggtttctctgcaaaggcagattctttagaatctgttgttgttgctgctgttgttgctgcatttgcaatatccgttgctgttgcaaaaggttcagttgagctgccgcagcagcttgaggattctgctttgtcagctgcagcaaatgttgctgctgctgttgctgttgcaggaatgctgatgggtctgaactctgctgctccatcttcaccgcactcaaactcctcaaagcttgcaactgcggcggctcaattttaacattgctagcattgcgcatcatctgggctgtgctattctggtcaggctgccccatctgcggttccaatttgaccccacctgtgctgccaccattctccaacttcactgtagcctgcggctgctgtggcggttgcggtggcaactgttgttggttgtaagacattggcagttgctgctgatgctgatgctggtgctgcaagtcctgcatagcatccaggtgttgttgttgctgctgatgttgcggtggtggatgcagattatctgaacccagctgattgcccaaactaacttgcgacgatgaagggaacgagagagaatcagaacctcccgcgccaaccaaatcgccagcaccatcaagccctcctctctgctgctggagggtattcattggaagcccaccaccacctggcatcgaccccggaccgagcatatgtcccccattcccaaacggccggttgagcagg

SEQ ID NO: 16561 - DNA, 1501 bp, Oryza sativa
gcgccgtacaggaggagcaaccggaggctgccggtcttcgaggagatcactccggtctgcagggagcagatggcagcttgctagaagatggtaattaattaagagtagtagcaaattgttaattaaattagcaggtccatcatctagtgttgggtagatatatagaatttcatgcacctatccgacgtgtcaacggcttcaactttatagggagaactagctgcaggtgcatgaagctaagcatgcatggatgtttttttttcttgtgagtgtgtgtgtgtgaaattaatagtgtgagatagagaagtataatgtgtgtgtgaccagttgcatgttttgtactctggttgtgttgttgtgtacttatgtagagttgataagtgcatggcttggtgaaggatataaatgtgtacataaatgtctggtgtattcttcccaattcaatatttccgttggaaaaaagaaaatattttctatctataaagcttatgcccattaaacacctaaagcttaacatacaagtataatgtatttattgccactcctaaaatctgcatgcaaacatgccacatcaacccattaaggtggtgtttgggaaggatctcacaaaaattttagtctctgtgggagagacttatacttttgtgagagtgagacttatacttttgtgagagtgattaaagtctagtccctccttcccaaacaccatataagtacacaaaactcaacatgcaaacatataataattatatctataatttatttcattctaaactaaacatacacatgctaaatcatcatactaaaatcattttcataatatttcaatacaaattatttcatcatttctccaacacttaacatatagggttcccgcagcaaagcgcggggcatcatctggtttttatgatgaaggataaaagtctaatcatatctatgaatccggacatgcatatgtccaaatccattggtagcgttggatttttttaatgatataaagggtgtatgtattaacgcattatattatctgggtatatgaaaatagtgtgtatattattttagaaaatcttctttaatacgtcatttgctccatattacaattaatgtttgttctagtcaaacttttcaactttgatcaaggtgcaacatttttaacccaaaacaaatatactataaaaatatatttagtggtgtatttaataaaattactttggtgtttaaaacattatcatatttttctataagattggttaaacttaagaaagtttgacttagaacaaaaccataacgtcttataatataaaataaaatttctttatacaatattaggtccgttttattgcctaagaaagtttgaattggcttctcactgtatagttgcaataaaaaaatatcttgatatcatatactagtaagatgcaactgtttcaagttaaaaagggaggatgctatgtggcagtcaaacagtcgttaaatatagaagagcatgggcctggacaat

SEQ ID NO: 16562 - DNA, 1501 bp, Oryza sativa
ttttttcaaattttagttagttttaaattcctatatggactctatactctacttctaataatcctttttttaattctgaatttcagttatttcctaattgtatttctatatggactccatactctacttctaatattccttgtttttaattccgaatttcagttatttcctaactgtatttctatatggaccctatcctctacttctaatattccttatttttaattccgaatttcagctatttcctaattgtatttctatatagactctagtctcctcttctaatattccttattttttaattccgaatttcagttatttctaaattgtatttctatatggactctgtcttttctttttctccgattaatgtgagaatttctaggccatgagagcgaacgtgaatgctcctttttctactaattttatttctatatggactctatactctacttctaataatccttatttttaattccaaatttaagctatttcctaattgtatttctatatggactctatactctacttctaatattccttatttttaattccgaatttcagctatttcctaattgtatttctatatggactctatcctctacttataatattccttatttttaattccgaatttcagctatttcctaattgtatttctatatggactctagtctcctcatctaatattccttattttttaattccgaatttcagttatttgtaaattgtatttctatatggactctagtctcctcttctaatattcctttttttttaattccgaatttcagctatttctaaattgtatttctatatggactctgtctttttttttctccgattaatgtgagaatttctaggccatgagagcgaacgtgagggctcctttttctattcctttaataatataatagatagatttacttttgagttaattggatccatatgccattgcaactctaccaactctaatttacttttgagttaattggatccatatgccattgctgccaaagtgccactccctcgcccaggctaccgccgccgtgtgagggtaggggcaaaatcgtactctcaccagtgtttctctctctccaaattaacaagaaataataaaataaggccctgagtgtccaggagctaattacacgacttttgtgatgcccgacggcaaattctcgtttttgtggtgtccacgagctaattacacgttttttcaatgtcctgtagcaaattttgccattaaacaaatatcactactattcgtaatattggttcaatgtcattagtattttgtaaaatttaaacaatgcgactgtatacatctcggatgcggatagactagatattttcatgccttacagcctcatcttctggccttatggttataagtcaaaatttgaattttcaatcttaaatttcgagttgattttgaggtattttttcgttgtagtttattttccagtcttttcgtttcttttcgattgctaagaacacg

SEQ ID NO: 16563 - DNA, 1501 bp, Oryza sativa
agaaataatacatttttaataaaaaattgtacaaataaagttcgatcattcaaaatcataagtttaacatcctatcgaacaactattcttcgatagatgacccatcaaacaacggttgttggatagaggttgtttgacgagacggtaggatttttttgcaattctttatgatgcatgtgtgtacgtgtgtgcatgggctaatgtgcatgaggtacctatagaacgttgaatgttcgagaggcctcctgcgtgcgtgcatgcatgcctgcaccttttactatttttttctcggaccaatgatcttatcaaacaattatggtccgaaccaatgttattcgataggctatctgatatatatcctgtcacacttcagttgtttgatatgatgctaaacttataattttatctggtatacctatatttttttcatttttccattaaaatcgtattatttctaaaaaaatgttgacatatagctataaagtggtaacggtgatgagcagtgaatttatctcactaattgacatgtgggaccatagagattgttaaatttggtaccaactactcctaacgtaaggtgacatttaggagccactaaacaatagtccacccattaggcattagctatggaggatgggataaattatattcaacctgctccttacaacgcattgatatttagctagtactcccccgtttcacaatgtaaattattctaacatttttcacattcatattgatgttaatgaatctagataaatatacaggaaatgctagaatgatttacattgtgaaacggaggaagtatgatttataattgtaaggataaggctgcaatggtaaaaatacaccccttcctttcctttttattttaaccagtgtaattttatctttggccaataaaaacttttaaattattatgttttgataaatgaaagtactataattatattttgcaagaaaaatacatgaaaatatgacatattttcaaaaaaaaaattaaaaaggataagatgtcaaagtttgtacacgagattagtatatatttggttctacgcggtgtgaaatatgtttataaataaacaatcggatttgttagaaaactttcacaagatttttaccctcgaaacttttagatttgtggccattggatcgccttgagatttgtatatgaagcgaaaaatgatagaaataaattttcacacatgtcaacattagattccattgctagttacccaaaccatagttgaatgcaagttttatataacttatattgtagtttcaatacaattatagtgcagttacaattataattcaattatagttacatctgaatcttttatactcaaaaaaaatttatagtagttttttagatactcccataaacatttttatttgtcaaagttactactccctctgtcctactcactaagacgcgcacgttttaagagtcaacttttaaatatttgaccaataaatagtttatatattattaatttaa

SEQ ID NO: 16564 - DNA, 1501 bp, Oryza sativa
ctcaggcccaaccattctgaagcaaccatacccggctgtacagatctaatctccaaaccaggagctaagcaaattattaccaggtataacatccataattattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctttgcacaacacaactcaccaaagtgcaccattcctggatcataatcacccccttataaacaaggcatggactccccagcgacccccgtgggcttatctccgccacttctcagtctggtgctccgcaatgaatcatgttatacaaaaggtaaagccgttgcccacgctggcttgtggttggcacggttaatgtttcacaacagtagctcgcgaaccggtccttaattgtcatgagcaggactctcaaaaccatgtgctcacaacccaccattatcaagttttagttggcaagtaattaattaatcaatcacgattaaccatcgtgaactatcattaaaccatcattaaataataatgaatcataagttatcccaatagtgtgctaatgtttctaagcatggctaagcaatcacatctaatatctagctgaaccaatatataaagctcaactagtcaaattataatcacccaaggtatcaaggattaaagtaatcaaagcaaacaggccataacaaaggaatagattcacaccacccagtgacattcgaaaataaatgcacggttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctaacacgcaaaacgaggaaaaagactaataaaaaccaaataaacaatacataaaaagtaaacaaacatgtagatcatttttttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttacacaacttttgcaacttgaaccacattaaactgagttcaaatgaattagttatgaatttttaaagattaaatcggattaaaacacttatattgattttaattgaattatgacgcaataatgaattatttttgaaaaggaaaagaaggattattgtgtcagcggctagggtttgcggtggaccgggtgcacggcagcggttcacgggacgaacggccgagatcgatcggtccacgaccggctcacgggagagggcgacga

SEQ ID NO: 16565 - DNA, 1501 bp, Oryza sativa
caccatcgggttcgcaaggtcgtcgccgtccccgtccaccgcttcgccgccgccgaagaccgccggagcgccatcaccatcgtcgacccgatctccgccgccgcttcttcctcgtcgccggcgtcgtccattgatcttccgccgctcctttggtcaccggtgagttcgccgtgccgtccgctacccgttggtgccctccgttcgtgccgaagtgccgccgttcgccggcgagcatgcgagcttgcgcctcccgagccgccgccggtggtgacgtcatcgctgacgtcatcgtcgccctctcccgtgagccggtcgtggaccgatcgatctcggccgttcgtcccgtgaaccgctgccgtgcacccggtccaccgcaaaccctagccgctgacacaataatccttcttttccttttcaaaaataattcattattgcgtcataattcaattaaaatcaatataagtgttttaatccgatttaatctttaaaaattcataactaattcatttgaactcagtttaatgtggttcaagttgcaaaagttgtgtaaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaaaaatgatctacatgtttgtttactttttatgtattgtttatttggtttttattagtctttttcctcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaaccgtgcatttattttcgaatgtcactgggtggtgtgaatctattcctttgttatggcctgtttgctttgattactttaatccttgataccttgggtgattataatttgactagttgagctttatatattggttcagctagatattagatgtgattgcttagccatgcttagaaacattagcacactattgggataacttatgattcattattatttaatgatggtttaatgatagttcacgatggttaatcgtgattgattaattaattacttgccaactaaaacttgataatggtgggttgtgagcacatggttttgagagtcctgctcatgacaattaaggaccggttcgcgagctactgttgtgaaacattaaccgtgccaaccacaagccagcgtgggcaacggctttaccttttgtataacatgattcattgcggagcaccagactgagaagtggcggagataagcccacgggggtcgctggggagtccatgccttgtttataagggggtgattatgatccaggaatggtgcactttggtgagttgtgttgtgcaaag

SEQ ID NO: 16566 - DNA, 473 bp, Oryza sativa
aaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatcttt

SEQ ID NO: 16567 - DNA, 1501 bp, Oryza sativa
tcatctcgacgcgggcagtctccagcaggagttctaccgatgacgggacatattgatttttcaaagcaagtcagtgcagccgagaagatcttgtacgtgtacatgagtggctagaggagaatatttattaatctacaggcctactgcatgtatacaccatcaaccaaggtaactggtatattgattttttaagtcaatctactaacttcgtagatatatctgtaaaggtacgtaatattttatacaacttaccgtaccaattctttagatcaatacaaattgttagatctataatttattatatttaactagagcatgttttctatataatatttattgtgcgagtgtttccggtgttaggtcgactacggtttaatactgggggctcgctttattttctttagtataaatcatgcttgtttacagtttacataatgcctaatatttaatctgctcgttatatcatgataatattagaagattcacgcagtctttcaagtacatgctcgatattctctgctatatatatctttttcaggaacaattgagcactcgagtaggatgtggtcgagtacatccctttatcgtgaacattctcgaaaaatgctgagttgtcacaaccaacctaccaacgaagaccgacgacttatctcatgtacagcgccggctataagttgggtatgtgagtcatgttggccacatgagatgcacatgtaataaccaactctagcgcctctataggtgattaagagacgcctactcctggttatcgaccagacagttgtaacgacatctcaccgcctatcaatctaaattcacttgtgcatcgctgaactccatctatcgttgtcgaaaactccatgtctctacggtcttacaccgggattgaccaagtgagtacggcaaatattgataaggggagtcacggataacaagagatgctttcgcgaatacggtttgttttcgtgtgcctatcaattgcctatatgtgattgagatacacctacaccaggtccttgaccagtagatcgtagcgatctctcaccacctaaaaatgcatcttcaagtaatcgagatatgcctacacctggtcctcgaccagtagatcgtagcgatctctcaccacctaaaaattcgtcttcaggtgatcgagatacgtctactcctggtcctcgaccagtcggttacagcaatctctcgacatctaacgcgacaatcaacattatcgtgatagcgacaaccaaggccgaatagatcgccgttgtcaccagaacaacaacgtctaggactaacgacattaggatgacaacaaacaaggttatgacatcacgacatcacacgacgacgatgaaactcgagatccccagacttctagagagcccgaggatgaggtagtaggtccaggagccgaacctccgactacaataattccttatcatcttcgtcgtcatcaggaggcggttctcgcaagttgcgaggacgccgtccatctattactccg

SEQ ID NO: 16568 - DNA, 560 bp, Oryza sativa
ttttccaataaaccgattttagagtgtttctcatatgaatttgattccgaaattcttaatttttgcataaatgaagttttaccccatatttatattattctaactaaagattcacctaatttaatatcactcatattttgtttatataattcatttgaatttttaattaaagttaattctcattccatcgtattaaaatttaattgttgttaatatggttgcgataacattttatttatttccaaacccacctaatctttattttaatttatattttaattatttatttagcccacttgatttttagggtttattcctagttaatttcctcccatttgtgatcgatgaaatccgaaatcaaaatccaataaaatcttcgaataaaattggcatgatgcaatttatttaaaaagtttttttttgaagatctgaatttttggagtctttgattttgttggtcgaattttcagaatgttacaggcggccacggaggagggggaggacggagccacgcccggacgcggcggcgggcgaggtaggagcttgcatcgtcgtcacca

SEQ ID NO: 16569 - DNA, 1193 bp, Oryza sativa
tcacataatcgccacgtcaatgaaacgttggacaaagacctagtcaaaattagccacgtaggcaccacctcagccaaaactgggcacaatactgctgagggaccttatttaaacggcttcgtaagttggagaacctgtcgtacccggttttgcgatgaagggatgaaaattggattgggcgataaatagagggacccaaagtgaacttattccttcaaactaaggcccgaccgcccgattcaagtggaatttggagagtcttttacccctatgccattaagaaagttggaggttacgcgtgtgccacgaaaaagttttgagtcacctgtatgccatgacgcaaactttcgtttacccgcgtgccattccatccaccttctgttagagaatgagctctgacatgtgggacccacgtatgaaaatgactaaattgcccctgaagcattttcatctctactactcctctcccgtgccctagcctagccgccgtcgccggcacgccgccactgccacctcgcctcgccggcacgccgtccccgccgcctcgcctcgtctatccggcgacgcgcctcgtctatctgccgccgccgcctcgcctcgtttatccgtcgccgcctctctagtcgcctcgcctcgctggcacgccgccgccgccgccggtcgtcgccgtcgctgttggtcgtcgcctcgccggcacgccgcctcgcctcgtctatccggcggcgcgcctctagccgccgctgccggtcgtcgccgccgccggcacgccgtcgccggcatgccgccgccgccggtcgtcggcgccaataacgttgtctttcggcgctaatggcggcccttgccggcgtgccattaatgctgattccatccattagcaagggtaaaatagatctttgaaacctccgtttgtctccgttagtgctgattccatccaaagtggcgcataggcaaaagaaagtttgtctcatgccaggtaactcaaaagtttttttttggaacacacgtaatctccaactttcttaatggcgtagggtgactagaatttggaaccaatgtcccagcagacattgaattggggattttggggcatctaggggtctcggcgccgtcgccgccgccgccgcttctagctcttcttctccgtgacgggcgcacatcgcagcagggtagcgggcgcaatggttggccttaac

SEQ ID NO: 16570 - DNA, 1501 bp, Oryza sativa
ggcaattagattcgcaaaaaataataaaacccgtgggacccacatatcagttgcacacacaaataataaaaaatggtgggcccatgtggacccacacgtcatcctcgatacccccttgtagcccgctccggccgccgcccaacccgcttcgccagccgggcactgcctactccgccggagagagagaggaggggaagagagatagaggatgacgtatgggtccacatgggcccaccattttttattatttatatgtgcaactgacttatgggtcccatagattttattatttttttttgatctaattgtcacataatcgccacgtcaatgaaacgttggacaaagacctagtcaaaattagccacgtaggcaccacctcagccaaaactgggcacaatactgctgagggaccttatttaaacggcttcgtaagttggagaacctgtcgtacccggttttgcgatgaagggatgaaaattggattgggcgataaatagagggacccaaagtgaacttattccttcaaactaaggcccgaccgcccgattcaagtggaatttggagagtcttttacccctatgccattaagaaagttggaggttacgcgtgtgccacgaaaaagttttgagtcacctgtatgccatgacgcaaactttcgtttacccgcgtgccattccatccaccttctgttagagaatgagctctgacatgtgggacccacgtatgaaaatgactaaattgcccctgaagcattttcatctctactactcctctcccgtgccctagcctagccgccgtcgccggcacgccgccactgccacctcgcctcgccggcacgccgtccccgccgcctcgcctcgtctatccggcgacgcgcctcgtctatctgccgccgccgcctcgcctcgtttatccgtcgccgcctctctagtcgcctcgcctcgctggcacgccgccgccgccgccggtcgtcgccgtcgctgttggtcgtcgcctcgccggcacgccgcctcgcctcgtctatccggcggcgcgcctctagccgccgctgccggtcgtcgccgccgccggcacgccgtcgccggcatgccgccgccgccggtcgtcggcgccaataacgttgtctttcggcgctaatggcggcccttgccggcgtgccattaatgctgattccatccattagcaagggtaaaatagatctttgaaacctccgtttgtctccgttagtgctgattccatccaaagtggcgcataggcaaaagaaagtttgtctcatgccaggtaactcaaaagtttttttttggaacacacgtaatctccaactttcttaatggcgtagggtgactagaatttggaaccaatgtcccagcagacattgaattggggattttggggcatctaggggtctcggcgccgtcgccgccgccgccgcttctagctcttcttctccgtgacgggcgcacatcgcagcagggtagcgggcgcaatggttggccttaac

SEQ ID NO: 16571 - DNA, 1501 bp, Oryza sativa
ggggcggcggcgcggcagacggcaagcggcggcggcgcgacggcgcggcgacgctggcagcggctaagcggctaggcggcggcgcggcgactagatggtgcgggagagagagagagagagagagagagaaagaggaggaggtgcctcatcgacgacaagcgacgacggcgagcgacggagggcgatggcgacggcgggacgatctccggaaccacctagcgaacacgatgaaaggagttagagagggagagggagatggaagagggcgaggacggcggccaagggcggcggccatggcgatgctcaccggcgcacggcgtggagcgggttccggcggcggaatccgacgggagaggggtggacggggtggccggcacgacggcgaacgcgacggcgtcgacgacacggctcggcacggcggctagaggtggctagcggcgaccggagcagcggcagcggcggagaggagggtgacgacgctagggcgatagagggcacgggagagcttggcgaaatgggaaaaagagagaggagagagtggggatgcttaaataggggagagggagctcggacgtggccggtagaagagggaatcgccggccgacgtgggggaagtgggagaggagagagaggcgggattcgaaaatcgaatcccggctgtctcgagcgcgggcgcaggcgggagagaggggaagtgggcgcggggaacgcgggcgcgagggcgacgtgggcgacgtggcccgggagacgtgggagcggggcgcggcggctccggccggaggaaggggacgggcccgacaggtgggccccacctgtcggcaaccccgggagagggaggcgggcggctggctcagctcggctgggcctcggccttcgaccggcccaacaagaagaggagggagagagaacgggccggcggcccattcgaaagaaaaaaaggggaaaagaaaaagaaaaggaaggaaatggattttcctgggattaaatattgcttgtgctcaattttaattggttaaaattatttctagagctctgaaaattccactaaaaatcttgttagcgtatttcgacatttagaactcaagaaaaatcccacatgccaaatctgattattatttgcattaatttattaaggtttactcttgctttacactggtattttcttgagaccatttataacttcaatttaggcttgggaaagaacttcagggtgtgacagtcaccattgccattgaccgcgctcctgtcatggcctcgcccgccgggcacggccacactcaccacatccccaaccgcgcacggcaccctgtaggatcaaggaggccgactagagggggggtgaataggcggtcttaaaacttaatggcacttaaacaaaactaacctaagttgctaggcaaggtgaggtgcaaggttaactaagcaactaagttaaattttgcaaacctaggtgatatgggctcaaatatgtctctatgaatgcaaattgcacaaatgtaaa

SEQ ID NO: 16572 - DNA, 1501 bp, Oryza sativa
gccgacgacctccggctggccttctccgctcgccgggaccgtctcccgccccggagtcgcctcctccggcttcgccgcaccgccgtcgaccccgtccaccccctcgccgagtccgccgaccgccggaacgccgtcgaccccgtcgacccgagccgcgccgccgccttcctccgctccggccgccttttttgtcgtcgccgtcgacctagggtgagccgtggaccgccgtctcttttcccccttcccttcccctctctcggccgccgctccgccgtgcctatggccgccgccggcgaccataggggcgcgggcgccgcctcctaccggccgcgccgagtggccgccttcgggcgcgccgagtggccgccgcgtggggcccggctgtcagccgcccgcgccctcgggtgcggctgacgcgtgggacccacggcgccggccggtgcgagcccgggtgcgcccggtccaccgtggaccgtgaggctgccgcgtgggccccactcccgtggacccggtccgcgcgccccctcccctcggctgacgtaataaaccctttttaaattaaaatttaaatgaaaaaattcataaatattcatttaaagagcatataaacttcaaattgccataacttggccatttgaactcggaattggaccgttcatgtctcaaatttttccttaagaagtcaagaacccatttttgtgctttgttcctgcttgttatatggagtttattagagtaaaagcccttttattttccgttggtcgtgtagacgttgcagcttcggaagatccgctcttcgtggaggttgaagccgacgtttgggaaagtgagcaaggaaagtcacatcatccttgaacatattgaatcccagtttataaaattattttgatttaaattattgcattatcgctttatttaaattcccgcgttatcactgtttatctagccatgcctatttacctttgttatgaccttattattgttattgttattatttccttgttcaccctagaataaacaaaaccccaactagtggacactctactcatggcaccactagtatgattttaggtagatgcttcactggttaattaggcaacattaggtggttttacaactctagactttgggaatactcttatcatctggacactacggaatggttggattattgtggaatgggattcacacctcaaaatggttttaggctgggctcggggtgcatggttttgatagtagcacctcggccatttaaggaccggtcttcgggcctctgttgcaaagtactaccgtacttccacatgtctagtgggtaaggcttagtttgtggctcagtctggttataaacaaaagtacacagatggagatggacgaagtcgggggtcgatggatatctctagggcaaatgaaggctacacgagctgcggctgtaacatcccggcctagggcttaataggattaatagaatactcatatcaacaagttacaactttttttccgg

SEQ ID NO: 16573 - DNA, 476 bp, Oryza sativa
agaaccccagagtccgcacatcctcaaatacaaagcacttccctagttagatgtaggttagacttcccgttcgagaaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatcttt

SEQ ID NO: 16574 - DNA, 1501 bp, Oryza sativa
taacttacatcttctttagtaaagatgaagttatcatggaagatgactgggcacccatccttggtaacctgcaaaattgatattcacggtttgttctcttctcaacatctttgcacaccgaattattgaagagacaaagagagaaggacaagaacaaaaagtaaacaaatcagtatcttctttcagcattttaagtttcatatgtaattaagcaaactgagtgtggaaacatttatcgagaatgtgtcaccataagtgtagtttagatatgacccattctaccctatctcttgtttctgtcaagaatcaaaatcagtagagcaagctgataagccattgctccaagccaaaaacaggcccagtgacacaatgattcctcctgaagtgtcgccactatgaattgctccatgtttgcgttacagcacaagatactttatagattcttttagtgcgtaggtggggtgtatgagcaaacgacaaaggcccactgtgttgattcggagctgagctgacactggagtaaactggaccatatcccatatcccatatccattgccacctacctcgtgagcgaacctaactcgtttcgtattttactaaaagagctgggagataatttgttccatacaccatttctttgtgtcggcctagctacttcatttgtttacgtgacattttaattttcatttaaagtaatgctagtatcaaaatgtttttggacaaaccaagtgtcttcctgttcctctttgataatcctaaacatattggggttgcaaacatcaaagtttccgggcatctgacaacacaatttctgaaaggagtaaaaatggccatcaccaaagtgactagtataaaatggagtactcgacgaagaatcttgatatagctgaaaaaggatgtatttctgtctctgtgagtattaaaaaattaatccggtgtggttaaatgtcttaaatcatctccaaatttcatactactccctccccccccccttttttttttgtgtgcgaagatcacaaatttacaatcggaagctggctattcgaacaacaacccccctttatttaggtttattataaaacagcaccagtgtgacgaggagaatcggaacgggaaattccaattaatcgtgccggtgagattttcgattcgcgtttcagtttctccaagaagggcaattattatgtcgatcgattcgtatttcccaagaaggcgagcgagaacgggcgggcgcgtggggcttacgtgtgacaccgcgaatcggaacagcagctcaccgcgacgcgtcgccacaccgttggctcttctgtttcgcccgcgggcggcggcgagcgctcgctacgctacgcggcgcccccactcctctgccctccatggcgctgacgcgtcgccatcgaggagaggaagccggcgacccgtcccatcacccaggtgaacgtgaacccatctccccatctgcctctcttcctttccttttccttgattggtctcgctttttcgt

SEQ ID NO: 16575 - DNA, 1501 bp, Oryza sativa
atctaactccaaaccaggagctaaacaaattattaccagttatagcatccataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtaacaataccctctgcacaacacaactcaccacagtgcaccattcctggatcataatcacccccttataaaacaaggcatggactccccagcgacccccgtgggcttatctccgccacttctcagtctggtgctccgcaatgaatcatgttatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatataaagctcaactagtcaagttataataacccaaggtatcaagaaataaagtaatcaatgcaaattggccataacaaaggaataagttcacaccacccggtgacattctaaaataaatgcatagttgaaataaatagagaattttaaatataggatcaacatgctcaaaggattgtgtttaggatctgtgtgacttgccttgcaataatcggtcttcaattaatcttcttgaatacttccggcgcactcgcgaaccttcgcaacgacgaaaacgacaagctaacacgcaaaacgaagaaaaagactaataaaaaccaaataaacaatacataaaaagtaaacaaacatgtagatcataattttagatgaattatgagacttgaacggcctcattctgacttcaaaagaatttattatgaattttataagattaaatctaattaaagcccatttaaaaagaattaaataaatttaattcaattcatggacaattttaatatgtagatctttattttatacaatttttgcaacttgaaccacattaaactgagttacaatgaattagttatgaatttttaaagattaaatcggattaaaacacttatatggattttaattgaattatgacgcaataatgaattatttttgaaaaggaaaagagaattattgcgtcagcggctagggtttgcggtgtaccgggcgcacggcaacggttcacgggaacggacggccgagatcgatcatatccaaaacggacggccgagatcgaacggatccaccgcggctcacggatgaacgacgacgatgacgtcagcgg

SEQ ID NO: 16576 - DNA, 1501 bp, Oryza sativa; identical to SEQ ID NO: 16575

SEQ ID NO: 16577 - DNA, 1501 bp, Oryza sativa
agccaagaaagtatttttaataaatggaattgcatttcatgaataatttaaaaaggtttttaaagtctcttttggctttgggccgaaagccggcccaaaacctctctctctctccctcggcccagtcggcccagtccggcagcagccgcccgcgcgcgcgtccgcccgctgacaggtggcagggctgtcttcctcctccagccgtcgcccggccgaaccctagccgtgcgccgccgctgcctttccaatttcgctcgcccctttctcgatccggtgaaatcaatagaggggaaatgatcttctcgatctcctctaccttttctcctttggaatcatcgcctaattcggtttggaaactcgtggattcgatctcgaatcggattcgtctctccctccgaaccctaacctttccttcgcgtcgccggtcgccgtgggccttcgccaccgcctccttgcccctataaaaggacccccgagctcccctctacccgcagccactctcgccttcgcccgccgccatctgtagcgccctatccccgtgagcttttgcgccgccgtcgccatcgttcgtccagccgtgcgccgccgtcgctccggtcgtcgtcgtcgctcgggaaagccgccatcgggatcgccaagccgtcgccgatctcgtccgcccctccgccgtcgctgtcgaccgctggaacaccatcgccgtcgttcgccggcgggcatgcgtgcccgagtcgtcgccggtgatgacgtcaccgctgacgtcatcgtcgtcgtctcccgtggtccggccgtggaccgatagatctcggccgttcgtttccgtgagccgccgccgtgcacccggtccaccatgaacccgacccgctgacgcaataatcctcttttccttttcaaaaataattcattattgcgtcataattcaattaaaatctatataaaggatttaatccgatttaatctttgaaaattcataactaattcattgtaactcagtttaatgtggttcaagttgcaaaagttatataaaataaagatctacatattaaaattatccataaatagaattaaatttatttaattctttttaaatgggctttaattagattaaatcttgtaaaattcgtaataaattcatatgaagtcagaatgaggccgttcaagtctcataattcatctaaaattatgatttacatgtttgtttactttatatgtattgtttatttggtttttattagtctttttcctcgttttgcgtgttagcttgtcgtttccgtcgtttcgaaggttcgtgagtgcgtcgggagtgttcagaagattaattgaagaccgattattgcaaggcaagtcacacagatcccaaacaaccctttgagcatattgatcccatttaaagctattgtttctattcaactattgcatttattttcgaatgtcattgggtggaattaacctattgtttgttatagcccttttgttcttgattactttattccttgataccttg

SEQ ID NO: 16578 - DNA, 1501 bp, Oryza sativa
cgtaccctccggcggcgttgccgcacaccccgatcgacggcgacatctcctcttcgtcctcctcatcgccgtcctcgtcacgggggaacagcctctcggacatctcccccggcatcgtgtcgtgcgccgcgccacgggacagcgcgaggccgtcgccgtccacttcccacgcttggatgacgactctgctcttcgcttgctcggctctaccgcagcgcttcgctccgaacaggacgagccgctcggcgccgccgcggccgggggcgaggccccatgtggagacggtggcgtcagggcggaggcggcaggtgggtccccactgctgcttcgccggatcgaaccagcttgcccacccggtggatctgtctgtgaggtacactcgctgatccgtcgcggccaccgagagccacgtcgccgccgcggactcccgcagctcggctggcatcggaccgcaggccgtccagctgccgctttcgtgtacctccaccaccgaggcgtcctcgccctcgcccagcgccaactggcacgcgccgccgagggcgacgacgcggtcacccaccgcggcgaacaccgggtcgacgcgccacacgccgggggccttcagcgcgacgcacacgtccttcccgagggggtccccggacacggcgagcccggagagggagagcgcgcagacgcggtccccgcccgcgccccgcaccaggcggacgtgcgacggcgtgtcgtggcgcgctgctggcacggtgacccacgcgcccgagtgcgggtcgtacgccgcggtgcggcgccgccggccatggaggtggaccacgagccagggcagccgccggggccgccgccgcagcgcggcgcgcaccgcgcggagccactcccgcgacacccgcgccgatgcggcgagatcggccgccggcacgcgctccaccaccgactcgagcacgtcgccgtacaggtccatctccccgagcgacgccacgccgtctcccgcgacctcactccccacctcctcgtgccgctgccgcccatgcttcaactcgtgaccccgaactcccactcccgcacacatctccaacgccaccatagctcacttcaacacgactcacccgcaaccgagaaaccacctctcgttgtctcgcttcctcctatcgttgtttcgcttcctctccccgcgatctccacctcgagctctggaatggcgagccaaccacggaagcgccggcgcttaaaagggcaagaccagtgcgggcaaccagcccggtggtcaatgaccaatgggatcggaattcggaagggatccacccaaacgggtggagccgacacaacgaaacgtcagcggctgcgcgacctgatcagtgcagtgcagtgcagcgcacgacacgatcacacgaccgcgacggcaagggttatccttccttgcgcgttgcaccggcgcgcctgaactgaagctatcagcgttcgtcgcgaacttgcgatctcgattttgttttagaaaaacaataatgtcgtg

SEQ ID NO: 16579 - DNA, 1501 bp, Oryza sativa
tgcagcggcctcgtggcggcggcgacgacgggggggcggcgtactcgcgtcggcggcagagggaggaggcggcgccggccgccggtggtgtcggtgacatgggaccgggagtatcgtgactagaggcttgggcagccgcgctcacccacgtggcctgaccccctcgggggggtcaggcccgagggtgacgtggccacccctccctctgtctccccgaggggtcgggccgctcccgtttcggccccgagggctggggcgccccgaccccctgtggtgttggcgccacgtgtgcgggttaggtgagcacagcggcgctcacctaaccgcatttattgcgggttggacgagcgcgccacgccgcatttaatacagcgcagcgcgctcgcttatccggtccgtgaccggtcgcagtatgtgaccagtcacagatcggtcggatcgcgggttaggtggcagcaggcggcctgtcacacgcctcgccccgtcccgtcggaatgatgagagcctccaggcactcgtccctagccggagccggtgtgctaactcctggagttagcacgccagtcccggctagatacattccaggcttcatcgcaaccattgcaaagaagtcattgtatgaagaaggacagacgtgcgacatgctaaactgacacgtggtggacaagaatgaccggtctgtgactggtctgacgccggtcacgtcatcagcagacaaaccgtgctcccacgttgcatctgcttccagcgaagtggaggtaggtatgacccatcccatcggagggtcattcggacagcggccattgcaaatctccgcccattaatggaggaatgacagggtgatcccctgtgtcaggcgagtgacggcgctgggcctcactcaaggacaagctgtgatttagcttccaagcaaaggcgcgagccaagttctgatcaagatagggtggatccccacccaaaagaagggtaggtagaagtggtgcatgtggtatccccttgagatataaaaggaggaccttgcccaccgaagaaagagaggggagatctagaacaagaataggggggacgactctgagaatacctgagctcagggagatccagaacaagaataggggggacgactctgagaatacctgagctcgtagaggacagaaagaggaagaggggttctagagcctgaactcttttgctctccagctctctgtaactccttcacacacagatccaccataacacaggagtagggtattacgcttcttagcggcccgaacctgtctacatcgcccgtgtcttttgcattggctctctcgcgaacattccacagatcgagggtgaagaacctcacttagcgcccccggccgaaccggcaaagggggacctgcgcggtctcccggtgaggagccccacgctccgtcatctggcacgccaggtagggggtgcgtgtgactttttaagccctcgtcctctttcgtgtgccccaagcttctcccgctcagcccaa

SEQ ID NO: 16580 - DNA, 1501 bp, Oryza sativa
attactgcgagtttccgacatcaaaattatcaacaagaccatgtccattacacaaaatcagacgcccgccactgcaaccaacctagcagcatcacattaccgtgacatcaatgcgcaaccattcaacgttttgcaggcgctgctagaccgcaacaccgttcaccgcaatcaaattaaaagaaaacattaaccacctaacgtttcaactttgaagcagatctgtgggacttcacactgttccctcgcagcagccattatccaaacgaatcaggcgaagaaaccaactcttcagactacgcctccccatacaacacaatgatacatgcaaatcgcgcgagaagggggcgagccattttacccggaagggagggcgtcgacgtagctgatgatcatcttgagtttgctcccgccctcggaggcgagcccggcgtgcatctcgacggccatcgcgtccgccacctgccgcagccgccccggcggcgccgcgcaccgctcctccagctcccgcagcaccgcgtcggcccggccccaccgcttcgcctcccgcagctgccggcgcaccagcagcgccacgccgaccgccgccgctgccgcgaccgccgccgccgccgccttcctcatcgcggtcgcccagcctctcctcggcgagatggggcccttacgtacatatgtgggcctcagccaccatcccgtaaaggccgcgcggcgctgcagtgccgttccagcccagcccaactaaaagacgtcatgtggctagagttggaaaaggtccactctacatccctcagctgtggattaattttcaacccaaaactacacgaaatgagcccagagagtccccaacttgtaaaaccactacaaatcgagtccttaacagtatagagggcggtttttgactaacattgcgcctacataacttgttgatttggccttctttcacatatgttgcgcttacattatgttctagtctgcaaaaaatgagaaaataattcaaatgaaaacgtggtgtttgaatctcctgaagatgaagataaaaatttaagtgtttcacgtaaaacgaggtggtaataatatgtgattaattgagttttaattattacaaacttgaaaaatggattaatcttatattttagaacaactttcatatagaaattttcgcacgaaacgcactgtttagcagtttgaaaaacataccacgagtatccaaaagttaatccaacctttgttggagaaaaaaacaggccctcaatgggctccacatctcagtgacaatcttcatccccttacctgcctgagttgagcttgagctcaaccatccatgtgggctagtcccctccctccatctgcctcccgttccatgttcctgcccgccgcgggtgcctctccgtctagctctaaatcggctgtgggaaaagaggaagggaaattggtctgaaggggacccccacaactgatatgtaggtcctatcgagtttattattatttttattttttttcctta

SEQ ID NO: 16581 - DNA, 1501 bp, Oryza sativa
ccgagaaaacgttttcgatggagaactagccgctacctgcatgtttttataggttatggctcgtgacagcctcggcgtttcccggtgtccaagttctactcgaggtcgtcagtaatcctgctcgaactagtactctatccgtctcgtattataagtttaattctttttaagttaaaattatttagatttaattaaattatagaaaaattaaaaacatctgtaataccattaatttagttaaatttaaattatattttaataatatatttgtttactaaaattattagtagtatattttttataaatttaattataaatttagaaaaatttagaaaatgttaaacgactcgtaatacgaaacgtattgagtattgcagatggacgggaagacgaaacccaaccgaaacggagccacgacacaggcttggattcggttttcttcacccccgcgggctccggctccgttccaagttcccaatgccaacctctccttccacgaacgccacgtcgcggtcgcgggcaacccacgcgcccagccgcccacgccccaaccagattggcatcgcggccgtccatcgccgcatcggcgcaggcgcggacccgaaacccaccacacggcaaaccaaaaaaaagaggcctcaccgcacggacgcggaaatgggtcgcgacccaacccacgcattccgcccccggctccgatctgctaagccccctcggatcgggttgcgggtcccctcctcccccccgacccaccaccgctcgccgccggccgcctccgacgaggtcagtccccgctcccttcctcgcccttccccccatccccacgctgcctcctccgcctcctccgtggtgttatcgggtccagtaaccggagtcataaaccctagccgagggcgcggtctacgagctgcttcgtgcccgatttcatgggattcgagtgtggggattggacccatggaggctccgatttagcttgtatcttccagatcgctcccttgtatacgctgattgcgtcgttggtttgggacactggggattcgggcgggttgagccggtgaggtgaggggatttaatgaaggtattttgtgcgtgtttcatcaaccgggcggaatggcagcttgctgcatctccagatgttttaatgggatttgtggattatcagaggcgttctgtagtgtgagtgtatgcttaggatatgagcttttcctgccaatttctacttgcgcgtgtatagttatagcttgtagctacaagtagaagagggcatggagaaaatatagtaacatcaaaggtcactcattgctttccagtgttttggacgcgtgagagtttgtctggaaaagagagtcaaaatgatgctattaccttttctttgtatggatgtagtgtctttatatatactatattgctactagcgttgcatgatgtgcttgtttggatctgctgcagtgggcgatcatatttagatacaagatagcatgctggagccaacagctatgga

SEQ ID NO: 16582 - DNA, 1501 bp, Oryza sativa
acgggggtcggtctggtggatggatggacgggtgcttcgctagctataggtagctgcacgcatggagatgcatgcgacgcgatgcgaaggcacggacgcgggaggagttgggagatttgattcgggggaggcgcatgcatgcacggacgcggctaccaaggaggattttgcaccgcgggcggcaaaaggctactaatactaggtgactattcctagctgtattgcctatcgagctgcgcatgtgcatacccttgcgcagtactcctactgctactacgcgttgccgcagcgagtagtgacacatccatgtccatagatccaaaaccctgccacgcccttccagagaaagatcgagcagagagcagtagtagtacttcgtttttggtggtggctgtagggtgctgcgacgacggactttgcttgtgcgccggtgcaataaccaaaagttgttgcgtctcattactgcacgtgcgtgcgtgcgtacgttcgtgggggcgtgtgcgtgcaccagcccagttggtttgttggttaggtccggtatgtaggcaggcccggccgttggggggacggacggtacgcgcacgctatcgagtttgtggtagaaagtagccggcgcccccccccccccccccatcgaatccgttcttccctacaaaggtttaaaaacacaaaagatgttattgcaattgattgttaacgatttgtgattcataaatttgggttcttcgtacggatatcctctccaaaaataatatgtattatacctttttcttttaaaaaacttgtgcacactagctgctagtgccagaatgagtagtgtgcaagctaagaaaaaagaaacaaccacaaatgtttttttgaaaaaaaaaattacctatgacgatgggggagacaatgctttcatgatgcaaagtaagcataactcaacctgggtttacaattccgatttcgtgaaatttcaacggctcgacgagactcgaaagtagaaaccatctgagagttcgaggagtttcatccaaattcaaaatagaattaataaaaaaagaaaaaaatcaaataaaatcttataaatactatgatattcatagaacctattgggataacaaaaatttaaaaaataatgtattgtgtgtattaactcaaacttatatcaggaaagaaaagaataaaaaaaataataataaaaagaaaacacttacatgtgctagattgcatgtactaggctcagttactgatcgaatttttgatgatttcgatcggaatttcgccaaaaccgaacttatcggtaaactcagggaatttgtattcaagttttggtttatgaaatttgttcggaatttaccggatttccaccggatttcacgaaattccgaattccgccagagctcgaaacggaagggcctgtcagaatcgtaaaccctgaactcaactggttgagtttctggtggtggagcctgtctattcgattctatacttgacatggtgctcgcatttagagcta

SEQ ID NO: 16583 - DNA, 1501 bp, Oryza sativa
tacgagtagtatctaccttgtttgtaccatatctcatttaagcttatgtatccatcgaattaatgcgaactggctttagatgcaggaatcttgtgggtggttttatgtttagttgatcagctttttctatatgctattatgtcaattaacaaagaaatcccattctgtgctttatttgggtgatgcaaaagttctgcactacctatgtgaaagcttggcttatcatgatggatgataaaatgattgaatttgaccttcattggtagcttcaggaaatttaatactcaatgtaggatttttgtttcacctgatttaattagtttggtaaaattctaatggaatgccaactaaagtactttttcctgacttctaatggttcacattctaaagtaagttgcttttcttaatttgcattcagcataaccatgtggacctcaagctggtcaagataaataaatgttttatttagcttagccattgtgcagtactccctccatccacaaaagttagacatatttcacatttgagtttttccaaataagttgttcctatttgtagtcttcatgcattcaatacataaatgaagagataaattaaatgtttgattagaacccaaggagtcatttaaatactcattggttgcatgcttgcattcactacttgattttgtaacatccaagatgatttaatttctccttggttttggtgacaaaagtaatatgtgtaacttttgtggatggagggagtatgaaagttggaaggatctgttctttttcatgactaaggctggaaatagcaaagttttgctgatatgggattatttccaatctattttgcatgtcattgatctattggggaatcacatttggcataggtcctcttttaggaacttgtacatcagtacttgtaagtgtttgccatagttgttgtgtaacttcagtattatgaatgcattttagctgtgccttccacacttccctgtgcttacacgtgtgaagatgctattttattttctcaatgtttcctatctttggcccatgtgtattttgcaatcgagttacttgataacatggagttattgcattgttgcaaaaatcttttctctgactctttactagtcacatttagctatcctgttctatttccttagattctgtaagagcaaggctagattatatagtaggtcagtaatgcgaccatttcattttccagtttttaacgcgagggcctgtgcagattatattataggtttatagcacaagagtgtagtgcatctctttgtcaatatttgaggtaagaaactgcattctgctgaagagtcgtataaatgtaatactgacagttgttgaggtggcatgtagcacagtagcagtatgttatttcacttccactgctaatataaaagcaaaagaagttgacccttgtcaatagaaacacttggcttctcatttagacatcttttttgatgtcacaggaggattctgaaactggagaaactggt

SEQ ID NO: 16584 - DNA, 1501 bp, Oryza sativa
ggtgacggaggcaggccggcggtgaagtcgtagacgcccaacaatggcggcataataggccaaccgtgaaggcggagacaccagtcggcggcggcgaaggcatgccgatcggtgaagatgatgtcgccatcagtaacggcgtcgcaggccaaccatgaggaagggaccagttggcaccgcagcattacatgtaaatagcaaaaagtaccaagagattaatctgatatttagagatcaatccaataaacaacaataagttactaatggcgaagtcggaaattcaattgttgagctcgccgagattgatctccttatctggactgactcagagacggagaaaattggcaattggttttgtactgtgcacacataatcgagcaatctgcaactcggcatgcatacaggacaacacaacaaaccaatttggttagtgataacaagtatgtggaaagaagcgtgcatattttcatgtaaacgtgactatctctgaactggttggtcagatgggctctcatagagacgtggtggcgatagggaaaaacatgctgacacccgtatatgcaaccaaaaaatcagaaaaggtaaatatatgttagggaataatctaaacacaaacaaaaattgcgaggaagctaggaacggcagcacagccaaatcccatcgcccagcagcgaacatagatctctattgccatcttgtgcatgagaacaaccatcgctccagcatgcataaaagacaaacagcaaagtttgatcaatctgttagtaggaaaaaaaataaatgttccatatatggatcaatgatgcacagcaggtcgatcggatcaacacgtcgcatggttcctgacgtgggtgcggccagcccatgacccggtctctaagcaggacttggatcgtgaatgattcaaaaacttagccagctccgtccaggagtacatgcaaacaaccagcaaaatcattagtaaatcaaatgattagttccgatccatgcatacatatatactagatattggtctctgtgttgcatgatgcatgcgtgtgcatgtccctggatggccctcctgatgccgtcattggaagtagccggcagagctcatcaaacaccagttcatgcatgcaaacaaaaatcgaacaacagatcaatctagattacaaatccatctaataatactgtattgaaatggcaaactggtctatgtcaaagattgaagtcttcgaacttggtggggttgatctaggttgattccatcgcactttttgatgggtaattcgacgcacctctacctggcgcgccaacagtcgaaacatgaattcggcaataataaaagggggtagcgcatgagatctaaaagtggatggatgcggagacaaggatttagacaggttcagaccatctcaatgagaggtactgccctactcctgtttggggatttgaatccgccgggtgtagtattgatttgacgaccaggtgtgttcatgccccctatagggcttcctgccca

SEQ ID NO: 16585 - DNA, 473 bp, Oryza sativa; identical to SEQ ID NO: 16566

SEQ ID NO: 16586 - DNA, 1501 bp, Oryza sativa
caatatcatgcaacaatttgaaagacgatgaaccacaaatgaggatctttcagtagaagaattgagcactttgccccacaacagacaggcaaattctgaaggacgcgagcatccgaccgaggtgtagtaagaagtaagcagtgaccctgacctctggcataggaaggtggaggcggccagaggtatcccggccgcctcggcgttggcggcgaggcgtcgccccagcagggcgccgagggggcccgccccggcctccccgcctgcccacgccgccagccgctgcaggtgctggaccctcagcagggaggccgcgtcagcgcgcgtcttcccggagctctcctcgcggagcgacaccgcctggttcccggccctgggcggcgccgccggggcatggccatggccgccgcgcttcttccccatgtagccgccaagccacaaccgcgaggaaggcaacggggcggggggcggggggcggagggcggcgggcggcggcgcgggagggagtaagcggaggcgaggaggcggcgacggcgagagtgtctgggtcgttgtgggccggttgggccacgccgccgcttaatttggactagcttcttttcgcctttcaggtttccagttcgagacttcgagggcatgttgatacataaaagaataagttcaccggaggtacctcaacttaattttttttaggtccttaaacacaaaaccagaaatcttcacccctaaactatacaaaaccatacactaaaggtcctatggcagtatatacagcgagatttttttaggtcccttaaatacaaaaccagaaatcttcaccctaaactatacaaaaccgtgcactaaaggtcctatggcagtatatatgggtggttctatggttcataaaagggtccataaaaggacatgggcagccaacagagcaaaagttggctctgtttcgtttgaatttatacttaaattcacgaattggtccataaaaggggagaaatcagaatcgcctgtcacctttgcagacgaggggacgccattgaagttagttgtcctctgttgtggctgggttttcttgttcagcatctactatgacatccgtgccctgttctggggtagatgagccagtaacttgggtggctggatcgacattttcattgactgcctctgctacttcacaattctccaacagcgcctgagctgacgtgctggatgagagcacattgttggaatcattgtgatccacatacataggttccaccattagttcaatctggcccatttagttaggattttccagatgtccatcttgatcaacactagtgctttgctgtgggattgcagagcctggagcaggagtggctgtatcacactcatcgatggctggtgtagctgagtgactgtgttcctccaactccagtgaaggacatgggcagatgacattgttgaaaccattatcctcctcatccataggctcgagggtcattgttgcatcatccaccatgtgaagctc

SEQ ID NO: 16587 - DNA, 1501 bp, Oryza sativa
aacttctgaccaacgtgacgtttttacctcacaaagctatgtcgtttatgatacagtggaaaaacctggcgccggtgcagctgaaggaggagttggagaaggtaaagcgatcgctgcttgccaatatccgcgagacaggagattcaagcagctgatgtcttcgtgtccttgatcttttaggctgttttctgttatgctagctgtgcattagctttctggcttgtctgttgtgccagcagcacttctacttagactctttcgctgttaattgtgaagctggcatccccggcactactgtatcagactcttatgctttcttataaaagctgggctttatgccttttctccaaaatactattcagtaaaaaaaatcgtaccagtagtattttctatagcttgttaagccaaaagtattgttcagaattggcatattaatagagaaatttgagatgaacttttcatgtgctatatatgtggatcatacactggacagaagtacaaatgatgagttgaagtgtctggagaatgattgacgctagttgataacgatggtcatcagtctgaatgaagggtaattttagaggcttggttttcccggacgcataagcaaagaattcggatacatggatatgaggggatgcagattgctgcacgaaatcgaaaagaaagttgcctgccgattgatcatttcagttgatctcttttcaaaaaatcatttcagttgagcggttcggttcagtcagttgaggcatccatccatggattgcatcgcatcgcatcttgaggtaggtggtgctttggatagctctgaattcaagcaagcatatccaaccgaccggatgatacgttagcttccagattccacaagctatccaagaaatcatcgtttttgcttgcgtctcttaattaaatgcatccatgcatgcgcatcataatatgcataaaaaatgcattagttcatgccccacaaagtagcattaccagtacctgaattatcagaaattgatcatttgcgtaatcatcactaagttcgttttgacttggattcagagatatctgaagccggtccatcggatgaagaaacaataatattaatttttccctcgaatatactactacttgcagcatgtacccggtactccgtactagtatagctttcaagcgttggtgtgaaagtaatattaaggtccagtagaaagcacgtgtcttgcttacgagaagcagcaacacataaaactttcagtaaagtctcttctcttgctcatgctagccctgtcattttcagtcctaaattaaatctctctttcttgtccatcggtttatcaaagaatatcccactcaaagagcataattcaggtttccttctcaactcaactctcctgatctctctggctctgcctctctctatatagtgtcacagtgtattcatgcagaaattgatccaaaccaaaaccaaaagtgaaaaaagaaagtaccaagaagaatataatcaacacaagag

SEQ ID NO: 16588 - DNA, 1501 bp, Oryza sativa
ggatggttgtggttgactggttgtgagagtgaacgttcgcagcacactatttataaccggtgcgaacgattcgttctttcccgaagctcgtcgaacgttcggagctttgagattcggacggtacattgtacatgaagggcccgatagagctttcccgaagctcgtcgaacgttcggggctttgagatttggacggtacattgtgaaggtttatttgctggcgtccactgttgctcgtctactacttgatttcgctcgttgactcgccaaactggagcccagcttgttgggggtggctgatcggttgcgcgcggggctgcagccggcagccggccagccgcgttgtcggtccgcccccatctaacccatcaatacaatatacagtacatacgtatatatacacatatgtatatgtatgatatatatttatataattattttatacgtatactaacaaaattttactatatacatatacaaagtttctatatatgtatatacaaattttgtgtacatgcatatataaactttatatattcatacgtattaaaaatggaaaaaccaatacgtatacaaactttatatacgtgcagaaatatcggaaaaaccagaaaaaaaacgagggaaacccgaaaaaaaaccgcgccagtcctctcacaagtctcaacacgtaggggtgggcattcagtctaaccgaaaatttcgatctcggtttcggtctttcggtcttttcgatctttgaaaagtgaagaccgaatttccgcgaaaaaatatcaggaccgacaaattcggtctcggtcctgaccgaaattcaacaacattttcatatatgcaaagaaataatggaaattttcaacacaaaaatcataaaaaaaaaattcgtaagcacttataagtaaagactcttattaggttaaatgcctagaagaagtagggatgtgaaaattaaagtttaatcctattagacatagtggattgtaggttgtattttgacaattttttttgataattcggtctattcggttacccgaagagactaaccaaattgaccgaacaaatttcggtttttcgctacctaggaccgaattgatcaccgaatttctcggtctcggtctcggtctttttggatcggtatttttctgcccaccccgtatcaacacgcgtcgctctgccgtccggctctccgcgcgatgctacgtggccgcgcctagtagcattttcgagcttggttggtggcggcggctgctgctcctgcagctgggccaggagcagccgacggatacctgtagaccaggtttgatattccctgtgtctttcacattagacaaaatttgctacaggacttaaagattgtggtctttgctgtgagacacccaaagatcgtgtatttgtttgtagacacggtaaaaaaatggtaattagctactggacactcctcccattattttattattttcgatgaaaacggagagagaaacttaagttaaagacaagtttgtcca

SEQ ID NO: 16589 - DNA, 409 bp, Oryza sativa
tggttgggcacattggtgaaatatggatgcatgaagacatactattcaaaagatgccctttacaagaccatcaccgctcatcctaacaaggatgggcacgggctcgggttttcgggtggaagtcctgtgtctaagcgtgtgatggtaaatgggaaagaatgcttgatgttaatgagagaaggtaaagctccacaagaaagtgaggtgactagtcttgtgagccgccagggacccggaacatccggacaaaccgggcgaaacctccgggtgggagtctctgtctctcagaaattcccaccaggaagttccggccggtttgctaggaagttccgggccaatggccgtgcacaagacatgtccggaagttccgggcataatgccaggaggttccggccagatggtctttact

SEQ ID NO: 16590 - DNA, 1501 bp, Oryza sativa
aatcaaatgcaatgtgtatgtaataatattgcatttgaaaggtataactaaatactaaactaaatccaaagtctatgcgtgatgatgttgtcaaagcataaaaatcataaataatgatgaggaagaaaaaatccatcccctcatcaatgaagtggacttcagtgccttcacaacctgttcttcagcccttagtgcgaaaagccttcacaaactattcttcaactcttcactaattcagagacgatgatgatgacgagatgaatgaccttcacaaactattcttcggcccttcaatgattgacgatgatgtcaactccgattaggagctggtgatatgacaaagatcagctccgacgtggagctactgatgatgacagaaggctaactccgacatggagcgagtgagatagtgataatgattgacaagcatgacttcggctgcgttcgaatgtccaacgattcttggatgaaattttagattctcgtggcacgcttttcaaactactaaacggtgcatttcgtgcgaagactttctatatgaaaattgctctaaaatatcagattaatccatttttcaagtttgtaataattaaaactcaattaatcacacgttactaccatctcgttttgcgtgaaacacttaatctttatcttcatcttcagaagagatggactttgatggacttgatgatatagcaaaaataaatactgacatgtacagcaaccaggccaagaagaagaattaaactaggctaagaagaagattaattctgctaataacatgctccgggacgaattcaacgagatgtaatggattttggtagactagataggaaacatagcgttggtgatatggacccgggggtatcacgtctagagggaggaggctgccctcaaacccacgtggctctccccgagggggatcgagcccgagatggagcggcggttgcctcctccctctagcctcaaacccacgtggctccccctaagggggatcaagcccggagtggagcggcggctgccccctcccagctagagggaggaggccgccctcaaacccacgtggctccccccgagggggggtcgagtccggggtggagcggcggctgccccctcccagctagagggaggagaccgcccacaaacccacgtggctccccccgaggggggtcgagcccggggtgcagcagtagctgcccactcccagctagagggaggaggccgccctcaaacccacgtggctccccacgaggagggggggtcgagcccggggtggagcggcggctgctgtcacgcccagaaattcccgaatagaatttcaagcagaatgtgcattaaaatccccgtccaggaccggccggggtacacaaacgacaatgttgacattcagatccacgtcttacaaacatcataaaagtcttacataaatgcagcggaagaaaagaaagacaacaggagctaagccttgactaaaactacagcggaaacaccactccacagg

SEQ ID NO: 16591 - DNA, 1310 bp, Oryza sativa
caagtcaccagtgtcatggataagaacataagctattttgggtggaagcacaaaaatatagttttgaagatggcatgcaaaaaagaaaatgacacagccgctgccacatgcaaaattttctcaaattttagtgtcttacaaaaacataacaataggatgtggccacattctatattccaaactggtgttaaagcttaacttataggcataactgttgcactcccccataaaaatgagcaatcatgtttctcaagttgtcaacaagtattaagaataaatcaactcatgacaaaagttgactagtttatcctgagctgtttgtattttagtgccagttgcatgacacttgcttacaaaaatgatagaccaatctgaacgaataacatatgggctaacgaattatgttaaaaaggttagaaaaacatgtgtacaaatggggatttaagttaatgatgaccgatgatcattgtccctttttttgaaaacatagaacttatttgaccatttaaatagccacaatgtcatgctagaaaaaataccttggcaatcatttaccgttccattagggttaaatttccaattattaacaccaatcagaacaacaaaacaagagtcaaacatcaataatcagttctgacctgaaattattattcgttattagacattgcacacccctaagcctgaggaaatgtttctagttctgatttgttgttttaaattttaattatattgcctggataatcaagacagttgtattgctctaatagcagaccaggtcctcccaataccctaaagcataggaaaggaacacacagacaataagtctaaagagttacctgtgcagggaacctaaagcataggaaaggaacgcactgacaataagtctaaagagttacctgtgcagggaacctaaagcataggaaaggaacataaaacataggaaaggaacacacagactaaagagttacctgtgcagggaattttccatggaacgcgcctcgcacaagatctaaccctccctttgtcttggccttgtatatcccatagagcagcttcaggtcgaagtcatagaggaacagttttgcccctggctggatcttctccaccacatcgatcttccccttaggcaagccaaacacaccattctggaagcactccggctttgtcttagcactgcacatgaatataaacccagcttcacccttcctctccctcgctttatcgtccttcttttccttcccctttattctccccttcttatcctccttcatctggtccccctctttcatctttgtcttttcctttctgct

SEQ ID NO: 16592 - DNA, 1501 bp, Oryza sativa
ccactggtgagttcgccgagtcgagctctacccgttggtaccctccgtttgcgccgtctcgccgccgttcgccgtcgagcacgtgctcccgagtcgccgccggtgatgacgtcaccgctgacgtcatcgtcgccatgtcccgtgaaccgcggtagatcaagttgatcttggccgttcgttttggatagggtagatctcggccgtccgttccgtagaccgccgctgtgcacccggtccaccgtgagccgagcccgctgacgcaataatcctcttttccttttcaaaaataattctttattgcgtcataattcaattaaaatccatataaatgttttaatccggtttaatctttaaaaattcataactaattcatcttagctcgggtttagttggttcaagtctctaaagttgtataaaataaagatctacatattaaaattatccataaatagaattaaatttatttaattctttttaaataggctttaattagattaaatcttgtaaaattcgtaataaattcatatgaagtcagaatgaggccgttcaagtctcataatacatctaaaattatgatctacatgtttttttactttatatttattgtttatttggagtttcttagtgttttccttgttttgcgtgttagcttgtcgtttccgtcgtttcgaaggtttgtgagagcgccggaagtgttcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactctattccttgataccttgggatattataatttgactagttgagctttatatatattggttcaactagatgttagatataattgctttgcaatgcttagaaacattagctcactaatgggatgaatcatatatactacattattatttatggttatatttaatggtagctcacgatggctaatcgtgttatgataattaattggtaattaaaatatgattaatggtgggttgtgagcacatggttttgaaggtcgtgctcatggcaattaaggaccggttcgcgagctactgttgtgaaacattaaccgtgccaaccacaagccagcgtgggcaacggctttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcagagtgtattgtcacagcctctattcgggtactttccagtatcacgacgcatggtagacatgatgttgaggctgtgtcttgtgggtacagtggtacacctctggccagagtaaaactattcgaatagccgtgcc

SEQ ID NO: 16593 - DNA, 1501 bp, Oryza sativa
acaaaagaaaagaaaaacagcaggcacggctattcgaatagttttactctggccagaggtgtaccactgtacccacaagacacagcctcaacatcatgtctaccatgcgtcgtgatactggaaagtacccgaatagaggctgtgacaatacactctgcacaacacaactcaccacagtgcaccattcctggatcataatcacccccttataaaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaacagtagctcgcgaaccggtccttaattgccatgagcacgaccttcaaaaccatgtgctcacaacccaccattaatcatattttaattaccaattaattatcataacacgattagccatcgtgagctaccattaaatataaccataaataataatgtagtatatatgattcatcccattagtgagctaatgtttctaagcattgcaaagcaattatatctaacatctagttgaaccaatatatataaagctcaactagtcaaattataatatcccaaggtatcaaggaatagagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaacacttccggcgctctcacaaaccttcgaaacgacggaaacgacaagctaacacgcaaaacaaggaaaacactaagaaactccaaataaacaataaatataaagtaaaaaaacatgtagatcataattttagatgtattatgagacttgaacggcctcattctgacttcatatgaatttattacgaattttacaagatttaatctaattaaagcctatttaaaaagaattaaataaatttaattctatttatggataattttaatatgtagatctttattttatacaactttagagacttgaaccaactaaacccgagctaagatgaattagttatgaatttttaaagattaaaccggattaaaacatttatatggattttaattgaattatgacgcaataaagaattatttttgaaaaggaaaagaggattattgcgtcagcgggctcggctcacggtggaccgggtgcacagcggcggtctacggaacggacggccgagatctaccctatccaaaacgaacggccaagatcaacttgatctaccgcggttcacgggacatggcgacgatgacgtcagcggtgacgtcatcaccggcggcgactcgggagcacgtgctcgacggcgaacggcggcgagacggcgcaaacggagggtaccaacgggtagagctc

SEQ ID NO: 16594 - DNA, 364 bp, Oryza sativa
cggcagcggcgtgggacgcgaggtggcgacgcgatgggcaagcggcgcgcgggtcgcggggcgcgagacggtgcgcggggcgcgaggcgacggaacggggcggcagcggcgacacgacgggcgcgcggcgatgggatgggcgggcggcagcgacgggcgacattggcgcggcgcggcagcgggacggcgatgggaacggctcggcagcggcggcgcgcggctcggagcgacgatgggacgcgcgcggcgatgggacgacgcggcgcgacggcgatggcgacagcgtggcaacggcggcgcgaggcgcgaggcagcggcacggggctcgaggcggcggcacggggcgcgaggccgacggcgacga

SEQ ID NO: 16595 - DNA, 1501 bp, Oryza sativa
gtttgtggtgttgtacatgacttcacctgcatgccaagccaccaaagggtgcatatattgaatgcaattcaatattttataagattattcatgcatgatgttagtttgggcctatctattaatatgagtgtgagacatggtgtgggactgtgcatgggtgtgtatttccctcatttctgcattctcgaaaggtgtcatgcattgtgctcatcacttagagtcgtttcaaattacagactttgaaacttggaaacgtatcatatgcacacaagccagctttcttttatatacatcatgcatatcaactaacaaaacttcatcaattttttttaaaaaaaattgtacatgtgctttcagtagtatcatatttatatgtaaagtctcatcttcaaattcactatatatatgaagcaccaaataagacaaaattatgaccgatttattcccttgaaactaccagaaattatagttttttttgttacggctagagcataatgaatttgagattaagactttacacatatgtgtaatataatgctattggaagtatatgtacaatttctttctctagattttttaaattttgttaattagtatgcatggtgtgtacatggaaaggttatgtgtacaggatacgttcccttaaaacttatactacccgtgcggcatgtgagtcatcctagtcatactctcccttgggggtggaccttcccttgttgcaagctgtgccatccaccatagctacttgccagcaagggaatcccatgcatgccttatgtgttgaacatgctaaccttggaatcccatgcatgtatttttctttgaggtactgaatatactaacccttgaaacatagcgatgaattagtgcataattaattaagtattaaaaaaactagattttgaaagcaaaattgaatgtatatacaattcttgcatctcttttcatgagtacaggtatattttatatacaactgtaccagtcaaagtatactcttataacttaagagatatttaggtacaataactttagtgcaaaatttcacctagtaccgaaggtacctgctcaagtacggtagaatcactcataatctaagtctaccaatctaccgtgaccaaacatttgcataataatagctattggccggaatgagagtataatagcttttagaatgaatatggtgactccatttcgccctctctcgtaaattatctttttatataattgcaaaccaaaagcttaacattcatgatgacacaacaagagacgttagatatctcccctcaagcgtgtcaatttattgtgtgcaattattgttccctattaattgctataaatatataatctagcttaattatttagtaccactaaatatagctatttgctaattattcttgccgattttttttttaaaaaaattaacatttcatcctgattgttcactatcagttatcacagcaatgtgcgagctagctttcagctgatctcaaagcatacgatc

SEQ ID NO: 16596 - DNA, 1501 bp, Oryza sativa
attacatcatttatctagaattccttattatgttggctactcgtgctgcatggtctaggatcataaggaacttttttctttttctgaacattgagaaaagaacatgctaatatatatgttaatctggagttgtctggcgtgtatgcagctggatatataaatgtacatgcaagaactgtcaacatggattaattagcaataacatttgcatttctcatgacacattttgaagccttttcttcttgagctattgttatggttacctaggaggcagccagctagcaggtattgcttctaaagaaataatgatgatacatgatccatatttcatcttataactaattagctaccattgctatctcctggtcctgcaacgacccatctgcaggtataactaattgtcaatgcagcttgatgaacaccagtaagttcaatcatatcggtagctccttcaatttgatttaattcactgcagcatcttaattcgtggatatgatcgtatgattgatcgatcaagcctttcctttcatctgtgctagctagaattgtagctctgacatgcatgcttcatgtcattttccctctttattttgtgcttcacagacagttaacatgcattgttcgatctgtcatccggtggcgcgcatgtctcgatcggtgtttgctagatgccatgcacacgggagaacggggagatcgattgatcggtcgtgcatgtgctcggctaaaccatcgacgagcttatctgaatccatccgatccatgtgagctctggcaaaaaagctagtgtcgaatctcactttgcatatggcaaggctgcttcgatctctaggattgccgttgtttcatcagcagcagtacgttcgttccaggctatcgataggctgtcaagtgtcaacatgaatggttgctatgttctgtttggaacgcagcaatttcacaacaaaaagaaaaacaaattaattcgatgcagtacgaatgatcaaagcttcatcactcagtagtactccctatgtgtactgtctaatctggttatagattattacggaggatatcttaggacggagagagtgcttgtgtaaaaaatcataggaaggatgaaaccaaatagatgacgacgacggctgttactgtatagcacgattcttccagccacttttgatggttccatagtttatattcttcagtttatcagccatagcaaattaaaacgctatttttagcattgatcttgatcattgtatattactagaaaaaatatccgtgcgttgcatcctgaaataaaagttacaataaatattagaagtttgggtttaatttttatgatatatatcccttaaaaaatcatatttttacgtggacatggtaacttgttgaaaatagtatattccttgactaccaccttcaatatcaacacataatttctgtgatagatatccctcttcccaacttctactctcattttccgcacacacgcttctcaaactgctaaacttgtgct

SEQ ID NO: 16597 - DNA, 1501 bp, Oryza sativa
cttagttaggtgcaccttttattttgtaccattaaattagcaatttatgatctatataaactaatttataacccactattttgaactatttttaataaaaaatattttgctatgataatagaccatcaggtctatcttttgttctaaaaaagcctctaaagatctctttccagtctttgcacgttgcacattgtgtccttgcctagtgggcatatgacctagtgctctacctgaagtagctaagttgatcacaatcgcccataaactttattaaaaacatttcaaaatttataggcacactacacatactaatatatttttactcttatttcaaataaatattgttttgaacaaaaacaaacaaacatacaaaaaagaaagaaattagctgcaaactattgttgatattttggactacaagccaactaattgtgtaggtgaattgtttcctaacataaaacgccttaaaaattcattagaattatggagaaaaaatatgaaaattttaaacttgtacgaacggaaaaaaaatccaaccataattttcatattatattaatctggcttatagattatactaatctattatattatactaatttggcttatagattagtatattagattatactaatctggcttatagattataataatctatcataataatctacttatttgttttagcttatatactcctaataatttagattataataatcctaagctaaatcaaacatggcctaaatcataccttgagttccttaccgtcctaatttttccttttgacaatattgaatggtatgcatgataattgcattctcgatccaaaggttggttcaaaagtcatatgagcttgatctatcttgtaagtcgatgaattgtttttagattcacccgacctatagtttgccctatgagatatgatttttgaacaaactataatatcttgttttaataatatgaatgcccacgtgttgcgtgagtcattcctagtttttctaacaaacgctgtatataagagaattagtattaaaataagagggataccaatcacacagtgaaaaaagtgaatgggatcaagtaaaactatttaattatatgtgatgcgactgcataataaacagttcatttgaatgttttgatcttcttgttggcttatcctagaaattctcatattaataggagagaaagaaaaacagagcccatatagaaatacaatttagaaagagttgaaattcggaattaaaaaataagaaatattggaagaggataatagagtccatatagaaatacaattaagaaataatagaaattcgaaattaaaaataaggaatattataagtagagtacagagttcatatagaaatacaattaaggaataatagaaattcggaattaaaaataaggaataacagaagcagagcatagagtccatataggaatttaaaagtaactaaaattcggaataaacataataaaattaaaagtagagtttaga

SEQ ID NO: 16598 - DNA, 1501 bp, Oryza sativa
ttggtccaaaacctattgtattctcaatccagtggactcactgagagaaaactgaagaactatgtgcaaattaagtgaaaaccgaatccatattctgcagttttgtgatgcgtacggatcaattacatcaaaagagaaccaactcaactacactagctaccagtgctgttcaactagatgttgttagttcttcaactgaaaacgaactagcatgccggcatgttattgttagtggttgtggcacaagacatgcatgccgggcatgttagtagttgtggcacaagagagatctaaagccaagataaatgtggctatctatctatcagggcagcatatatgggatccgtaccatttaaattaaaacctcttggtatatgcgattatcaggctattaaataccgttcgcgaactgttgcatcacacagccggacgatcgtacgtctagctagcagtgcaggcattagctactctcaccagccggccgcgaaggcaacagcctgattgacgacgacgatggatcgaacgcgaaaagcacactttcccatttaaatggcgacctgctttaaattccatcacgaaaaatggccacagaccacaaaaagaactgaagcttttcgcagttttgccgctgttattttcgtggcataaatagatagacaacgtagttaaaggtagctacattttattttacctttattttgtgatggagaagaacgaggtagttcttgaaatggcatacatgtagcggaaaccatcctaaactctcgaggagacattccctcgttgttcacgaaatagttatgacaaactgtttgatggtattttggcgattatatgtgtacacaagacttactcatgatggacaaagcaaacaagcagtttgtaagttggctagcttatcatttctacgcaatgcccggccatgtatatacacgcaaatacatgcatgcacaggcagctgggaatatatatacttggattagtatatatgcatgtataattaaccaataactagccgtgtgaagattggctggtgaggcaatcacgtgcatgcatgcatgtactacagtagacggtcgtatgtgtgtgcatgcctgggtgattaagcaacctatgcatatccgagtgattaatcatgggctcggcccatggccgaagacggtagctgcctacgcgccaagatttcagaagttaatatgcggaagagataaaaccagatgaattaagagataaccaacaaaccaattgattttatctctataacaaacttgatttagttagttacttcgcgcgagcgctggtgaggcgcttatcaccagaccgtggcccagcagcagagaaacaaagcaaattacaaatcagatatttgacgccaggagaagctaagagataaaatcaaataaggatatgaacaaataacaaactgatcgatcaagccttatctgcaacgaacttgacgcggaggaaacggcgcgcggacgcggcgagcaccgaccccaga

SEQ ID NO: 16599 - DNA, 1501 bp, Oryza sativa
caaatcaaggatgtctggtatctcggccaggtcgcagcttcgggtagatgcatcaccagcggcttgaattagcagcgtcgagtccagggacaagtagcactacgtcggcttgaacagacaccggcatcgatgaggcttctgtgatgcgtagatgaatcggccaccgcgacttccccggcgacgacgatacgtgcagatggatccctatgcatggatgtgtgcgtgctgtatatgaaagaaaacaaaacaatcttgctagcttttacctggactagccatcaagctcctctcctgcgcttgctgatgatcggatcaccgtgcgcgccctctcctgccggacgccgggactccggccgaagtagctcgccgccgccggtgcgtgtcgtcgatggatggatcgccgatgagagttgatggatggatcgccgatgagagttgatggatggatgtgttgatgctggatgggtagatgcattgatgataggtggcttgtggatgctagatgcattggtgaatgaatgtgtggatgagttcgtgaatgcccctggctgccgaggggtcgacgccttatataggggtctggggtcggtgctcaccgcgtccgcgcgtcgtttcctccgcgtcaagttcgttgcagataaggtttgatcgatcagtttgttatttgttcatatccttatttgattttatctcttagcttctcctggcgtcaaatatctgatttgtaattcgctttgtttctctgctgctgggccacagtccggtgataagcgcctcgccagcgctcgcgcgaagtaactaactagatcaagtttgttatagagataaaatcaattggtttgttggttatctcttaattcatctggttttatctcttccgcatattaacttctgaaatcttggcgcgtaggcagctaccgtctttggccatgggtcgagcctatgattaatcactcggatatgcataggttgcttaatcacccaggcgtgcacacacatacgaccgtctactgtagtacatgcatgcatgcgcgtgattgcctcaccagccaatcttcacacggctagttattggttaattatacatgcacatatactaatccaagtatatatattcccagtatatatattcccagctgcctgtgcatgcatgtatttgcgtgtatatacatggccgagcattgcgtagaaatgataagctagccaacttacaaactgcttgtttgctttgtccatcatgagtaagtcttgtgtacacatataatcaccaaaataccatcaaacagatgcccccaccaagtaaattttgatcgtggagcgagcgaaattaacttggtgtcgtgttggctcatgcgatacatgtccggtagagtttagtcatgcgacgaaaggactcccatgctgaagcttatctccggccgtgcggcgaaagaaaaacaaagctagaccgtcatcggctaagactccaaatcctttgcagttacgagtaatttggatgaag

SEQ ID NO: 16600 - DNA, 1501 bp, Oryza sativa
tcacgcatggtgcggtccagctcggggtgtggagaatcttcaatacgcagaccctttttagaagatttcggcaatggaagtctgtcaggacgagcagttctctccttcttatgacgccagtcacgcaggaattcgattgactcgccgtggcgtttgtatcctcctcgatcatctctacggaccgggatcttcgcgatatgctgggaagggttgtcacccttggtctccttctgttgcttgccaccggatcctcccgggcgcttatcttcgacagtgtgtctatctcctgccgagcgcctatcccatgttactcgcctgtcccccgttctccgcccgtctcgcgggacacgctctccgctgccccggtcgctggcgccacgctcgcctgcacccctggatgctccgtcttccctggccatctcaagatggttgcctgatgaaaaagtacaggatgatcaagaagcgtcctaattccgacggctaaagaatcgacaatggatatatacctgtgatggagttaaacacctgaggcgccgtattgcataatcaatgcacaggcatgaccagcaatatataggcttcatccaaattactcgtaactgcaaaggatttggagtcttagccgatgacggtctagctttgtttttctttcgccgcacggccggagataagcttcagcatgggagtcctttcgtcgcatgactaaactctaccggacatgtatcgcatgagccaacacgacaccaagttaatttcgctcgctccacgatcaaaatttacttggtgggggcatctgtttgatggtattttggtgattatatgtgtacacaagacttactcatgatggacaaagcaaacaagcagtttgtaagttggctagcttatcatttctacgcaatgctcggccatgtatatacacgcaaatacatgcatgcacaggcagctgggaatatatatactgggaatatatatacttggattagtatatgtgcatgtataattaaccaataactagccgtgtgaagattggctggtgaggcaatcacgcgcatgcatgcatgtactacagtagacggtcgtatgtgtgtgcacgcctgggtgattaagcaacctatgcatatccgagtgattaatcataggctcgacccatggccaaagacggtagctgcctacgcgccaagatttcagaagttaatatgcggaagagataaaaccagatgaattaagagataaccaacaaaccaattgattttatctctataacaaacttgatctagttagttacttcgcgcgagcgctggcgaggcgcttatcaccggactgtggcccagcagcagagaaacaaagcgaattacaaatcagatatttgacgccaggagaagctaagagataaaatcaaataaggatatgaacaaataacaaactgatcgatcaaaccttatctgcaacgaacttgacgcggaggaaacgacgcgcggacgcggtgagcaccgaccccaga

SEQ ID NO: 16601 - DNA, 1501 bp, Oryza sativa
acgtgaggtccgtaggttgtaggtgcgtgtaaggaattttgctactatatataagcccattctacttaggtattttttgtaagtcgtaacataaagtcatggtgaaataaaatagaagaagaatagttggattttttttaattcaagaatagctggattgggcatgtaacaatatttacggaatatgtaaattgaattgagcccaagcgaagcttatactcctactttttaatttacttctgtgcaatccaagttatagtgacatcctggtaattaaggctaagcagatcttgcctaacaaagagcatttaaaatgcagctaatccaactccaaattaagcgttcgaaccaaaatatctcattctatttataaaataaaagaaagagctagcgtagtttgtcctaaaaccaagattaagcgcacttgaagatcacctagaagcttcgcatgattttgttctacttctccgtttcacaatgtaagtcattctagcattttccatattcatattgatgttaatgaatctagacttcattaactttaatatgaactaggaaggtagcccatgcattgcgcgggcatgtattttattgtgttcgaaaaacttacatagatcgaatatcaactcaatgacattgccatgtttcataagtactatttctccataattttacttcatcggcattgcttagataatttttccaaactatttgttagcttttaaaatatataatatttaattcattcgtataaacaattatctatgatccgtataaacatttgtcatgtttcaaagtatctatttagtttgtttggaaaaaacatatctaacaaattaaacgtaaattaaaagtaaaatattttgtcttgtttaattgaatgtttagtggctttttttaacaaatcctaaagcactattattgttagtaaacatgttttatttgtaccatcaagttagtcctctttttagttggtttagattcacacaagttgttacatacttacatataaattaacaaatacatatcgtagaccatcgcttccttgtaatatgtttgacctatagtatcttttctaaaagaaaatatagttaacatgagttcaaaaatttaaatttaatagtaataaatataaattttcaactaactatatgtatactgctaccatagtgtggcttaataggctgagaaactcattataccatggtatagaatagatgcaagggcattaatatgtaagcatttaaaaaaattataaaaatagagcatgtaatgcttggtccaattttagtgaaaggtacgaacttatttgattttctccaaatagttcaacttagtccatattgatattttatattttaaattttattttataccagttcaaactatagaggttatgaacctttaaattgatgatttaattatgaatagagcaatagttagattagaaattagatgtacagctaaaaaattgcatgttttaatattattgattatttct

SEQ ID NO: 16602 - DNA, 1501 bp, Oryza sativa
cttctaaattttactcaaaccctatttattttctttctcttcctttccttttctttttccccttttttttcttctttcccttctcttttcttttctctctttttcctctcctctctttctttttctctctcttctctcctcccggctcctttctttcttttccttctcttcctctcttctctttcggctccttctccctctctctctcgccctgcctaccgagaccggctgaggaaaaggaaaaaggcggcggcggcacggcttaccggcggcaacggcaatggtggcggcgcacggtggctgcgacggcggtggcgcacggcggctgcgacggcggcggggaacgcggcacggccaaggcgcggcgcggcgcggcggcttcgtggcggcggcgtggcggctctatgcgacgacgcggcggcgtggaggcggcggcgcggcggcgtggaggcggcggcgtggtggagtgggtagaggagaggaggtgaggatggagggaaagagtgggaatagtggagtttatataggagaggggaagagataagggggagaggggagaggggagacgcgacggcggcgcggggcgcgaggtgggggcgcgcggcgcgaggcgacgcgacggctgcgtggcgcgagcgacgcgacgggcgagcggcagcggcggcgcgcggcgcggcgcggggcgcatggcgacgcgacagcgacggcgacgtgcgagcgatggcgacggcgcgcggcgatgcgacggcgatggcgacggcgcgcggcgcggggcgcgagacgacgggacggcgcggcaggcgtacggcgcggcggggcgcgagatggcgacgtgacgggcgagcggcgacggcgacggccgacggcgacagcggtagcggcggtgcgcggcgtgaggtgtggggcgcgggcgcggcgtcggcgcggcagcggggcagggttaggctagggaacctcgtcgaacacctggctggctaccgaatagtgccgttttctatttaacccgatttaagcctattcatttatttaaaattgattctataaacctaaattttgtacaaatgaagttcactcaatatttgtgttattccaaccaatgggtccatccttgattaattttacctatattttatttttatataattttcttgaatttaattagagttaattcttattccgacacttttaaatttaattgatacaaatatagtcgtaataatattttactcatttctatcctcaccaaatattattttaaattgcactttaattatttacttagtcaatttactttttagggtttattcctaactaattatccattattcgcgatttataaactctgaaatcaaaatctaataaaataatcgaacaaaatcggcatgatgcaattttatttaaaaagtttttgaaggcccatatttttgaaactttgatttttgttcgtcgaattttcagggtgttacagcaccatggccgacctggcacgccggctggacat

SEQ ID NO: 16603 - DNA, 1501 bp, Oryza sativa
ccttacttcattctatgtcgaataaaaaatcaagggaacatgaattgggcatacttcttttttttttatgtgcgtgggcatgaggcatgcgacgcactaacaagatgaatcatcaaagcacatacctgacacatgataccgatcatcgaatttttgtcaacttacttttgcacataaatagctaaaaaaaatgttataataaagttgtgctaatgggtttttctctctccggtttggggccatgtgccgccgctaagttggcacatcttcatagaaaagcatttgacactgactatacttctacattagaaaaaaaaattagagttggttctaatgttatattagcattggagagggtgtaatgttatattaggattatatggttttatactatgttgttgtgatatattagtatgatataattacaagattataatacacacataaatgttataaatatcggtaaaaaaaggctaatccaactattaaataaccagtacacacaggctagagaacccactaaaacacaacccaataacctaattttcaagaataagtagccaaatgtgtagggtgaccctttcaataaagatgtgtagggtgactggatgagattgcttttggttgtattttcttgtaacaagacctgtatgtgtaggatgagggtgggtttttttcccttctcatgtttccttctttcttgataattttgcaaaatttattttgagtaaatttcacaaaactacaaatattatgatcaaactatcacaaaactacagatttaactcggtgtatcacaaaactacatatttaacattaaattatcacaaactatatatttaaaataaagtgttataaaactacatatttagtaataactaaattatcccagtcaaaaaaaatatagctccaacataacaactatgctaaggatttaaactctaaagctatagtttgtgataactttaatattaattgtttagttttgtgatatttagccttaaatctatagttttgggataaatttagtgctaaatctgtagttatgcgatacaacaccttaaatatatagttttgtgatagtttgatcaaaatatatatagttttgtgaatttttattcacttattattttctacaagaatctgaaaagaagatagaagtcatacttaacgggcccagatattcacgaaaggcccagcgcgggaaaccaatgggctgataagcccatggcaacgtggcccaccgagttgatcagactagatccaacggtgaagaacccagaggcttaatccaacggcagctgctttctaggcggccctccggttatagccggcgagcgctccaccccacccgccgaattttccctccaacctgctaaaaccctagcacccgccgcccccgacggcgccgctcgacgacgagtcgccggcgtcggtcgccgacgagagctagggcaagtgcggcggtacagggtttcagaggaggaggggagcatggcgt

SEQ ID NO: 16604 - DNA, 488 bp, Oryza sativa
gtacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttattcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatcttt

SEQ ID NO: 16605 - DNA, 272 bp, Oryza sativa
ttcgtcccacgggcattgacgtggcgattacgtggcaattttatctcgaaaaaataattaaaatagtgggacccatatgtcagctacacaaaaaataactaaaaaaggtggggccatgtggtcccacatgtcagcctccttttctctatcccccctctctctccccctacactgccatgagagaagggcgagcggtggcaccgagggggcgacggagcgaagcggcgtggcggccgacggtgcgcggttggcggcgggaggaagcggagcga

SEQ ID NO: 16606 - DNA, 1501 bp, Oryza sativa
gctgtcgcgccagcgtcttcgcctcgacctcctctccatttcccctcaagaatctcgaaggatggtgctacgagtgtggagatcgtccaccatcttctccacctccagtcaccgtcgccgttgccgaatccaccccctccggtgagtaccaacctaattccatgcatcagtagcatctatggggcctctctaacctcatggacacacatgcatgatagttcttggagctgattgagccatcgccgttcacccggaggttcttgccgccgccgagccgttacacgagccaccgtcataaacctagctaccccagccatgtctaccatctcggtgagcacccttcagcctatagaacatacatgcatgcacccaattaaccaatacatgattgtagaagcacatgcatcaccacccgaaaacatcctcctttcggactcgccgccggcgttactccgatgtccactgaccgagaaaagtagaggaatggaatcgcaataacatgatcttcattttgtattttggttgcacccccaaacgagccatcgtttgtcgccggtgagctcgagatcgagctcagccatggctgttctgcctctgtgcgtgagaaaagaagtcagggaccttgtttcgagaatttaaacaactataaggtttaatgtgcaacttttcaactcactgacatatgaggctaggtctgcgtgttgattcttagaaacctcagggatctttttgtatattgatctttcactgacagtggaccccttggaaacaaaaatctgaaattataaaaggaaagtacctaaaacttgtaaaatccatataaaattaaatatagctcattttaagatgatacaaatttctgtcaactcaccaaattgtgaactttagtgttatggaataaaaacttgcactcacagtacaaatttagcctctaaaatttatccaagttaaatcacacataaagcatgcacaaatttataaaatgcatacaaaattcatttcaactcatcttggagcaaactcagtttctacagatccaccaacttatgttctactataaagcaaaatgaaatagtatacatactatacatcgaatgcctctaaaactattacctttaaaatgactagttttacataagctgaactttagaagtttatataaaattcatcttagatcctttttgagtaaacccaaattcagtagaatcatagggttgtgcacttcaatgttataaaataaaaagacatacttacagtataatgaaaacccctaagtatttaagtaaggaataagcaacatggagcataccttaaattgtaacatttgtagaaaattcatctatagtctaaatgaagtgaaccaaattttctatagaaccagcaagtaatatacttcaacctaatagagtgaattatagcaccctcttacagaccatggctctgaaccttaatttggtagaataggtactaaacacatagtaatggttaaacaatacatatg

SEQ ID NO: 16607 - DNA, 238 bp, Oryza sativa
cggcgcggcaggcggcgatggcgacacgcgcgcggcgacgggatggcggcgcggcgcggcagcggcgaagagacggcgcgcggcgcgtggggcgcgaggcggcgggcgcgcggcgcgaggcgtgacggcgacgggcgcgcggcgatgggacgtcgacggtgatggatggcgacggcggctcggggcgcgaggcgcggcgacacgacggcgacggcgacagcggcgatggcgtcggcgc

SEQ ID NO: 16608 - DNA, 1501 bp, Oryza sativa
ccatataaaaattatttacggtcaaaattaaacaaatgaatcgtacaagtactttcaaacataggtttatcattgcataaaacaattttgaattctcaagatgttccatgtgttttgcgatgtaaaattctttatacaagttaatgtcatggcatgtattgccttttttttctagtttttgttgtcttgaaaagtatcgaacatctatatgtaactaggtgaaaccccgcgcattgttgcgggaatttagtatgataataataaaaaaaataacgtgtaagatagctagataatatcagattaagtaaattaatatggtttatgataatttaaatttaaatagtatgtagaatggtgattcaaacgtaaaaagtaaggtagtatgactttttggaagaagaaaagtagggagataatttggaccgtagattaatcatctaaaggctaaaaataattgatgtgatatgacttaattagaggaaaaaaggaaaaagataatttggaccatagattaatcatttaagcactaactaagtaaggataaactatataagtatataggatatcataaaacataataaatatacatttaaacattatgtgaattatgttggatgataatttaacatgtttgtatttgaaaagctcttaaattataaaaactataaagatatagcatgtttgcatgatgtttaaatgtgatgattgttagtggatgatgatgtggtatctttgtatgttaagcttaaggatttagtgggggtaactttatagtaagataggatgcacatttgggaggcagcaagccagcaaaagagtatgtgatttttttcttagtaaatttcataaaactatattcaactttcacaccataggaactttggtacgtgggccgtaacctcaagcattatgatccgagcgtttcacaaaagcatgttattaatcatcttgactttaatctgccatacttttaacttatacaatcgcacgtttatgaacattttatccaccatataaatgttaaatgtgctttgtttattttgatataggtacatgtcaaaatggttaattgtgtgattttgggaaactttagaagtataatacttagctttatgtgttacatgctaaaataattgtggtttgtgtaacttagacctaatatgtgggtttaataaaaaatactcattttttttataggatctagcattttaactgaagtttcagctaaaattttagacctactcccaagaatagctcaaatgttaatttgagcctttcacttcctaaaactttcatagcgaataccatgtcaccaaatcatatacactctactagctcactattaccatagcataaacaaggtcataaatcattcatcaacattgatatcgacagtcacagtatctcactggtctcacacacccaaaccagacaaaactccagcttaatcactccaacaacaagcaagcaagcaagcacatagtttcactcacagctgttg

SEQ ID NO: 16609 - DNA, 1501 bp, Oryza sativa
tagtagttggctatactattaaacttgctctaagtgagagatagagagaggagaagaaaattgtagccaaccttagagaaggtacaatagcagactattagccagctacaatcatattctaatgagatatataaaagataagagagaggagcagcgagctacagatctgtagccagttgcagcacggacttcaagacacaatgagtgtatgacaggtgggaccgtatattaatagtatagtaagcaactattgtataaattggctattatattggctatagatgaattggagttagtattgggctatactattgaacttgctcttatagctaatttattatatatgttgactttaagatggactaatagtagaaagtaagctatactactatccttgctctaagtgattcctcagtttagtacagagtgcccagtagagatgctgaacagaaggtgagcaaactcacatgagtgaaaaccctactttattactccctccgccccctaatataaggatgtgtttggttggatggttttggtgggtcgggtcggggccatccctttttcggagctgtttggtttgaggattatgtgggttgggttggttccaaaaaggaatattccaccaatattcgggatgaactgaccacccaaaaacgaccggaccgatcgaacccacctctctccctctcgcgcacgtgagttgcacgcgcctctcctgagcggtaaccctatcctccctcagcgcctttccccatcgcactttcaccatcgaaaaaaaaagaaggcggcggcggcaacgcaagaagcagcggcgaccgcgcgtgcaggagccggaggcggcggcgaccgcgcgtgcaggagcccgaggcgccggcgacagcgcgtgcaggagcaagcggcggcagctcgcatcctctgtccgtcctccatcctccatcccccttggctactgcagcaacaagaggaagaagaaccagcgcctcccacctgtcgcctcctttcctcctctgtactcaactgctcatcctcgtcctcgcatcctcagtgagaaaggtaagaaaaccctagcacttgaaaccctagatcttgctgaatttgtttcctgagatgattttcccttgttgttgaaaggactaggtgaagcagttaattcacagtagatcaatttatagttgaatagatgtttgcctattgatgtggtatttttgtctatttattcacagtgattaatttctgacgtgagcaagtaatttgtgattacatgatgtgtgattgagaagagtttttgtgctttactttgattgttgtattgtagatggataagaggaccaagcttttaatttttgctgctgctgcacatattttattgtcaatgatggccattattattcaatctagaaaaagaaagagatgtgcacggagacaaggtgttaagtatggcccaatggatgaaagggatcgaatgagatttgaatacctagacacaaaaatttggagg

SEQ ID NO: 16610 - DNA, 1501 bp, Oryza sativa
gggaatgacctaatatcaaataatcatttaagtttattaaaattatattttaaggctaatctataaatcatattctagtgtcctcaaactaaatatttaatagttattgatagtaaaagacgtgaatattagggaatgacctaatatcaaataattagaagggatgagactttgaacccaggtcgtttattccatcaccttgtggagctagccagaagacccatcagcgtttctcaatagttattgatagttaaattctagtaaatgatttgtatcaatcttattcaaaacgtcagaattatggaactgagggacgtacacaattattatttatattactgtgatttactttattagtgagtttgatttcttttttgctaatcagccatttataatttgtataagccaaatgtgaagagctttttttttaaaaaaaaaacatagccacttatttacgaaatcaactaacattgctacaatcaacatggctacaaccaatatggcaatcaactaaatccatagtaatcacagccttaaagcgatggagttaatcgggacaccttcaaagatcatgaactacaagaagtgttagatatttgaatggctctttcgttaggctcgttatcccggttcaaacacgaaataattcctactgtagaaacagagaaaaaggagccctgaataaaagggacaggggaagtggaacgcgactcaccaaacaaaggatgggccccaaataaaaaggcgctttgtattcaacgctcgaatttcgtgggccccaccacagggaaaacaatcgacgcaggcttccgcgaccgtggccacgcgtacccacgctcacgggaggcagggccacgtggacgtggggccgcgttgtcatcgacgtcgcgcgacacgggggggtcgtgtgcggcgcgcgcgcgcgcgttcgatgccgtgcctggtggtgcgctgcgccggtggtggtggtgctggtccctcgccgctgtcccgactcgcgtccgatgacgtgggcctgtaaccatcgtatgggggcccgtggtgggccatcgtccggaaaggcgaaagcttcatcgtggcgcgggacgggtggggcccagtctctccctcgaggtgtaaatcttgcacagttgcacacttgtgctgagcttatcggttctctcgtctcaaattgtcatacataaactttgtgcttattacaacctcccataacattttaaaattgttctaaaatggttgttacataaatcattttcgtttcaatttttttttcattttatccttaatcaccatcccaccaccaactatatatggatctattcggctgcacatgccacttatatagccgttacaaccaacaacttgccgaacgctccctataaagaattatggcttgtttaatgtttatatagttatagacatttttaccaaaaaaaactgagcctctactttcttgttctcataatataactatttttaaactttttataaagattaagag

SEQ ID NO: 16611 - DNA, 491 bp, Oryza sativa
acccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcaga

SEQ ID NO: 16612 - DNA, 1501 bp, Oryza sativa
atgctgattgcctggttgtctggaacatgcaggtgcaggatcgtcagggctcttgagctgcctcacttgcctggaagatgctgatgtaactacaaaggtacgtgtggtgaaattcgcctctatagagtcttgtcgaacacaagagatatgagttgtgttaatgagtgttatatattgtttgggaattttgccgtatgcaggagtgaagtttggacgcctgttgattgtttgctacaaatatatgctgaagttgatctcgcacattcaccagctgaattaaagcgctgagatctgggttagctttttttttggtttatctcaagagtattgtgggtaaggaaggtggtgtgtatgttggaactgtgaggagtctactaaaatgaagaaagcattcagttgatcattcttttcaggaaagattagttgcaaaattctgtgcgtaagcttgctgttgtaactgatgggcgttattgtgttgatggatgggagattaggggtagttggatgtgctgtttaatttaggtgctggtattaattaagtaggcagtatgtggttagaactctgcagttaagatgaggtagtatcctgactgttggtaactccactagaaatgagagtggattggaggggttaaattaattttgttttgtgtggattggtttgaggaaggattggaagctctggtggtgtgtatagttagttagcgtcagagtttggtaagcaccgtacaagcagtttggaggagaattggagaaagaagaataacatagagcgaagagaatatgtgtgtgtgtgtttggctttgcctgcagtgggagggtgcgtgcgtgaaacggtgacccagacacacaagcaaacacttgttacttgaggccggttaaattacttgaccagcagtttgctggctaatacatagtactagtagtagtatattggtggtgtatgcagatgcagtttttttttttttgggtgagatgagagctatgcagaggcagtaggcgtgcgtaattcatcttgctcctaattcccttccaaatgcaattgcgcttgatgcatgcatgctggcgattccttgcacatatctgcatgcacgtagacgcacgcttaggcttgttagtttttaggttgcttgtgaaataaacatggaataatcttgtgcataaaatgcaggcatgcacgctagctatatcttagctgcagctgaagaagaaatgagctatagtagaataagcttaagatttacctttttctttcaggcaggcaggcaggcagggcggctgggtttgttgcttgcttgcactgttggaagatccatcatcgatctttgttaatttgttggtaaggctagccaatatatatggatgaatcgtccccatacatttatcatcgatgagcgcggggcgggaaactaacaaattaacgatcgactctgtgtctgtgatcttatagggtagggtaggcgagaggaggcggatagatagctagagtatatgaataata

SEQ ID NO: 16613 - DNA, 489 bp, Oryza sativa
gtacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatcttt

SEQ ID NO: 16614 - DNA, 1501 bp, Oryza sativa
ttcgggcgcctccgtgcaggccgtcgccggcgccggctggtcctcgccgtcgggccactttgtcttcggcttctacgccaccgacggcggcctcgccgtgggcgtctggctcgccaccgcgcccagcataacggtgacgtggacggcgagccgcaacgacacgccggccaccggcggcgcgctgcggctcacctacgacggccgcctgctctggaccggcgcgaacggccaggacaggaccgtcgccgcgccgccccagccggccgtcgcggcggccatgcgcgacgacggcaacttcgtgctgtacgccgcgaacgcgacggtggcgtggtcgacgttcgcggcgccgaccgacaccctgctcgccggccaggacctcgcccccggcgcacagctcttctcgagcgtctccgccacgagcagggccaccggcaagtaccggctgaccaaccagctcaacgacggcaacctcgtcatgtacccggcgggcaccatgaacgtcgccgccgccgcgtactgggacaccggcacgttccagataggcttccccctcaccttgcgcctcgatgccagcggcgtgctctacctcgtcggcaacaatggcagctacaccaagaacttgacgaaggccagtgcagctcaagccgtagagcaagctcactaccaccgcgtcacgcttgatcccgacggcgtcttgcgttcgtatcgccatggattgctgtcgagcggcgggtggaagaccgacgtcgagtggatcgggccgagcgatcggtgccatgtcaagggcgcctgcgggttcaacagctactgcgtgcttgatcgcgacgcgcagcccagctgcttgtgcccgccggggttcgatttgatcgacgccggcgacgccgcgggcgggtgcacggcgagctccggcgccggcgagtgcacggggggcagagagccgaccctggttcgtccatggcgaccatgcagaacgtgtcgtgggcggacacgccgtgcggggtgctggccgcgggcacgagcgccgccgactgccaggcggcgtgcatgtcagactgcttctgcgtcgccgcgctgctcgacaccaacgacggcacgtgcacgaagcaacagctcccacttcgatacggccgcgcgggcggcggctacacgatgttcgtcaagaccggtggagcggcgagcccggcgctcggcggcggcggcggcggcaaccaccaccaccaccgcttcaggcgagcgagcaccgtcgcgctggtctgcgtcgggctcctgacgttcgtcgcgctgtgcgccctcctcgcgtcggcgcggctgctctggctgaaccagaggatggtgcgacggcgcgtcgcgctcgccgacgccgaggccctggacgaggaggcgccgctccgctcgtacagctacgaggagctggagcacgcgacgtacagcttccgacaccccctcggccgcggcgcgttcggcacggtgttcaaggggacgctgcggcgcggcggagaga

SEQ ID NO: 16615 - DNA, 1501 bp, Oryza sativa
ctccaccaacacttagaagttttttccccgatcgatctctctcggcttctccttcgccgccactgcctagggcatccccgcaccgacgccgccgtcgtatctcgccgtcgtctcgtgcgcgtcgtcgtcgccacctccgtcgccgcctccccctctctctctctctcttcgatctcgatctctctctctctcccgaaaccgccgccggccgcctcgttgccgacgccaccgcctacgtcgtcatggccgaacacgactccgccgcgccgacgatgccgaccccgaccttgatgcggctggcaccggcgacgctgtcgccctcgcagtgccgacgaagccgcgccacaacgccgcggcggcacgacacgctgggacgccacgacgccgccgcggcatggcaccgccgcgccgccacgccgccgccgcgcaacgccgccgccacgccgcgcgcgtcgccgtcgccgcgcaacgccgccgccgcgccacgcgccacgccgatgccgtgccgccacgccgccgccgctccactgccgccacgtgaacgaacgaacgtgaacaagaacgtgaacgtgaacgaacgaacgtgaacgtgaacgtgaacgagaacgtgaacgagaacgtgaatgaacgaacgaacgtgaacgaacgaacgtgaacgttaatgaacgtgaacttaacgttgtatttgaacgtacgtaaacaaacgaacgtgcgtgaacgaaaagtgaacttaacaagaacgcgaacattacttaacgtacgttaacgtggacgcacgtgaacgaacgaacgtaggtgaatgatatacgtgaacttaacaagaacgcgaacgtgaacgatcgtgaacgaaacgtgaacttaacgagaatgcgaacgtgaaatacaatatatgttacttcgcgtttatcctaatacatctttttgtatgttgcagaaaagacgttgtcgtcgtcgtccctcaagccggagtggtagctagccctcgaaggaattcgcgcaggcaagtgatgtaaatatatgattgttagatttttaatgcaattaagactattagatttaatatacgacacttagacttagcattataattagagttttaatacaatattatttgagttttaatataagattattagatttgtaattagacttagcatataagattatgtagggttctaatatatgactatttgagttttagtataagattatttgagttttaatataagattattatatttgtaattagacttagtatataattattgactagttagggtcctaatatacgtcacttaggcttggcatagttgactattacagttttaatacaatatttgagttttcgtataagattattatagttttaatataagattattagatttgtaattagacttagcatatacgacagttagacttagcatatatgacttagcatatatgattgttagcatataagattgttaaagcaaaaatgtctcatgacttagcaactatt

SEQ ID NO: 16616 - DNA, 1501 bp, Oryza sativa
gagttaaaatttcggtcagtatgattagaagtatgactactgtagatttgtctgaacaaaagccactttacccttcagcttataagccgcatttaaatttaaattttattaattttagagttaattttaggaattgtttttcatcgtaatttttttcactgttttcttttaaattgttaacaacatgtatatataagtttcatgcacaaatcatatttttgttgctaataaaccgttattttttagataatggaagctttatttagactcagttagttatatcaagatgatacaaacaaactgagtcatccccggcctctgcataaaatgcacacagccagaaaagaagaaagaaacaactagaacatctcccaagcataaaagtttgacagaaacatatatcttagtggctatcaatccgtaggctaggtcgccacccatgctcctgggtaaaaaaactcctgtgccacctggtccaactgtcgagataccaccgtatatcttagtggctatcaatccgtagactagaccgctacccatgcttctgggtaaaaatctcctgtgccacctggtccaaacatcgagataccactataatagtatcccgcggtcccagttggtggaggatagcccaggtacgtagccaccgggtaactaaggtgataacctgcaaaggagaagacaccattttgttatcaaaaattactccattcctgcttagccaaatggaccaacacagagctgttgcacccatcaaaagcagattcctcatttctttggggacacatgatagccaactcccaaacatatgaccaacattgcgaggaggtttcagattagaagccaaatgaattacagaccacaccaagcgagataagcggcattgaaagaataaatgttggatagttttatccttgtgacagaaacaacatgtcttgctgcctttccaatttcttttagcaaggttgttcttggtgagaattacgccccgacgtaaacaaaccgttatggcttataatcaacataagtgaaacgatgtctgtctttgttccgctatacagacatgtgctgattaaattttgcacgacaacctaccaatctaccatacccttatacgtattttatgacatcgtatttagcacatgttggattcttatattctttgtttggcttagacactacgaatgatgatttaatcagaaaacaaagtgtacacctttctaccgtcttcaggtcttttcattgagaactacttggaaaattgttgcatgtgacaatacaatacctccaagctgcatttcaatatttgatgtaactgcaacaaaacttagtttgtcaagtcaagttttgatttgactccatatattctaattccattgacgaacttgagtagtattctgacgacattgaataaaggaagaaataaagcacggttagcttctttcttaaataatcgtgtcgaaataaagcaagtggttggtaaaaagggggaacaacaaga

SEQ ID NO: 16617 - DNA, 489 bp, Oryza sativa; identical to SEQ ID NO: 16613

SEQ ID NO: 16618 - DNA, 1501 bp, Oryza sativa
aagggcagcggggtggcgccaacgaggaaggtacagaaagagaagccgacaccggggctggtcgagcacagcggcctccaactcggtgctgacgccgtctcgctccgaccgcacgttcgcggcgccgatccgtgacgagcggagctggaagcccctcagccatgcgagggcgagggcgagggcgagcagcgtggcttggagaccatgaagaggacgacaccgtcctcccagacactgcgcttgccgaagacgtagtcacccagcggctgcagcgtgcagcgccatagcttgtccttctagccgccgcctccgtgtgcgaagatccagaggtgaggaggacgaggatgacaacgtcacgcaacccagcccgtcgccgccaccgccgcaaggaccacgtcgcacgcatcctcagccggagctccgggttcaggtggcaacgcaggcgcgagcggcagcagcggcttagggttttggtggcggcacaggtgtgagtgtcgactggaatcccgtgcggagcggcccctatgccatgacggcggttgaggacgctgcaggggagcgacgtggctgctcctcgtcgccccgccggtcatccactgccgcaaggacctcgtcgcgcgcgtcctcagctagggacgccgacgccgccggccggaggcggcggcgcagccgcggcccactctgccgcctcctccttggctgcctcggcttcctcgctgcgcgccccgacagcacgatggtcgccgagtcgacgcctgtgaggtggcttccgctgtcggcgtcgtcgatggagtggagtggcggcggcggcggcgcgtccatgcacgtgaaaacgcgaagaggcgccgctgagagacggcgtcaatagggagtggatggaaaacacaaaggagtggcatgaattcaatttcccagaattgcagtggcactcaagagtgctcacgaatagtagtggcattttcttaatttggcatatttgcaatggcatggatccaattaactctaaaaacaatctgtccaaacgaaaatcggactgtaatccgctggagaacatggcgacacaattctagcgaatccattcttagtttactagaagggtatgcgcggcgacacgccgcgcacgacaacaaatacatgcactttttaacccatattttttaggtagattagcaaagataaaatgcatttatccttcttccagattaaaaatcattaccataaaaaaaaagaacagaagttattaagccaaagttccatataacttcacaagataaaatgcacaaagttccaaacaacttcattaagctaaagctatttttgtgttcaatcccacaaccccaaccacctttcgcattcttggtggctttcattggtgtcgaaacatgatttcggcaataataaaaaggggtagcgcacgagacctaaaagtggatggatgtggagacaaaggatttagacaggttcaggccctctcaatgagaggtaataccctactcctgtt

SEQ ID NO: 16619 - DNA, 1501 bp, Oryza sativa
cggtgtccccgcaccgccgccgtcctgaccgtcctcatggccgcaccgccacgcttttgtcatcgccgtgcactccacccgctggtcgcgacaccactcatggcttgcagtcctcatcggagaagagagaaaagaggcagacagaggatgagatcaagaagaagagagcggatgaggaagacaaaggatgggcattttggtcactccgcataaaattatgggccccctatcgcctcgtcagcacaaatgcattattttaatcagtgcggtgtccgttgtaaaataaccacgtttagagcgtgttttccctcaaaagtgagttcgtgcagtgtcctacaactaaaatcacaaagtcgtgatgtcctattgcaaaatttgctaagaaaaaatatattacagttaaacttaagtgtttgaggaaggcacttaagaagtggagcaaaacattgtcaaagctaaatagcttgataaaaaactgtaattaagtggtggattctgttgacaaattaatggagtcaagatatttaacagtaaccgaatggaacttctgaaagctgatcaaatcaaaagctttgatctacatacatgaagtacaaacagatctactaaataaagatgtaacatatttttgtatatggttgccatgcaaagaatggggtctatgtccaaaccacatacgtctaggatgataatgcataagcacgaagcagaaaaccaatccaaatggctaaagtcatgtatggaaaagaaataaaatataataccaatccaaatggctaaagtcatgtatggaaaagaaataaaatataatgtattctctggtacctcggccttacgctaacgctagattccgaggcttcgggtttcctcaactttgaggttgagtgagtccctcgtcgccaagaaaataagagcacaacgactagggcccaactattgctttttttactaatagttagcggttgtcctcgtacctaatcttattccgtttaactacccgagattagactcgagggtgggtaagatccggagcgaggttgtccacgagctgaggcctctcgaagaatactttcgtgtataacaaaatatgagtaatattgatctcaatttatttgtataattataaattaaataacagttttaaaaattaaaaactggagattttgtttaaaagttatgctcatttaatttaactgtttatagaagtgctagctctaaaatagaagtgctacgcactttagtacttacgtgaccactttgatacgtacacgagggagtgaggtggaggtgatcgtacgtacaggaggaagggaggtgttggtggaagggatttatttttcaaaagatttaatttaatggttaaaaatattgggtccactaaattgaaaatcaaagctgagatgttttgcttttttcttagattttttcggatttcctctaatttattagagtgacacatgatggattatgagcgtttataggatgtgatgtggcggtgtac

SEQ ID NO: 16620 - DNA, 1501 bp, Oryza sativa
ggcataataggctagccgtgtaggcggaggcaccaatcggcggcgacgaaggcaggccggcggtgaagtcgtagacgcccaacagcggcggcacaataggccagccgtgtaggcggaggcaccacttggcggcgacggaggcgggccggcggtgaagtcgtagacgcccaacagcggcggcataataggccagctgtgtaggcggaggcaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactccccaaagcgaaaacgaagtcggcgactcatgaaattgattccatcgcgctcgttgataggaaactcgacgcaacccctacctggcgcgccaactgtcgaaacatgaattcggcaataataaaagggggtagcgcacgagacctaaaagtggatggatgcagagacaaatgatttagacaggttcaggccctctcaatgagaggtaataccctactcctgtttggggatttgaatccgccgagtatgtattgatctgacgatcaggttgtctcatgcccctagagggggctccctgccctccttatataggttggggggcagggttacaagatagaagccttaaccaatacggtatcggtttcctaaatctactttacaatattatcaaaccaggactttaggccgttccgtaatatacaaggaaacgt

SEQ ID NO: 16621 - DNA, 1501 bp, Oryza sativa
atttcaaaagttagccacctaaattccttccaaatattaatttggattcaaacttccttcctcaaatatcttccaaaattcaaaaataacttctatttgcttttgggccaaaattcccttttcttcttctatcggcccatctccctcttggcccaggacggcccagccaacccttccagctgagccgcccctctcctctctgtgggcgccaatgccaggtgccctgggcgccgttgtcgtgcgccgtgatttgcgccgccgccgacgccgtgccgtaccttcctctgccgccgccaacatccttccgtcgccgttaagaaatcaagtcggcgttgttagattaatgggctaggcccaattaaatcctaataaattccattggcccacattaagtgctatgggtaataataccagctttgaaatctaagtgaagagttctcaacttaaatacggagctagtggaaagtctctgttgaccggttgagatggtgcgcggacaaccaggaggggcgaggcgaggcgaggcgaggcagacaattgctgctgctgcgctctctcattttgtaacggacggtaataaacacggagaattgatttcgtatcaatgaacgcgtcggttacggaattaaacgccgtgaattaatttgattctgttggttacggaattaaatgccgtgaattgatttgattccgttggttacggaattaaacgccgtgaattgtttccgtattaacgagcgcgtcggttacgaaattaaacaccgcggttgatgactccgaacgttactctcgcgctcgcatatatatactccgcagcgaccagaacgacgacgaagttcttcacgactcttgcacttcgagttcctcctcctctgttcctgagctgcaaaatccttccccggttctgttcacctgcactcacaggtgtacaggacgagcaggtgcttctggaactccgtccgcttgagaacttgcacgggtaggcgggcgatcaagtttttaggtagcgcttcaagcgcgactgctcctgttcttcgcgactactactgctacatcgacgcctttgtcaacatgtcgacggagattggagacaaggaggtgaacgacatcaacggaggcaatactgcctcaaaatccagcggtgggacgttcttagggtatagtttcattctcctgattctattagatgtttctatgttgatgttctttgcaatggcagcgttgcgttactctgtaaatgttgatgcttatttcattttaagcatgctcaagttgtatacatctagcactatcgctagatctactcatattgcaaatgtcatgtttattgtcttaatattttggtttaaaatatgccgaattatgaccaaatttccaacaatcccaaaacttgataggtctttttcggtagttggctttgctgcatcactaaaaccacatgctttcgatggttcaaattataaaaaatggaaagcacgtacacttttatggttgacggcga

SEQ ID NO: 16622 - DNA, 1501 bp, Oryza sativa
ctgcacaatctgcagggggagagatccacaaatcggccatggctagcgccccgaaatggcaagcgaaatgtgcaaagaaaccaggagctagcggccggcgcggggatctcacactccaaccgatcgaccgagctagcaagcaaacaactgaaaccggcatgcatgcaatgcgacgcaatgtgatgcgatgcgacgcaatcatgaaccatgcaccgccagtcgtgacttgcggcaatggcaccgaattgaatgagtaaaacaaattgttcccaaaaacgccgcgagatttgcaatcaagtcaatcgtccaaacggatgggggcaagggcaagccgagcgagctagcctaagcctagctagctactggtcacctgcccacgccgggggccgggccaagcgtatactactattgacaaggaacagcacgcactcctccgctcgctcgatcgatcgcgcgatatatgaacaatcgcgggaccagccagtaattcgatctctcccttcgatcggccgccgcgcccgcacgctgtgccagcttcgaactaacgattcgcgttggaatttgcgtcctgtactggaacactgttggatcgatcgggttcgcgcgcctgaccactctttggtgcagcgagctgtagcgcgcgagattccccctcccctgcggcagcaacagcgctggtcagggcagcgccatgaaagcgcatggcatgcatgcactgcactgcacgcacgcacgcagatggatggatggatggattgggcgatagaggggggaagacgacacaggcgccgtacgccgtccacgccactcgcggtagcgcgaggaaaggaccatgtaggcatgtgtagtgtagcgtccacatataccaagcagaggcagaggcagagacgagccccgcgccgagttaaatgcacgccctctgatcgggtggatggatgaagtgggatcgcgattggcagcgatggttcgttcgttcctcccgcggcgacggggtggggcacacgtacaccgtggggggtgaaatcacggtcctgcccctactcctctcgcggggtggagttacgtacactgacagtgagaggccactttgccggcaggagatcgcggcgcccgaagaagatatcgagtcgttcgcgcgagccgagtcgagtcgtgcgtgccgagccagccacaccgtaccccctctcctctcctctatttatgcctctacgcagcgcaatgtgcctcactctttcgcttttggcctctctctctctctctctctctctcacacacacacacactctcactgactctgctgctgcattagtcactcgcagagagccacagctccctgcaaagaagatctctcgtagtgaattgcctcgatcacgtactactacacatagacctactacttgagcccgagagaagaggagaggaggaagaaccagagggcgtcgaagatcatcggggaggagttttcctagagctcgctgctgctgttgcttttctccggcga

SEQ ID NO: 16623 - DNA, 1501 bp, Oryza sativa
gagggtgaaacagtttgagggtagcagtccatgcatagttgagctaagaaacgagcttattcagactaacttaatccatgtggattggcagccgaacgaacaggagggaggacacagaccaaaggaggtcaccgagagccggtagaagaaactgagatatgtatgttagggtatgaagaaggtaaattaagaggacttgcctggtcttctcttgtgtggagggaacgaaggaagacgacgatgccagtaatcctcgatcctccgcctcaagtcaagggagaggcgagagacatataaataagggtgctccgatgcgttagaatcggagcttctagcatgtgtggaaggaatcagcctggcgatgcaatggacgatgagcttcctattgaagtggagacggattgtttgacggcggcccagttgatgcagaccaaggaaccggaccgctcttcccttgctttcattgttagacatattaaagtgttgattgatggagagagggatttcatcatcaggaaggtccacagatctcaaaaccagattagccatgctttagcagacatagctcgcactgataggctttctttcctttgggtaggcgacacatgtaatcttatttctcagctagtttgtaaggacttgtcggttgagcaatagtaattcccagctcttccccgcaaaaaaaaaaaggttccaaaaataatgtttacttattctgaaaccgactgagtaccgtacctattaggccgtgtttttttttcctcactttcctaatggccatgaaaatcgatcgaaattaagtttggagattttcaggcaccttcttttcacttaattgatccatatatttcgcagattcttgtgttcttgcctttcttggaagctcgccgcgtacgtttttggtttcttagctttcggccggaagaggtagcagagaggaagagaagcgcgcgcgggccgaggagaggaagaagaacgctttaaaatgggcttcccagtaagcccataatgggccattgggttgggccgtatgggcctcgcttcccatcttctccatgtctcacgggagagatcgggtcggctgccgcggaaggagaaaggccggcgaagtgccacgtgtccacgacggccgcctcactccaaccgcggcctgatcccgaagctatgtggcgtagccggcgagacgcgcgctattctccgcctccgacatggcttccgccgccttggcctcccgcgcgctgccgcctccgccccgccactgcgctcgccgcccgcgcgctccaccgaccaccgccccacggccacgacgcggatgcgcggccgccgctcgtcccgcgcgctgcagggcggtggccgccgacgagcgccccgcggacccctccatccccgagggcgaggacggcgcgctctccgggtacgtttcgcaccgcaccactactctccggcgattgatcgatgctcataggcatagccggttttgcgttctgaatcggggtcaggg

SEQ ID NO: 16624 - DNA, 1501 bp, Oryza sativa
actttaattcatttcagcatgtactagtagatttttgagagataatggaaatcaatctggcccctacatgcatcattatctaaaaacgtcctacatgcatgcatgcatacatgtacatccaaacacaacagcatgtagatgaagaagaaagatagtggatcatgctgctagctcatctagctcgatcatgttctgtaaatttcaacccgggatctagatatatatgcatggggtcacagctatatatgatgcaaactaattaagcagagattaatctagtgcgttttgccatcatatcatgtgtactaacagtctcgcaacaaactcacaaacaaacagagagctaaacaaagtaacaaaaacctaatgatggtgcagggttgttagggagtaatatgctgcgtgtgtgcgcttgcagtactggtgcagtatatgggtatagggtgtctttagttttttagttttttgagtgtaaagtttttaaaggatacggatacacatttgaagtattaaatgtagattaataacaaaacaaattatatattccgcctataaactacgagataaatttattaagtctaattaattcgtcattagcaaatatttactgtagcatcacattgttaaattatgacgtaattaggctcaaaagattcttctcgcaatttacatgcaaactgtgtaattggttttttccccatatttaatgtctcgtacatgtgttcaaatatttgatgtgatgtttttggcgaaaattttttagatctaaacaagaccatagtgaggcagctttcgaagtgattgtccctgatttcatgatatctatctttgagaaaataatccactgcatcaccagtacagtgcaaatggccagtacattcgcacctatatatatctgctactcgatctgtcccccaaaatacttctagcctcatcttttgatttatacttatgcttataaattaaaattttaaattttaaatttaaatttagagttaattttgaggtttttcatcgtagtttattttttagtctttgtttttagattgctaagaatacatatataaaagttttatttataaattattttttatttgtaaatatgccgtttcgcttattccgtcaataagcgaaacgatgaagtctgaaatcatttccgatcgactatacaactggataaatactagctcctagtatttgctacatctgtttcaaaaagattcatttctgattttacaattggttaaatatttgtctaaattcattcatagctaggaataaagtttttgcgggaggtactagattgcatatgcaggctcgtacttcctccgtttcacagtgtaagtcattctagcattttctatattcatagtgatgttaatgaatttaaatagatatatatgtctagattcattaacatcaatatgaatataggaaatgatagaatgacttacattgtgaaacggagagagtagctactagctagcttttagtgatgcag

SEQ ID NO: 16625 - DNA, 1501 bp, Oryza sativa
tttagaaacattctcaagccaccacatggcactccttaaaacgctctcaaattgccacgtggcaattaaaaaatctaaccattgattttcatttaaatcggtaggcccactattatcaaccatctgatcaatctttaaaacccattattttacaccattagattggatctattattggaaaataataatttcaacacaatttagttgtgtttttcaagtagttatgattaaattataatttgtttgagattaaaattctcaaagtatttttatatttttagaattatttgactatacatatttgtcaaaatataaataataaaatgatgctatggatatacatatttgtcaaaatataaataataaaatgatgctatggatattatcgtggtggtatgtctcatgagttataattttttaaaatatcatcgaacgattaccctcggtcattttcatccctgtacgtatgtcagtacataccgctgcctgcgtcccgtacgtacccaactctgtccaagcaatcacgcatagatttttatgctagctagatagccacacagttatggatgatctatatgcatacatatgcacaccaaaaatctataaaagatcttcgaattagaagagaaaaataagccactcataaacaaacaagcaattttttggtttttttaaagccataagccactctttatatactactattaaataaaaaaactaggttggaaaaaaaattggcttatgtaagacagatgtatgactccaccggcatataagctaaaaatctaacttaaaaatcgaaaccgataagcataagcctatatttagaggccctaagcaggttgatggtctgattgatgatagaaaatgtttagtaatctagctagggcacttggctctatttttcctttgctagacttaatttgaatggttgtagtctagctttacaattaaatcaatagtttaaacccatatatttattagggttaaatggatcatgtcactataaatgtggctagataaatgtcactactatttatgatattggctacgtgccactaaaatttgaagaaactgagactgtgcaattccatcatgttttccgtcagacccccagacgtgggacccatatatgagttccatcttcccctatcctccctcttctttcttccccatctcttcctccatccccgctactgctatgaggataacgacgatgatggcggtggcaacagcttccgagccctcccgcgcagatggggttgaggatggcggctcccttgcctcccgccgcggttggcgtcgaggatggtggcggcggctcccgagccctcccaccatggatggggtcgaagacaacagtggcaacggtagtggctctcgaggcctcccaccacggaggtggtcgatgatggcggctgcaacggtggttgtcaacgacggtggtggagagagaggaaggggaaagagaagagaggggagggaggtgaagttggaactg

SEQ ID NO: 16626 - DNA, 1501 bp, Oryza sativa
gggctgtgggaacgggtgaggctagaacatgataaccacgagccaagtctcccattttcgtcttccaactatatgtcgcatggccgtatttgccaaacgtgacgaatgctccttcttcagttagaccgagaaaaattaagctagattccataactagcatcgatcgcttatgtgagtgtgtcagctgccttgcacgagctgatcagctcgcacgcatcgcggaggattcagtcaaaaatatgatcactcgcgcatatatacatgcatttcagaaagcacggatgcgcctagctcgcaagcaacagcgccgtgcagtagccttacaccatgtaattacacttggaatctagttctaccatgtaattacacttggaatctagttctataaaaaaaagaagttggaatcgtgtttggaacgatcactctgaagtttgatccactcagatcccccggaaaaaaaaatatctccatcatttgctttgtcaacgagttacttgaaatgttgagtacactgcgcggtgcaacgtacgtaacgcaaaattacaatcccaattaagcagacgcagtccccatatattgcatggtcaaaaccaaatgaagtccaagtctccactagattaattcgggccaatattaagtatcctgctgtatgtctttcggtagaaactctgcaaattacgatcaatatttagcccgtttcaagaggaaaatagttacagataagtaggtgtgtggtacgtatacgtatatatgtgtttagttcacatcgaaattggaagtttggttaaaattgaaacgacgtgacaaaaaaagttaaaagtttatatacgtaggaaagttttgatatgatgaaaaagttgaaagtttgaagaaaaaatatttggaactaacaaggccgtaaccgaatgtcaaatttgcatcaaaccacgctcctgtagcagagacgccacgtgcagcacggccaagcgttccattcctcccgtttccacccacgcgcgaacgccacaatttcccccgttttcctgggcgtttttccaccaccaccaccaccgccgcgagacgacacgagaggagggcgcggcgacgacgcgagcttccccgcgcgcgcacacaaccgcgacgtttcccgacccctcactccaccccccaccgcaccacgcgtgcacaccaacactaatacaacactcttcttctcacttaacccgctctctcttataatcaccaacctgcagcgagctgaactgactgagaagccaatccgcgaagctaccaaaccgagccaaaattttgatcgatcgatcggccggccggtgtctttgttgaggcgtgcaaggctcgtgctttcgccgagagggattaattagccgcgcctccagcatctccggcctccatagagatcccagcttataattaaagctgtcaagagtcgttttggttgttaggcttaaagttaactactgctggctagctaggactaagagatccgagggagcagacatgg

SEQ ID NO: 16627 - DNA, 1501 bp, Oryza sativa
aaagagtaattgtatgttaattacgtgggtaacgatggcgtatagcggcagcgtgctgtagctgcagagcacctggacgatgattctgcaaaagttcatgacagaaacatcacattactgttcagttcaattcaattcagtgcagaaatatgtactaaaatttttttttagagaaggtaatacagaaatatttgaattttttttaagattccaattaaagaaaagcaatcaatttctagcagaaatcagatgtaaagctcagacttttagtactgacccaatagcaagtctggggagggcataaatcttgttctccatgatgcatgaatcaaacccatatgttgcctgcaattgaaatttaccagcttgtttaattagcaccatagttttatactaattaaaattgcagaaacccatatgaagacataagagtactttctgcaagataaattaaaagtgcaggaaaaaaaagaatgtaatgctgtaaaacagaccagaacccagaagaaaaaacccatctcaaaggagttctggaacaggatgaagtggatcaaatggaggacaatcctaggcttgctgaaccagaagtgctccttgcatggctttgtccaggggtttcctgttgcttcatctgggcagtctgctgcctcttgtgccagcctagtgcttatgagctccagctttgtgccaacaatgagtaggagctgcagatgtgccccaaaagttggaattcctcaatcattaaaactgaaaagagtgtgctcactgttgacatatatgttgagttgtttgaagttcatacttacaattaagggcaagaaagacagccagaagtatgtgtgccaccctgcattggatgcaaatgaaaagtttaggggatagccacctgaatagatgatggaaactggatagtttcattcaatgacaaaagacaatcctagttcaggcattcaacagtctgatgcagatcaattgttgttgtgatccatgacttgttctgaatgagtgaaaatggatcatgttcgtcaactggaaatgctgtggttaaagtctaaattgtggtactagaaatagaataagtcgtatggtaacttaagtggatatctcccagcaaaaaaaaaagaaaaaaaagaaagaaaagaaaatttaagtagatatcagtgtgatggaattcagttatccaaacaattacatgagggcacttgtttttaggtttatgggagttaccatttatattcagtagcaggaagacaataacgaaaagccataggtaccagctgcatgtaattgcatagcattagatacagtaaagatgatgtagtttttaatcaagtaaagttagtattttaaccaagatactaacctgattccaactacttctttaaaatcatgctcaagagcacgaaccatgtacttgtggaaatcaaaatcaggacggtttgggtagtgcctctggggaaaaaattatgtcctattagcttcaaaaatagtacaatgacac

SEQ ID NO: 16628 - DNA, 1501 bp, Oryza sativa
tacatgactctttcgtgcgtatatagggtgctgtagttttaatttgatttgtaccgcaatttggtttgttggttcacattaaggccgagtttagttccaaattttttctttgaactttcaacttttccattacatcaaaacttttctacacacaaaaacttttaacttttccgtcacatcgtttcaatttcaaccaaacctccaattttaacgtgaactaaacacagcatcgctagagccagtcaattttggaactagccctagttaattcatgtcagtggccgggcgtgcaactgcaggcaattaatgttgtcaacgcctgccatatttacatgcaccctgcaggacgtaacgtatatgccggcatgcaacacaacatgtatagtacgtacgttacgtacgcactatatattgccatgcatggatggacttctcatgtttgtcttttgcaaatgcaaatcctttctcaacccatctgtaaattaattaacaattagtcacccttttaaaaaagaaaaaacaacatgcatacatatgcatgccaagacgaacagcagtttaccattccatgactttctggagtatagatccagcgtacgtacgtcaagctgattttttgtacgtatgcaacaagtgcaaatgctcaaggacgattctcaaattcaaaccaacatgcgtccacaactacattacatgcataacaatacaggttaagctctgcgtcatttagaaatgattagtttggatcgatgctgctggagtgctggtcagtacagtgtggtcacacaaacattggcgtaattaataaaggattcagattacatcaacttgcatgaacatacatacctaacacgtactgtaacatgcaatgcctagtcagctgatgtgtctgatggtcacatgcttgtctcacttagaattagattcctctttagctccatggaagcagtgtatgtcagggataggagatggtgaccaactacactgtttaaaatctctgactagatgagtataaaactatggatgtctagctatctgcgaggagctggtaattaattaactatattagttggctacagggtttaattatctatgtagttatgataattaaccgcaaaatttgcagagttaagtacttgcattgtactgtcgtgtctcgcttgtcacacactgatggaagctttcacctggtctctcgtagaactagaacggcgtagctaggataactagtagagactagagagagggtgtgatttttacttttaccttccaaacattttaaatttgagttctgtacttgcttccaacattgcggtaattaaggagatagagtcatagagggatcattcattaatacgatcgaatcgatccttaattagtttagctggctatatttcatttgaggtttatcatttcaatttctgaatatacatcttaaaaagcgcctttaatttgaagcaaaagatggtaatttaaccaagccactcaaaaagtaatccca

SEQ ID NO: 16629 - DNA, 1501 bp, Oryza sativa
catgtgttcctcctctttcccgtcaggaggtccatgatgctagagtaggttctgtccttcaagaagcttcattcccttccctaccagcacaatcaaggaaggcaccagcacatagtcagagctcaaggactgcagcaaggattggggaccagcagtttcgtcctttatcagttactagtaacaggaatgttgctttagcacagcagggtacaagaacattacctgaaaacacccatgtatctgggcttgcacaatacagcaagagaactgagaacatgcaccaagctgttcagcctcagttcctaaaaaataattctttgatcccttctggctcaacaagccgccctgtgcatgtccccagttctgctggaaatgaaaggcaagacacattcagcaacagccaggtgttatccagtgtggaggacattcttgcagcaaataaagccctggttgagaaaatgcgggctgcattaggaatggatcaggatatgttcaacgcatttaaagagatcgctggggaatatcggcaaggtgttatcaattcttcagagtacctttcatatgtaaagcagtttggtctcttgcaccttgttcctgaaatggccaggttattgcctgatgctcagaagcagaaggagcttgcagatgcctactatgccaatttgcgccttacaagcctccaagaaaatggtgggggtggaaccgataactcgaaacaaggcaatcagaataagaaggggaaggggggagttcctgacgccataggaaccagtaatgctgcaacagatccgctgaaagataagttgctgaatactgccatcaagttccagtcaaattacatgccccaggaagggtgttgtggcgtgcagcgaaaagaagggagaacaacagatggatcttctcagggtctgcctttgaagggtgcttggcaaagccgtgggggccagagactcttcatgagcaaagcaaagaagtgacgaattggttttgcaggtcaagttagttagacctgccatttgagccgctacgaaatgtcaaggtttgtgtctatctggtgtgtgtctgatagttgagtacatgagtgcagcaatcatgtgtgatgcgtttgcattttgatttttttttcttttttgtctatcatgtgtggtgcgtttgcattttgatttttttttctttttgtctattttttgtgtggtgcgtgcgtttggtagaccatggaacttgagactagaacggtccacaccatactgcatagtggagttttgcaacttcacatgagtgaatttgggctatagacggttctgttgctgtcaactcaaaactccttttaatacgaagttatggtcaaaatcgtaccttgatagagataaaagataatgtcaaactcatatgttctgtaaatacttttgccgaggaagtgctaattactactcaaattagtgcaagccatgtcggtcgttcactgctttgccgacaagtcagagtttgatttgcatctttg

SEQ ID NO: 16630 - DNA, 1501 bp, Oryza sativa
atggggtatcatgttatagattgaaaccaagaggagtggtgcctgggggactcaaaccgtggtttgttttattttccgttttaagggggaatcggatctagagtcagactattttttctgagagggagtcggacttttctttttattttttcgctatttattttgttttgacggacgaaggaaacatctcttattttttaagtagtaaagatactatgcaacgggcaaaaaaataataatccaagtataaattgaaaactactccggttaaaatgattaaatgattattaagcataaacttgttataacaaaaaaaatatccattttcaaggcatggcacaagtggtcatatctttgtctctatgacgggcagagcctttgatggttgattggcagcagtgatcatctcaccatggccttgttctgattcctgagcctcttgccttcatggcattggtagtgctaaaatttcttctgcaaataatacagtcattaggaagaatcgttatgaaaatgcaaaagaaacaggagaactgattttctgaagcaagaaaataccgaaggattgttatgcatcaaaacggcaaggaacttaatagtatctgagattgttaggctttatataacttaatagtatccggtctacggtttgtgaatttagattaaatgaaatattgtgtatgcgggctggaagcaacacaccagaaaaatccccaactttacttgttaaatcaaatatttctacgaaaccaatgtcagacatgcattttgttgtagcatggggtaaaatcatcccatattcagtctaaacatccttggtattaaattgaaatggagctgcccaagacgatgtccaccaggatcttccttttgagctatttcctgtagccaatgaggaaagtctctattcgagccatcccctatggtcagaggggagaatcccattcgaaccacttcctatggccaaaggggattctcaccagtgacttatatttcgccgaattttttatttacagtaattaatgatccttaaattaaataaatagtaaatctcagattaaatttgtaaaaataggaaggacgctgttcccaatagcgtccagacttggacacactttcttttgaagagcgtccaaaggtggacgctgttccggacggcgtccaatctggttcacctcatcctcttgggttcggttgttctttgacgttctccacaaccatttgcaggcgaaggtgcaccatcgccggctttcctctcctccctgcacggctagggcagaggagccaccaccgccgtccacctcgacgtccgggtggcccgcaccgatcgacttccacctccaccagggaaggtacagagtccacctcggctccagcttccggggaggcggcccatcgctgtcctcctccacccttgagaccacagccgcttgcctccatgcccaagaaaccaccatcgtcgttcccctccatgttgtcttccatcccttctcacatatgc

SEQ ID NO: 16631 - DNA, 1501 bp, Oryza sativa
ccgcccggggcccgcctgaacggacccaggatatcgagcccccagacagcaaacggccacgaaagaggtatggtctgcagggcctgggccggctggtgggtttgcctggcgtggaactggcacgccctgcaccgccggaccaggtcgaccgcatcgttgagagccgtcggccaatagaaaccctgacgaaaggccttgccaaccaaggtgcgtgaggcggagtgggctccgcactcgccttcatggacatcggcgagaagctcgacgccttgttcccgaggaatgcacttcaggaggactccgttagccgcgcgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggaactgggagcgctcccctcgggtcccgaggcctggactccgacgggcctcgagggccgttcaggcgcgtccgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcgaaatggcgctccatacgccgcacctggcgtacgtaagcgtccatctgcgggtcagagcactggtactccttacagacctggttaacgaccaactgggagtcgcctaacaccaggaggcggcggatccccagtccagctgccactctgagtcccgcaaggagtccctcgtactccgccatattgttggtcgcccgaaagtcgaggcggaccaggtatctgaggacgtctccgctcggcgaggtcaacgtgacccccgcaccggcgccctgaaaagacagggagccgtcgaactgcatcacccagtaggcggtgtgaggcagctgcgaggggcccgagctggcctcgagggcggagacgggctcgggagctggggtccactccgccacaaagtcggcgagggcctggctcttgatcgcgtggcgtggttcaaagcgcaaatcaaattcagagagttcgattgcccatcccgccaccctggagcgcgcaggagcgcgcccgcagcctggagcgcgccctggggcgtgccgccattgccgtagacgaggcggcgacgcgccccgtctcgccgtcctcccccgtcgcccgcgggcggcgaagtcacggatcctccgacctccccgagcgcctccccacgcccaagatttcggcgagagggggacggtggggtgcgagcccgacggcgcgggttctgctccccgtcgtcaccgctagcgctcggagagaggctgtgggccactgcccgttcggccattgggctgagcggaagaagcttggcgcacacgaaagaggacgagggctcagaaagacacgcgcgccccctacctgg

SEQ ID NO: 16632 - DNA, 1501 bp, Oryza sativa
ggtggtggccgagtggagaggaggcacgcgcttgctcgcctcgtcgtctcgatacctttcttctcctttccccatcgcctcctcacccagagagaagaggaggttggaggaggaggcgaagaggctagctagctagctagggtttcgtgctccccatcgcctcgcgcgcgcagccggatccgatcgggcgtcctcgtcggcgtcggcggcggtgcccctggtaaggccggatcccgatccttcccgttcggttgcggtggtgggtggtgtggggggcgtcggcgatctgggggcggttgggcgagctgggtccaattttggtggggggcgcggggttggattcctcgggttgtggggtggggtttggatgggggggaattggagacgatgtggtgtgggttgctgggcttgggtctaagtagggatgtgtttgttcgggtttggggtttgatgtggtgagaattgggggggtgttcgtgttgtgcgattaggggaattcgcggtatgctgcgtgcttttgttgaattgtgtgagaattttggattttaggtagttctattgtggggtggggggttaattgatttgggcgtgactttggatcgtgattccgggggacctgagccgtgccgtgtgaaatcgcgctgattggaagggtactcgttagaccaaattgttctgttctggggtttatgtttgatttggtcggcgtttgctatggtttggaggtattaattggagagaatttgagctggttgaggctctaccgagtaaaaatgggtcttgtgctggaactatgactatgattacatagcattacctgatagaatcattatggggcttctggaattctgatatggggaatataactttcttatttttcccatgtttggcttgatgagttttgacataactggtagtttttgttggctaatatgttcatttgctcggagtatatatcctatgaaaattggcataaatcttgcaaatctagttttcattagggatagaagttcttgaaaaaaaatgaactattgaaagggattagggaggatttgcactacagttttacaatatctcaagatcattttcaactaactcccccaagtgcaaaagatcatacttggtgactagcgagcagtgaattcgtatgcactatacagcaaatgaaaatgagtttaacaatgcattttacttggctacacaacttatctgtggtagttttttttttttggcaacttcggaaagctatactttgttaaaactgaatttgaacacctgtgccattgtttacaggctctttttttcaacaatataacatgtttgtttaagtgtatactatatttgttttcatgggatcattttggcctcagctgtgaataactgatgtgtttgctttccatcgtgaagccattttgagactttggtcaattgaagtgtttatattctaagcccttcttttctccatattctagatatcagtgttgtgattccgttgcaatgg

SEQ ID NO: 16633 - DNA, 1501 bp, Oryza sativa
gaaaccggtgccacgaatttaacacgaacagccttcttccttgtaggtggagtgacaaagtcatcatcatcatgaatggaacgacgcttcacatttcttctcacgctcgcacactttggaagccgcggcatgctattaaaaactaccattattaaaacaagcaatatgattctcttcgggtcatatacttcaatttaaaattaattaaatctatatttacaaagattataattgagatgtccacgtaaaagagacattgctgctgtttcactacctacctaaattttattcactggatgcaattaaagatattcgaacgggcatgttatatacctaaaacaatctaaattcaactgcatttcaacaaaaaatctataaatttaggttccaggtgattcatcatgtgctcagtttagtagataaaaagaagaggaatggcaaatcatctatacataacagggactgcatgtgaatgtaagatgtgtgagtgataaacactgagatccatacctttcaggtaatgcagctcgctggtgaataatgtctgttccgaagctcacgaacaaccagcgacggcagcgaaaaggcacttggacatcaggcgctgtaatggcttgacaaaaatggttgaggagttctggtttccagcaagaggcttgtggacgaacgtcgtcggtgacgaaaaccacggacgtcggccctcttcacggcatggcgagcaatcccggcgaggtaactcggtgaagacgatgtggatagctagctcttggaccgtgaaacagtgtggaaaagaaaaatcaaaaaaaggaatacagtagccggttatatgtgcatcttgaaaatggaatgtaatcttgaaaatagatggcaataatcgcaattagtggaatggcgtcatttttcaaaaacgaatcgtgattcaaaaggtaagtatctgcatgcaaacgttgtatatatggaaatgtgatatagaaaatggaaagtgctaatcataatgtgtatgcatgattagagggcgcaaatttgtaaatacatgcacagtaaaaatggaaatacctgcatgcatgttctaaggaaagtatatgcatgcaactcttatcgggttagacccgttaatgtgtgatagcatcctctagtgtgttgcacggatcttaaagcatttggacggtggatggctatggagcccgggcaccatggtgcccctaacaaatttactatatatatatatatatatatatatatataaaactggatataacacattctattgcaacgaatcggaacatcccatattagattggtttttttatcacaagaaggaagtaggtggaagtggaacacactgctcctagtactacaattacactggtcctgcccggtgacttgaagtcaatgaggtcaagtgaactcttacaacaagggggccggggggaaaaatggaatcagaaagcagcgatatatctccagcctgaaactaaactttgctccaaagacgcttacc

SEQ ID NO: 16634 - DNA, 1501 bp, Oryza sativa
aaagtcatcatcatcatgaatggaacgacgcttcacatttcttctcacgctcgcacactttggaagccgcggcatgctattaaaaactaccattattaaaacaagcaatatgattctcttcgggtcatatacttcaatttaaaattaattaaatctatatttacaaagattataattgagatgtccacgtaaaagagacattgctgctgtttcactacctacctaaattttattcactggatgcaattaaagatattcgaacgggcatgttatatacctaaaacaatctaaattcaactgcatttcaacaaaaaatctataaatttaggttccaggtgattcatcatgtgctcagtttagtagataaaaagaagaggaatggcaaatcatctatacataacagggactgcatgtgaatgtaagatgtgtgagtgataaacactgagatccatacctttcaggtaatgcagctcgctggtgaataatgtctgttccgaagctcacgaacaaccagcgacggcagcgaaaaggcacttggacatcaggcgctgtaatggcttgacaaaaatggttgaggagttctggtttccagcaagaggcttgtggacgaacgtcgtcggtgacgaaaaccacggacgtcggccctcttcacggcatggcgagcaatcccggcgaggtaactcggtgaagacgatgtggatagctagctcttggaccgtgaaacagtgtggaaaagaaaaatcaaaaaaaggaatacagtagccggttatatgtgcatcttgaaaatggaatgtaatcttgaaaatagatggcaataatcgcaattagtggaatggcgtcatttttcaaaaacgaatcgtgattcaaaaggtaagtatctgcatgcaaacgttgtatatatggaaatgtgatatagaaaatggaaagtgctaatcataatgtgtatgcatgattagagggcgcaaatttgtaaatacatgcacagtaaaaatggaaatacctgcatgcatgttctaaggaaagtatatgcatgcaactcttatcgggttagacccgttaatgtgtgatagcatcctctagtgtgttgcacggatcttaaagcatttggacggtggatggctatggagcccgggcaccatggtgcccctaacaaatttactatatatatatatatatatatatatatatatatatatatatatatatatatatatatatatatatatatatatatatatatatataaaactggatataacacattctattgcaacgaatcggaacatcccatattagattggtttttttatcacaagaaggaagtaggtggaagtggaacacactgctcctagtactacaattacactggtcctgcccggtgacttgaagtcaatgaggtcaagtgaactcttacaacaagggggccggggggaaaaatggaatcagaaagcagcgatatatctccagcctgaaactaaactttgctccaaagacgcttacc

SEQ ID NO: 16635 - DNA, 1501 bp, Oryza sativa
aacctccccgccgccgcccgtcgcaccgttgccgtcgccgtggtgtccagatctggtcggccgcgccgtcgccgtcgtgggtggatctgggcgcggatccggggctagatccgcgccgcatcgagacggacgtggcgccggcggagatcagggaggacgacgactcttccacctcgccggtgtcggatccgctctttccccctctcttccccgccgccgctcgtcgccgtccacctcgtcggcgcggcctccagctcctccaccacctcgagctctagccaagggtgttacgggaaatacgggtgtggggaacagtgtccacaagctacggtgtgctcaacgcggctcctcgcttcgtttctctgtcaaaagtcatcgaggggcacgtccccctggagaaaacacgcgcctctccaggggcacacggcacggacgggcaaagtaacggcggtaagcaggtacacgggttgagggtactcattaaacatggcttcagaaagacaacggctccctagtgcagtgctgctcccgccagtaatgttgttgctcctctgtctctccagagtccagaccctactcctacttcaaggacctgaacttccttttcactgtatcgtagcgccgtgccaacatagctatactcgatagcaagacagaaaattcgtctgtacacttgaaaaattgttcatgagagagagagagacgagagcttgctgtgcaagaatcttgaacaaatcgctgaattcaggagtactaggagtagtacagtactagagtggtagagaagagagagagagagagagagctgggttggagtggagaccaggaatggaggaagtagaaaggtgtcagtgctgctgctttgcctgcaaaatccccttccttccaaagctccccccctgcccttttcggtctctgcctgccctgcttcttgcccaccaccacctgtgtcctcttcctctcctctccttgcattgcagccttctccttgcttcactgcctccctcacctcctatatatccttcccccttgcctcctccacccacccacacttcacacttcttgtttgatcaatcacagagacagagagagagagatggcttggaatggcaggtttggagaggatggagaggaagagaggagccttgagctcagccttgccctccctggatacttctccagctcaggtcaccacctcccttgctctcttcttgattcatcttgccctcaaagtttcctgctttgtttgatcatatctgtgtgttttgtcctatgctttacatttctggtggattttcatttctcaggtttgcaggggaacacgagcactgctgctgatggagccaagggaaacgatgggttcaaggcaaggtgatgaaaattttctggttttttttttgggagcagtctgtttgctcgcaacaacatttttctgacgaatctgcagcaaaaagatgctaaaatttgcccctaaattctctgcgattcgcagcaggccggc

SEQ ID NO: 16636 - DNA, 1501 bp, Oryza sativa
ggagtccgtgctgcagctggctacagatctgtagcccgctgctcttccctctcttcctttatctctttaaaatatgtttatagctggtttatagcccgctattgtacctgctcttattagggtcctttgtttctggcaaatgggcttgccaaatttgtcaccttggatggatgcttgccaaactgtgaaaactgaacaatgcaagtgtcatttgattccttgatctcatggctgttgcatttttttagggtcatggctattgcattctagtgttatggctgttgcatttttcataatatatgttgtttatgtactattttaaatcgtaagccagctccttgaagtagttttatgagcattcaccaattatatcttgacttccactgcatgcatgcatgcatgcatgcatgcatgcacattcgttcagagtactaacctgaagtttgcacaatatacagaaatcaatcaaaatatattcaacactaacttttctcttgatagtatctccacaggtgaccagcttagtagcttactgtcggccagcaggctgcatccatcacatcggttaccgagcatggcatccactcttaaacacccagaacggaagaatgtacaggtaaacttgagctcagcattgtgcttctcagttgagagacagttaatcagctccttgacaaagtattagtactatagtacatggattagctgctaatcatgcagggcacacgcatcgaggcagggcccccggcaaaatctacatgggggcgcgtgtgtgaacgtgacgtaaaccgtcaaagggaagggggggaggctgccaggggcaaaaaagcgcgcgaatcgagtaccaaccttgggcccctcactctttccaacgagagctgactaggcacagccatggtggccccacaaagcaaccaatggcatctctccatctctggagctacagggcctcactttattggcagccaaagacaaggagagaagattgggatatttctctattcaccgctaaagctaactgacacaagacaacagaaagcaaaagcacccaaggtgagagagagagacatagagagcgagagagctgtacatggaggagtagtagcttcttgagaaagttggcaagaatccaaacatatacataaaatactctcggaaaacttgctataaagcacactccctcccgcagcccctttccctccctctcttgttcttcctctctcatgtgccattagccaatagcatcaaggtctcctctcttcctcctcgatcctcttcattttgtcttacttgcatgacattcttgttaactcatctatgtgttattgtatgttgcaggtttttgtacattgtagctgattataattcattcatatagctattcaaacaagttcggtggctgtccacattttagctttggatagccggcttgccagctgcctgcctagctctaagcatctcttgctgttggagttttgagaggaaggctagaggaagcata

SEQ ID NO: 16637 - DNA, 1501 bp, Oryza sativa
taagatgtgagctttattttgttataaacaattagataacatacaataattaggtatcattaatccaaactcatttttgaaacatgcttgagatgaaacagagaagtgctacactacctaattgtgacgatatccagattgtgcatgaaaataactttcatacatcataacaatacacaatgatgtttcaaaaaataaaacatgaattgtattgtaataacagaagctatatatgaagccacattatcatctattttgtatatacaaagagttacatctaatcatttaaaacattgattttattcgatgataaaactaacaaatcccgtggcaaggcgcggggtgccaactagtaataacaaaaactcatttaaaacattgattttattcgatgataaaactaacaaatcccgtggcaaggcgcggggtgacaactagtaataacaaaaactcgacctgtgggggtaagacagcccccccttacggtagtccatgtcccaacgagccttacagtagtccatgtcccaacgacggcgtgggacaaacgaggagatttttttaaccacagcccccgccttacggtagtccatgtcccaacgatccttacggtagtccatgtcccaacgacggtgtgggacaaacgaggagatttttttaaccacaacctaaattttgttccaagggggaattaaacacagaacctgagaagtgctactatagccacctaaccaactcagctagaggctccttgcatcttaacaaataataatcaaggtatttagcatccagcatgtcttatgaaagacataggttgctactgatacattacacacatgacaataaataggttcatatatacctttagcacgtggatgcagggcatagctggaatgaaatggagggcgtgccactcgcttaatttactatattttaaatcgagtttaactgatgcggttctctaagtttttatttaaaagggtacacatatagtgaaaataagtaatgtatagttaaaaaatttcttaatcgggttcctacttcctaggcacccctctcatatactctagttccacccttgcttggatgccattgaaacactgctagctaaaacataacttcgtccacaaattcatcgttgccctaagagtttgcagacttgtagtcatagactctggtgtgcaaactacagagaatacatgaagaatatttcctgaatgtcctttctattacctatctgtctcaagcaataggctttggaggtttcaggaaaccactgcatctgagctagagagatcaaagagtaatctggatttccttgcctgcaggtgttctcgatggcttccttgcctagtgatgccacctgcagcttgatgcaaagacggccattcacagtcagagccacgctatgccgtgcctcaagcaaccaattcaggtggtgtttacatccagggacttaactttagtccctgtctttagacactaatttagagtattaaatata

SEQ ID NO: 16638 - DNA, 1501 bp, Oryza sativa
ttgttatgttgtgttgaatggcattccggtcatttctgccatgtttttccacaagtgtgagctcatgataaaacaagacaattgcatatttgcattagctattccacttactgcagtggttacctccgtggtaactctcaaagggcttgttattacctcataaagggattaaatgaaataagcctgtattaggcacataactaccatctactcccttcatttcaaaatatagcaacttaggatatgtcctaaccaattttattctaggttattatatatggggacgaaaagagtacttagtacttcacgtggatggagaatagtgcgtttggatgttgcaacctgtttattcctagtattgggtgttcgtgttgtagacgcttggcgtgactgtttatttcccgagttattatattgtattttttctgctttatccataaaatacgaatatatagctctatttttttagggagtattttgggggagggagtatctcccggtgaccgtgaacgaaaaccaaattggtcgactcttctgtcgctgttactaatcattagaggtgacagttcaggtgttactttagatttcagcggagccaccgtttcgcttattttagcgaaacgacatatttataaacggaaagtaatttgtaaataaaacttttatatatgtgttctcagcgatctaaaaataaagactgaaaaataaacttcgatgaaaaaaaccttaaaatcagctttaaatttaaagttaaaaattcaaattttgaatgataagcataagcataaacgaagatagtccatcacccagattccattgccggagctaagcacacgtgggaaaaggcgtcgtcctccaaacaagcaaaaaaaaaagaaagtggtccacgtggactgaagccattggccaggtgccctcatcgatcaatcgcaaaatgcctcaggcctaagaaatctctaatcctggtcctaaacttcacgagcaagtcactcggcatcccggaagattccagtaggcgcggacacaccaacgcaaccgtcgccaacgccgccgcctccgcccgggtcgggtcggaaactcggaacccggcgcgtccgatcgaagcttccgacctcctcgcccgcgccgacccggccacgtcaccaccacccggtgcaataagaccctggtcggcgagcgagttcgaggcaaacggcgcccccattcgaaaatcaaaatctcttcctcgcctctctctctgctctctgctctcctcgccttcctctctcgccagttgctccgcgtcctcgctcgagtgcgcggcgatccatccgggagggagaggtgcgtgcgctctgatcgctcgggaaaccgtcgtcctgctcgatcgcgctggttgatcgcgattcgccgcagcggcattccgcgcgagtagttcgattaactttttttttgggtgctttgttttgctcttgcagacggtgacggcgcgggttgaagttgaactcagcggcgggtggga

SEQ ID NO: 16639 - DNA, 1501 bp, Oryza sativa
tccctttttactttttgcatttcagcctggacacatctatgatctactgactactaccccctcatttgcatgcatgcatgcatgaatgaatgatgcaaaaccagagaagatgccatgcatatgtgcattaggagttaggacacagggccaggcctcctcaactaacattcagattttcagaggctgcaacttgcaagcaaatctagtacaaagtactactagtgccaatgccaaatcagatgccatctctatctccatcacacacacaaaagctgagtagttagagaggcagtcagtacagacatggaggcagaggaaatttatgtgatggttgcagaggaagccaatccaggggactggaaatctgaagtttggtgaaggaagcaaagagaatgatgagtgagctagtagtagcaaagctaggtcactgagcccagtgagtgagtgagcgactgactggatgagtgaatgagcatgtgcagaagcaaattgaatgcatgaacacaagagagattttaatttctcggcatcattctcttcctcccattgagatcatttcatttcatctctctccctccatagctggcatgcagcacggcagccaagtcactgaacacagggcaatattaagccattgcaggggatgatcagttgttgcatgcaatattcactgtccgtccagtgaatcaattccaagaattaatgccaccgattttttatttttgatccgcacgcatccctgcacagcaaagaaattaaaaaaccgtcggttttcgatcaaatttggatcaatcaaacttctcccctcaagaaaacataaataaaattatataataaagagctcaccgtcttcgtcgccatcgtctatctatggatggtgacatggatgggtaggtgtagcagagcagatacggcgggctccattggggcctttctgtctacccggagcccggacaggcaccgcgacctccacagtacgccggccgggcgagccggagccccggacaccgacggcgcccgcggcattttgccattgccacctcatttttcatctcctcatctccattttttttatcatcttttttcagacaacgatttgttgttatcttcttgcagagtaggcatgccaactaggctcgccagcgagtcgcgccactgtgatatatggcctgtatttttccgggcttcattatctaacactatccgtaaaccggaatccgcgtgtagtatttgtctaggctctagaaaattcctggatccgccacgcggagagtcgcgtggctggatttatatgcatgtagttgtagttcaggtgccatggtgaaagctagaggtatggaagggagctaggttggaacacttgtaaggaggaggtgcaaccatgtgtaaggcaagatggatatgggtgaaaaaccggatatatgatgatttctttgcaggttaatcttcgctttctgatctttactgaacctcatctggaaccaaccaatccgggcctgaa

SEQ ID NO: 16640 - DNA, 1501 bp, Oryza sativa
cgtcagcgtcccgcccacgccgaacaccgtcgccgtgaacagcagcaccatgtccacgctcaccagggcttgcaggatcgtgtagtcctcgccgcgcggcggcggcctcagtgcctggaggatcctcgccgtcgccgtcgtcggtctctgggattcaggcgaaggctgtgccgccggcttcgcgggcgcggtcaccacggacagcgcccgcgggacgtcgtcggcttcctcttcttcaggcgacttattcttgaacagagcagcctcctcgcgcactacaatggtgaaggggaggaggagcatggcgaacacgacggcggcgctgacgccgtactcggcgcgggtgaagcggagcctcttctggaggatgatggcgaccatgaggtaggcggcgagcgcgagcgacacgtagaggaagccacagaacgcgcggtattcgcggcgcgccgcggctggcgagcgcggcgtgcgtatgatccggatggtgccgaggaacgccagggagacggcggccggcagccagccgacgagaaggatgagcggcttggtgttgccgccgccgtagaaggcgaggtagagctgcgtgaagatggcgccgctgaggccgacgaatcctttgagcaagccgagtatgacgccgcggctctcggggaagttcttgacgcaggtgacgagcgcgccggtgttggcgaaggcctgcgagttggcgccgacggcgatgtagaggcagacgagccagagcggggtcttggccccgacacggccggtgacggagaggtagagcatgaggtatcccccgagattcatggcggcgccgatggcgaggatgaaccatggcgacgtgacctcggcgatgaggccggcgtggatgccgacgttggcgccgacgtccttgaagaagccgacggtgttgagctgctcctgagtgtagccgagggtggacttgatgtccttggagtagatggcgaagatgtacgtcgcccccgccgccgacataatgaggaaggagccgtacgccatgaaccaccggcctcgcagcacatgcgccgcgaaggccgccgccgccgccatgggcatggccggttggaggctggactggagcgctagctggtacagtaaatgtttgtacacgacgacaaggggagtacgtagataggaatatactactcctagacacgtcgtgtgattgcctcccggatccggatgatataacctagttctcaaaaaaaaatgttgcactactttgtaaaaaaagttaagacagttttgaagacggtagaaagtctcttcaacaacacaaattttgacaatttaaccctttacaaaaactaattttacaaatgaatcgtggccaaaacttatttaaaatacgaaccttttgtggcgctgaacttagacaccttagcaccgaataacacggcgctgaatgcacattggcacgccgactagcctcccatccgcggtggcacaacattcagcaccagttgacgtggcgctgaga

SEQ ID NO: 16641 - DNA, 1501 bp, Oryza sativa
tactgattaggggaagatttgagaaaatataccgccgtcgcactttggttaagcgagagcgcgatatcgcataatgaattagcgaagatgccagcgctatcgctaattgaaacagcgctatcgctaattgaaaccgcgagagcgctaacgcatcggtctcgcattccaaaagcgcgagaacgactcggtctcgcacgatcgtaccgcgatttcgcggccgtctgacgtgaaccaagaccggcgggccccaagcagtctcgagagcgcgtcccacctgctaatggaatgcatgagccatgcacatactggtatatatccatctatatgtgtgttcagccatatatagatgcatgcttggccaatgtataaacgtatacatgcatgagccaacaagaagatgatatatttgacggctatatatatgtgtatgcatattcgtatatacgattcagcgcccggattcactaacgatatatgtacgtatccatttttgattgagcgatagcaaagcgctctctcgctttgccagagcgataccgcgcgtcggtcttgcacattcggacagtgataccgatatcggtctcggtctcacgctttgcgcttgcgagaccggcggcccactcgcgtccggtcgtttcgccaatatgggtcccatgacatgctcagtctcgtgcgtcgggattacgagaccgatttcactctcgctcttgtacaccgcgataccggcgcgacaacgggtcggttccatcacgtggcactctcgctctatgaaagagcgatatcgtggtggtctcgctgtttccacaagcgacaccgccagctcaaatgcaccctcgcgagttgatagtgcgatagcgtggcggtatcgcattttgttcttgcgaacctcggtatcgctcttccaagccgcgataccgatagtatatttgtgcaaatcattctccatccggtatatttttgcaaaacaaatccataaacagtatattttcaattttttttcgtaaatatgtcacctcacctatttccattgtaaattttacaagttaccctttgaatttcttaatattaaaaggatcaaatagtcacataaaaaatcatattaagataaatattttctataaaaaaagatggataacatattaatacattttcgttaagaacattttactagtttggtcataaaaatctcctacccgtaatagtataaagtatacaaaaacagatagactaggctatgacggcgatgatgcacatactggcaatattattcatattgcgtcacaccaaacggaacggaaacgtacacgacacagctagttatagttatccagcaagagtacgcctccctagtgtagaagacgtatcccacccttacacgctctctatcccactacttttacaagaaagccctccagttttctcgtatttctcttgccgttcccgcgccaccaaaccaaaccaactcttcgtcgtcgcgccgcttccgttcttccggcggcca

SEQ ID NO: 16642 - DNA, 1501 bp, Oryza sativa
gtcgagctccctccggcgaatccgagccgtcggctcgtctcccctcatcctgtgcaacatcccggtgtgctcgccttcgcctgtatcgccctggttcgctccgccgctcgccgccgtcgtccgccatccgttccgaccggcgtcgtcttctacctcccgccggcccgcgtggcagccacgtaggcgccacctcggcgccacctcggccgcgaccggatcggctgacctggccagccgctccctccgtttccccccccccccacgtgcgcgtggtccacggtgagccgtgaggctacgcgtgcgcccgccgcaccgcgtcctccgcgaaccgcgcgcatgcgccgcgtctccctccccaaaccctagcacgccccgcgtgcacctcgctcacgatgagccgagtcgccgacaagcgggtcccacccaggaccacgcgggatggacccggcccaccggctctctctctcccctcctcgcccgtgcgcgcgccttgggccgccttcttgggccggccggcccattaagctcggccgagccgccccattctctcgggccgcgccctagccgcccgagggaagtctaatttccctccctcctccttttcctttcttttctttttcaaaaaggatttaaataaatccttttcctttagaccaaaaatccaataatctgagaaattcaatatcttcccaaccgtaagtccgtttgactccgttcaacttccaaaattcctcaaatctcgagatctatctaatggcacgcttagaggtcattaatagggctttatttttgccgtttgttgagttgtcccgtttcgcgtgtagtttcggagcccgaagacccgtagtgcgaggatttcgaggatcaagctcaagatctcgagcaaggcaagccacccttgaacatcttgagcctatatttgaacttaattatgttgcttgaaaaatattatgcattgataggatcgcacttaatccgcttgtcccgtctgcaaggcagattggcggacctacctaatttgttgcatttgacccttccattgtaattgttataccatgttcccttgtacccacctagttgcgcctcggtaatcgtgcactctgcacgggtatcgacggtcgccttcaaacttaaaatctgagaaacatcttgggtaaaacttgggttttacaaaagatttggaaaacccgacacctgggccggtgcttgcgaactaaatgaatttccaaaaccgcggaccgggaaacgtaccgggtgtacggtttcccgctcttgcacttaaggaccgtttccttggaatttcatccgaacataagacaagtgcgaccacatgggtgaaatgggacacccctgactgagtaactagcttatcgggggagccatgatgctaagagacatgtggattcgccggggtggtgtcggggaggacccctgggcttcctggcatagtatggtctgagacctaatctggtgttggtctgggacccctctcgttggcata

SEQ ID NO: 16643 - DNA, 1501 bp, Oryza sativa
acggcaaaccacacaggtttgtactctaaaatagagaaaatccataaaatgccatcgacaagcaccttgatcctagaaatgccattgacaaacgcaacttcctgaaaatgccatcgtacaagcctatttctcccagaaatgccatcacaccgttagtccacaccgttagaacaaaacattttacaagaatgactaaattgccctcactccaaataatactatcccaatccaccggtaaaaaaaaaactaccgctaatgcttgatgcgtcacatggccggcctgcctcgaaggcgccggcctgacacgcggctagccagaggaagtgggaggctcacgtcagcggcggcgaatgactcgtcgtcgctgtggttggagtcggagtcggcgcttcgctcgccgtcgctggaggaagaggaggagaggcgggcgagccccgcggcggtcatgctccagacgcgggcgccgcagtaggggcagcggacgtgcggctcgagcgggccacggtggatgacgaggaacgcgcgcgtccgcgacggcatgaacccgcggtacgcgcccacgatgtcgtcgtacactgcgccggcgacggccagtggcggagctagcggcatcgttgagcccgggcgagtaatagcgtttttcggtgatcgactaattttgataggtgttgacagctattcgtagtgaagacgacatcgacggagcacgggcggccgcccgacctgtccgggaggtggatccgccactggcgacggccaccgcgtgctcgcaaagtggcccggcacggcggcggccgcgcggcagcagaagaagagcagcttcgccatcaccggccaacctcccccaatgagtcgatgcctgggaccgtcgtgcggatgcctgctgccgaggcgccgtcgcctgggaccaccgtgcctgcggccgacgcgccgccgcctgggaccaccgcgccgccgcatgccacctcctcgccgcccatcgcgtcaacgcctgggaccaccgcgcggacgcctgctgccgacgtgccgccgcctgggaccgacgctccgctgccttccacctcctcgccgcccgtcacgtcgacgcctgggaccgctgccgcaggcgccgcctgggaccaccgcgccgccgcctgggagccccgcgccaccgcctgccacctcgccgcccatcgcgtcgacgcctggaactgacgtgccaccgcctgggagcgtcgccttgccgctgtcgcccatcgggagctggcgattgaagtggaggggagaaatagtggccggcgatgggatggaagagaaggggatttatcctttgttgaggagggtaatttggtcattttgacaaaattaacggtgtctaacagagtgaaagtgacggcgatggcatttttgggacaaaatggctcgtacgatggcatttgctggaagtcgcgttcgtcgatggcatttcttggattagggtgtttatcaatggcatttcatggattttctctaaactaaaaac

SEQ ID NO: 16644 - DNA, 1501 bp, Oryza sativa
gagcctacttaagccgtcattagcacacgtgggttactgtagcacttatggctaatcatggcctaattaggctcaaaagattcgtctcgcgatttatagctaaactgtgcaattggtttttctttttgtccacatttaatgctccatacatatgtccaaagattcgatgcgatgggtgaaggggaaaaaattttgggaactaaactggccctaagcttgacccccatgcatcgagagtacttaatctcatcgatcgacacgtcttgatattattctgaaatgcatgtaggagctaagtaaggtcgatcatttatgcatatatatatatatatatatatatatatatatatatatatatatatatatatatatatatatatatatatatatatatatatatatagggccaaggaagtaaattaaggagatttatagtttgagagcaagtttaatagtatagccaactactggctccaaatcatctatagccaatgtaatagtcaattcatataatagttgcttactatactattaatacctggtcctacctgtcatacacacattacgtcttggagtccgtgctgcagctgactacagatgtatagcccgctgctcttctctctcttcctttatctctttaaaatatggttatagctggcttatagcctgctattgtacctgctctaatatagcatctgcccatacatacacactgaaagatgcagctgcagcagatcagtgtcgatctctagcttttgctcatatatatggctgcccaaccggcctttctccagtgacatgacatgcatcaatggacgatcgatatatgttctggggctccatctgatcatccatcagtcttcctgtttattgcagagtagatatatatattagcttgtctatatatattggctacatgcatgcatgcatgttttctcgaggtgtagctaggacaggcaatgctgtgtgaagcacaagttcgtgcgtgcatactataatattagtgcatccattccaaaatataacaatctacaaataaacggaacatatttatatatgaatctgaacattatagtcttattcagatttatgtgactataatgtgttccatttaattatagattattatattttaggattgtggggtatatattatccggtttaatttaatttttatggttggaggccgaaggaccagagaactggagaaggaagaagggccagctagctagcgtgctgctgctgctgctgagaccaactttaactttatgcaccctaagccatatgtatgcatggaatcatatactacatcacaattaccgagatcacaaagaggtcccttttctgaggaaaaggaccggaactactgctatctctcgtccctttatttcaaaagctacataaagtatatactactagttggaagcccaaaagatcagataatactctccctaattatttaggccatcttgatcttctcctacaatgtcacacaccctac

SEQ ID NO: 16645 - DNA, 836 bp, Oryza sativa
ttagacaagagggtgcatctgatttaaccaataaattagtgacatattttgttgagtccggtgaatcacattgacagggccacctaagcggtgcgtacgttagtaatagatctggcctgtggaggatgaagtcatcacaacaataatgtcgtatccctctgtcgaccccattcattattgctgcatggtttcatttgcaaaattatttctcttagttcaactatacacttacttgcagaagggatgcttttgttctatattatctttaattttaatccaggtgatgtaccggggattttatgtctcctgaacttttcttttcaataagttgctttgttatataaaaaaaaaacctaggctatatcgcatgagaagatctattgtttagggagagcatggacctatgagaaaacaagaatggagcttcgatgctagcttgtaattggagacccaataccattagatccatcgttagatcatctcgtcgccttgttggtatcctatcttactataatattgatgtccactaacttttaaagcttaaaatacaagtgtgtgccacatcgtcacttactatcaattattatttagagtctttaaaatcatatgcaagtgtgccacatcattacttactagcaattattatctagagtattttaaatcatatgtaagtgcaccacatcatcacccactagtaattattatctagactatttcaaatatcatgcaaatatgacatatcatttataattttgttatatttttataactcaatatgcaagcattgtcaaatcattaattatcttcacatcatttttatattatttaaatatata

SEQ ID NO: 16646 - DNA, 1501 bp, Oryza sativa
ctcctatatgaattttggtttaagttgtcatgattttatatgtatggagtacacctaatacatgctcgaagttatttgcatattagatcatgtttgacttattggcacttgatcgaatggatttatgtggaaccaaatcagctagaaagtacaaagagtacattcatgtggaaccgttcgttttagtttctgaataaagtaaccatcacattgattcaacagttttgacaactgacaatgtatgcccccaaagatatttcatttccaacatgtttagtgcaagacttaattcactggttcattacttggacaagtggaaagtctatttggcactcgagaacgtcccctcgttttttacatgtcatcgaaaaagtcattaaaaagtccttttaacaatatactccatctatctcaaaatatacgtatttttagctattttgggatggaggtagtacaaattaacagtatagatcaatgaagatatatcacttcagaaacatccaaatttaaatttaacttgtacatgtaaaaaaaattaacgatgtgtttgtattatatttatgcaagtcatatttaaacttacatatgttagtggaatacataatataccacatatttatatattttgtcattctctctaaatgtttttgatgattttctagacgatatggcgctaaaacaagagtacatcctttaaaatctacatcccgatatcagtgctatgttttgaatctcaaaaggtcgattcttgcattgtaaccaattcgcagtaaaccaacttctttattttattagtttgcatagttttaactttcagtttcagcaagcttttgcatcatatcagaaacagtacgtgccactatgcatgcaaattaatcaacacagttcaggcgatcgatccattgcatggatggtacatacaacaaaacacgcatgcatggtcaaaagactgaaaaacagatgcatggttgccgctggctttggctacactccaaaaacagagcactagctagctagctcaagctcaagctcctcccttgatcgttcatctaccgaatcaccaaacaagaggtgtcgcctaagctgcgtatctcctcgcctacggccgcgcgtgtagaaaaaaaaaaccctcaaagaaatggcggtggtggttgcgacacacttggcatgtcctatatatatgtagacgactcgagtgctttttcccaacattcattccatccttgccaggccatctcccactcaaagtctcacagagctagctgatcaagagccattacagattgtggctcaaagcttaggctacacaaattaagatgaccatggctatctcctctgctcttcctagccctctactcttggcggcttccctactgcttctcatcgtccaagctcagggcatcactaggcactacgaattcaatgtatgcctgcacacgcatagccaatgcaaagtgatctcgccttgatgaaaaacttaattgattgattgattgattga

SEQ ID NO: 16647 - DNA, 1501 bp, Oryza sativa
ctcagtctcatcttatctgtgcctttttatgtgggcatctggtagaggtgctctcttcatctgcatccaccatttcattcaccaactaagtaggcctttttgagctaggtggttggttggccttggccttattaatttttcatgtggtactacaatatgccattatgtccctaagttgtgtccttcacattttatttagtatctatgtagttatgtcttttacatttatttacatagttatgtcttttacattttttttacatagttatgtcttttacttttttttacatagttatgtcttttatgtggttatatgatggagaagaagcttccgatttgtctttcttgccgttttgagtttcttttcttgtggtcagagcagaatgcaagaattaaaaattaggtgagaaatggaacagaaattttggatttaaactttgtttcttctcttgttgttatgccctctgatatttggccatggccacacctcaatgttttccaccactgcttctaccatgcacctgcagtttgatctctcattgttctgcatttgatgcgtgcgtttgtagcagttgttgccttgttggtactaagttgttgttgttgttgttgttgtttcttcaatgctcaaaattgcaacttgggagataaagtttggcggagaaagagaagtgtgagaagaaatatcgatcctaataacaatggatgatgcaataccggcaattttttggggcatccaaaatagttttgactaatcaacccatgttaccctgaaaattatgtggcctatatctgcattaagtcacctgtttatacaacatttctggtttcttatcctttttctttcttagtgtaaatgttgtatgctgattgttattgttagctgggcctctgttgcttcgtgtaattattcttgctttattgaggtgttacgtatgatggaaagttatagtgtagtttgtactttggagtaacatgtaatccagtgaattatcagttcttccttcataagacactatttagcattcattttacctgtcattgtttgtgggcaattcctacctatttgtttgtttttatataatggcaattccccagtacaacactaacatttctcactaatggctttcaatctttgttgttctttaaaatgaatggttacctcaattgcctgatttcataacccagacaaagaaatttctcttgtattttttttctttgctttttttagttgtttcacaaaattatattggtgaacccgtcaatttttataaatagatgccatggtaactgctatgtacaaaatataggatcaacctgtcagagatttccctaattctctagtaatctggtgcgtcttactggctggctggctggtggttgatctgctcgctggtggtgttgcagtcttgcaggattcatcagtggtgtgagctgaagtgggggttctgtggttttttgtttctccgttaaggtttctctttccgtttcccctctcgct

SEQ ID NO: 16648 - DNA, 1501 bp, Oryza sativa
cccctgcttttgacaccccaaactgaaacatataaatgctgcaatgaataaagcaactaactttacactatcacagccctagcttctgttctggccagtttcttgctccctccagacggtaatcactttactctgtatcaacatttgcatttaaactggttgtggttgactggttgtttgactagattagcacaactagaaaccatgccaagccattcctgatctgcagtgtgtcgtttctttcttctgaactgaagatttgatcttttctgtttgcaaagttcatgcttacacacttactacacttgaaatctgtaagataagtgctctacattgaactaaaaatacgtaaattttttgtacatgatctgatttctcatgtgcttgttttcctcttagctaatgacttttatcttttctgttgtagaaattagaatccatgctcatttaccattgtaagatgaaatcctacattgagccaaaaatctaactttcttttctttttgtttgtacatgacctcgtcctctatttggatgaagatttcacctttgctactaatagacgagccttgcaaacaggctaaagaaatgatcttttttttttatttgagtaaatttcagaaatctacaactatttgggtcaaaactatcaatttgctacacgtcatactcatgcatacatgccaagttcacacgcacgcacaactggttacagttgcagaacttgcagtttaatgataaaatcgtttgatatagttacaacagttttgcgaaatgttcgccttaatcttatagaaaagcgatacctttgaccaaataactacagctttctgaaatttactcctttatatatattttgcatcacgagaaacaattttaatcacttaggtggatatctactcatttgttgcatgtgaacaaaatgaatatgaaaaaaaaaataaaaagaataattaatacacgtatattcacagatgaatttgttttttttgttataacttgtatatttcatattaatctatctcgttaatttttttatattatttatttgacatgcaataaatggacgaacatccacccgagcgattacaatcctctccaccaacatacaagtttaaattcaacttctataaattgtaacaaaaataacaaatttaactccaataagtatatgcatattcacaaatgaatttattaattttgttataacttgtagaagtcgaatttaaaattgcatgtttgtggggtgatatatttcatattaatctatcttatcaacttttctgaattttttttcaataaacgggcgaacatccaaccgagcgattacaatcctctctcttggtagctaactaaagaagtgatcttcttcttcttcttcttcatcttgcatgacttctcacgacaatggcggcgcgcgggtgcaggagagcagcatgagtactcgcaccaccgagctgggatggtcggcgatggcgaacaccgatgcagccgccgccga

SEQ ID NO: 16649 - DNA, 1501 bp, Oryza sativa
tcccccgttctctgcccgtctcgcgggacacgctctccgccgccccggtcgctggcgccacgctcgcctgcacccctggatgctccgtcttccctggccatctcaagatggttgcctaataaaaaagtacaggatgatcaagaagcgtcctaattccagcggctaaagaatcgacaatggatatatacctgtgatggagttaaacacctgaggcgccatattgcataatcgatgcacaggcatgaccagcaatatataggcttcatccaaattactcgtaactgccaaggatttggagtcctggccgatgacggtctagctttgtttttctttcgccgcacggccggagataagcttcagcatgggagtcctttcgtcgcatgactaaactctaccggacatgtattgcatgagccaacacgacaccaagttaatttcgctcgctccacgatcaaaatttacttggtggggggcatctgtttgatggtattttggcgattatatgtgtacacaagacttactcatgatggacaaagcaaacaagcagtttgtaagttggctagcttatcatttctatgcaatgctcggccatgtatatacacgcaaatacatgcatgcacaggcagctgggaatatatatacttggattagtatatgtgcatgtataattaaccaataactagccgtgtgaagattggctagtgaggcaatcacgtgcatgcatgcatgtactatagtagacggtcgtatgtgtgtgcatgcctgggtgattaagcaacctatgcatatccaagtgattaatcatgggctcggcccatggccgaagacggtagctgcctacgcaccaagatttcagaagttaatatgcggaagagataaaaccagatgaattaagagataaccaacaaaccaattgattttatctctataacaaacttgatctagttagttacttcgcgcgagcgctggcgaggcgcttatcaccggactgtggcccagcagcagagaaacaaagcgaattacaaatcagatatttgacgccaggagaagctaagagataaaatcaaagaaggatatgaacaaataacaaactgatcgatcaagccttatctgcaacgaacttgacgcggaggaaacggcgcgcgaacgcggcgagcaccgaccccagacccctatataaggcgtcgacccctcggcagccaggggcattggcgaactcatccacacattcattcaccaacgcatctagcatccacaagccacccatcatcaacgcatctacccatccagcatcaacacatccatccatcaactctcatcggcgatctatccatcaactctcatcggtgatccatccatcgacgacacgcaccggcggcggcgagcgacttcggccggagtcccggtgtccggtaggagagggcgcgcgcggtgatccgatcatcagcaagcgcaggagaggagcttgatggctagtccaggtaaaagctagcaagattgt

SEQ ID NO: 16650 - DNA, 187 bp, Oryza sativa
tatagggcgaattcgagctcggtaccgttgtccaactggacggcgccagcctctctggcgccgtccccttgccgacgtggcggggcgatgctgaggtggctagggggagcgccgccgtccccttgccgacgtggcggggcgatgctgaggtggctagggggagcacgccagagtggctggcgccccc

SEQ ID NO: 16651 - DNA, 1501 bp, Oryza sativa
aaggtcttccggcctaaacaccagcgatgacgagcatgatggcgtcaatgcttgctcgctgcttgatctgggccgcctgtgctgccgtcccatcgtggtcacgtcggaaacttgtgccacggaatgatcgatgatcagcatgagccgggcttccgtcgcgtggatccaaaggtgttcggagttttttgttttttctacgaacccaccttcaaccgcctcatcaaggcctcgtccgagcgccgccgctgcatcgtgcatctcttggttcggaaccctcgtctctggcggacgcgtacgcacacgaggtgtaggatcggacacaagtaaccaagcctattaagggggggtgaatggtagggaaaaccaaatacctaaaaacttttagcggaaataaaagttaccctcaaatcgatggaaatctcgacgtagtcctgtcgccgccgcgggttgaaccgcttgcacgccgccggtcgaaccgcttgcacgccgccggtcgaaccgccgaacccgatgaaacacaaatcaaagaactcttaaagtagatgacaactttattacttctctgtatttacaaagtgcacgaacagcactccttacaaaaatctcgactaaactcgaaaccctaactaaactagcaactcaattgctctcaaaagcgataccgggaagcctcacgctccccctctatttatacataaaaaacctcctactcaaagtaggtgtagaactcctattcacaatagaactcaataactcaatttcctttttctcgaaaactacagccgcgccgcaccgaagtcggactcctcctgccgtcgcagcgaaactccagccgccaaccgagccggactcggtctctgtgttgtgcctcccaggccaactgccaatcggacatgcaagcccacgtgctgacgtgcatagccttccatccaatctcagcacacagccacacatgcatgtactaaacacacgtgtacagcacacagccacacatgcatgatcaacatacatgcatcgataccatccatatgcatgctacagtaccacgtgtactgtagcaccatatacccttttctcgatttctcactccaatctccttcgcgaacaccggcacttgcacgcacacctcgtgaagcccgttgtaaagatctctcccacatggtgtccatccaccgtgtgccatctcatatccaacttcgtcacccggtattcttgaccgtctggacctcaactcctccctgagtttagttccgatccccaccgttgaccgaagttgacctccaagaatccagactctagtcaccttctcacatggtatcccgaccgcactagacctctgctcctccctgagcatagtcccggtcctcaccattgaccaaggctgacctcaagtcacctgcacacaatcagacaaaacaaccgtttctgggcacagatatcacaacctgacccacattagtcacacgcactcacaccaacatccacacatctctcaaaccaa

SEQ ID NO: 16652 - DNA, 1279 bp, Oryza sativa
gtgtccatcatgccgggcatggagacggcggcgccggagcggacggagaggaggagcgggcggcgcgggtcgccgaggacggcgcccatgttgccctccacccaggtgagcgccgccaggatctcgtcccacagccccgccggcatcgctttctgcgcctggtactgctggcacgcctccgtcgacaccgtgaaccccggcggcaccgacagcccgatgctcgccatctccgccaagttcgcccccttccctcccagctgcacatccaattttatccatgcaatttacatatatatgttcatatacaaattaccagtacatgatgaatgaagtagtacatatatgcacgcaccaggtctttcatggtcttgttgccgtcgctccggcccttgccgaagtggaacaccctctgccccaccgcctccgccgcgccatcccgatgagcggccggcgccattgatgacgatggttcactctgatcttctcttaaattagcttccttctgcttgatactggcactcagtctcagctagctttcagctttccgagctcgctcgacggggcagtggcacgtatatatacacacactacaacacgagtctaggagtaggtggtggcagccagccagccagccagccaacgccgtcaagtaaccgaccgccctgcaagaagtcgatttttttttatttttttttgtttacagaggaggagtatctgtgtactaggagggagaccgcaggcggcgctgatacgtgacttggggcgcacttaggatcaatggatggatgtgataactgcatgcacgaccccacgacatcgaccgctgccgccaaccaaattaacccttacttaatctcgatcgaccatcagctgacagcaccggtgtgctagttcaattacttcatcaatatatggtgaaagctaattaacccatgtccaattgtccatgtagtggtggactcgataatgcggcagattagcatgcagctgcatcctgtatatgtctagtggtagtagtatacatactacattattatgctcactagctagactgctgcatgcaccagtggatgcacgcattcatacatgttcaattgttcagttgaaccgttactctgacactaactagctactattctgaacattttgcaggtgatcaagagatcgatcggtggtgtgctggtgtactgcttgccaagacgctactttgctcgatcagcgctctctctctctctctctcactctcatccatgcatgcatgtagctaggcatgcatttt

SEQ ID NO: 16653 - DNA, 1501 bp, Oryza sativa
catagctcacatcatggatgaacaagatgatatcaagatcaagtcctctaagtgctggaatccgattcggccacctgctacactgctgacttcaaacggctaccgaatctgcatacgacctccgttttcggcccatgagtacttgatggaaagttctcggagtcctctttccaacagatctggctttatcagcagactccatcttgtttggccgcaaatacaaaaacaagttgttgcgtcacctgtcatgggccaatgggcttgtaactttgtttgggaccccggcccaagtggggcccatgtggggtgcgccccaactaggtggaggacgacctagaggtcctcccacctccttaaatagctaggtagcctttagagtttcttgggttttgatagattaaaattttgccattgctacttgcttgcagcgcgcgtgtcggctagaccgtccgtttgcttgttcttcggaaccccaacttatcatttgtattaaattcctatttgcaatataagattgcttttatcttgttcttgcttgtttcttcgatttgcttgcaggaatagggttgatctgcaccggcaagatcaacaacccacggagaggtgtatcgattgctaaggcgcaacacaacgtctcgtacggttgtagtcggatcgtcaacgtttctcccaaatcgtagttatcacaactcaccaaaagatcgggccaacaacagccttgagtgtcgagaggaactcagggttcatcaccataaatctaattcatagttttgctaaaataatataaaaaatcttggcaaatagactagcaccaatattacaagagatggtttccactaatcagagtgctttcataaggaagagagctatacatgacaacttcatgtatgtgcaaaacccggtcaagagactgcatagaaggaaaacacccaccttgttgctcaaacttgacatctcaaaggcattcgactctgtaagttggcaatacataatagaggtgctaacaacttttggctttgggctgagatggagaaactggatgtattcactctttaacttcaacctctaagatcatcctaaatggatgcccaggccaagcaattcaacgtgcaaaggggttaagacagggagatcctctctcaccattactatttttattagcaatggagccccttaacttcattataaaacaagctgagcatcacggaatcttatccccactcaatggtggacctttgaggtttagaacctctctctttgcagatgatgtagctttcttcttgcacccaacagcccaggaattatccaatctaaaaaccattatggaacactttggcatagcaactagtctcaagaacaatgcgcacaaaactcaaattctctcaattgcttgtgaaaacattgatgtgcaacagttgttgctggatttcctaggagctgttcaaggcttcccaaccagttacttagcctacctcttcaccttagaaaactatggaaggta

SEQ ID NO: 16654 - DNA, 1501 bp, Oryza sativa
gaactctaaattttcaaattaagatgatgaaaaacaccaaatcaacatgaaaggaagttggataaaatatatattcaaacgatttctcacagtaaatttcacctaaagtaaaacgtataataataataagattaaaataaccttcacccgttgcaacgcacgggcatttttctagtacaaaaaataaatttatcttttcagtaatcatttcgtattagagttttgtaaaataattgatataaatatactatgagtagataaagagaaaaataattatatcttgatctaataatatatatgtattaaatgggttgtttgattgatgccattttcaaccacactatttttggtaaaattgcaaaaagatataccaaaaagatatacctatatttagtttgttaccgaactttagtaaatatataagaaatcctatcattttttataatattgctaatttagtactattgataaattttgataaggtttattttgattataatttgaacgcccctgtcttttgacacgaaggaaaaataaacttgagtatactaataaacatgacggcgcccgtcttcactgacgcaagcagtgacacacgaattcgccggccggtgagctgctgcactgggcatgggttagtgtttcagttgttttgctccctaccctcgcaccatttgtgagctcatcacatacggcaacaacacacaccatcaaacctaccgagcacctgtcaggctgtcaccacccgaccattcccgaactcacgctcaacttctaacaccgtgtttagatccaaattttttctttaaacttctaacttttttattacattaaaacttttctacacacataaggtatatttggttgggtatttcaacttaccacacctcaagttagcacataccaaaagtgtggcgaacgaaattcttaacatagctttggctcaaaaatatgtggcaaagcagcaagaagctacctaactttctttggcaggctaaactatagaagcaaaacaaacaaaggataagcagttgtagctgactaacatgaggtgcggcattctatgggatggatccaaacagcctcataaactttaaacttttccgtcacatcattctaattttaaccaaacttctaattttagcgtgaactaaacacaacataaggaggtcgagtttagttccaaattttttcttcaaactttcaaatttttcatcacatcaaaactttcctacacacaaacttgcgactttttcatcacatcgtttcaatttcaaccaaatttttaattttaacgtgaactaaacacatcataaacggattgagatccttcgctgtcactgtatcatgtcctaaatgagtcccaagtgataaaggcgcgatgcagtcgaatgctgaggaatccatccattgctacctataaaagcgaccaacccactgatcgccctccactaccaaagaacaacacacaactcggtctctagttgaaaagctatagcca

SEQ ID NO: 16655 - DNA, 1501 bp, Oryza sativa
agaggtgtggagatgagagaggagaaggacttttcacatatttggtgacttggcggtgggatccatgcggccgtggaggaggaggcgacggggagattcgaggggaagaaaggggacccatcccccacgctccttagcgacgacgccgtgctcgaaccataagagagatagaggaggaagggagagaagatgagaaacatatgggtgatgacgtgggtccaactataattttttatttttaaccggtcagttactgacatgtgagtcctatggtttcttttaacttgaagtgtcacgtcaacaccactcgtagatgccacgcagccgaaaccaccatccaaactactttagaaccttctttgcactgattttggaagtcgagggatacatcatattagtattgttatacagtaatgaatttaaaacttggcgacaaattaagggacataagtgaacttattacaatcccagaagctcggctgtgaacgggctgcgggccggccaaaccggccgctagtccagcgtgagtcggcccaataacacatgggcttcgctcgggtatctgagttacggcccaatagcacctcaacgccaaggttacggcccaattaagttgcgtaggactcctgtacaggaaccatgggctttcttaaactgtccctttattcataactgtcactaaaaatctaaaaaaaaaagacccccacttttactattttttccatcgaatgatccgcgcagattgcgcagttagtatcattatatttttctcatataatagcatatatatatacatatatatatatatacatatatatatatatattcccaatttattattaaaaatattaaaatgacaacataatttcaaattttgtactaaatttaccaaactaccaatgtgatagtcattaattatttttaatatcaaattttagttatttctaaattgtattcctatatggactctagacttgtttttcaatattcattattttttaatttcaaatcttcgttatttgtaaaatttatttctatatagactctaggcacttcttctaatattatttatttttaattttgaatttttattatttctaattgtatttctatgtggactctaaactcatctttcaatgttttttatttttttatttcgaattttagttccttctagattgtattcgtatatagactctaggctattcttcccatatttttttaattttgaattttagttatttgtaaattatatttttatatggaatctaaactctacttttaatttttattatttttattcctgattttagttaattctaaattcctatagggactctatatcttcttataatattcctttttttaattctaaatttctattatttattaattatatttctatatggactctacacttttcttctaatattatttatttttaattctgaatttcagttatttttcttaattgtgtttctatatggaccttatacttttt

SEQ ID NO: 16656 - DNA, 1439 bp, Oryza sativa
cgatcgatctctctcggcctctctccttcgccgccactgcctacggcaaatccccgcgccccgacgccgccgtatctcgccgtcgtctcgagctcgtcgtcctcgccgccgcctccgcctcctccgccgccgcgcatctctggggtgagagccgccgccgcctctcccttcatcgatctccaatctcgatctctctctccgtcgcgccgcccgccacgagacgccgcgccacgacgacgccgcgccacgccgacgccgcgccacgctgccgccggcacgccacgccgccgccttcgccgccgctcgcgcaacgccgccgccgccacgccatgccgccgccttcgccgccgcgcaacgccgccgacgcatgcaacgccacgccgccgccgccgtcggcacgccgtcgccacgccgccgcgccaagcgccggcccaatgccgccacaccgccgttaacgaacacgtgaacgagaacgaacacgtcaacgtacgtcgagaacgtgaacgagaacgagaacgatcgaacgaacgagagcgagaacgagaacgatcgaacgaattaacgtgaacgagaacgacaacgaacgtgaacgagaatgaacgtgaatgagaacgagcgaacgaatgtgaacgtgaaatgcaatatatatatatgttacttcgcatttatcctaatacatattttttgtatcttgcagaaaagacatgttgtcggagtcgtccctcaagccggagtggaagagctagccgtagaaggaattcgtgcaggcaagtgacataataatataaatgattgttatatttgtaatgcaattaagaatattagacttgtaattagacttagcatataagattgtgtagtgttctaatattatttgagttttaatataagattattttattgcaaattagacttagtatgtaattattgactacggaattggtgcgactcctagcaattgactattgtagtcttaattagacttagcatatacgcacgaaacacttagcatacatgactattttagtcttagcatgtaatattatttgagttttaatataagattattttatttgtaattagacttagtatataattattaactacggaattggtgcgactcctagcaattgacaattttagtcttaattagacttagcatatacgacagaacacttagcatatacatgactattttagtcttagcatgtaatattatttgagttttaatataagattattttatttgtaattagacttagtatataattatttactagctagggttgtataatatacgtcacctagacttagcttatatcacgattgtaattagacttagcacgtaaggttgtgtagggttctaatgtacgacatttacacttagcatacatgacttagattgttaaaacataaatgttcgtgacttagcagatatt

SEQ ID NO: 16657 - DNA, 1501 bp, Oryza sativa
tacggtaatttctaaatgtatataacgttaaaaagaagatataaagggagtatataatgtttgtttttctaataacattgatgggtaacaatcgatctcatcttttcgcttatatttatacttatcagctataatttaaagttttcattttaaattgggagttaattttagagttttttcatcgtagtttatttttcagtctttgttttaaatcgctaagaacatgtgtataaaaattttatttataaattattttacgtttgcaaatatattgatttggatttatttcttagaataaggcaaacggtggggctgaatattagtaccatcgacagagcatcatatcccttgcaacacacgcttccagcattcgaaaagcacgatcagcgtgataccttgcgtgagcgagtgtgaaggcagtttcaactttcaacaagtactgtactttcttcgatccagcgggggagagtttccgtttcccttcacggaaaacgcctcccgccccggaatttcgcagggtaaagcgggggtgaaccgccgcgaaagcgtccccggattctagattcttccatgtgggccccccgcgcgacccctaactttatactcctcgtcctccccccacgcggccgcgtccaggtcatcgtcgtcgcctcgcctcgcctcgccttcccccgcgtggcctcgccgtcggatcgagccacgccgccgccgccgccgcgtcgcggatccccacgctcgccgagaggaggaggaggtgatgccgcttcccgcttgcccccaccctctcctctcgtctcgcggttgcttgggtgcttgtatgctgggtttgtgcgattcggatttgggttcggggccggtggtcgattcggagggggcactggccgattcaggcgtagatttggtttgtttgtttatggcgatctgttgtttgctagttgttcatacgcgggttggttttcctagagaattgggattttttttaattgttctgcgattacggtagaaatagatcgggcttatggataatcccgtcttcttctagcgtgtgattttatcctccaacgtgggagatattcctagatgttttatttccttgtgttgtttatttatgcttagattgttgattccatccttgtggatcgtcagcatcttattctagatgatcctatataattgtgtgaaacaaaattgaggttgttgggagggtttctgatcatcagctgtcctctttaccggcacgaatttggggaatctttcttggttgtgttcttgttggcttataccttttttatgttttgctcaaactcatgagatttttatcgtttaatgctggatccttatgtatgaccacatgctagtagctggcggagcaacttcgtaattgttgctagtagccattatattacatagtactcctaatatattctatcagttttgcatagctatttctagcattgttggtgattgtagtttcattggcaattgcagcttcttgcacttt

SEQ ID NO: 16658 - DNA, 1501 bp, Oryza sativa
ataattccacatcaatcccagggtttgtgtccgatcgagactgcttggtcacacggacagacttgatcagaagcaagcctccaacaggcagcagcagcaaagtgcagccaagctgtgcaaaatcagagaaaaaaaaagcagattcggttagggcgccgaaaaggcgaaaaaggacaaaatacagctattacccgtgcaaatcccatactaattaacaaaacccagagggaccaacaagttgtgtgttcgctactcttggcagtatcaccaaccactaccgatcatatcccttccagctgcgctttacagagcgagagttgccggttagctagctagtggtggtggcgcattgctgtcaacgttcccaaatcgtgtgatttgttgttggtccactcgaactgctcaatcgtcgtgtgaaccaaccgtggaattaaaattaaccagtgaaaacatatcgcaagttgaaataaaaagacaaaaagagaacttattcactacaacttggtgaatatggtaaaatatcaaaaaaaaaaagaaagaaaaaaaaacacaatctgtgtgtcgctgtcagacgatgatccctcgaaattttacggttcgtatttgtgtggacctcgaaattttagtcgtcggttagaaggtcacattgggagcgagtgggcgcaaggacggataagaaaagagacgaaaaagaaaggtagaagttggcacagaagaggcgtggggcccgcgtgccagtgagccagacacagtcaggtcacgagccacatccaccacacccaactcgcctgcctaacccgtcgtcgtcgagccccccaccacccacccaacactccaccgccggcgagcatcgccgacgaggaggaaatctccaccagaaacccgaagcccgaactgtctgggataatagctagtagtaggtgagagaggaggaggaggaggacgtaccatccctccatgaaggaaggcccgctgctgtggtgctgctgctgctgcggcggcggtggctgcgcgtacggcggcgggtagccctgctgcggcgggtacccctgctgcggagggtatccctggggagggtacccctgcgccggcggtgggtagccggccggcgggtaccccggcggcgggtacgcgtccttccccgggtaccctgcaaaattcagatcgatcaaccaaccactacagttacaagaagatggggaggaggagtggaagggacggatctggataggaaaccttgcggcggcggcgcgcccaccggcggctgctgaccgtagtagctcatctctttctagtttagctggaggattacttttccccttctcttggcgttcgtcagtgagaggattggcggttatataggcacccaggtaggcagttggccacttggcctggacaagggagattggagtatcggagaggaggctgttgaattggaaaaaaaccaacaaaccgggtgggtcatgcactcatgctgctgcacatgcaggtggatggatgg

SEQ ID NO: 16659 - DNA, 1501 bp, Oryza sativa
gaacgagatagagaatattagaaagatacgcaaaacgaggtgagccattagcacatgattaattgagtattaattattttaaactttaaaaatagattaatatgattttttaagcaacttttctatagaatttttttttaaaaaaacacaccgtttagtagttcaggaaacgtgcgcgtggaaaacgaaacaaactcactcgctttgttctccaaacgaacgcaccctaagtctggacactgtgtatacattatttattgagtggaagtgaaggaatacctcagtggttaactataagtgcaccagatctgtttaacttttgagcttgacattaagaaacgattacatcactccgaaagtgtatgttgcattggaactctgaataatttgtttttggcaatctagaatcctctctgggatatttatatttggtcagtgaacatcggtgaagaggagtatgttcaagttgatcttggtacagactgattaagataggcattaagtttttgcctaatccggattagaaaaaagaagttgaccagaacaagatttggagagctaccctcatgtctgaatttcctgaatcctggacgtcccaattgattttactattattacatccatgcatgtatgtctagtctcttcctctcctgtttagtagtattaagagagaaaaatcttccatttttctcaattagcccatgctaattaacttgccctcctttttgtaaggtttcttggactatatatgaagaagcatcaaccatctcttaaaaaaaaatgaaccagggacagagaggagacgtgtgatcgattgggtatagtagctctggaaattaaggggagaaagggagacagatgcctagatatgagatggtgttgtgacttgtgaacaggtaggactcgcattgaatggcacggtgacacgatctctatctgttattctacctctctttgaagtcattgtcctgaaaggattgcatattgaatgcaaaaacacatcgaaaagtcagaaggacgaactaagtatgatatctccttactgatgctcgacggcatagctacttgcagaggagcaaatgcccaatttggttgcaccaaaccaaaaagacgatctagatgaagttcatctgtagctaccgattgaaaacgagacccaaatattaaagccattgatgcttctattacaagctgacatttacagcactagagctttcagccatcctattgatcacgatgttggacacgtcttgtgcaactgtgtacaatagcgatagagatagacgaagataaattaattaaacgatcatcttaatttgtactctttccattctaaaatataagagtattttttatccgattctaaatttttatattttaagatggagtgggtattaattaaatagataaattatttagaggacattaagctttgaattgaagctgctgcgcagatatataaatattgcgtcgtctcccatgtcgcctcgcgtctcactgc

SEQ ID NO: 16660 - DNA, 489 bp, Oryza sativa
gtacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttggattccctccatcttt

SEQ ID NO: 16661 - DNA, 1501 bp, Oryza sativa
tacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgaccctcgtgggcttatctccgccacttctcagtctggtgctccgcaatgaaccatgctatacaaaaggtaaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaaataattaattaaccaatcacgattggccatcgtgaactattattaagccatcattaaataatagtgagtcataagttatcccaatagtgtgctaatgtttctaagcatggctaagcaatcatatctaatatctagctgaaccaatatataaagctcaactagtcaagttataataacccaaggtatcaaggaatagagtaatcaatgcaaattggccataacaaaggaataagttcacaccacccggtgacattcgaaaataaatgcacagttgaaataaatagagaatttaaatataggatcaacatgctcaaaggaattgtgtttaggatctgtgtgacttgccttacaataatcggtcttcaattaatcttcttgaatacttccggcgcactcgcgaaccttcgaaacgacggaaacgacaagctaacacgcaaaacaaggaaaacactaagaaactccaaataaacaatacatataaagtaaacaaacatgtagatcatgattttagatgaattatgagacttgaacggcctcattctgacttcaaatgaatttattacgaattttacaagattaaatctaattaaagcccatttaaaaagaattaaataaatttaattctatttatggataattttaatatgtagatctttattttatataacttttgcaacttgaaccacattaaactgagttacaaagaattagttatgaattttcaaagattaaatcggattaaagcatttatatagattttaattgaattatgacgcaataatgaattatttttgaaaaggaaaagaggattattgcgtcatcaaaggcgatccacggtaaaccgggtgcacgggacggtctaaggaaacgaacggccgagatcgatcctatccacaacggacggccaagatcgactggtccacggccggaccacgggagacgacgacga

SEQ ID NO: 16662 - DNA, 660 bp, Oryza sativa
ccaggtagtagtcgtaactcgaccacttaaagtggaaatagtgggagaatcgctacaccgctggtcgaggaccaggtagtagtcgtaactcgaccacttaaagtggaaatagtgggagaatcgctacaccgctggtcgaggaccaggtagtagtcgtaactcgaccacttaaagtgaaaataatgggagaatcgctacaccgctagtcgaggaccaggtagtagtcgtaactcgaccacttaaagtggaaatagtgggagaattgctacaccattggtcgaggactaggtagtagtcataactcgaccactagaagtaattgtacgagagatcgctacgattgactggttgagaactagtgagtaggtgtctctcgaccatttggagtcgtggtacgaggaccgctatgctgtctgtcgaagatcagtcatagctgttcctcaaccatctgaagtcatctgaactcgtggtgcgaggaccgctacgctattgccgtagtcatacctcgaccatcagaagttaaggcgcgagagatcgctacgtcctactggttcgagaaccaggagtaggagcctctcaatcacctataggggtgctaaagttggtttgttacatgtgcacctcatgtggccagcatgactcacatacccaacttatagc

SEQ ID NO: 16663 - DNA, 1501 bp, Oryza sativa
ggaagtggctccaacagcataaaaatcatcatgcaatatcccatcccacacaagttaagaatttagagtctagccaagtgtaatacacgtcccggtgctcaataaccgcgagcacggctattcgaatagatttggtttactcacactgcagtggatgtacactttacccgcactctgcgactgcccaacacatgagcctcatcccaacacatgagacgcgtcacgacaaagcttttcgataacctcgcattggcagtatccgctccatgaactttacatcctcatgcactctaggcatacacggtttctagcagtgagaggagttctagcgcacccgggaagggaagactcacacatgcattaagttataattatgtttagattctcacatggcagtcctaccgatggcgacaccactgtagacacccgcctcgtggtcctaccaatggctgccccaccgtagagcccctgcctcacacatcaagaaaccactatgcatggatactgcctccgctcagctatctactccgctaggtctatacccatacgagaagtgcggttgtacggggttcgtttcatgcttaacttcatgactcggtccttaattgaccggggacggtactagccttttccagataccacccaaatcctccgtccgccccagtcaaaaacagttgtttagtttcatttctcctttcacaaatcatgtcatcaatatcatggcaatgtggtgctcatgtctccacatgccgtatctcaattatcttcccaaaggtaattgcccaagcatatagcatttgataaatatgagtatgcatgattctagaatagcatttctaagcaattgtcataattgactagggacttatacgtaatcatggttacaaggatcttaagggtaaacaataatcaaggcatggcataatcacaagtaggatgttcatcattgcatgcaattttatttgtaaacaaaacaatttcgcaattgggatcaacatgttcaaggaatagtgatgacttgcctgctcagaatagtccttattcttgatacaatcttgatcaaccttcacctcctggaagttgcagacgttgcctcacgactgaccgatacacaatttctataatacgcgagaaaaaccaatattcaagcaacaatcaaatatgcacaaacaaaatatatttgttgaggtcgaacctagggttgctcatattattcgcgcttgctaatggattctaatcaaggtaagagctaaagtttcttagtctttctgttgtcatggtggtttagtctagctaatggctatggaaggattatggttacacatgcatctatctaaataaaatggtcatatcctagagattatgttgtcagatggatttaggatcaatcaaataattacagtgaatcatttgtattattattttattgatggaagctttactttgattatcaacatattttacttgtcacaataaattagaaaaggttaataattatccg

SEQ ID NO: 16664 - DNA, 1501 bp, Oryza sativa
ccttgtgccttgtattctctttctgagctctgccgtgtggcaactgtcaaaattgagtagcagagagtatctctggtagtgcaatgcatatcagcgtatgtcgcatgcagatctttgcacttactactacacagtctgagcttagaacatgtgtaacaatctatcatcttgctgtgttaattgctgatttacagtcagggccggcctgggcagtgcggacggtgcaaccgtattaggtctccaaaaattagaggcctccaaaatatatgtactatggtatcaggcctgataggcttagaggaaagacagaaaaccaatcgacgatcgagcatatcgtgattgcctgattgtattttaagcttattagcgtgaaattcgttaatgacaatgagtttttaaatattatcttatatttttatggtgaatgggggcctacattttttttcgcaccgggccaccaaaaagtcagggccggccctgtttacagtaatatctcccttaaaggaaactgcttgcgccaaaattcaaagcattccgtttttctggactagaagggatcaatattttgaccagagaaatgagccaatgtaagatgccctccgatcaagattgaaatatccacttgtacatatacaacttgttttgtggggaggggtgtacatatacaacttagtactccttcggaagctgtaacgcaggagtttttgcaggaaattcacatgaattagtttaattttttaaaaataaatttctctgtaaaattctttcgttccataagagaggctttgaacttgaaagaaaccagagctgctttcaattatgaacgcattttgaagaatggatgaaacaaacacatgagaaataggaaaacatattcatttaagcacaacatagcacgttttatactatatatgaaagttgacagaatgacaggctttatcagccacacatatacatatgatacatacacatcaaactttgtatttcatagcatacatatcacacactctttatttcataataaatctcccaaaccactacaaaccaaataccacaactccacatgcatatatgcatgacacagcaaaatatatgttacacaaatattattatacatcaattaaatgcacaatccaaggctccatgcatgcctccacatctccatgacacaagtcagagctcatgtatatatgctacatatgtcactatatatatttatatgtatatagcatagccaggtgataaactatacttattaattatgcaggtaatatgtaatttgatagcttaattaattaatccatgcatgcatgcagagatcagatgcagtaggtgattattaattaattagtgatcatacataattgaggtgatttatgatgggcactggaagctggaggggacgtgcttgccgcactcgttgacgagcacggagatggcaacggggaggacgaggctgacgccgagcgccttggccttgatggcggtgcagaggcagagc

SEQ ID NO: 16665 - DNA, 1501 bp, Oryza sativa
ttagttttaaattcctatatggactctatactctacttctaatattttttatttttaattctggatttatgttatttcttaattgtatttctatatggactctataatctacttctaatattccttatttttaattctgaatttttgttatttcttaattgtatttctatatggactctatactcttcttataatattatttttttaattcagaattttggttatttataatttatatttctatatggactctagtctcctcttccaatattcttatttttttaatttcgaatttgaactatttctaaattgtatttctatatggactctgtttttctttttcttcgattaatatgagaatttctaagccgtgagagtgaacgtggaggctcctttttctattcttttaataagttaatagatttctgatatcaaatggaaattgtatagaggattttggagtagatttttcatgatgttaatggcatgtttgtgagagtttttgggcagatgtagcttctccttgaattcaaaattctcttaaataattcagttttttaatccagattttaagaagttgtaattgtcgaatcaaagaaataaattagaagccagaggctaaaaaaaaccatattctcaccggctaaattttcactagttgtttcttataatctaaaactctctaaaacagactaatctcattgttttttcctttatctagtgtgtatgcctagcctcaaagtaggcaagctgagttagccaagaggcttagggataagagaatgtcagtgaataagagattagagaaatcatgtccctaattactgcgttttccattttgctgttttttagcctcgtgttttaccgtgttattctgtagatggagcatgttctactatcagattttggttgaagcatgttaaagctacaggttttgcgattctagaattggacccttggtttgcttttgacaggttacacgagagaaaaaaaaaagaatatcctctctatgcgaattcccgcaactgtaggggctgatctgcaaatcggggaaaagagaaccctatctgcaatcgcctctttgcctccccgtctcggcggaagcgcccatcgattcctctctccggcgaacacgcgggtgggcgggtcgggtctcctctcgccgaagcgccacctcggctcggtgtgaaggtatccttctctcgcaatcctcctcgatactgatcaggcttagtgtggggatccatccggacttggattggttttagtggttgggtgatggattccaacttgattggattgttttgatgttgttcttgtttttttattctctgggcgcaaatctaacccaaatgtttcgctctctgcgatccagtgatccgattcgctcacatgtctgtccaggtaattcggtgattcggcaagggctgtatttatgcagaatggttctctgtcaaggcttatctgctggacacgctcagctgcttgcctttcctgcggc

SEQ ID NO: 16666 - DNA, 1501 bp, Oryza sativa
cactctagggttgggaaaacggcaaccttctagaactcacactagctagaaaacaagatgcccaaagagatcgcaccagtaatttttgtggcttccaagcgcaaaactaggacggtgcacgatgccctagcatccaaaacatgggtccgagacatcaacctccccttcggattaaggcagcggatcatctacgacaatacgtccatttgtggactatgatacaacgtgtgggtcccatgagtgagcaaagggacaccatttacctaaaagctgatggctaatgcagtctgctcggccaaatctgcgtatagactacaattcgttggagcgaccgaaacgatctacaactagactatctcaaaatgttaggcctcgcctaagtgcaagttcttatcaattatatactaaaagtccattaaactttctagaaacgctcttaagccgccacgtgacgttcttacaaatacaattagaccgccacatggcactatttaatcttaccgttaatttccatttaaattagtggacctaatattctagaccgttatattagatatattattttgagaaggtaataatttcctctcataatggggccgagaaaagaaaccaaacataagtatacttcgtatacttcgtgtacggacttacgtgctggaaaagaatcaactaagcttaaaaaaaacctaagtacgaactgacgataaaatcaataaagtaaaaaacaattacgtaacatcaacgaagcttaattaaaagaaaacctacgtacgaactgacgataaaatcaataaagtaaaaaacaattacgtaacatagttagtacgtagtgccataaaaaaaatcgatggtccataatatacgattttctactatttaaaaataaaaatataatactctataaacttacgcaaatatacatagttaaactagatcttctataatataaaaaaatatcctatctttaaattattttaaaattatatatctaatttgtgatccagtcggattcctttaattaaataaactattgatgtctatcttcctaaatacatcataacacatgaggctgacatataataaataatattatgataatatttttaaggaaaaatgacgaattacccttaaactgttatggtcgaccgaattacccccataaacctaaaagctagacatttttcacactcaactattaatatcggatgaaatacctcgctgacacagcttggagtggtggcagtccagtcagtattttcttaaaaagaaattgatgggacccacctatcgtatctctccctcacccatcccctccctctttcttctccctccatatctatcaataggcaaggctagaggcagtgagcaggtcctcctcagtctccgccgacgcgcacctccttgatggccgtgtggcttctcctcaacatccactggcccgtgaagaggacaacagcggtggaggcgactaagggcggtgagcagcagaggcggctcctcc

SEQ ID NO: 16667 - DNA, 1501 bp, Oryza sativa
acgagatactacactcgatcgataagatgaggcggaagttcttctgggcaagaagagacgacacatcgtggggatgtgcaaagcaaatagggataaagcctgcagagtgcagacctaagaacctgggtggccttggtgtgcttaacctagaccagttcgccagagcactgagaataagatggctgtggtacaaatggactaaaccggataaaccttggaacagcactgcgatcccctgtggtcaattggacagaaacctcttcatggcgcgacgataatcactctagggttgggaaaacggcaaccttctagaactcacactagctagaaaacaagatgcccaaagagatcgcaccagtaatttttgtggcttccaagcgcaaaactaggacggtgcacgatgccctagcatccaaaacatgggtccgagacatcaacctccccttcggattaaggcagcggatcatctacgacaatacgtccatttgtggactatgatacaacgtgtgggtcccatgagtgagcaaagggacaccatttacctaaaagctgatggctaatgcagtctgctcggccaaatctgcgtatagactacaattcgttggagcgaccgaaacgatctacaactagactatctcaaaatgttaggcctcgcctaagtgcaagttcttatcaattatatactaaaagtccattaaactttctagaaacgctcttaagccgccacgtgacgttcttacaaatacaattagaccgccacatggcactatttaatcttaccgttaatttccatttaaattagtggacctaatattctagaccgttatattagatatattattttgagaaggtaataatttcctctcataatggggccgagaaaagaaaccaaacataagtatacttcgtatacttcgtgtacggacttacgtgctggaaaagaatcaactaagcttaaaaaaaacctaagtacgaactgacgataaaatcaataaagtaaaaaacaattacgtaacatcaacgaagcttaattaaaagaaaacctacgtacgaactgacgataaaatcaataaagtaaaaaacaattacgtaacatagttagtacgtagtgccataaaaaaaatcgatggtccataatatacgattttctactatttaaaaataaaaatataatactctataaacttacgcaaatatacatagttaaactagatcttctataatataaaaaaatatcctatctttaaattattttaaaattatatatctaatttgtgatccagtcggattcctttaattaaataaactattgatgtctatcttcctaaatacatcataacacatgaggctgacatataataaataatattatgataatatttttaaggaaaaatgacgaattacccttaaactgttatggtcgaccgaattacccccataaacctaaaagctagacatttttcacactcaactattaatatcggatgaaatacctcgctga

SEQ ID NO: 16668 - DNA, 1139 bp, Oryza sativa
aatattttgaatagaacccacattactacgatataaattaaagcatattcaggtttactgacaataactgcttaggctgcgttcgaacctcaaggttcccaacctctctccctcgttttctgcgcgcacgcttttcaatatgctaaacggtgcgtgttttgcaaaaagtttctttacgaaagttgcttaaaaaatcaaattaaaccatttttgaaaaaaaaaaagctaatacttaattaatcacgcgctaatggacagctccgttttccgtgcggaggggatgggttcccaacccatcctatcgaacgcagccttattatagatcgtaacatttttttcttctcatgcatgttcatatgcattaatgaccaccacactgaatgaaactttcccggataattccatctgtgttctccagagtcatgataattgtagagattaacacatatcaccaagctaaagagtacaaaatccattttctagagcagagaagtacttgaactcatatgagccacttagaccatcacctggcagcaaagtttgaggaacaccaacccacatttacatagctcaggaggaccaattcaaaactactcgtccatgtggacttacgacggctctcaattagacatatccacctagtccgtgattcagtatgcacaatagggtttatttatcagggaatcgaacggatatctcattagtcaaaaccagggggcggatgatccaacttgggacatgggggggttcagttgaacccccaaactttttgaggggggaacaaacaaactgttacttgcagtagtagtagtattaaggttaaggctctgaaattaagaggagagcttcttccagatctagaagagaaagctagggttaacgaacgaaccgaacgcaagcaaattccaagacaaaagtagtcccggtgggagcgagatgaatcagaaagaaagaggatgtggatggatgctcaccaggatcccctccgctgctctgctctgctcggcaaatggagatcgccgcccctctctccctgttcagccccgcgacgcgtcttggcgcaaaggagcgaagcggaggagacgaacgagacgggagagatttccaccctcttatctcaaattctcaatatttttagt

SEQ ID NO: 16669 - DNA, 1501 bp, Oryza sativa
tcgctacactgctagtcgagaaccaggtagtagtcgtcactcgaccacttaaagtggaaatagtgggagaatcgctacaccgctggtggagaaccaggtagtagtcgtaactcgaccacttaaagtggaaatagtgggagaatcgctacactaccggtcgaggaccaggtagtagtcgtaattcgaccacttaaagtggaaatagtgggagaatcgctacactgctggtcgagaaccaggtagtagtcgtaactcgaccactagaagtaaggcgagagaaatcactacgttctactggtttgagaaccaggagtaggagtctcttaatcacctataggggtgctaaagttggtttgttacatgtgcatctcatgtggcgagcatgactcacatacctaacttatagcatatctggatgtcagctcgtaatcatgtcgggtgatcaagccgacaacgttcacgagaatttatagcccagccatggtcggcgctatgagataggtcgtcggtcttcgttggtaggttgggtgcgacaattccgcatttgtcgagaatgttctcgataatggggtgtattcgaccacaacctactcgagtgctcaattgttcctaaaaaatattttctagaaggcaagatatatagcagagaatatcgagtatgtactcagaaaactgcatgaatcttctaatattatcaggatataacgagcagattaaatatcagggattatgtaggccgtaaacaagcatgatttatacagaagaaaatagagcgagcccccagtattagaccgtagtcagcctaatatcggaaacactcgcacaataaatattgtataaaaacacgctctaggtaaacataataaattattgatctgacaatattgtatagatcggaaaagtaggtacgataaattatatatttatatgccggatatatctacgaaattagtagattaatttacgaaatcaatctactaaataccttactgtgcatgcttggtgaggaacagcaactccttgatatgcttctgcgtgcatggtactgtcccccgtctaagcaccttgtattttggttctttaattgatccgtttgccacgtcatcggaacaaacaaccagggtgctgcctagagattggatcctagtgcaaacgtgagaatttacaccaatgatcgaacagatccacgccggattggatctagctccccggtgctcgttttgctggtggagattgatgtcgagttctcgactcagccagccgattcctcgcacaggtcgatgccgcacacgtggaggaatcggtattgcattgctcttggatgctgccgacacagtagctctcctcgacgacgatggttccgattccgtcgggggacgtactccagtcgggttagatctccccacagtcaaagtcgtcgagtagcttgttgttgaagaatccatcttttaaacccatctcgtcgaaaccttgaagcaccaaaagatcccctacctggcgc

SEQ ID NO: 16670 - DNA, 1501 bp, Oryza sativa
ttgttgcaagataatatatatgttcgtgtttgtcttatggttattttaaagtaaatttcataaaactacaagtattttgatcaaattatcgtacagttacagatttaagacaacatattataaaactacacatttaaggtcaaatatcataaaactatagatttaatactagagttatcacaaaattatagattttgtagtttaaatccttaccactaatgttataaatgttgtaattttgcatttaacatggtataaaacatttagttttatgataattttaaaactaaatctatagtgtggtgattgcccatcttaaatttgtagttttttgataaaatttgtcctaaatctgtagtgttgggatacaccttcttaaatctgtagttttgtgataattttatcaaaatatatgtagttttgtgaaatttacttttttttgcgcgcacatcctgataggcgcaaaggcagggtgtaattttattttctaaattaaatgaaattattcctgttatctagcaattaaagcagataacaattaaagtgtaaggtcatcatcatttgcccatatttattaataagccaaaagatttattaggtaataaaaattaatttgtaagtaaaaattttatatatgtgttcttagtgacttaaaagtctatactgaaaaagaaactacgttgaaaatatcttaaaatcaacttcaaaattaaatttaaatttaaattccagtttttgctttcacttattagggcaaccaatgagctctaaaacatacatagaaaggatgcagacgagcctagcacaaaagtaacaatcattttttcgcgaggacgaaagtaacaatcattgatgcctctctaattgattgtatagcaaatgtaagcacaatattgaacaagtcagaattaaataatataattaacaatctaattgtaatacattaataatttattatagtaggcttagcgtttgtaaattcaactctaggcgccacttatgcgaccattaaggtaggagctggtagtcgtcgcaattaggcattggttgatgcattaggcaacttaactatcttagtggtgttttaatttattgctatttattattatggtctattttttatgtaatatgattgctaatttcttttatttgattagttggtatgatatatatgcccactaggcgcaacccagaagtctggctagcaccttgcgctttcttaaccaaagagtaggctagagatatgatttgcaactatattttgaagtcagactagaggacattcctcgatcaagtcatggaaaaggcatttccccttcataaaaagaataattgaaaagcttctttcagcggcttttcgaaagcaaattttatttatttatttttccatgtaatatattttaacatttcttatttataatagattttaaagggtataattatttttcaatgatagataatgtacttgttgacatgacagcgatacactgtgacctcagtc

SEQ ID NO: 16671 - DNA, 1501 bp, Oryza sativa
acagtagattaattatctaaaggctaaaaacaattgatgtgatatgacttaattagaggaaaaaaggagaagataatttggaccatagattaatcatttaagcactaagtgaggatgaactatatacctatatcataaaacataataaatatatacattgaaacattatgtgaattatgttggatgataatttaacatttttgtatttgaaaagctcttaaattataaaaactataaagatatagcatatttgcatgatgtttaaatgtgatgattgttagtggatgatgatgtggcatcttgttaattagtagatgatgatgtggcatctttgcatgttaaggttatggagttagtgggggataactttatagtaagataggattcccttcaagcctgtacgatgatactccttgaagatttttggctgtgttcggtagtttgggatgaaaactaatccctctcatatataaaacgatgtgactcattagtacataattaactaagtattagtattttaataatttttccatagatttttttttgaaaaaacacaatctatactctctataaagttacaacccactaactctaatgcttaatatgcaaccatgccacattatcacccactagcaataattacatactcaatctcattcaagcatgcaacatcatctacaatctatttaattctacaaatcattatgtatagtataaatccaatcatcacccctcacatcatttccacaatatttttacaaacctatcaatcattcttatgatatttaacataaacttatcaattaaagtgtgagttttatttgtttgtttcatgataaaaactgataagccttggtatttcatttattttttttacccctagcttgattgtagtgaaaatatatatattaaaaattaattttcacatcaaagcgctgaaaatcaactgtctttagcaaattgagaaccgtgcgtggggtagaggaggggagaagctgagaaacggtatcgtaggtaccgcctacgtagccgtgttcggccagatatttcacaagcctacaacatctatagcccacgaagtatttttcaggacccaaaatgcggcccaccaaacttagccggcccacgcagttaaagcccaatcacccaatggaaacggttcaacttgcgcgaccgatttcaggcaccgcgagtggaccacggcggaaggaggagccgcacaagcgacgagattttcgcccccgcttcggattaaaaccctagccggctaaacctgctccgctcccccccgccgccgccggcgccgccgccaccaccactgccggagagagagagagctgcctgggaggagcagcctcggtgcgcgcgcgcgcgctaatcccctcctccactctccgtcgccgccgccgccgcagccatgatctgcgcaagtaagcttctctcactgtctctccgaaaccctagctgttctctccgtgcgtgcgctgatttgtggcctccg

SEQ ID NO: 16672 - DNA, 1501 bp, Oryza sativa
atctcagcacgagcaagtttgccctccctgcaataccctccaatcattacagtgtacgtgtggacatttggcttgtacgagctactcttgatgagcttcaagaaaagccggaacgcccgctctgtccacccaatcttgcagagaccatcaatcaacgttgtgtgcgtgtacacattaggcttcaaccctcttccaaccatctcctccagcacatggaaggcttgcttcacgtagcgtctcttgcacagcccatcaatccatgcagtgtaattcaccacgttcggtggcgtgcccgtctccaacatcctcctgaagaactcagacacatccttgaaccgtcccttctcacagagcgaccgcacgaccaccgtgcacgtcgcgttatccagcgagaacccataacgccacattgccgccagcaaggcatcaacctcctccacctttccctcccggcagcacaccacgaccagcgcccggaagctgcgctcatcggggcacacaccggccctcgtcattccgtcgaacaccttgcgcgcgtacacgaagctcccggtctccagcccgaccctgagcacccagttcgccgtctcgacgcagagcgggagcccgtggctgcgcatctcgaggaccatgtcggcggcctcggggagcctcccggcctcgccgaaggcggccaccatcccccgcatgacctcgtgcgccatcgggaggctccccctcgcgacgaaggcggtggccgcggtgacgtagagccgcatgaggcggcgcaggtccgggcgcgacgcgaggcggcggaacagcgccagcgccgccgcggagcccgcggagtccgccacggtggggagggacgcgatggcgtcgtcgggggcgagcgcgccggggtcgccgggcgcggcaccatcgagggtagcatccggaggcggaggcggagacggggtggagatagcggcggtggagagtggtgggaggttggggagaaggcggcggcggcggcggaggaggaggccatggcaacggcgagcaagcatctctctctccacgcagaatgctgctttcccgttattttcttatttagatatagattgattttgttagtaataaactgttaaacggtagtagtagtatactttttacaaaacgatatagattttttatcaaataaatctataacaattaaaacttaattaatccgcgagctttttattatgataaaactttatatactccctcaggttataagatgttttgactttaattaaaatcaaattattataagtttaattaatttaaaaaaaataatatttacaataccagcatagtttcattaaatatataattaaataaatttttataatatatttgtcttgggttaaaaatattactattttttctataaaattagtttgactttgaccaaactcaaaacgtcgtgaaacagatggagtatatatatctatatatatttaaaagtatataaaataaatatatttttataaattta

SEQ ID NO: 16673 - DNA, 861 bp, Oryza sativa
gtagtattttgttgattgttgtgtacccctccgtcccaaaaaataagtccaatcctaactacgaacctagacatgcatgtatacaggttcgtagctagagtttgccttttttttgggacagactagtacatgtttaatagtgagaaatagttagtttacgagaatacctatagtaactggcacaaaaattatgttgtggcaaccaaataatttacttgttgataaacttgttgtttacacattcattggtgcactctcaatttatgagatgagtgatagtgttagatccatgactcactgtgccattctggcccttggagtatttatgttcctaaatattgaaaattgtttgtagttatttttgttatgaattgccacccttattttatttgaaatgacgtttgactagattctatatcatggattgaatcattcacaaaaaatgattttcttagctcatctattgttccaccatcttcaatagatcttcagttaatattatatcattttgcttgtgagagagtaagtggtatccacacaaaagatctagtatatatcaattgatagtgtaactctattttgaagatctatgaatggtgtaccaatatgtgatttacgattatgatcatgctttttgtttgtatattttctcccgtttctatgttgcttgatactagtcaatagtgctcttgttcttcactagatttggaacaaattaataattttgtgcattgtttagttttacatctaaatcatttgtgttttcaatctgaatatagtttatctttctaatgtgtttattggaattgaataaaatattatgtaattatttaaaaaaacattctactcttatttgtttga

SEQ ID NO: 16674 - DNA, 1501 bp, Oryza sativa
aatacacaagaagagaacatgaacaagaaaatggtcagaatttcgtggccacaagcaactaaagcttgcacgcaatcaagtgacaaactcactgaccatgtacacaccaatgctggccatggccagttgcctagttgctagctgggatatgcctcgaattaccatcggtttttgcctcttcttactgaaaccagagaactgcaaagttaagttcatcaagaaagtaaatactaataaaaggggcacatgattgcaacacttgccaaccacaaaatcaaagtcaggttgctactagcatcacaacctatgagcgacgacaagaatcaaaccgatatattccttgaccgagaacagctagtagccatcgacgactctatttgcattggttatttacaaattaaaattcagtgtgtatcccctgttatgtttatccacgatgacagtggatcataaactgaaataaacacagtgcgatctggcagaggaacacgcgtaattcttagccagtgtggcaaacgagtgcacgtaggatatatcgcttgttagatagaaagaccgcgtacgcacacgcctagctaacaccggctgtgacgtttgatcggagtccagctcgtgcaaaccggagtaccggacgccagacaaagccaaaaatgcatgatcagtttaattagtacgttaatttagtagtatcatgcacatgtatgtgtggttatgtacgacagagttaaactatatttgatcgaaatcatgcatatataagagtatatgtcctgcacagtgcatgcatgcacgcagttctgtgacaaaatcttatttgggcttatatacttcgttctcaagtaactaacagtaattattttcatcttagactacttaatataagtttttcctatatacacgttttaacaatatagcataatttctagcatttgcaaatattttgctgaacgatcaaaatgtgaaaatggaagtgtccaatatcaggtttttaagtaaatttcttagaggcatgtaaatgtatatagccatataagttactccctccatccctaaatatttgacgccattgacttttttaaacatgtttaactgttcgtcttattaaaaaaaattaagtaattattaattcttttcatatcatttgattcattgttaaatatacttttatgtatatatatagttttacatatttcacaaaagtttttgaatatatttaaaaaactcaacagcgtcaaatatttaagaacggagggagtaataagttatagtagttcaagttatataaggtatttcctccgtttcacaatgtaagactttctaacattgtccactttcatatagatgctaatgaatatctatataataatgtctagattcattagtatctatatgaatatagacaatgctagaaaatcttatatcgtgaaacggaggtagtatatctaaaaaaaaattataggaatacaaggccacgtcgatcagcatcgaccacatcgaaacg

SEQ ID NO: 16675 - DNA, 1501 bp, Oryza sativa
cccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccataagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgcttcgcaatgaatcatgttatacaaaaggtaaagccgttgcctacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataataatgagtcataagttatcccaatagtgtgctaatgtttctaagcatggctaagcaatcatacctaatatctagctgaaccaatatataaagcttaactagtcaaattataataacccaagatatcaaagaataaagtaatcaatgcaaattggccataacaaaggaatagattcacaccacccaatgacattcgaaaataaatacacggttgaaataaatagagaatttaaatataggatcaacatgctcaaaggattgtgtttaggatctgtgtgacttgccttgcaataatcggtcttcaattaatcctcttgaatacttccggcgcactggcgaaccttcgcaacgacggaaacgacaagctaacacgcaaaacgaagaaaaagactaataaaaaccaaataaacaatacatataaagtaaacaaacatgtagatcataattttagatgaattatgagacttgaacggcctcattctgacttcatatgaatttattatgaattttacaagattaaatctaattaaagcccatttaaaaagaattaaataaatttaattctatttatggataattttattatgtagatctttattttacacaacttttgcaacttgaaccacattaaactgagttacaaagaattagttatgaattttcaaagattaaatcggattaaagcacttatatagattttaattgaattatgacgcaataatgaattatttttgaaaaggaaaagaggattattgcgtcagcgggctcgagttcacggtggaccgggtgcacagcagcggttcacgggaacggacggccgagatcgatcctatccaaaacgaacggccgagatcaaccgatccacgaccgggccacggcggacggtcccga

SEQ ID NO: 16676 - DNA, 1501 bp, Oryza sativa
aaaataaataagggggacatagcctagtggtacttagcttcttctactgtattgacaactccagttcgagaactagcaaatgcataattttttcatttcttctctagtggcaattcctaaaaactttttcctctccttgaacgggaaaaaaaattctgttgccccagaaattttttaattttttgaacttttttatttttaaattttaaaaataaaccattcaaaaacttattttcagaatatccggatttcatccggtctgtccggaccgggtcgacaacgaaaaaacacgtgtttttgttgtgctatgataaattaactaactactattttaagacaaaaaaatattttacgtacagatttcatacggtctgtccggatcgtgtcgacaattaaaaaacacgtggttttttgttgtcctaaaaaattaaatcactgttatttaattatatatatttttcatgtggtctgtccggaacgggtcggcaatgaaataacacgtgattttttggtcgtgctaacattttttaaataactatattttaagaccaaaaatatattgcatctcttttccatgcggtctgtccggaccgggtcgacaatgaaataacacatgatttttttgtcgtgctaacatttttaattaactatattttaagacctaaaatatattatgccactttttcatgcagtctatccggaccaggtcgacaatggaaaaacacgtgtcttttcggttgttctaatataaactaaataactactattttaagacaaaaatatgttatgtccgaatttcatcccgtttgttcggaccgggtcaacaatgaaaaaacacgtgttttttttgtcgttctatgataaattaactaactactattttaacacaaattttacgtccagtcttttcggtcgtgcttagataaattaaataagtactattttaagaccaaaatatgttacgtccaaatttcatccagtctgtccagaccgggccgacaacgaaaaaacacttgttttttggttgtgctaaaaaaaattaaattactgttatttaattatatataatttttcatgcggtctgtccggtcaagatcgacaatgaaataacacgtgatttttttatcgtgctaatataatttaaataactagtttgacggacaaatcaaccccaaatcgatctgaatttagcaatttgtgcctctccgaaaattattttcttctccctccactctttccctcctttttttttgctcccgcaatttttttctcagttttcttttttttgccgccaacttttttttttgcccccaccttccccatcgagaaaaacaagccaactgcccctaaaaatctctttcctctatcctgactctctgagtaaatctctttcctgttgtgggattcctttctcctatgaactctcccgtcgttctacggttctcctcctcgtcttcatcggtgttgatctgtaggtaagatgccgggcgctttactgacc

SEQ ID NO: 16677 - DNA, 1501 bp, Oryza sativa
cggttgctcgcggcctatcccgccgcgccttgccctccccggctacaagagccaccatatcacaatcaatgcgtagtcgccttcgccttgcagtttggaggggtcgcacgggctcgtgtgtagcaaacgatgcgcccatcttttagccacccccaggctaccgatcgagcaagagggtagtgaaagcaagtttaataatagtatagtcaactactagctccaattcatctatagctaatctaataactcattcatactatagttacatactacactattaatatatggtctcatctgtcatacacactgcgctttaaagtccgtgctatagctggctacaaatttgtagcccgctgcttttatctcttctcacttatctctttaaaatatgtctgcagctggcttatagcctgctattgtacctgctctgagggtgaggccatcatgggatgggaggacacatagggcatgatggagatgggagcacgccggccggatggatgttgaccccgagcatgcatatggttggatggagcgaccgtcacagtggagtttgaaggccagccagccagctcccagctgctcgctaagtcgctagtgtgtgtgcattctgatgtggctgaaatgtttcacatggttcatcgatggacggatgctccgtgatatcaagtccatggaccaagtaaaaacataatggttggctacagtcgggtatagctcctgtttggggatcttctacttctggtagatgcaacaactcaaaatctcaggctctcccaaacaattcagatcataactcttgattctccaactcaatagttattacaggaactatggcttgttcgatttggaggaaaaccaaaggatttgaattcataaggattaatctctatgtgtagaaaaccaaagaaaatcctcccctttgtcccttgaaaaaaaaggagaaaatatccccttccaacaagttgtaaaagagagaacaaaattttccatccattcaaatctcttggaaaattcctatggattaaagtgtacatgcatttctattcctccatttatcatgttcctatgagttaaaattccaccaaaccgaataagcccttagaaaataaactagtacccagaattctaaattctcatctagttgtatatttattaactacttaaaatctctagcttccaaaacaaagctagtctgtctacacgagaagagtgttttagcactaacatgggcacttgacaccaagaagaataagctatggaaaactaatggtcaaggtggtgacctgacccaaaaaaaagaaatgcacgttcaccctcaacaactttaatcacaattcacagaagacacgggtttctatcgacaacggttactgttgtgttgatgggcctatacttctggactacacaacatggggccttcacagaataaatgaattacatgtaggggaggggagtatctgagtaaatcgccttgggtccatttgcacgaggcccatta

SEQ ID NO: 16678 - DNA, 1501 bp, Oryza sativa
gacaggtgcagcagcagccagtggaggggaaggagatggcagggatggtgtaggagatcggcgacgagcagggtgatcgcgatcgatctcttgcgcagttgtgtgcggcgctcttgggaaaaaaaaccagaaatttccgttcagaatggcccacttttattttttttattgtactgaaaaattacccttgcgttgcaatggaaaaaaaactaatgttatgataatgattatatttattttatagtttcatgggagttataagagatagttataaaaataaacaatgccccttctctcccaccgtaagtgatagcagctgccatttcctcatcacggaccgtgaaataatatgatatggttagatttaatttttaattaaattaaccatgattaataaatctcttttaatttttttttgaaattttgggagctttattgctaattttcataataaaaacatcatttcagcatttatttaaataaaaatctaaataacagttagtgatgctctaaaatgaaagcacagtttaaattctatagtctgctacatccttcgtttcatattatatgtcactagcaaatatgcccgtgagttgcaatgggtgaactaaaaattaaagatttgcactggttttaggagtttgaggggacaaattaagggagctaaagcgaaattattctgtgcggagcgtacacatggcctatggggtggcccaatagtgcggccggcctgggaacaattcagaggcaacttaaaggacctaaagtgaacttatttcacgcggagcgtacatgtggcccaatagtgtgggcaacctaggagtggcacccggcccaacgcgggagaagccgtagttgtccgatctgatggacggtcctgattgatcccgatctatataaaaactcagcagcccaaaccctaactctaaaatcatttttcctcccccctatctctctcaaagccaccactccccttcccttcctcaccggcgtcgccgctcccccccgcgcgcgcgccctcaccggcggcgccgctccatatccccctcttcctcctgtctcgccggcgcggccacggggaggcggcgacggggagggcaccctactggttcccctcgaccactccctccccctttctccaccggcggcgctctccctcccggcgtggaggcggtgatacattctagtataatgaatttggatagatgtgtcacattcacctaaaatctcttatgctatgtaacgaagggagtattgcaactttgcaagtttgtaaatgtgccaaaaccggtgtgttgaatgaaacatatgttaacgtgctaaaatgatgttaacagtttaataatcggtgaattgatttttgcgtagttagtagtagtacatgctaaataatgaacgtaagggcaagctattgctcgtgcacacttgccatgtgcactgatattttgtttttgacattttggtttttagtaataccccttcttttttttaaaaaagtctt

SEQ ID NO: 16679 - DNA, 1501 bp, Oryza sativa
ataaggcttgatcgaccagtttgttatctgttcatattcttctttgattttatctcttagcttctcccggcgtcaaatatctgagcatcggggagatggaggcccagccgcccgcgcatgcgcagctgggtggtgattccttcatcattatttctatagataagaaataatcaatagagataaacttgatttgtaattcgctttgtttctctgctgctgggccacagtccagtgataagcgtctcgctagcgctcgcgcgaagtaactaactcgatcaagtttgttatagagataaaatcaattggtttgttggttatctcttaattcatctggttttatctcttccgcatattaacttctgaaatcttagcgagatagaggtccagccacccgcgcgtaggcagctatcgtcttcggccatatgggccgagcccatgattaatcactcggatatgcataggttgcttaatcacccaggcatgcacacacatacgaccgtctactgtagtacatgcatgcatgcgcgtgattgcctcaccagccaatcttcacacggctagttattggttaattatacatgcacctatactaatctaagtatatatatccccagctgcctgtgcatgcatgtatttgcgtgtatatacatggccaagcattgcatagaaatgataagctagccaacttacaaattgcttgtttgctttgtccatcatgagtaagtcttgtgtacatgtataatcaccaaaataccatcaaacagtttcacctagtgcaatcataatgtttcactatgtataaatctaatgttgtagtgaactgaaacattctttcactatttgctgaaacattgtttttatataaggtgaaacaacacctgatttaaacgagtgaaacatttttgatctacttagtgagacaattccgatatacctggtggaacatcgtgcaacatttaaaaaaaatcaataataagctaatttttttcgtcggaatatatccatgtgtggtctttttttgaagatttaattgcaacgaatttaatggtgtaatcggattatgatttggataattaatttaagagaaaaatcggtttaaaatagttttgcacgtaaatcggacgcgcccgatttctcagccccgaatcgatcgcccgatccgtaggcgctcccgaggaaggggtagcgactggcgtaccttttaaaaactataaaattattagaattatgtgaatgataattttaaataaaatcatgtattaaaaaatagataattttaaattgatgctagccacccaactagttttaactatattcactaaatatttttagcataattttagttttaccatggcaacacacgggcagtttgatcagtaaaattaaaaacaaaaggaaaggaaaaaacggaggcagcgcaacattccagtggctttgcaatctaatttggggccgaacacaccagggtctgcgacgctggcgaaggccggcggtcgggagg

SEQ ID NO: 16680 - DNA, 1501 bp, Oryza sativa
gtggcagacaggcgatgcagaggacggcgcggcggctgatacggagcggagcgctgatggcggaggtgcgggagcggaattccggcggagggcggagacgcaggtgtggtgggagagcgataggaaggggggtgggccgtgcgggtcgtgcgctgattgagggaggtggatatgggatcgatctgaaccgttcggattttacgcggatgatctgaaccgttgaatgatgaatgtaagagtgtaagagtaaaacatgagtaaaacgagttggtgaattatagaatagatagatagatagacgagttggtgaattataggatagatgagtacgcgtgatgtgagcgtctacttttgtatttaaaaaaactcgacaaaaagatgaggaacgtcgagcggacttattccgcagtgggttgtcacaggctcgcagctctcacgcaccagcccgctactgctccgaaatcgtgtccaattctccaaccgacggaatccatctgggcctccaattctccaagccgaatgccagcacaagccaacaactcggccgtgtccaaatctccatgtacatatctctcacttttttttttgcataattccaatttcagttttcatatatctaatattctaatgctggcagtgtttaccagttctgattgggccacttgacggcctttactttcaaaataaatcctagaattatgtgaaagaaaaaaaaacaataggaaaaaaataggcttgagtgttgctgcgttgcagctctcctgttctgaggtgctagccctcttataggaatgactatgtattaatctagaagaatccatggcagctaaaagtgtttgaattaaggagcgatccaagtaatgtaatggaaatactccttcaaaataagtatattttaacctatcacacacatacaaataaaaagtaaaaatactaggataccccactttattaaatcttaatacaaatatttttactttatatacttttcaatgcgttctcttgtttttcacaaactacaatgcaataattattttaaaaaataaagttattttaagacaaacggaagtaggcaaaaatgatattttgggacgggtggtaggttttgtggtatgaattccacccatcaaacataaatttgcaaacaaaacctaaaacaccttaaaaataacatcacctattttactagacgttttatttgttttgttgattataattaaacacaacaaacagactcgaagcaatacctacgaaaagataattgatgatttttaaaatgtatgaaaattaaactaacatcataaacatttgcaaaattaaactaacatcataaacattgaaataatctgtccgggatataacacgagcgtgcctttgccttagccacgttgattttctagtaattcaaaaattaaaacttgcttctgaaagactgaaaaatagacatagatttctaattattgtttgcaagtgaaaatttagacagcatcttttttagaaa

SEQ ID NO: 16681 - DNA, 1501 bp, Oryza sativa
tgcctttgcgtttctattccccactcttctcttctaagaaaaaaaaaatgttcccctctatcttttcttctctgttcctagttcctgctgtattcccctttttttttctttttctaaaaaagatgctgtctaaattttcacttgcaaacaataattagaaatctatgtctatttttcagtctttcagaagcaagttttaatttttgaattactagaaaatcaacgtggctaaggcaaaggcacgctcgtgttatatcccggacagattatttcaatgtttatgatgttagtttaattttgcaaatgtttatgatgttagtttaattttcatacattttaaaaatcatcaattatcttttcgtaggtattgcttcgagtctgtttgttgtgtttaattataatcaacaaaacaaataaaacgtctagtaaaataggtgatgttatttttaaggtgttttaggttttgtttgcaaatttatgtttgatgggtggaattcataccacaaaacctaccacccgtcccaaaatatcatttttgcctacttccgtttgtcttaaaataactttattttttaaaataattattgcattgtagtttgtgaaaaacaagagaacgcattgaaaagtatataaagtaaaaatatttgtattaagatttaataaagtggggtatcctagtatttttactttttatttgtatgtgtgtgataggttaaaatatacttattttgaaggagtatttccattacattacttggatcgctccttaattcaaacacttttagctgccatggattcttctagattaatacatagtcattcctataagagggctagcacctcagaacaggagagctgcaacgcagcaacactcaagcctatttttttcctattgtttttttttctttcacataattctaggatttattttgaaagtaaaggccgtcaagtggcccaatcagaactggtaaacactgccagcattagaatattagatatatgaaaactgaaattggaattatgcaaaaaaaaaagtgagagatatgtacatggagatttggacacggccgagttgttggcttgtgctggcattcggcttggagaattggaggcccagatggattccgtcggttggagaattggacacgatttcggagcagtagcgggctggtgcgtgagagctgcgagcctgtgacaacccactgcggaataagtccgctcgacgttcctcatctttttgtcgagtttttttaaatacaaaagtagacgctcacatcacgcgtactcatctatcctataattcaccaactcgtctatctatctatctattctataattcaccaactcgttttactcatgttttactcttacactcttacattcatcattcaacggttcagatcatccgcgtaaaatccgaacggttcagatcgatcccatatccacctccctcaatcagcgcacgacccgcacggcccaccccccttcctatcgctctccc

SEQ ID NO: 16682 - DNA, 1501 bp, Oryza sativa
gcgagcctgggcgtggtgttcgccttctcgctcctcctcaacagcgtccagccggtgctctccggcgtggccgtcggcgccgggtggcagtggctggtggcgtacatcaacctgggctgctactactgcgtcggcatccccgtcggctacgccatcgcgttcccgctccgccgcggcgtgcaggggatgtggggcgggatgctcactggcgtcgggctgcagacggcgatcctggtggcgatcacggcgcgcaccaactggaacaaggaggccagcgaggcgcacgccaggatccagcactggggtggcacggccaagctcgccgtcgacgaccccatctagttaagcgacagcgagcttcatcatccatccatggcgtaagaatttgtaatgtacctgcacaatgcaagtacatgtacatcctgttgtcggatttggtttgagattcgtgcgcgtagcatggattgcaataagaaaatgcagatgtgttgatatgtcgtggttttgtgtatccgagaatgtcaatccacgatgcaattatgcagtgtatgtgcaccttgttgtttgtttggatttgattggagattcgtgcgcgtgtagaatagataaatatcatgaataaagcatgatattatatactagtatctccatttcatacaatttttttctaaatcaagtttatagaaaaacataacaatattttcaacataaaacaaataatgttataagtgttactgtttttttaaaaataatggtcaaacatttaaaaattgactttaaaaaagttaaaacgaattataatattaaacggagtgggtaaaaagaaatgcagttgcgttgatattgtggttctgtgttttggcagtttggtctcagattctgtttgtcaatggcaatggaacttgggcaatggatgtgtatgatgtaacgcaagcaacattcgttctccagtgacttactcacggaaaattttttttgacagaattggcttttggtgctactatataaataaaactaaaataagtaaagatatttccgtgctataagaccatttttttttccattggattttgatgaaataagacaaaatgacacttgcatgaagaggtaggagagcaaactgaggcccctatcgtttagccaagtacggataatagcaaaataataatatttataggtaagatttttatttatacgttcttagtgatttagatgccaatactgaaaaataaactttaaataaaagattttaaattttggcaacgagcgatgctgtatggaggaagcgatgggcctgaatcctaagccgtctaggatgaacaagcccagtttaaaaccaacacggccctcacacagacggcccagctcagcccagcaaaatataaaacaaagaaaatacaggaaacacaacgaaaagcagaggagaggtagcccaagctcggaagggaaggggagcgaccttcttgaggcagaagtcacgaaccaaccagcgccgccgccg

SEQ ID NO: 16683 - DNA, 1501 bp, Oryza sativa
tctttggcaatactatactccaaccaattatgcattttgaaccacgagtcatgaaagcttctttgtcgatttcccattaacttctgtggatatttatgaccaattggttggcatggacctcttgacaagtattcccttctaacagcatctctaatgtctatatgaaattgctcaattggttttctaagcccaggatcagcaactatgtcagccggattaagctcaactgtctctgaattgtgaggttcttgttctggttgtggaatattactccccactgtctcaacaatactaggggctgcctcacaagtactaggggcatgttgaacttgaatgttactagctctagctccagtttctcctatggctgcctcaacaacagctgctgcttgctgagtattactacctccggttcccgctgtttgtggaggatttgggtctaaattggattggggtgttgctggggcataaaaagatttcaatgtagtcctaggcctcttcatcttctgatctctattgcaagttaaataaattgattggaatcaatagatctatagacactgcagtattttaggcacttagccacttaggcatttgagaaaagaagtaaagaacaaattgacagaagaaaatagagatggaaaacttacccccgtacttgctgctccgctcatgagcacaaagccgcgccttggcccttggcccttgggggttgtcggctcgttgccgaccgccggtcccagtgatggcgcactggtgctgtccgcctgtccgccagggagccggatgaggagaggagttgaggctgaggagtaaggaggcagcaaggcagaggcaggtagggagcgaccgagcgagccgaggagacggcgtgccaggcgggcggcggcgccggcgtgctgtcgtgctgggtaggaccgtaggagcgagcctcgagcaagaaggcgtcgcgccacgccgccgctctcccatctctgtctctcgcttctaaggaactgaggaggggagttagggttaggttgatttagtgggccttgggccaaaatttcagaggtatatctaggtggggggtccattactacacggcccacgacctggtccgcggcccaggttgccccaggcctgggtccacccctgagagacgctaaaactttactgatctgaattcagaacgtgacacacctaaaggagcaggactctcacatatcagttggattttatgtagcagacgatagcctagaaaactttgagctgaaatgagcatttcaggtagtgaattgcaacctgcactattgaagtattgagactaaggaatgttgacctgtttcacatggttagttagcaaacttacagcagcaagtttaaaatgtgacaaactaaaggaaaatggtataagatggaaatgtcagataagatatgaacaaataatatttcaatggaaggtagcgtctagtgagacacatacttatgtgaacctaattaatggtccgtaaacatatga

SEQ ID NO: 16684 - DNA, 1501 bp, Oryza sativa
tctcctaatatctgaaggtatttatttaatttaagtgggcaaatgtctttatagtatgcagatttctgaccagattgtacccaaggtatgatagagatctaacattcttatattcatgtccttgagacaaattgttgcaacgagtgaatcattttctgctctatggaaatttgctcaaatccttcttaattgtctctctgctgtgcatatatagctcatgttactgccttgcttccaagatattgggttcaaatgtaagataacactaataggtatctgttgttccaaccataatctcgatctgtttaactaatgcagactctgtttgcttttataatgctcattttatacatcatatgtttacggaccattaattaggttcacataagtatgtgtctcactagacgctaccttccattgaaatattatttgttcatatcttatctgacatttccatcttataccattttcctttagtttgtcacattttaaacttgctgctgtaagtttgctaactaaccatgtgaaacaggtcaacattccttagtctcaatacttcaatagtgcaggttgcaattcactacctgaaatgctcatttcagctcaaagttttctaggctatcgtctgctacataaaatccaactgatatgtgagagtcctgctcctttaggtgtgtcacgttctgaattcagatcagtaaagttttagcgtctctcaggggtggacccaggcctggggcaacctgggccgcggaccaggtcgtgggccgtgtagtaatggaccccccacctagatatacctctgaaattttggcccaaggcccactaaatcaacctaaccctaactcccctcctcagttccttagaagcgagagacagagatgggagagcggcggcgtggcgcgacgccttcttgctcgaggctcgctcctacggtcctacccagcacgacagcacgccggcgccgccgcccgcctggcacgccgtctcctcggctcgctcggtcgctccctacctgcctctgccttgctgcctccttactcctcagcctcaactcctctcctcatccggctccctggcggacaggcggacagcaccagtgcgccatcactgggaccggcggtcggcaacgagccgacaacccccaagggccaagggccaaggcgcggctttgtgctcatgagcggagcagcaagtacgggggtaagttttccatctctattttcttctgtcaatttgttctttacttcttttctcaaatgcctaagtggctaagtgcctaaaatactgcagtgtctatagatctattgattccaatcaatttatttaacttgcaatagagatcagaagatgaagaggcctaggactacattgaaatctttttatgccccagcaacaccccaatccaatttagacccaaatcctccacaaacagcgggaaccggaggtagtaatactcagcaagcagcagctgttgttgaggcagccataggagaaactg

SEQ ID NO: 16685 - DNA, 1501 bp, Oryza sativa
tctcctaatatctgaaggtatttatttaatttaagtgggcaaatgtctttatagtatgcagatttctgaccagattgtacccaaggtatgatagagatctaacattcttatattcatgtccttgagacaaattgttgcaacgagtgaatcattttctgctctatggaaatttgctcaaatccttcttaattgtctctctgctgtgcatatatagctcatgttactgccttgcttccaagatattgggttcaaatgtaagataacactaataggtatctgttgttccaaccataatctcgatctgtttaactaatgcagactctgtttgcttttataatgctcattttatacatcatatgtttacggaccattaattaggttcacataagtatgtgtctcactagacgctaccttccattgaaatattatttgttcatatcttatctgacatttccatcttataccattttcctttagtttgtcacattttaaacttgctgctgtaagtttgctaactaaccatgtgaaacaggtcaacattccttagtctcaatacttcaatagtgcaggttgcaattcactacctgaaatgctcatttcagctcaaagttttctaggctatcgtctgctacataaaatccaactgatatgtgagagtcctgctcctttaggtgtgtcacgttctgaattcagatcagtaaagttttagcgtctctcaggggtggacccaggcctggggcaacctgggccgcggaccaggtcgtgggccgtgtagtaatggaccccccacctagatatacctctgaaattttggcccaaggcccactaaatcaacctaaccctaactcccctcctcagttccttagaagcgagagacagagatgggagagcggcggcgtggcgcgacgccttcttgctcgaggctcgctcctacggtcctacccagcacgacagcacgccggcgccgccgcccgcctggcacgccgtctcctcggctcgctcggtcgctccctacctgcctctgccttgctgcctcctcactcctcagcctcaactcctctcctcatccggctccctggcggacaggcggacagcaccagtgcgccatcactgggaccggcggtcggcaacgagccgacaacccccaagggccaagggccaaggcgcggctttgtgctcatgagcggagcagcaagtacgggggtaagttttccatctctattttcttctgtcaatttgttctttacttcttttctcaaatgcctaagtggctaagtgcctaaaatactgcagtgtctatagatctattgattccaatcaatttatttaacttgcaatagagatcagaagatgaagaggcctaggactacattgaaatctttttatgccccagcaacaccccaatccaatttagacccaaatcctccacaaacagcgggaaccggaggtagtaatactcagcaagcagcagctgttgttgaggcagccataggagaaactg

SEQ ID NO: 16686 - DNA, 1501 bp, Oryza sativa
tctttggcaatactatactccaaccaattatgcattttgaaccacgagtcatgaaagcttctttgtcgatttcccattaacttctgtggatatttatgaccaattggttggcatggacctcttgacaagtattcccttctaacagcatctctaatgtctatatgaaattgctcaattggttttctaagcccaggatcagcaactatgtcagccggattaagctcaactgtctctgaattgtgaggttcttgttctggttgtggaatattactccccactgtctcaacaatactaggggctgcctcacaagtactaggggcatgttgaacttgaatgttactagctctagctccagtttctcctatggctgcctcaacaacagctgctgcttgctgagtattactacctccggttcccgctgtttgtggaggatttgggtctaaattggattggggtgttgctggggcataaaaagatttcaatgtagtcctaggcctcttcatcttctgatctctattgcaagttaaataaattgattggaatcaatagatctatagacactgcagtattttaggcacttagccacttaggcatttgagaaaagaagtaaagaacaaattgacagaagaaaatagagatggaaaacttacccccgtacttgctgctccgctcatgagcacaaagccgcgccttggcccttggcccttgggggttgtcggctcgttgccgaccgccggtcccagtgatggcgcactggtgctgtccgcctgtccgccagggagccggatgaggagaggagttgaggctgaggagtgaggaggcagcaaggcagaggcaggtagggagcgaccgagcgagccgaggagacggcgtgccaggcgggcggcggcgccggcgtgctgtcgtgctgggtaggaccgtaggagcgagcctcgagcaagaaggcgtcgcgccacgccgccgctctcccatctctgtctctcgcttctaaggaactgaggaggggagttagggttaggttgatttagtgggccttgggccaaaatttcagaggtatatctaggtggggggtccattactacacggcccacgacctggtccgcggcccaggttgccccaggcctgggtccacccctgagagacgctaaaactttactgatctgaattcagaacgtgacacacctaaaggagcaggactctcacatatcagttggattttatgtagcagacgatagcctagaaaactttgagctgaaatgagcatttcaggtagtgaattgcaacctgcactattgaagtattgagactaaggaatgttgacctgtttcacatggttagttagcaaacttacagcagcaagtttaaaatgtgacaaactaaaggaaaatggtataagatggaaatgtcagataagatatgaacaaataatatttcaatggaaggtagcgtctagtgagacacatacttatgtgaacctaattaatggtccgtaaacatatga

SEQ ID NO: 16687 - DNA, 1501 bp, Oryza sativa
ttttatccaaaaggctacaatcaagagttgcttccagggcaaatgcccttagttatgctttcttttttaatccccaatgggctctcctctgtagaattttcttccaactttatcctctttggagtttggcctaacctaacatctaattatatagttaccatcgtacaacgttactctcaagcgagaaccaagtcgtcatagttccaaagtaggaaaagttattccattaattagctactcggtccatgcaaagatcgtaagcatatttattttatcatcgagaccaagaaaaaaaattaactcattcgatttgtactcccatgtaacaaactttttcatatgcatgcaaaagggttggagaatgcatggcagctcaagtttcggtcaacaatttaatcatacacagtaaaacgaaaagagactctcttcatttaaggctcggatgcatggagactatatgaataagctcatctcatttggaaaaaaataatcaaaacaatgaaatatgcttaatacatttggatttggatggagtatctccctatgacgaaagagacgagggattgcctacttctttccacatcaacctttgaaggctatggcagagctacatttgcagcgcagcctctctgcatgatttcttactagataggataagtttcaagagttaatttcttgtactcttgggcgatccatgctgtcaaatcagcaactaacgaggcataatctcgatcactagctctgatctgatcttcagctagcgccggcgagctgcagaggtctccatccatggcgccggcggtcagtgcatcgcagggtgtcatcatgcggtccctgacgagcaagctcgactcgctgctgctgcagccgccggagccgccgccgcctgcgcaaccgtcgtcgctgcggaagggggagaggaagaagatcctcctcctcagaggcgatctccgacacctgctagatgactactacctcctcgtggagccgccgtcagacaccgcgccaccgccagactcgacggcggcgtgctgggctaaggaggttcgcgagctctcctacgacgtcgacgacttcctcgacgagctaacgacccagctcctccaccaccgcggcggcggcgatggcagtagcactgctggtgccaagaagatgatcagcagcatgatcgcccggcttcgaggggagcttaaccggcggcggtggatcgccgacgaggtcaccctgttcagcgcccgcgtgaaggaggccattcgccgccaggagagctaccatcttggcaggcgcacctcgagctcgaggccgagagaagaagtcgacgacgacgatcgcgaggactccgccggcaacgaacgccgccggtttctgtcgctgacgttcgggatggacgacgctgctgtgcacggccagctcgttggtagggatatttcgatgcaaaagctcgtccggtggctggccgacggcgagccgaagctcaaggtggcttccattgttggatccg

SEQ ID NO: 16688 - DNA, 1349 bp, Oryza sativa
agaaggtcctgacaggtgggccccacctgtcagcgagcgagagcgcgcgcgcgagcggcggctcggctggtgggctaacttgggccggggagagagagagggcttttgggccgactttcggcccaaaacaaaaagggagattttaaaacctttttcaatttaaattattcatgaaatgcaattccatttattaaaaatacttccttggctcaaataaatcccagaaaaatttaggaactatagaatcaagtaaagtatttaatgaaattttatctagcccacttttatcttagaatttaacaaattaaaattagatcttttcttttaagcttttaagatcatttctactaattccaattaaacaacaatttgtaatttaaggatttttaaacaagaaaagcacttaacataattataattaaatcattaatgattattgattaactaattactgaactgtcctttgtatcatttaggaattgagctccgaaaaatccgagaaaatttcagagagtataattaatcatggagaatttaataaaaattaaatccatccatgctttatatttaggaaattttatttcccacatttaacttttcttgtaaattaaagaacatttaatataaattctattaataatttattaaataatttataaatcctaaaacgaaaaaatcaggatgtgacagatctaccccccttacaaagaatctcgtcccgagattcggaacggctagaaagaaaaaggcataggtaaactgcagtctatcttattccataactccgataattattctaaggctttatagaaaactactgccgctttgaaactagtggctgagctgtaacacttgaagatgcaactcttgaagacacaactggtactgcattggctcctgtgacgacaatgttgttgacctgaccttgcggctgctgatgcttcggcttcggacactctcttgcaaagtggcctggcttgtaacagttgaaacatacctgctgctcccttctactactgttattctcccgagactgatcctgctgaactggcatcggctgatttatttgctcgatgttaacttcattgctttcattagtctctgatttgatctcaccagcgatattcaactgttgcgactgtccttgaccagcggaagaagattcaccaatttggagtggcttgatacgctgcctctggctactaccttgtgcctcctggaatacaatcattttccttttacggttatccatcctgttcttcttgtcttcaagtcgaattgctttgtcaaccagctgctgaaaatcaacatagtcatgggagattaacgtaactgacagttcatccttt

SEQ ID NO: 16689 - DNA, 1501 bp, Oryza sativa
cttcaaacattgcatgtattcagtttgctgttggcaaaaaaaaaaaaaaaaaaaaaaaaaaaaaaaaccggaacgaacctctccgcccagtgggctgttggcctagcaagtaacagaagaaaatattttcgttctttcttagcagccagtggacgaaagcggcccacttgataaacacgtacttccttcgtccccaaaaaatacttaacctaagtacaagtacttccttcgtccccaaaaaatacttaacctaagtacaacgaatctggacaaagaactaagaactgtctagattcatttagattcgttgtactagtaggggtcacatcctccctggtcacatcccctcctaaggtagagttttttttaggatggagggagtactccacattattttgtcggaaaaaaaaacacgcaaccaatgagtaaaaaaaggaaacacgtgaagattgatcaacaatgtttctcggtaagaattctcaaatcccgctgcaacgcgcggggcatccactagtttttcttgttagtaggcctgaatatgatgtctatttttttgaggaatatggtgacggagtattagtcttgtcactgacaaacgggtccactcctgctggtttaccacattactccctccatctcataagggattttgggtggatgagacatatagacttgttgtactaggatgtgttctatccacacaaaatctctatactaggatgtatcagatccacccaaaaatctttgtgtcatatccacctaaaatttcttatattttgggactctatgtgtcatctccgtcaaaattccttatattttgggatatttttgggactgctgtatgtgtccttatattttgggacttctgtgtgtgtcatatccacctaaaatttcttatattttaagatatttttgggactcctttatgtgttatattaaaatatttttaggactcctttatgtgtcatatttatctaaatttcttatattttgagatggagcaggcctcctgtgactatcccacgagcgctggagcaaggggccacgtgagaattgtggcgatcggcagaatgcagcgagtccaaatcgcgaacgggacgtgtgagaaccatccagatcgtcagagcttcatcgtacggcaggggactcgcgagcatgtatatctaggggctacacgcgtcgccctgccattggctgccgccgacgcgttcggcgcaaccgcgacgccctcgctgggtccatcgccggcgctcggttcagcctcaggtagccataggtgccgcgattcctccggctgccgctggggcccactccgatcccgagtatcccattggaactgagcaatcacaacctgggcattgcacaccccaacacactgacaggtgggcccctgtaggacacgtgagacgtggcctcccatgtcagtgggtcgggttcgcaccacgttcgtatcgatagaaatataaaaccagccgttagtatctatgattttttttttcct

SEQ ID NO: 16690 - DNA, 1501 bp, Oryza sativa
ttggttatagaacccgtacctataataccatatagggtgtcgatttgcaaccggcaccaacgattgaagtcatcagtgccgctagtattgtgccagcaatgatgaatccagaatgaaaatagacgggtgtcttgttcgaatgaaagtttcgggcgagaagcgttgactattataaaattcaaattttgatttattttaattttgatgaaaattctacataagaagttcttgctgaaatatcacaatgtttagtggtttgacaagcatatgcctacagaaattaagaaatttggttatctgtttattctttaatttgagttatttctggtacaaataagaaatttgatttacagtggattgatgtgtatagtttactagctttaggccatgtcctttcagatttagagttttttgcggtactttatgtatttgaaatttaactatatacccttcccaaaattgaacttctaggtacaaatatatacgtctcatcttagatacattttagatactgatactaattaaggtggtagaaaggcagtgtcgcggtagtatcaggaattaaacggtgtaatggaagaatgcaagctctaataattattttgtccgtgtcagttgtggtatacgtagttacgtacggtgtatccgatagtactctgttagggagtgtaaccaaatatccacaaggctgtatctgattgcgaacgtggccgaaacaaacgacttttgaggggatataactccataattaatcagattacttccgaaataatcagaattgaacaggttctacgacaaataattgacatggtgacaaaagcaatggaagtggataagcaaagattttatacaacatgcaattatttgaaatccttgaatccctgtgtctaactttagtcactcgttttttgagtctaatcctgggcgagtggatgggaagagcaccgtcagtggcggagctggacggaaaatcaaaggggggccagccggcttttgacagctcaaaaaattggcaatttctcctttttttcgtgtattggcaatacataaaagcgaatagtttgcagaagcggacaatatacttacatgttcatttaaactatacggcacgagtcttcactgtattgaaatcgctgctatgggccagcaagactgaattgggccatacggtggcctgctagacctggagaccatatataggggtaataaaaaatttctttttattgggaggggccatggcccctgccagcccccctcaattctgccactgagcaccgtgagcgtgctgtggagttaacgacccagctttttccgaaaagcacgatgcggggcgcacgggagggtgggaacagcacggacatgatgtggaacggtgcggcgtctgggtcagcatttcgtcaaacaccctgtgtgcgtgcaagtggctatctcaaggaaggagatggtgaatagttgcgggctgggttgggcggcctgcttaggggaagggaaaaagagaaga

SEQ ID NO: 16691 - DNA, 1501 bp, Oryza sativa
ttgttcacaacgatggagcgtcgtgcttggtattaacctgtgcccacgtaatcgatcctaagcggagtaagctatgttctttttccctctttcccaactcccttcactcgtttttcacgtacacatttttcaaactgtcaaacgatgtatttttttaaaagttttctatatgaaagttgttttaaaaaattatattaatccatttttcaagttttttttagctaatacttaattaatctcactaaatcgtgtgctttgttctccgtgtcaggaggaacacagcctaaggaactgtccgttcggtttggtgcggatcatatcgcctctgctcgattggtgcacgtctcagaacacgttgatcttgctctgatccgtgtccaaggggcgcctaactgcattcctctgggattctccgatgaggctgatttgtctgggaaggaggttgtcgcgattggattcttcggacttgacggcacctccatgtgtattgatccgggaacatcgcgcggccacatactgtaattaacgagagcctttctttcacatttttctttatgaaactacatatgtatatgtatgttcaatgcaatagctttgttaattactgtacacgctgatgcaaacctactgctcctagtaggtaactaatgctgtttgacgctgtctgtttcacaacatgcatgtgcaggggcgaagcagtggtctttccaacagattctgatgatctaaatgaattctcccctaccaatttgccgacggcgaaaggcatgtcaggcgcaccggtcctcctggaggataaggtggccggcgtcctatgcaatagtgatgctgcggttatcaatgttatctaaatagttatgaaaaaattttaaaaaattgacatgataggttagtatgtatcacttcacaagcatgcaagttcaaattcaacttctacaaattgtaacaaaaataacaaatttgactgtaaatatacatatactagttagagtttaatttgttatttttgttacaacttatagaagtcgaacttgaacttacatgtttgtgaagtaatatattacgtattaatctatcttgtaaatttttttaaaattttttcataattatttaagtggaatgcaagaaaagagagattagaatccatcctctgagagtgagacagagatttgtcgaccaccattgcttcaagaaccaccaatccggcaatctctgattccgttcatccttcgttccagcttggtatgatccaggacggcgtctcgccgcagagggccatctccagcttgttgaggcagcaggcgagcttcttgaagctccggttctccaggctgaacaccgactgtacttcatcgtggtggaatgccgatcgttcacctccttggtggtcaccgagtagatggtgttgccctcgaggttctcgaatcccgcggtctccatggcaaatccgtgcaggaatcgacaaacagggcgcggccgccgatgccggtgagctcctgtc

SEQ ID NO: 16692 - DNA, 489 bp, Oryza sativa
acccatgaattcaaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcag

SEQ ID NO: 16693 - DNA, 1501 bp, Oryza sativa
gcgcctgaaggaaaaatacgagccgacgttgcacggccgaaagcccgaaccagaattccatccagcccagaaacaggccgcctcgcaggccgcattcgctgatctggctgggaggacaagtttctcttttttttctctttgctaattggacccatatgccactgcaaatttgttggttcgaaaaaaataccacattcatgatattaggtatataccactgaaactttataaaatttaaactatgccactccgtcaccatttctgttagtacctctaccatctttaacaggaaacgagcaccgggcgataccgctgccaagcacaagatggcgacaacgaggaggtcgttggcgagggccaggtggtctaagggtccggcaacgatgaggcgcagctggtggtggcggtgacgagcacattattgggcgccacgagcaggcatcggtgaggtcgaggacggtgacacggtgagctcggagatagcgcttcccggctgccgcgagcgtcaagatcaagcgcatgtcgtcggggccggtggagaagctgatgccgccgccgagcacgactccctcctgtagctccatcctctgtgtcatctccttctccctcccttcccttttcttttcttggctgcgcgggcgtcaggatccagtgccggtcatcggcgctggcgccgacgtcgagcacgactccttcccgcagctccaccctccacgtcacctcctccttcccagcccgtggcggcggcggcgacacttgcactcccctccaacaccaccggtgacgcgatgtcaggcttgtcggatttggtggctgcggctgccgctcccttccagctccacctctcttcaccgggtgctaagctcgccaccattgttggatttacatcgccgccgcatgcctcctctgcctcgctcgccggagttgggcacaagtatcggcgttggtgtgggcaggaggagaagcccacgaattgccgcccctgcttctcaagcccacaagccgccgtcgacaagtcccctccgcgccactgtctacgagcccgagcgccgctgaagatttgtcgcttactactgtatgcgctggagctggagaagaaacggaggcaccaacggaaatgtaccatcaaatgcatgctcgggcggaaatcttgacgggaatggcacggttcaaattttacaaagtttaagtgacatgcacccaatatcatgaatagtaatggcatttttttcaaaccagcgaatttgcaatgcatggatccaattaacaaaaaaaaatctgtaagctgtttattcaaggaaaaaagatctggagctctcctagtaagcaaagataacccggagctctgatgtgttgcaattgttcgtgcatgccaaatagagcaactagtggcgcatttcttcaatttgattcgtcaccatgcgcgcggctaacttttcaccccgaaaacgattctgacctgcaggcagtatcgatcagccgaccttcaggcaggcatcaa

SEQ ID NO: 16694 - DNA, 1501 bp, Oryza sativa
gctaactgaacataaaacaccttggaggttattgtccatatctgggaaaagacggcgccgcacgtgcaagctaatttgatcttggtgtgcagaagagaatgaccaaactgactgatctcttcctgggagtaatcctgcatttgctgctacttcaacagcatttctgacacatcaacaagttaattaacatgtcaaatgctgtatgctaaacacagatatggtcacgttacgtcctgtaaagagttttttttttctcgattctagcttcccattgctgtgaaagcatccctatgagcagttcttgatttccaaacttccaatcgttgtattagggcattctcatataattaagtagtaggacgagtgatgtgatagcaaaattgatgagttgatagagaagggtatcccatgttagtgtagtaatgagaagatgtaattcatttgccacatgactcgtgctagtgcagaccaaagtgaatatgctccaaaactaaatttgggtaataaaatatggcctaaattctaatttactttaggattcaatgatgcaataatattaattccatttgttataaaactggtccgaaatcactatcgaaaaccaaacacgaaagaaacgtcataggtaattcaaacacgatgatcgcattgaagtacgatatttgttaacgagatttaaccgaagcctacatccctggagtgcttcttcccatccagcatttacagcgtattagagttataacaactatcgatcgaacgccgttggcagccgctccctctcactatgcgaactctaacaaactcctccttagcgaatatgccacgccaacatgaatttgttatttgctcgaacctccgtgtgccagaacttgagttggttcttccaccgctcatgctgagttggcccgacaagccttcaccaggatcaccacaacaagagactcccgctatccctgtaacttcttcctcttgattgcacctgcaacagtgttccaccctctcttatatcaccacaatcgtcttgctaagtgaaattgaatttctttctacctgttacatcatagactcctcaaaaatcatgttcaactacatctactgttttaaatttgacttgttctaatccatggccagataacacgcattgttaccaaatagaaaaatcaaactcactagacatgaagagaaccttttcttctttgatgtcttacgaaccgagctaattaacaaatccaatatccacgcttctacatagaaagtctcatgtaatatgttgccagaagttgtttctattgaaatctggagtcactgactccaaatcaacagaacatcttatgttgaatcccatatgagtactaagatcctttcgtgtgagatagtattccgtcccgaagaatcggaacgtaataccttcccacacgtatcgcaacatacagagaaatcgtacggtaagaaaacgtgaaccagagtcatctactagcgcgaaatcatcccaacatattgc

SEQ ID NO: 16695 - DNA, 1501 bp, Oryza sativa
ggacaattcacttatcctttaacactcctcgtcaatctaggatccctcctacctcacacttacaaggcttgccagcgttttatttaaacagtgcctgacaagatttgaactcaagacctcttggtagtgatacaaaattgaattgcatgcaccagaaagttcacccaaaagcttaactaatggagaagaataggcaattccatgagtttgtagttatcaaaaagagtatttaatgggggcactaaatctgtaatttgattcatactgactgaataaagcactaactgctagcacatattacaatagcatatttacatttcaaaatgaagagtaattaagtagtgaaaaatgtcaaatcaagataagctatcagaaataaggaacgtacaatgtgtaaatgcagcaacagctgagattagtgcagcgtcgaatagagacccatcagcattcaaacaatagacatcctgtaaagttgagatgtcaagaaaacaacagaagtataaaacacatactttttgcaaacttgtttttggacgggcattgcctgaacttatttttatgccattgtttgttcctttacaagagctgtggttgtataaaacacaaatactttttgcaaacttgtttttggacgagcactgcctgaacttatttttatgccattgtttgttcctttacaagagctgtggttgatgttgtactttacacccacctctattaaagaccttcagctgacagatgtacgtagaaatgttgtgttgcttgcatttttgcaatatcttccattaaaaaagtgtattcttttaaacatgtgtgtgttgtttgcatattgcaatatcttctgcaaaaattgcaattttgcaaatatgtgcgtttaggttgttgattaatctcatctagtggtatatatgattttctgatttcagggtactagttggcatttatcacaatgctcaggtacaataatagtatactggcaaatctcacatcatgcgctcagttctattgcagcaagcaaccgcagataacagatttggtgctgccacatgaactgtattttagggaaacagcagggaaagtccctgttggagtttccgttaaaaaaggggcatatttgttcaatgccataaaaaggaaattggagtaggaaaataacatcaagaaaccaaagcttccaaagaccattaacacagaaaattcttgagaataccatccccgtaaacttttttcatccatatctaatgtttccatcctactaggacaaagataaaaataaaagatacaggttatctgacattctcctcatctcttgacgttctgggagctgctatagcgtgattgaggacaagcaccgagcatgcgcgaccacacatgacgtgctccaatgactgaaatagcaacaaatggtgagcatggcatagaacacgacaagaaggttccatttttatggacatatagaagagatcagagaaaaattgacaggagcagcatggaggtgaca

SEQ ID NO: 16696 - DNA, 1501 bp, Oryza sativa
gccaaatcggataactgggcatcagtcaaactcaagctgtaacacttattcctcattttcctgaacctttgaatatactcacgcaccggctcatcatgcttttgcttgattgacgtgagatcagacagtttcatctcattaatcccactatagaaataactatgaaactacttttctaaatcggcccaactattaatcgacccatgcggcagagaagaaaaccaagtaaaagccgacccagccaatgacaaccggaataacctaaccctcaaagcatctacaaccgatgcctcaccacactgagctaaaaatcggctaatgtgctcataagtcgatgtagtgtcttgtcctgaaaactttgagaaatctggtgctttgaaccggttaggtaaaggaactctttcaaaccattcaggataaggttgtcggtacaaatttccagtctcttttggtttaagcccaaattgctccctcattacatcagctatcacatcagcccatggtcgctgctgaggtgttccttgaggttgttgtggtgtgggctcaaactggttgtaaaactgaggttgaactgatcctgcctgttggtactgaacttgtggtgatggaggttgatattgataactcaaattgccccctggtaattgtgaaggttcggctgaataccacgcgccaaatgctcaggaataacttgaggtactactgaaccatctggttgcacatgatgaaccaggtgttccgggacaacctgatttgtagtgtactgcacaggctgaccaccaggcattgcaaatccagccgacgcgttcattgaggcttgctgctgaatcggctgaacgacctgctgtctcaacggtgtctgctgaatcggctgtaaagccggtcgtcttggtggcgtctgctgaactggttgcacgacctgctggattggggatgtttgttgaataggctgcacaacctgttgcctgggcggcgtttgctgattcggctgctgctgagccgaattaatagcattctgaggaggtagaaacatagatgcaaccgggtcttgtgttatctgagtcacattcggtccaggatgctgtgattgctctcttaccaatatttgaggattgactaattgacctgaggccgacgacggcactgcaggtgctggagccgatgctggtaccgtcggctgagctgatgatgtaacaggaggaactccctgagtaagtggatgaacatcggtaatcaaagtccgataatttggaaaagtacccccttgcaaataaactgggcctgcagcctgatgttcagctattgaaccatcggctaccgatttcatcatatttgacaaggtattagttaatactccagattgattgatcaaagcattatacacggcatagtcaacccgatcttgaaagttattgaaaaaatcttggaatgcattgtcattctgattaagatttcccctttgcggtccctgagtgccgtcaccttgaactccatgtacttc

SEQ ID NO: 16697 - DNA, 1501 bp, Oryza sativa
aagccaaatcggataactggcatcagtcaaactcaagctgtaacacttattcctcattttcctgaacctttgaatatactcaccaccggctcatcatgcttttgcttgattgacgtgagatcagacagtttcatctcattaatcccactatagaaataactatgaaactacttttctaaatcggcccaactattaatcgacccatgcggcagagaagaaaaccaagtaaaagccgacccagccaatgacaaccggaataacctaaccctcaaagcatctacaaccgatgcctcaccacactgagctaaaaatcggctaatgtgctcataagtcgatgtagtgtcttgtcctgaaaactttgagaaatctggtgctttgaaccggttaggtaaaggaactctttcaaaccattcaggataaggttgtcggtacaaatttccagtctcttttggtttaagcccaaattgctccctcattacatcagctatcacatcagcccatggtcgctgctgaggtgttccttgaggttgttgtggtgtgggctcaaactggttgtaaaactgaggttgaactgatcctgcctgttggtactgaacttgtggtgatggaggttgatattgataactcaaattgccccctggtaattgtgaaggttcggctgaataccacgcgccaaatgctcaggaataacttgaggtactactgaaccatctggttgcacatgatgaaccaggtgttccgggacaacctgatttgtagtgtactgcacaggctgaccaccaggcattgcaaatccagccgacgcgttcattgaggcttgctgctgaatcggctgaacgacctgctgtctcaacggtgtctgctgaatcggctgtaaagccggtcgtcttggtggcgtctgctgaactggttgcacgacctgctggattggggatgtttgttgaataggctgcacaacctgttgcctgggcggcgtttgctgattcggctgctgctgagccgaattaatagcattctgaggaggtagaaacatagatgcaaccgggtcttgtgttatctgagtcacattcggtccaggatgctgtgattgctctcttaccaatatttgaggattgactaattgacctgaggccgacgacggcactgcaggtgctggagccgatgctggtaccgtcggctgagctgatgatgtaacaggaggaactccctgagtaagtggatgaacatcggtaatcaaagtccgataatttggaaaagtacccccttgcaaataaactgggcctgcagcctgatgttcagctattgaaccatcggctaccgatttcatcatatttgacaaggtattagttaatactccagattgattgatcaaagcattatacacggcatagtcaacccgatcttgaaagttattgaaaaaatcttggaatgcattgtcattctgattaagatttcccctttgcggtccctgagtgccgtcaccttgaactccatgtacttc

SEQ ID NO: 16698 - DNA, 942 bp, Oryza sativa
ggaagtgtttatgatgactttatcaattaagatttgtcgatctagttgcaggaagtgataacattatgggccgtacgtgtggctacagattgggccgctccaaaacccagactccgggcggctccgtcacaagccacgccgccgccgccgcattgccctgcagctccgctcccccggtctccgcgcgtccgccccgacgctccgctggcccttccctcgcttgctcgacgccattgccttccggccactgccttgtgccttggcctgttgcggctcgtcggcgccctccgtcgtccgccacctccgtgcctgcggctccgacgtattcttcttgcgcgcggacgcctggaggacaggtaataacaaagctcttccttctcccagctcctctccaactccagtggtgctggtgctggtgctggtgctgtggcggtggctctcccacatgtgctccatttgatcttcttctctttttttttgtcactgaaacatatagcttactgtatttaaagaaaatctctatacattgtagtgggacgggttcagcatcggcaattaatcgtgtctgatagaaattgaaggatgatgaagtttcatggttactttcctttattcatgttttcttctttggcaattatacattgccgactcccactgcttccagtgttgatagttatgccatataccgcttaagcccaacaaaaaaatgaaatcattatttatgttgtcaattaattttgaaaaactgttactatgaattattatgccagatttagattttattgctcaaaataaatgcttatggttaatcaatagtacagaccacagatagagagtagtacaagcaaatccaattatcaaaggtttccttaaaaaatggatttcagttgttctaaattgaaacaagggaacttgtaccaggacttcaagatttagatcgta

SEQ ID NO: 16699 - DNA, 491 bp, Oryza sativa; identical to SEQ ID NO: 16523

SEQ ID NO: 16700 - DNA, 1501 bp, Oryza sativa
tgcacatcaagaagaatacattgaaaatgcactgtaatcttcccataagcttgttgtgtcctatagacctatacaatcaagctgtgcaattcatcgattggatgaagtactgaattgccactgaaatactctctcgtagaaatctaatgtttccaaggtctgaaatcaacaagttccgatattgttaggttatgcaatctaatgttgtaagcatggagtgctgaattgtcactgaaatgtgctatacatctaaaatctgaagttgtcaagttctagaattgataacttctaaaattgtcaagttatgtcatatgaacttgtgaacatgaagtgttgaattgtcaccaaaatactctagtactgaaatcagaagttgtaaagttctaaaattgtcatgtcatataatgttgtcaagttctgaaattgttaagttctaatttttttaatttctcaaatctgaaatctgaaactgaatttaaaatgaataatgaatgaagattagatgtcaagttctggtttctccctacttgacagccgaacaaagtgcaaaaagtcggaccggccatcgaattggtcgagcccttggtttgaccgtctggtcatgcagttcgactacagaaccgagccttcatttggtgtgaatattgttcactaattaggtgcatgggtggtccctaattggcttagggtgagtttgtttgcttgcattcctttagcctggcccatctctctcatggaatcagagtttaaccttgatgaggagatactgtttggttgtttccatctgtttagtttggctgggatgagattttgtttgattacttgcatgatagatactgttgggaagagattttgttttgttggtcgtatggcattgagcatagacctcttcatttagttgggtgagcttacctctacaatatcatatgacaagtttatattacctctactatatagcaatagtgattctccatataattgatttttttttcaattttcatagtgaaattggtagtaaaaaatagacttcttcaaaaacaagtttataagacgaaccggtcaactaatctgtaatttattacctgagaaaaacaaataaaaaagaaaaaaaagaaaaagatgggaggtagaaataaaggggatcgtctatagatggccatatggcccgagggcacgcccaaggcccggtgatttggcctggcccaggcaccgcaagactcgggtcatgcccgtgccggtccggcctaacagccgtgccgtaccgtgcctggactgctatctcggcacgctgggccagcatggcccggcatgaagtttagggatgtgaaacaaacttattttcaaccatatgtaaggcacggtacaaagaatatagtggagaaatagatatattatatggcatggcccaaagagtagggacgtacaatagacttattttagctatatatatgtcaaagcccaaagatgagggacaggaaatagacttattttaaacaatgca

SEQ ID NO: 16701 - DNA, 1501 bp, Oryza sativa
atcgaaattcaataaaaagaaatgatttatgaagtgaacgaattcctgcttcaaaaccactactgtttcctatgaaaaaaacaacaaccagagattctctaaaaatgaataagtctattttgtttcccttgactcttaatcctgattgaatcgccccctcaatcacaatactcggtgtaacgtcttccctatctttgaaaacccggtgcaaatcgagtccacggtatgaattcatcccgtcacagcccaattgaacccacgagaaggcgagaagcagcggaccattttgtccctcctattgatgttcggcccaatctgcaccgttcgctgggactcgaagttgatcggtccgttcgttgctgtactttgtttttcccttgcgccgggcgcgtctggcgctgccgtgatggccgctgcgttctccggcgatgttgacgcaagaacacgcggcggcgaactccgtaggatctccggcaagttgcgaagcgcccacacggtgtcctcgtcatcgctaatcgctatagcgtagaggagtccatggcgtcatggatgttcatccggtttgctcctcatccgcattttcttcgtgttcatcccagtagctctgctactaattagtaattaatacatttttgaagaaatcaggcacaatgttgaagaaacttggcacatttttccattgcataaaccgatgaacgtaactgaagaaataatatttttcctggttacagatcagcttccagatgaggatagcgaacttgctgaattttccagtggattcaaccctttatttttttccaacagttcaaaaaattacgcaaattgcctataataggtcggtatatagataggcgctagtttgtcaacattatggcggcgtattgagcttctggactggaaatttggctatttccagatgcacaatgttgtgcggttcatttttctcttctgactaaaacaaatggttgtagtatgttctgccggtaaagtctctttctatctctctcaagattaaccttaagacacacatgtggagattatggatatcccatatctacacggcgatgatatttggactgaatataggataccgaatatagatagaatatcttatgtgtatcctgggtttgtttcctaacttgtatatcaaggaaataccttgagacttagtcggtcacgactgtattccgttagggacatagattatcttttgtaatccggactccttcttatatataaggggggtccgggtgcctctaggggcagatgttgattttctctaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacagttggcgcgccaggtaggggtagcgtcaagcttttcgccgatcagtgcaa

SEQ ID NO: 16702 - DNA, 1501 bp, Oryza sativa
cacctgtcggggtcgtcgtcctcctcgcgccgccgcagccgtgccctagccgcgcgcaagccgccgccgcccttccaaattccatcgctcctttccatctccggccgaatcgatagaggggaaaagatccccgcgatccactctatcttttctcttatggaatcgtcggctaatttcgtttggaaatccgtggattcgagttcgattcggatcgatctctctcctccgaaccctagctttccatctcgccgccggtcgccgtgggctttcgcctccacctccttgcccctataaaaggacccccgagcttccctctacccgccgccaccctcgccttcgtctctcgccgtcggtagcaccctagccccgtgtaaccttgtgccgttgtcgtcgccgccgctccagccgtgcttcgccatcgctccagtcgccgccgtcgctcggggaggtcaccgtcgtggtcgccgtcgcgtcgccgtcctcgtccgcccctccgccgtcgctgtcgatcgccggagcaccgccgtcaccgtcgacccgaagaccgccgccgcttcttcctcgtcgtcggcgccgtccgttgcttttccgccgttgttttggtcaccggtgagttcgccgtgtcgccctctacccgttggtgtcctccgtttgcgtcgtcgagccgtcgttcgccggcgagcatgcgttgccgagccgccgccggtgttgatgtcatcgctgacgtcatcgggaccgtctgccgtggcccggtcgtggactgatcgatctcggccgtccgttttggataggatcgatctcggccgttcgttcccgtgagccgccgccgtgcacccggtccaccgcaaaccctagccgctgacgcaataattcccttttccttttcaaaaataattcattattgcgtcataattcaattaaaatccatataagtgttttaatccgatttaatctttaaaaattcataactaattcattgtaactcagtttaatgtggttcaagttgcaaaagttatataaaataaagatctacatattaaaattatccataaattgaattaaatttatttaattccttttaaatgggctttaattagatttaatcttgtaaaattcataataaattcatatgaagtcagaatgaggccgttcaagtctcataattcatctaaaatcatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcctaaacacaatcctttgaacatgttgttcctatatttaaattctctatttatttcaactgtgcatttattttcgaatgccattgggtggtgtgaatctattcctttgttatggcctgtttgcattgattactttattccttgataccttg

SEQ ID NO: 16703 - DNA, 1181 bp, Oryza sativa
ctgaaaaatataaacggttagcatttattctaccaccaagtgtgatacctcccaagctcctcgaggcagcatgtacgtaagaaaagacaccacacctttttttactgtgtactaatcaagttgcagggacaatagtcaagagagcaatgtataaactaattaaactaccaaaacagtagtaatcaagccgctatatataaattgtagcacattttttttattattcaggctgttctcacatcacgtaccttattcatctacactgaacttattaatcattttggtcccattgtgaaagatctcaagaacaattaaattcgcgtcactgcgtacccactacacacagtcgatcgagcaaagattgtgtccttttctagtggggtttggtggccattttttaccggccacggattcttggatcaggttcagaaaccagtggcgtgcaaatctgaatctttttgacctgaagaacaaaggaattcagtcagagtagggttgctttgatatgacctaaatgaatggagacttctaccagctggcaagtatacattattagccggtgctgtgcctaatcaaatcgcacgtagaaattctacaagtcatcactactttcacctgcatgggataactgataagattactccaaatgtctcatgcttacctttatcagtctgtcaatggtgtttttacaggataatgtcatcagtgggattagcacttatcagcactgtcagagcaaacaatgaatccagatttgttcatgaatattttaattggttacctgttcatgaatggattccctcttgcaagctcatgctgataattaagttgattcatggattaataacctacagttcctttgacgttatgtttcatctctccaagcatgtacagatgtgctgacattatatttcttcagctaatccacgtatgaacaattagggactaggctggtgcaccaacccctatgatgtggggctattttagacacatggggccgtaccaacacagatagtcaatttttttgcatttaaattactccttttttgtggcgcaagtaagcatatatagtagcttcagagatacaaagcatctgaattattagtacaacatagcccaattaaataatcaacccatcgcgatgaccgatttattacgcgtgcacggcatcataatccatc

SEQ ID NO: 16704 - DNA, 1501 bp, Oryza sativa
accgccgtcgagcatcccccggtgaatccgagccgttggctcgtctcccctcgtcccgtgcaacctcccggtgtgctcgctttcgcctgtatcgccatggttcgctccactgctcgccgccgtcgtccgccgtccgttccggccggtgtcgtcgtctacctcccgccggcccgcgtggcagccatgtaggcgccacgtcggcgccacctcggccgcgaccgggtcaagcagaccccggcccgccgcttccctccgcccctcgcgggcgcggtccaccgcgagccgtgaggctgcgcgtgggcacgccgcaccgcgtcctccgtgaaccgcgcgcctgcgccgcgcctccctccccaaaccctagctcgccccgcgtgcacctcgctcacggtgagccgagtcgccgacaagcgggtcccacccgggaccacgcgggatggacccggcccaccggctctctctctctcccctccccgcccgcgcgcgcgccttgggccgccttcttgggccggccggcccattaagctcggccgagccgccccattctctcgggccgcgccctagccgcccgtggaagtctaattttcctccctccttcttttcttttcttttctttttcaaaaaggatttaaataaatcctttttcctttagaccaaaaatccaataatcttagaaattcaatatcttcccaaccgtaagtctgtttgactccgttcaacttccaaaattcctcaaatctcgagatctatctaatggcacgcttagaggtcattaatagggctttattttcgccgtttgttgagttgtcccatttcgcgtgtagtttcggagcccgaagacccgcagtgcgaggatttcgaggatcaagctcaagatctcgagcaaggcaagccacctttgaacatcttgagcctatatttgaacttaattatgttgcttgaaaaatattatgcattgataggatcgcacttaatctgcttgtcccgtctgcaaggcagattggcggacctacctaatttgttgcatttgacccttccattgtaattgttataccatgttcccttgtacccacctagttgcgcctcggtaatcgtgcactctgcacgggtatcgacgatcaccttcaaacttaaaatctgagaaacatcttgggtaaaacttgggttttacaaaagacttggaaaacccgacacctgggtcggtgcttgcgaactaaatgaatttctaaaaccgcggaccggggaatgtaccgggtgtacggtttcccgctcttgcacttaaggaccgtttccttggaatttcatccgaacataagacaagtacgaccacatgggtggaatgggacacccctggctgagtaactagcttatcgggggagccatgatgctaagagacatgtggattcgccggggtggtgtcggggaggacccctgggcttcctggcacagtatggtctgggacctaatctggtgttggtctgggacccctctcgttggcata

SEQ ID NO: 16705 - DNA, 1501 bp, Oryza sativa
cctcctctcgtgcacgaacacaagcacggccaaaacagaaagacaaccaactcagcaaccttatatgcaactcaacaactccaaaaccgaccgacaaaaacttctggaaactagaaaagcgaaatcccaacaacaagacaattccattttcctaggtcccgacgacaacaaagacacggcgggcggcgacgactgtggtacaaaacgtgaccagaactcgaaactctaaacgaactagacgctatgaccagcaacacgatgtgacgatgcaacacaaaattcaacaaatcaaaaactgaaaagaacaatgcaatggcacaagtatggctaggtaaaggatgcaattctttttttatggcaattttctggttatgggtagataaaaactcaccgagtaacgaaagctctgataccacctgatgaaccctgagttcctctcgacactcaaggcagttgtttggcgcgatctttcggtgagttgagataactacgatttgggagaaacgttgacgatccaactacaaccgtacgagacgttgtgttgcgccttagcgatcgatacacctctccgtgggttgttgatcttgccgatgcagatcaaccttattcctgcaagcaaatcgaagaaacaagcaagaagaagataaaagcaatttgaattgcaaataggaatgaatacacaagataagttggggtttcgaatacaagcagacggacggtctagccgacacgcgcgctgcaaggaagtagcaatggctaaactttcatctaaacaaaacccaagaaaccctgaaggggtacctaactatttaagaaggtgggaggacctctaggtcgtcctctacctggttggggcgcaccccacatgggccccacttgggccagggtcccaaacgaaattacaagcccataggcctattacaggtgacgcaacaccttcttccatcacgactgtgaaggaatttggcaatgaggttagatccgtttgaaagaggactccgagagctttccatcaagtactcacgggtcaaaaacggatgtcgtatgaatattcggcggccgtttgaagttagcagtgtagcaggtggccaaatcggattccagcacttggaggacttgatcttgatagcatcttgttcatctatgatgtgagcaacgattgtatccgtagtagtcatggtcacatcaggtattatagtctttttcttctaaccttagcacatgctaaacaacctagaatgacaagtattatgtgacggagatagttctaacaaacaagtggttgcaattctctatggattaaattggtctttttatacgcacgaatctcaaagctcaaccaatggctgatgcaccatgtgtcgtagtaacacggtactaccgtgtgaccgtgtccctaacctgtggagtgggaccccgcaacaactctcgcaccaaaccacgccgccgcccaaaccccccacctcgccggcgctaatggcggcgccgccgccggctctcc

SEQ ID NO: 16706 - DNA, 1256 bp, Oryza sativa
cccccgcaaaaaaaaacatataacaaataaatcatattttatataataataataataataataataataataataataataataataataataataataataataataataataataataataataataataataatgcaaaaatcttgaaacttatacatatacttctatgtcgtataaggatgctataaaaatatcataatttcaaacttcactcggataagttagttgtcaatctttaacatctataagggtctttggtattttttaaaagaagtatctggcccaacttattaatcgcatattatagaaactataaactcaatgtaatatatattagagaaagtaacaatatcattgattcattaatgttatattacagaaaggaatattatcagtgacaaatcatggaaccggtgaaaatcagtgacgtaaaataggtcgattttctctaaacatgtataattatatacacgtatatatcttttgatgttcgatcactattcattgattatcacctagtgccgtactgacaaattcttcatgtactttggaggcgtgtaagaagagagctcatcactgaccgtgcatccattgtagtagatggaatagtacttgagccttttagacctagccttcatgtgtcactgtacagatcactgcctagctttaatttgctcataattgtttattctctgtacaagttcttgatttttttttatttttttctgtatgattatatatatattcactgtatccaaagcgtacatttttcaacatttgcacttccattgacctgccacataaattctactcacgtacgtacctcgagatgacatgtatgtatacttgcagctaattaatttcgtactggatcaactgttcatgcatgcacaaacaagctaaaaggtcaaggatactatattatactaggcttggcaattcatgcctgctctgctcgtatacgtacgatactgccgtagttgcatcgtattcttctccgacggatacgtatatacgtaccccatccgtcctaaaatataagtatttttagactttgacacggtctccgagatgctactttaaccaataaatatctataaaagtaagatattattaataaaaagagttacatattataattgtttgtttaatgataaatctagtaacattgatctttttttttgctattaatagttaaagttaaaaatgcttgacttgttattgtgttaaaaatgcttatattttgggacgga

SEQ ID NO: 16707 - DNA, 1501 bp, Oryza sativa
  unsure (1)..(1501): unsure at all n locations
aaccctaatttttcttcgaagttatcaaattttgaaaattcaaaatttgaattgttcaaatgaacttatttgtacaaaggaccgatacaatagttgtagatctcgatgagttatacaattttgttgtttatgatttttgatggttgtgtatgtgaatgaatgtatatgaaagggggatgttggggtgtgacatatcccagcctagggcttaaaaggattaatagaatactcataccaacaagttacaactactcttccggaagccgatctccaaagaactttgatattaaacgtgcttggcatagagcaatttcgggatgggaggaaggacaaaagaaagattggcgtgagagaggtgggacggcatggcaaggctagccaaaaataaaaattattttttaatttatttttttttgggattatactcatctgtgacgggcattaacttaggcccgattgagatgactcatctgtgacgggcattaacttaggcccgattgagatgactcatctatgactatgacgggctaagttaatgcccgtcacagataagggtcatctgtgacgggctatattttaggcccgattaagatagatcatccgtgacggcctatagtttgacatgtcgtctgggtcaaagctatcggtgatgggctttaattagggccgaattaaaaaggttcaatcgcttacggccggtntgtcggaattaaattacttttcacattagtgacttctagcctgtgacggacgccgtgcccaattgagatgggggttgccgcccgattgaggtgatggtatcctttctagtgaaataaactacgataaaaaagaaataactccaaaattaaattttaaaattcaaaattttcttctaagcataattgtaagagaaacaatttggctcggagtttgaatcgattagatatgtaaaactaagattcaactccaaaataccttgttggtgtccttgacattgtacaactaagacggtgtttgaaattaatgaaaatagagaggatacatgaattgagaaagtcattagcgcatgattaattgtcttttagttattacaaacttgaaaaataggtttatttgctattttaaagaaacttctatttagaaatttattttctagttttaattaattttttttcatttttacaaactccgataaaatgattacttaaaaataaacttattttataacaaaaggaaggggctagaatgaacttattacaggacggataaaatagaaatcactattttttctatttatttttcatttagtctataagaacaaagtcatgcttaactgattatagataaccattaaatttgttgaggggcgttttatgcataatttagatctgttgggttctacatttttaaacatcatctattactgttgcttgatctttctttttcccatttcatatatgcctaaggatttttaaataaacaatacaacatttatgtaccccgaattacacagtatcca

SEQ ID NO: 16708 - DNA, 1105 bp, Oryza sativa
  unsure (1)..(1105): unsure at all n locations
cggcgcaaggtggctacgcgcgttgacggtgncaccgtaatgacggcgcgcggactgggctcgggcgggttagcacataggtgggagaggagggggaaggctagggtccacatcgaacacttacgccataatgaccagtgtatttttctatttatcccgattttagtttattttccatatgaatttgattctacaattcctaattttacatatatgtattttactcaatatttgtattatcttaactaatgaattcaccctagattaatattactcatattttatttttatataatttatttgagttttaattagggttaattcttattccatcgtaattaaatttaattgatccaaatatgatcgcgataatattttatttattactatccacacccaatctttatttttaatttatatttattttaccaatttgtttttaaggtttattcctaattaactattctttactcacgattaataatcttcgagatcaaatccagataaaatagacgaataagattggcatgatgcaattagtttaaaaagtttttgaaaatccgtatttttagagttttgattttgtcgatcgaattttcagggtgttacatgtgtactccacccatcagtgtttatgtcacagcctgtacgaataatatacttactatggtgactttttaaatgaaatttagtgagaatagtgatttagatcttgctcgatctattacatcgtgtgtcataaggtgcactcgtgggtatgtcgcatacgtagtggaatgtgcaaagtatgccttatttgtattcgaatatacataaatcaagcgatttcatattttcaaatgtcataaaattagaatagacatacaattggcgctaatattatggatttgttattcgtgattcactgaaatattctctatatatgtttgcggatcttagagaaaagaaaaacaattatgcttcgtcattgataaaaaaattaaaatcaaaatacaatatcaactatggattaataaattgaatattgataaactctcatagaggaaagcaccctaagaaaaactccaaaaacttgagcttggcaacttgggcgaagctcaaggta

SEQ ID NO: 16709 - DNA, 1501 bp, Oryza sativa
tttttaatatcaaattttagttatttgtaaattatatatattcctatatgaactctagactcgtcttttaatatttttcttttttttacttccgaattttctgtaaattgtatttctatattaactctaggctcttcttccaatattatttatttttatttctgaatttttattatttctaattgtatttctatgtgaactctaaacttatctttcaatattctttaattttttaatttcaaatttcagttacttctaaattgtttcctatattgactttaaactcttcttcccatgtttttcttaatttcgaattttagttatttgtaaattgtatttttatacggactcaaagctctacttttaattctattgtgtttattccgaattttagttagttttaaattcctatatggactctatactctacttctaatattctttatttttaattctgaatttctattatttcctaattttatttctatatggactctatactctacttctaatatttcttatttttaattccgaatttcagttatttcctaattgtatttctatatggactctagtctcctcttctaatattccttattttttaatcccgaattttaactatttctaaattgtatttctatatggactctagtctcctcttcaaatattccttactttttaatttcgaatttcagctatttctaaattgtatttctatatgggtcctgctttttctttttctccgattaatgcgagaatttctaggccatgagaacgaacgtggaggctcctttttctattcctttaataatataatagataattataaaaaatatatgaaaaattgacggtgtagaccagagttccatctattactctatcgaaaatcaaatttaaactcgatctatacattaagaacaaaagtaaattcaagtgtaaatagtacaaatactgttcatttgttagatttgtttttttatttctccatgtataagtagagtttagactaaatatttattggatagtgcgctattttttaaagattttcttataacagtttaagtaatgtgtttgaataaacgagatggcatccccgagtgattgaaagagtttcctctctcttcagagtgtgtgcggttgagtggctgtgtataaattcaggcaagtatggttgctccctctgtggtggcctggcctcacaaagtcccagccagtttgcagcttattagagagatcaaagtggaagctatcaagcaagaaaggaaacgcctacacctactcctggcccctgccccccaaaacttctcatagcttcaaatcaactttttctagctagcccttcagcttcaaatcaagcggcagcttcatcacatacacagtgatctgtggatagctaatgagagcaagcatctagagtatcttgttcttgattccttggccgtctataagcttgtgtgtgcagcatcagctagcaacagaagcagcttcagctcagctgcaa

SEQ ID NO: 16710 - DNA, 1501 bp, Oryza sativa
ctcggcgaccatgtgcacgacgatcgaaacgcggctgacgacagcaacaaacgcggccgacgcggggatgaggtcgccgcctagcagtatggagccagccggccggtgagcacgttgcccccggcggtacatgcaaaacaaacaacagaaattgattagcaccgtagagaacagatgcctatatacatatatacttgctataggcatgcatatatttgtgatgcaaggtctgtttgcatgctcctgtaatccagtcatgcaatgatcgttggcagtgcatgcattagattggtcagaaccaatttgtacgcttgctctggccattgtgtggtcgtagcatgcaccgtcgacatgtaggccaggtgtccgtgtcgtgtcgatgggcggcgaacagcgtgaggacgacgatggcttcgaccagtggtcccgccgataaccagcaaacaccccagccggcagtacatgtaaccgaggggaaaacatatcagagaatcaactgtgattatagatcaatctgataataatatattgaaacgacaaaccaattgatgttttgggtcgttgaactcgttgagattaatctcaactcttcttttggaattgattccatcgcgcttgtcgatggaaaactcgacacaacccctacctggcgcgccaactgtcgaaacatgaattcggcaataataaaaggggtagcggacgagacctaaaagtggatggatgcggagacaaaggatttagacatgttcaggccctctctctcgatgagaggtaatacgctacttctgtttggggattttaatccgcagggggtattatagatctgacgagatctagttgtctcatgccccctagagggcctcctgcccaccttatataggatggggggcaggattacaagatagaaaccttaaccaatacggtatcggtttcctaaatctattttacaatattatcaaatcaggactttaggccgctccataatataaaaggaaacgtaatacccaagtcatgatctgtacatattccacagatataagctatctcctatgactagtcgataaccatgccgtgtgggtattgggtacccataatctccacaagtctttatctctcctcaaatttctgtgtttttcctgtggtccaatcaaacggtcattcctatgttttttctgtgttttgcaattctctgttttacacttatattcctgtcagaattctatatttttcctatttctccgttttttcattcctgtgattcaaagagacccttaaattttggctgatcccatgattagtattctggtgctgcgttgttccgaatctcaaagcggcactcacgtgcgaagcaagggccaaaagcccaaaaccttctagaacgaaccgggtcgtctcctccaaaacccagcaagccaacaacctcagtggagctcacccttatcccccccagctccagaaccttctcctctctcctctctcgctcgctcgcttctcgcggttg

SEQ ID NO: 16711 - DNA, 1113 bp, Oryza sativa
agggtagaatggtcatttcattcataccgctgtatgcgaggatgacttgacatgctcacgtggcactttttgtgggtccaaggactatattaacccaaataattaatttagaggacttgtttggatatttaaaacatcaaggactaacctgagccgaagtgaaacttcagggagcatattagctattcacccaatttaaaataaggaatattagaagtagagtatagtatccatatagaaatacaattaagaaaaaaatagaaattcggaattaaaaaataaggaatattagaagtagagtatagagtccatataggaatttaaaactaactaaaatttggaataaacataataaaattaaaagtagagtttagagtctgtataaaaatacaatttacaaataactaaaattcgaaattaagaataacatgggaagaagagtttaaggtcaatataggaatacaaatatagaaatacaatttagaagtaactgaaattcgaaattaaaaattaaagaatattgaaagataagtttagagtccacatataaaagcaattagaaataacaaaataatattgaaagaagagcaaacagtctatatagaaatacaatttacagaaaattcagaattaaaaaaaagaaatattaaaagacgagtctagagtacatataggaatatatataacttacaaataactaaaatttgacattaaaaataattaataactaacacgtatataaaatataatatgaaaaattcagaaataaaaataaataatattggaagaagagcataccgtctatatagaaatacaatttacagaaaattcggaattaaaaaaatattaaaagacaagtctagagtacatataggaatatatataatttacaaataactaaaatttgatattaaaataattaataactaacacatatataaaatataatatgaatattacacattagtagttttgtaaagttactgtaaaatttaaaattatgttgtcattttaatatatttgaataatacgatgagaaaacatatatgctattatatgatagaaaatataatgatgctagccgcgcaatctgcgcaggccaccatgctactt

SEQ ID NO: 16712 - DNA, 719 bp, Oryza sativa
ggggagggatggggagggttagggttagggttagggttttgataaggctgtgggccgaccgggatggaaataagtctattttaggtccctcgggctggaaataagtctatattaggtccctcgggccgaaaaaaagagaagttcatttttagtgcttcattttttcagaagcatttacaattatagttattgaatgtgtttatttctaagcaaacctaaaaggaaggattttctttctttttccaattaaataattattaaatgatgtttgtattattaaaattagcaattaagctctgaaaattccaataaatttccaaagagcgtaactaatcatggagaatttaataaaattaaatttaacaatgtcattttatttctcacactttacttgtaaatttatttaattatacacatacctccttaaaaatactaaatatttcagcgaatttgtattttaattaattgcatattttttctgatacgtgcgcttcccggtgcaatacacgggtacttttgctaaaccaaacaacaattttggtcaatatacacactccgtaatcacccggtacaacgcacgggcacttttgctagtactatatacatacgtatagaagtagtagattagatacagagagactagagaaagagggagactgattgcgcgcgcgcctccctgcgcggctgatcgcgtatcagccgtcccgacgtttggtagg

SEQ ID NO: 16713 - DNA, 475 bp, Oryza sativa
agaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatcttt

SEQ ID NO: 16714 - DNA, 474 bp, Oryza sativa
gaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatcttt

SEQ ID NO: 16715 - DNA, 1501 bp, Oryza sativa
tcgcgaggagcagaggacggcagagaagcggtggcgcgggcgccgggcggtgggcgctggcggtgcgcggagcgcgatgctccgccgctggctcgcggtctcgcgaagtcgtgtgcctgtctctctcctctctagggttagccactatttgtgttgggctggaaatttagggatgagttatagactattgattctatgggcctttttaactttggaaattccgaccgattccgagttccgatggaaactgctattatcatattcaattccgtttccgagaaaatatttccgttttcgattccgtttccgagaaattccgaaaaaattccgactggctgattccgtttccgaaaacaggcccggaatccagaaagtttccgtaccgttttcacccctagctggtggtggcgcgtatggccctcctccccctcacacacacacactaacgacacaaccgctggtagagatatactccatccattaaaaaaaaccaagctatgcatggatgaaacataatgcatgacagcgattctgaatatgaacatgtctagattcattttcctaggttatgtcttatccatacataggttagcttttttgggacggaagaagtagagtgttgtggaaaccatcggataaaagcaatctgaattgcagataggaattgaacacaaataataagttcagggttccgtaatgagcaaaccggcgatctaactgatcacgggattatacggcaaagtagcaaagctaaactttaatctaaacaaaacccaagaaactctgaaggggtacctaactatttataatggtgtgagaacgaccaagtggattctagggtcgtgctccacctggttggggcgcaccccacatgggccccacttgggccagggtcccaaacgaagttacaagcccaaaggcccatgacaggtaacacagcaccttgtttttgtgtttgcggccaaacgatatggagtttggtgatgaggctggatccgttagaaagaggactctgagagctttccatcaagtactcatgggctgaaaacggaggtcgtatgcagattcggtagccgtttgaagtcagcagggtagcaggtagccgaatcggattgcagaacttggacggcttgatcttgatgtgaacgacggttgtatctatagtagccatggtcacatcatatacttatgtgtttgagatagattaagatgaggagcttaagattaagaaattcgctagtgaaaatcaattttcacagccaacacttttgactcaaccgccagccaagagatatttttagccaaaaaagaaaataaaatccattttcatgacaaaaacacatcaacttttcaataaaaacatatttaaatcactccagtgacattcaaacaccaatagattagcatcaatagattatatatggacaaacaaaaacacaaaccactaaagaaacctagataggtgccggttgtgaaccctataggtgccggttgtgaacct

SEQ ID NO: 16716 - DNA, 490 bp, Oryza sativa
tacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagtcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcag

SEQ ID NO: 16717 - DNA, 1288 bp, Oryza sativa
  unsure (1)..(1288): unsure at all n locations
atggcgatgaatcagagggggaggcggtggcggagtgcggcagcgcgagcgtcaggttaggggcggcaccgatctgggcgacggacgggacgggggcgcgggcgcgctccatggcaatgtgcagagggaaggtgtgggaagaggcagcgattgatttgctcgcatgcgtgattttcggccggtcaccccgcgtgcgcgcaatctctctcccacagtgtgaccccgcgtgcgccggtaccgttggatctagaagcgttggatgatttggaccgttagatttgatgaatgagtaatgtaggtgtaagagtgagttggtgaattatagggtagatagactatagttcgatttttatattttcctcaattttctactattaatgtaggattttctagacaatgagagtactaaacgtggaggcttctttttctattaatttattaagttaatagatttctagtatttattaaagtaccatgtggtaagttaggagcgtttgtaggagtgtcatatggcggtttaggattatttgtaggaagtttaatggatttctagtatataatagatagatagactagttttcacgagccgagctaagccgaatcggctcgttagccccccttacatgcgcgaggttgatccgacagctaatggcagtggactgagatctattatattattaaaacagccttgaaaggaggcaccacgttcgctgtggaggctaaaaattcccacattaatcatagaaaaagaaaagaagaatccaaatagaaatccaaatataaaaatagctaacattcggaattaaaaatatgcattattgaaagaggagtccatatagcaacccaatacatgattaattaaaactcggaataaaaataaaataaattttgaaattagaaaaagaaaaaaaaacaagagttcgagaaggaatacaatttaaaaatatcttanattcagaattaaaaaagtccatacaggaatccaatacaagattaattaaatttccgaataaaaaaataaaaaacaccgaaattagaagaaagaaaagaaaagaagagttcaagtaggaatactgtcagggttattgataccacatacctaatagtagttgactaaatctcggcaggacccaccacataccatgtcttatacggaaaaaaccttcggatataggaggagttccgtataaggaaggatgaatagagttctacatgaaaacgacaaggactactcggattgtatctatattggtttccctagttctacttagacaaagggacacctatg

SEQ ID NO: 16718 - DNA, 403 bp, Oryza sativa
acttcccgttcaaaaaactttaccttttacctgccctcaatttatgcacaattaatgaatgccacctgggtggaagcgagaggtggaaatggaaggtcttatttcggaggtggaatctctacctgatagttgcattgccattcatgatgatcccttggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaaccatttgttgctatctaaattccatttaaggcggtcccttatcgcccagcatcatcttattctctatttgtattc

SEQ ID NO: 16719 - DNA, 1008 bp, Oryza sativa
aatgggtcccagcaaaattttttaattctaatgccacgtagacgccacggtggaatgaataccatgtcaacaccgccacatcagtgccatgtcagcaaaaccacacttgaaaaccactgaggaagtcaaattacacggttttaatagttcagggagtcgttctgtccggttttgcggttgagggtcacggattagattcacgtcacttttaagggagtcaatgtggacttattccttttcagtatatgaaggcatgagactattaatttgaatgcggcccatctggcacattcccttgcatggcccagcaactgatctgcataccggcccaacagttcattcggcccaactatctgatgcattatatatttattcaggaagacaacgcgcatttaatttgcacatctacattccttttagaaaatcctgcacatctgaagaggaaatttattctcatatttgaataggtgtatatccaaaataaaatggcatacaataaattgtaggaaaaaaaaaggcatttaatgctggagatataaaatggaattaataaaccttacacatggaaaagcaataaattatacaaagatttgtgaaggcataaatgcaaggacacatcatcgtaagatttggttgtgcccctatataaacatgagcaaaggggcacaacaatgagcacagtgaaactgaagagggcagatacatacaaacaagagctcagagcttgtttcttcagtgatctctcctaatggcagctaccaagaggatggcttactccatctcggtggttttcatgcttcttttgatcatctcttccaccttctcatcctgctacgcaggcaagcatcgatcccaattcctcacccagaaatttactgtcattcagactaattgctatgtgtgctgtttgatttgagtggttcatgatgatctttcttttcttgaaaaaagaaaacagaattgcgcgaatggtggcttatgatgcttcaattgtgttgcatttgcagc

SEQ ID NO: 16720 - DNA, 956 bp, Oryza sativa
tatgtcctaaccaattttattctaggttattatatatggggacgaaaagagtacttagtacttcacgtggatggagaatagtgcgtttggatgttgcaacctgtttattcctagtattgggtgttcgtgttgtagacgcttggcgtgactgtttatttcccgagttattatattgtattttttctgctttatccataaaatacgaatatatagctctatttttttagggagtattttgggggagggagtatctcccggtgaccgtgaagaaaaccaaattggtcgactcttctgtcgctgttactaatcattagaggtgacagttcaggtgttactttagatttcagcggagccaccgtttcgcttattttagcgaaacgacatatttataaacggaaagtaatttgtaaataaaacttttatatatgtgttctcagcgatctaaaaataaagactgaaaaataaacttcgatgaaaaaaaccttaaaatcagctttaaatttaaagttaaaaattcaaattttgaatgataagcataagcataaacgaagatagtccatcacccagattccattgccggagctaagcacacgtgggaaaaggcgtcgtcctccaaacaagcaaaaaaaaaagaaagtggtccacgtggactgaagccattggccaggtgccctcatcgatcaatcgcaaaatgcctcaggcctaagaaatctctaatcctggtcctaaacttcacgagcaagtcactcggcatcccggaagattccagtaggcgcggacacaccaacgcaaccgtcgccaacgccgccgcctccgcccggctcgggtcggaaactcggaacccggcgcgtccgatcgaagcttccgacctcctcgcccgcgccgacccggccacgtcaccaccacccggtgcaataagaccctggtcggcgagcgagttcgaggcaaacggcgcc

SEQ ID NO: 16721 - DNA, 975 bp, Oryza sativa
tcaatgtaaaggagactaaataagataagactcaagtaaacattagtctcacacttatataacaataacatggaaatcatatatatgaacctatcaaaaagtaggtgataagaagtgatacatatcgctttatctccatgaatttcatccttgtcatgattaaggtccatcatcaaagaatgcatatctaccacatctcattatcgggaaataaccttgttgaaaacttatgtaaaagagaggttaatcccataaacatcggtttatcatctatcaccaaagtaacaattacacaaattgtttaatccaagatttttcaatcttttctctcttttgtgatagataataatccgatataaacaatacaaagagatgggatgaaagataatttcaaatcaaagtagagatcttataatgaacaaaatatagaataagctccccctaaagatgtgcatacatatggatatgaaggaatgcatatgcacataatcaatcaagatcaatgagggagctcacactatattttggatctacaagagagaccaagttagaatatgtgaagtttaatacatacctcccatcatttttgctttcatatccaaataagactagtcaaagaaaggctcataaaaacgttagtctcatataattagatttatcattaatcaccgaaaccaaattaagtcacttgaacttacagttgcttagttaacgtcatctgtacatcatgaactatggagtacttgataagattgatcatggatggaattttcgacttttaagtattattagataatggcaaagtttatcactcataaatgagggcatatacattttttaccaaatcatgaagaggtatatgctctcccacgtaatatggttggctacatgcatgcatgcatatatgcgtgaataattgcatgtatacatgcatcatatcgagagcagtgtgacacgtaggtttattatcatggt

SEQ ID NO: 16722 - DNA, 489 bp, Oryza sativa; identical to SEQ ID NO: 16613

SEQ ID NO: 16723 - DNA, 1501 bp, Oryza sativa
cgtggtcgtcgccgaatgttcggaaggccattctctctgagcaaggcaagtcacatcatccttgagcatattgaatcccagtttataaaattattttgatttaaattaatgcattatctctttatttaaattcctgcgttatcactgttttatttagccatgcctatttacctttgttatgaccttattattatttctattgttattattaccttgttcaccctaggataaacaaaaccccaactagtgggtactctatttatggttccactagtatgaacttaggtagatgcttcgctgattaattaggcaacattaggtggttttataactttagactttgggaattctcatatcatttagacactatggactggttgccttatgttggaattggacacacacctccccctctattcaaaacccccaaaatggttttagcctgggctcgaggtgcgtggttgggttttgttagtcgtacctcgggtactataaggattaagctcaggcctctattgcaaagcactaccatacttccacatgtctagtgggtaaggctaagtttgtggctcagtttggtcataaacaaaggtacacggatggagatggacgaagtcggggctcgatggacatctctaggacaaatgaaggctacacgagctgcggctcggtagttgagatgtcatggcacagggccggtgttctgctgctaggggctcaatcctacctacctgtctcgggggttccagccgtaggcggggttgggtcggtactcttgtctatggctaggatgggttgggaactatgtcacatcgtccgtccgtatgccgtggtggtatgtggcacgtggttacacgtgaggaagacgtgtcttgtgggtaatgatgtacacctctgatcagagtataatctatgcgaatagccgcgccctcggttatgggcaagcctagcaatgtactcaagttagtgttttaattcttaaaaccgcttaacaactaaaatgtgaaatggttgggctgggttggcttgggacgagctgggacctgggtctggtggctagttcggtctgaatcatcgtaggccttgggttaaggcaggttcgtgtgggttcacagccttgattaataacattgtgtagctctagaatcatctttacaaaatagctttgggcaatgaagtaacttttaaatgttgtttactgcaaaacttaacccctattattatccccttgtacccccttgcattaatcatgcatctgccggtgtggcttgctgagtattgtggttgtactcattcttgctctatctttacccccttcagtaagagaagctttggagaagaagtcgtaggtggagtcctggcttataccctagttgagcgcctgtgaagatggaaccgtcggcccgctagtccgctgctgattatttctgtttgtcaggccttaagtgcctttgtaataatgtaaatattatcgatataataaagatgtgccttttgtatc

SEQ ID NO: 16724 - DNA, 491 bp, Oryza sativa; identical to SEQ ID NO: 16611

SEQ ID NO: 16725 - DNA, 358 bp, Oryza sativa
tctgctgctctgatttatgaagaacacacattaattcatagtgttttagtttacatatagaaaatagattacatatggaagtcatctatttctacattattatttgcagaagagtaattcatttttatagaagagtttgttagtctttttttttaagaatgtctattgcttagttgaggttgcatcttgttatttcatttttctagaagtgttagctagtcttttttttttctaagaatgtctattgattagttcaggttgcatcttcttatttcatttttctagaagtgtttgttatttcttttttttctaagaatgtctattgattagttcaggttgcatcttgttattccacagg

SEQ ID NO: 16726 - DNA, 472 bp, Oryza sativa; identical to SEQ ID NO: 16541

SEQ ID NO: 16727 - DNA, 484 bp, Oryza sativa
attcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcgggtggttttttgctgaagcatttgttgctgtattaaatccatttaaggtcgaccttatcgcccagcatcatcttattctctatttgtattccctccatcttt

SEQ ID NO: 16728 - DNA, 1362 bp, Oryza sativa
atatatataaatgtgggcaatgctaaaaagtcttataacctgaaatggaggaagtacaaaacagcaaatagggaagggcttatatgtgccggaaactctatagtcggcacatatgagacgtttttcaccttttaatacaataaaattaagaagcggcacctataaccacttattggtaccggttcataaaaaaaccagcaataatagttccccaagtcacaagtgccagttcttcttataaagcggcacgtaccgacattatataggcgacggttcttataataaatttgcacccactagtgtggcgcaaaatgtgctggtttttactgtgaactggcaactatggacttcacatatctggtttactatataaaccaacatctatgagtccttaggtacccgttgacaattaaaaccggcacctataatgacgctacttatatatatatacatatatatatatatacttatatatatatacatatatgtatatacatatatacatgtatatacatatatacatgtatatacatatatacatgtatatatatatatatatatatatatgtatatatatatatatatatgtatatatatatatatatatatatgtatatatacatatatatatatatatgtatgtatgtatgtatgtatgtatgtatgatttttacctaactttctcatatgaagttggataaatataaagtttgtatcaaatttgtagaggtcgacgagatatacaactttgtgtagttgatgacattttgatttgtggttgtcaggatgtctaaaaatgtactataagttctcaaacctatttggaaaagtggatatttaaaatttctaaacaatctccaaaggagagaaaatctatatgaaagttatagatctatatgagatctttgtaattgacaaaattttcatttgagcacgtctatggtgttaaatatggattataagttttggatgagagtagcctcaaaattatttgcttctaagacatgtgtttttaggtgagatcgtaaggaggcttccggaggagagggaggtcataggtttgaacccttcttaccccgtgcgtatggaaatagtgttaaaatcttgggacttgtgggacttgagggaggtcgcacgtttttttttattatgtttgctcccactaggggtaaataatgagctagctcggcttgttaaggcttggctattttgagtcgttaggctcgttaaagagatctattcattttctctactattataaaattaaagatgtttccactagaattttggtacgtcaaacttgtttgaatcggttttaattttatgtttttgtcaaatccttttcttttttcttgcgccaga

SEQ ID NO: 16729 - DNA, 1501 bp, Oryza sativa
ttttattagtttgactgatttatttgaggtaccaaatttagttattaaattataccaaaattacagtgagttgtatgtgttgagtagagcctacatgaattttctcatgattttatcttgcacgaattattttagataattcgcaagacttatgtcttatatgtgtttccctttcctaaatgcatgtaaatgtttataaaagttatatttggactcttattaacctgaggtgatattgatatgttagaattacaatttaccttacacatgtcataagctccttacctatttatgcataaatttactttagcattaaattaagagaatgcttatagagatgattaagatagaatataccctatatgatataatttatttgttcactttcatgttcatgacatgtcttcagatggatgtccaaattagttttgtgaggcttgacattagccatgttgatatatttcaaggtgtatggtttctatttttgtgaaatcattatcatgattaatatttgtgatgaacaattggctatgcaaatgatttagttaaagaattggtttgagagtttgtgtgaatgttggtgtgagtacgtgtgactaatgtgggtcaggttgtgatatctgtgtccagaaacggttgttttgtctgattgtgtgcaggtgacttgagatcagccttggtcaatggtgaggaccgggactatgttcagggaggaacagaggtctattgcggtcgggataccacgtgagaaggtgactagagtctggattcttgaaggtcaacttcggtcaacggtggggatcgggacgagactcagggaggagttgaggtccagacggtcaaggataccgggtgacgaagttggatacgaaatggcatacggtggatggacaccgtgtgggagagatcttcgcaacgggcttcacgaggtgtgcgtgcaagcgtcggtgttcgcgaagggaattggaagaggtttatgtatggtgctacagtacggtggtgtactgtagcgtgcatatgtgtatgcgtgcttgtgtacagcatgcatatatgtgtggtatacgtgcaggtatgcatgcatgtacggtgctgtacatgtatgtgtgtgatcgatacatgcatgtgaagcatgtatgtgtgcatgattggttggccgagcagcaggagagcggctcggtggctgtggcttgttggagccggcccaggccgtgcggcgcgaggagaccgagtgcgagctggcgaaggatcggtaaaggaatccgatccggagcaggattttccatggccggtgcggctgtggtttcggagaaaaaggaaattgagagattgagtcctactgtgaagaggagtcctacgtctactttgattaggagggtttttcatgtataaatagagggggagcgtgaggattcctggtatcgcttttcggtatcgcttttcagagcgtggagttgatagtttagttagggtttcgagtttagtcgagatttttgtaaggagt

SEQ ID NO: 16730 - DNA, 1501 bp, Oryza sativa
ttcaccacttgcatgcatattagtcctggactcctagctatagaatccttcagtttagttgtgggccaaaaacaccggcgccaattagctagtcgcctatcagtgtgcacaagctgcaacaggatgtgagcggaacatatatggtcccatttatcaacttatcttgttctattattcgcaagtccaaactcaagtcactttccaaagcatgtgcaccttttttaactatcactactagaaaaaccattttcccaggcgggggaaaatggccttcccaggcagatgcccgctccacctggaccccaacacctgcgaagatcaacacggtcgggaggtccgcctgggaagattattttcccaggcggactagagctaaaggcgtccgcctgcgaagataggaccagtgcgtctaagaaaatttgacagagccgcctatttaattaggtacaagaatttgaaaaaaaaattttacaataataatttgtgataaataatgttccaattaattaattaatttatgcataaaaaatattagtaactagaaaaacatttgatactgacaaatataaatatattgtataagtgaaaagtgtcgtcaagatgttacaatatttataacattgtcacttcgaatacactatctagttgcattatcgcatcgtgttgttccactccggaagattcttgtattcttcgcttgtatccaggatactctctaggtcgaagaaccgtcctttgacatgaaaacactcacggtggatgaagtaacagagatcgcgctgcacatttgtaatagttgtatcgtcaatgcttattcgatgttctattctaggaagctgcatgcatgaaagaagcacaatatatatattagtaggttatagatgtgcagttctccaatgcacttatacgttgagtcgagagacttacatcctctgcgttaaccctgtatctcccattaaccctgaggaattcacatgagtaatacccacagaggaccgagcctctaggttgcttgtgatacttgatgacatatcatagaaggaaaaagttaaattttctaattagtaaaataattggaatacataaactgtgtagactattaccggccaatatgtatgtactagcagcttctcccttgtttgaatccgctctccacccttcttgtagtagttgtatgcacagtatggattttttaccgtttcgtattaaggaggagatttaattgtaatgcattaataattagacatgcaatagtatcagaataacagattgttggaaattgtttgtatgtcttgtgattataatcaagggggtcaaggactgccacggagccgtgctttgggttgataatgaaacatatgtaatggttgctacatggtaaggaattgatggtgtagttagtcacgaatgagataacacagatatgttaaaagaaaggaaaaagtacgaattacccccccccccaacaatcgcggtcgaccaaattacccctctaaaccac

SEQ ID NO: 16731 - DNA, 1036 bp, Oryza sativa
cgataatgtatgtctcgttttacctttgcgaggagaagaccatcaggcagccggttggtgaagacaaggtcgccaccagcaatgggggcagagtacaccagccatgtacgcaaagaagccagccagcggcgacgacagcagccgacatacatgcataaccattaccgatcaaaccattattagtaatctgtgaaataatctaatttgcgaaagaatttaaaacgataaacctggcttgtaatccaagatttttaatgcatgtatgtcatcagcggtgtatggcttgcttgatgaatcagagactccagcaaaaaggtcgctgcgtgcatgtatctgtctaggtagatcatgcacctgcatgtatggcttggacagaagtggcttgatcgatgcccttgtgcgacaattgctccaatcagctgggttggagtccatatcgattccgaaattgaatctcgccaacaaattttgatgtcgacgaggaaagacgccgatgcttcagagctttgcatgcatgttttctgctgatgcttgatctgttgcttgacagcacatggcgacagatttgatctcattgcataaaatagaattgacaggaacaactacttatggaggctcataatagctgttggcttcaaatcttttgctgatcaagaacaaaactcggtgactgacgtccggtcttgccgatcaaagaaaagactcggcggcgacggtgattggatcaatcgccgagattattttcccggctagatggaatctgagtggaagaagaaaagtttaggaaattggtcgcgggcgaggaagttgcagctcccgaagtgaagacaaagccggcgactcgtaaagttgattccatcgcgctttttgatagataactcgacgcaacccctacttggcgcgccaactgtcgaaacatgaattcggcaataataaaagggggtagcgcacgagacctaaaagtggatggatgcggagacaaaggatttagacaggttcaggccctctcaatgagaggtaataccctactcctgtt

SEQ ID NO: 16732 - DNA, 1204 bp, Oryza sativa
taattatagattaattaggcttaaaaaatttgtctcgcgaattagctttcatttatgtaattagttttgtaagtagtttatatttaacactctaaattagtgtctaaatacagggactaaagttaagtccctgatccaaacaccaccttagtactgtcagtattgcttgtggcgtacgtctctgctgggggaaaatcgttaataggaaatggaagttgaggggtggtaaaggttgttgtctattgtttgggtagtgagcgtgaaattatgttttagcagggattaggaattaataaagtttaatatatagtagcaaactcacctttttaatacatgggtagatacaaataaatggaaggaaattctcctgctaagaataacgaactccttataattcttatctctactaataccaagcaagggatgtggagaaaaataaaactccctcacaaccaatccctaccaaactcctaatccacttctcgtgccaaacaagctaaccgttggacaaatgtcctagctagtaaggccagtcacaatgggtgtttcatttgagtgtcatgcgcatttaatacagtgacaagtcagcaaaagagcaatatttgcatgaaatgggtaggagagagagtaaactcgtttcaccatggtgacacgagatagcgccgtttcccaggtcgctgaaacggggtgaaacagcattgagagttcatcgtttcacctccgggatcccgtgcgagcgctgctcttcgccatcttcgcgcgcatcgccggattcttcccgcgcgagtcccccatcttcccgcgcagcacctccatgttcccgcccccaaagcactggctcgaagctttttccccaatctcacctgcaaccctagcgccagactcagtccccatcgccccgtccgtcccataccctagcgcaagaaccacgagcggagattgcggagctggatccacaagtaggtggtgaatcctgtccatctgccgccgtccgccgtccagcagccatggatccacaaggaggtggtggatcccgtctgagcgccgccggcagaggagggaataagcgtgggggcaagcagctgggcctgaagaggtcgtcggcgcctgctccatcaccggcaacagctcagccaccgctgcctgcaagttcccctcctgaagctccatcgccggcaacagttcagccgcctactccatcgtc

SEQ ID NO: 16733 - DNA, 506 bp, Oryza sativa
gagtgtacctgaggtaccaatcggaccaatgcaattagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctcca

SEQ ID NO: 16734 - DNA, 1501 bp, Oryza sativa
tactcacaattgtttttaaagatggtgtatctattcatctatctattatattattaaaatagttttgaaaagaggcaccacgttcgctgtgggggcaagaaattcccacattaatcagagaaaaagaaaagaagagtccaagtagaaatacaattcacaaatagctgaaattcataattaaaaataagcaatattgaaataagtgtccatataagaacccaatacgagattaatcaaaattcgaaataaaaataaaataaaatctaaaattagaaaataaaaggagagcctaggtaggaatataatttaaaaataattgaaattcggaattaaaaataaggaatattaagagaagagtttatataagaacacaatacgagattagttaatattcggaatacaaatgaaaatgaaatccgaaattagcaaaaagaaaagaagagttcaagtaggaatataatttaaaattaactgaaattcgaaattaaaaataagcaatattgaaagaagaatccatataagaacccaatacaagattaattaaaattcagataaaaaataaaacaatatccaaaattagaaaaattaaaagagagttcaggtaggaatacaattttgaaacaactaaaattcaaaaataaaaaataaaaatattaaaagaacactatacggtattaattaaaatttgaaaaaaaattctgaaattacaaaaagaaaaaaaattcaattaggaatacaattaataaataactaaagttggtgataaaaaaaaggctattgaaaaaaaaagaccatctaaaacacatgatgaggtaaattaagggcgtgtttgcttgctgccctcagattcgcgcctggctcaggcgtcaatctcaggcgtccgatttcggtcgcctgcggtcggatcgacctgcctgagcaacggtctccaggcgagggcagcaaccaaacagcccctaagtaacaagcctataaaagagtagagtagtggcggttgatacgacatataaaaattgctagtaaaacaccgaatagaatgctaatgatgattaaaaggagggacgacaggcatgccatgaagcaaacgggcaaggcggttgccgggacttctaaaaagtaaaaaaaataaatcccatttataatcatattctatttttaaaatctcaatgataataaaaaggagaagcggcggatggggtgtataggagtatagttgcagagccgccgactgttggcaggacttctataaaataaaaaatgaattccaacgatagttatgttcgatttttaaaatcccaatgacaataaagagtatgcggcggatgggtcgtagaggagtatagtatattagtatcatcgtttgacgtgacttctaaaaaatataaaaaataaaacccaacaagataataaactctaaaactacaggtccaattttaaaggttcgaaacttctaacaagtaaaaaaaccaaatgataatcatcttcaattttaaaatctcaa

SEQ ID NO: 16735 - DNA, 1501 bp, Oryza sativa
gagagattgtccctcatgtgaatacgctatcattcgaaaaataatgacatatgaatatatgaaattaataaacaacaaatcgatacgcaatgaaattttgaatggtttatatatacgtacatcgagctctcgtgtggtgtagatttgggttgataggcagtgggcatactcgtatacgtagtagccgcacaagttagttccctggtcccgctttgcacactacataagaaaggacaagagatttaatatacacttatattaactgtaattagagattcaattcaatataatttcggagcatgcatgtactgattggaaaattaaagctccgtccaagtttttctttccaagtcccgcggaacaattgacggaaccgatcccaagccctacatgcagttgcaagctatgattatttattatccgagatccgcataatagcaataggaaaaatccatgcggctttggaatagatggcattatattacctatctataagttggaaaaccttgtcaaaagtcttctctttattcattgagtcatacacattgactctgcatgcatccaagtcgaaaagtaacaggacccagtggaatctgcaacatgcgtgagatgatatatgaaaatgtacatgttatatgtatgggaacgaagtttgttcgaacgatagtaaaaactcactctgtgttgtacggcagtactatgaacgtcttgaaatgctgctgcgtcaggagatggacgagattgtcctctgtgtctttctcgtacttgtcgatcatttcgacgttgattttctgagggtcgatgaacccagtatcgcaaaccccccgccgtcgggtcttttgaatcttcattctacaacgataaaaggaaattattattgtttacatatatgcaaggagctaattattgaacgaaacaaatcgaactcaacgatacttacaaaatccatgcgctcagaagagagacgttcagggcgttcagatggtatagttcgaagacatccttgaaatggatccagagaacattttctccttgcaagaagtcggagtttcttatcctcgctccgaacatctctctacccttggcgttcatttccatgtaccattcatggaatttgtacatctgtgtcggtagggactgcagctgctcaggcgtgacaagcggtttaccgagttcaaacttgtatgccacttccgtcttcgggattggtgcgcctctaatcaactgttccacagttagaccggtgtcagaaatgaattatgttatgccaatttctttgccgacaccaacggctcgacctcttggttaggttgttctccaagctgaggaactggtttggacttcttgtaataggctttcttaagtgttcggtcatagtccgatagctttaaggcctccttgtttgttgtggacattttcttgaagaagttcttcacgctcgggtcaataggtatcttcttttcaagactccgaggcttgaattgcctcttcacttttgctg

SEQ ID NO: 16736 - DNA, 1501 bp, Oryza sativa
ttgcattggttttttccctttccctttctctttggtggtcattaggcctacctgatactacttgtagtgagtgagtgataagttgataacacttctccctgccccaattgtttccttgttcctagtagaagtagaagctggaagctggtctctttgggttttggaaggcttcatctttccattttaggtcctgcaagtgtgctcaacaactcaagcttcactgtcttcttggtttctacctctggtatcagctccttttgttcatctttgtgatgcattgtgttattcaccatgcatcagttcatctggtattttatgaatttatcaaatgagaacagaaaaagaaaagattcttgttttaaaagttggaagatcagttgtatgttagttgcaagattgaatctctttttgttccaatggaacaattctgtgaggatctatttgtggcttgtactgttgattcttttgctactgtgaaggtaaaaactaaaagtggtagtagatgaaaagatcaaaaactttgatttcaagggtacacctagtacaagcctgatttgtcaaaagaacaacaaaaatctcgtgaagaacagtgtgtctgaatgtctgatgcgtgtgtgctgctgctgttcttcttcttcttctcaggttttgattattatcactagtttctgcaattcttggagatttccgaggcggccatgagcggcaatccatcgttctcgcagctcggtgcggtggacgccgccatgaacggcggctacttcatggcggcgagcggcaatggcgccgacgtgccgctgttccatccggccatggcgccgccgcatgatcacggcgggagcttcggctacggcgacgcggcggcggcggcgatggacgtcggcgcgcacttcgcggcggcgaacaacctcgtgctcgcgtccctggcgacccagctgttcggcgccgcgccggcggcggcggcgcacgggcatggcgactacctcggcgcgacgacgccgccggaggaggagatggggggcgggtacgacgtcgccgtcggcgacagctccggcggcgcggtgagcctcgcgtgcctcggccacggccagccgggcgacatggcggcggggtggtgctcgacgtcggcgaggaagccgagctgcaactggagcagcagcaacgccggtgtgcacggtggttcgtattacctcgccggggtgccggaggctgccggcttcgtgtccgcggcggcggcggcgagcgagctgtcgctgagcctgtgctccaagtcgtcctcggacagcatgctcaacgccggcggcgaccagtgctcgtcggcggcgagccgttccgggctgacgcaaatgagcagggtggtggtggtggagcccgagccgccgctcgtaccgtactacccggcggcgaacttcgccgtggtggtggcgcggtcccgatacgccgcggtggcgcagcaggtgctcaacgacgccgtcggctgcgtgctggccggcgtcgcgga

SEQ ID NO: 16737 - DNA, 1501 bp, Oryza sativa
ctgctgctcgccgcgccgcagctgctgcaccgcccagtgcttctggatgaacgccgactcccagctccgctccctctcgccgccggtcaccgccgacgacgactcgccgccgcggcaaggcctgccggccgcggcggcggcggacatgatctcgccggcaatgcggcgcctcaggccgtggtacattgccgacacggcgcggtgcgcgaacggcgcgcagatgctgctgctgctcatcccggcggcgcgcgccgtggcgtgcgtcagggtgttgaacctcgccgtcgtgctctggatctcgtcgaggcattggttgtacttctgatccatctgcgcatttgaattcgtatcgtcgtcaaaagatggtttcaaatttgattcgaaatggtagtacgaaatttgcttgaactgatgcctcgggagtcgtgtggagaagggcgagctcaccagctggagcatggtgaggagctcgctcctgagccgctgagccgaagcgtcgccgccgccgtgcgtgtgctcgccggaggaggcgatgagctggttgttggagctcacggcggacgacggcgcgccgccggccaccgagcagctcgacggcctcgagctgccgctgtcgacgccgctggccgagtcggcggcggcgtccgcgacgccggccagcacgcagccgacggcgtcgttgagcacctgctgcgccaccgcggcgtatcgggaccgcgccaccaccacggcgaagttcgccgccgggtagtacggtacgagcggcggctcgggctccaccaccaccaccctgctcatttgcgtcagcccggaacggctcgccgccgacgagcactggtcgccgccggcgttgagcatgctgtccgaggacgacttggagcacaggctcagcgacagctcgctcgccgccgccgccgcggacacgaagccggcagcctccggcaccccggcgaggtaatacgaaccaccgtgcacaccggcgttgctgctgctccagttgcagctcggcttcctcgccgacgtcgagcaccaccccgccgccatgtcgcccggctggccgtggccgaggcacgcgaggctcaccgcgccgccggagctgtcgccgacggcgacgtcgtacccgccccccatctcctcctccggcggcgtcgtcgcgccgaggtagtcgccatgcccgtgcgccgccgccgccggcgcggcgccgaacagctgggtcgccagggacgcgagcacgaggttgttcgccgccgcgaagtgcgcgccgacgtccatcgccgccgccgccgcgtcgccgtagccgaagctcccgccgtgatcatgcggcggcgccatggccggatggaacagcggcacgtcggcgccattgccgctcgccgccatgaagtagccgccgttcatggcggcgtccaccgcaccgagctgcgagaacgatggattgccgctcatggccgcctcggaaatctccaagaattgcagaaactagtgataataatcaaaacct

SEQ ID NO: 16738 - DNA, 491 bp, Oryza sativa
tcccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcaga

SEQ ID NO: 16739 - DNA, 491 bp, Oryza sativa; identical to SEQ ID NO: 16611

SEQ ID NO: 16740 - DNA, 289 bp, Oryza sativa
atccccgcgcgcgcgaggcggacggcggaggcggcggcggcggcggctcctctcgtgcgcgagacggacggcgacggcggcggcggatccccacgcgcgcgaggcggacggctgaggcggcggcggcggctcctctcgcgcgtgaggcggacggcgacagcggcggaggcttctcgcgcgcgcgaggcggatggcgatggcggcggcggatccccgcgcgcgcgaggcggatggcgattcccatgcgcgaggcggacggcggaggcggtagcggcggaggagacgaaga

SEQ ID NO: 16741 - DNA, 1501 bp, Oryza sativa
gatggtgtaacgaccgtcgatggcagtaagctacagtactcaggtggtgtcgatgtcgacgtcgatggcagtgtccattatccacacgcgcctttgcacgctgccgcaactgggcccacaacagcctcgcgcgcgtgatttttcactgccgcatgtccgattaagactgcatcgccctctccctcgatttaaaaattgaagatgtttttgtaaaaactatggtatgtcatcagtatccgattcatgtcacgcgtaacattcattacaaagtcacgactcacgagcaaactatgaaagagagtctgtgtgatatggataccaagcgaatgaaactcgcagagtccgtgtggatatcacgtacatcattgcccagatcatccgattctgttcgtactacacgccatgattcctggaacatgttagcataatttcaagtcttttaagtcagtctccacgcatgcttgtacgtactagtagggatactgttacaataatccataaagcataatttcaagtcagtctccacgcatgctcgtacgtactagtagggttacttttacaataatccataaagaatcagtttactttcgaaaagaatatgccaaccaaaataaaggatgatcgaagttaatgattttgtccgtcatccattcctgcccgacttgagataaagctggacgacaaatcgagctcgttttttaagccctcattatttggcttatgcttattcctataagtcaaattttaaattttagaatttaattttgaatttgactttttggttatttatcgtactttattttacagcattttcttttgagtcgctgagaacgtgtatataaaagatttgcacacaaataatcatttatttggcaataatcgatatgtataagcacatgaataaacgaatcaatggcctgtgattatttatccacagacacatatgcacaaattaaattggctctacccattgcaatgcacgggcatcttttctagtgaggtatgacaaaagaaggataccaaattaattcttacggaaaatacaaaagaaaatctataatgtattttcaaataatatgttataataattaagcatgttttagagatacaaagcaattttagattctcaataattcttaagataacaatagatctagtaaaaatatgttctcaaaaacaaaacataggaagcattgttccttaaaatgaagatgtagtagtcaaacattcaaaaaatttatcttctgccggattttatttacacagaaagagctccaaccaattttaaacgattgtattactgtgaatacatgctaataagatgcagcacatacatgatatcaaataaaaaaaaatcctcatctcttggttctgcatgctgcagctatctcaacaggaagcactagcttctgtagttctgtgggtcacaagaataaatcatgattcccaataggctggcgaacaaaaaagaggaccagcaatcttgttttagtcttaatac

SEQ ID NO: 16742 - DNA, 1501 bp, Oryza sativa
gaccgtcgatggcagtaagctacagtactcaggtggtgtcgatgtcgacgtcgatggcagtgtccattatccacacgcgcctttgcacgctgccgcaactgggcccacaacagcctcgcgcgcgtgatttttcactgccgcatgtccgattaagactgcatcgccctctccctcgatttaaaaattgaagatgtttttgtaaaaactatggtatgtcatcagtatccgattcatgtcacgcgtaacattcattacaaagtcacgactcacgagcaaactatgaaagagagtctgtgtgatatggataccaagcgaatgaaactcgcagagtccgtgtggatatcacgtacatcattgcccagatcatccgattctgttcgtactacacgccatgattcctggaacatgttagcataatttcaagtcttttaagtcagtctccacgcatgcttgtacgtactagtagggatactgttacaataatccataaagcataatttcaagtcagtctccacgcatgctcgtacgtactagtagggttacttttacaataatccataaagaatcagtttactttcgaaaagaatatgccaaccaaaataaaggatgatcgaagttaatgattttgtccgtcatccattcctgcccgacttgagataaagctggacgacaaatcgagctcgttttttaagccctcattatttggcttatgcttattcctataagtcaaattttaaattttagaatttaattttgaatttgactttttggttatttatcgtactttattttacagcattttcttttgagtcgctgagaacgtgtatataaaagatttgcacacaaataatcatttatttggcaataatcgatatgtataagcacatgaataaacgaatcaatggcctgtgattatttatccacagacacatatgcacaaattaaattggctctacccattgcaatgcacgggcatcttttctagtgaggtatgacaaaagaaggataccaaattaattcttacggaaaatacaaaagaaaatctataatgtattttcaaataatatgttataataattaagcatgttttagagatacaaagcaattttagattctcaataattcttaagataacaatagatctagtaaaaatatgttctcaaaaacaaaacataggaagcattgttccttaaaatgaagatgtagtagtcaaacattcaaaaaatttatcttctgccggattttatttacacagaaagagctccaaccaattttaaacgattgtattactgtgaatacatgctaataagatgcagcacatacatgatatcaaataaaaaaaaatcctcatctcttggttctgcatgctgcagctatctcaacaggaagcactagcttctgtagttctgtgggtcacaagaataaatcatgattcccaataggctggcgaacaaaaaagaggaccagcaatcttgttttagtcttaatacatctctcatct

SEQ ID NO: 16743 - DNA, 491 bp, Oryza sativa; identical to SEQ ID NO: 16523

SEQ ID NO: 16744 - DNA, 1501 bp, Oryza sativa
gccagatctaggaggaacacgaggaggagcccctgagcccgcgtggcatgatccaaatgggagcgaaacgaaaccccgccgcacctttccggcggccgatcagctggagcgcagccggaggcggccggcccatatataagatggcgagccctcgacggagagcggcccctccggcggcggcggcgggttgattgctcgaccgcgtagaggagtagagaggagagggagtggagatgaagatggtggggaggattccttggaaggaatggaagagagcagtatcgggggaaggagggcgtggagtggagtgaagtcgtcagcgtctgggcgaggcgaggtggttgcggtggcggactcgcgggagcgccctgtgtacctctacctgctcgccggggtggcgcgtcaggattggtttccggtcgcagtgctgatctggctgacacgcgccctctagtaatagggctgtgtttagttcctgaaaaagttataagtttgggaaaagttgaaagtttacgtgtgtataaaagttttggatgtgatgatgtgatgtgatggaaagttgaaagttagaggtagttgggggtgaactaaacacggcctaggggtgagtttgagaagagaggaaaatacgcaaaacgaggtgagtcatcagcgcatgattaattgactataaattatttataaatttttaaagcaaattttatatagaatttttttttgcaaaacacacgttgtttaatagttcgggaaacatgtgcgcggaaaacgaaacaaactttctcacgatgttatcctgtccaacgcctgattttagggggctgttcattttaaagctaaaatttagcaaatgtaaccatctaaatattgtcaaaagttgactcttaagatttggtaattttagaatcttcttctcataaaaacttataaaggtaatagcttgcacatcatagccttatcaaattcttcctctatccgaaaatgttgttatctagtattttatccgtttcatattacaagtcgtttgattttttcttcattaaagaaaaaaattttctttaggtttgatcacatttatagaaaaatatactaatattttcaatacaaaacaaacatattatcaacatatatttaatattaaatttaataaaactaatttggtgttataaatgttgctaattttttctataaacttagtagtcatacgtaaagaactttgactaagaaaaaaaatcaaacgacttataatatgaaatagagagtactagatgaaacacatgttaatactatgacttctgtctcgattcgtagtattagaatgtgtcacatccagtactggatagtcatattttgtgacgtaaacagtattggacaatgccaaaatttggcactactgaaatttagtaaagtcaatttagacataaaagtgtacaaccacttaggctttgtttgaaattgccgtaacttcttaaatctagtaagtttcacaaaaccttaagtattg

SEQ ID NO: 16745 - DNA, 414 bp, Oryza sativa
tcgagccacacacgacgcccacgtcctgtttacttggccgcaacttcacaagtactgagtcctcgccgacgtcgttgcttgcaccaaccaactaacctgcatgcatgcaaactgaccacttcctactcctaatcttgtgcaagactcggctaatcactagcccacaattatgcatggctaactaactaagctacatacatgtgctctcatctcctggctctttattggctcactactccctgccaaccactactcactaagccatgcagcacccacgtacatatagctagctcgccaggccatgcaatacacacatgcatatagataaacatgctgaaattaagaaacaacaagattaatttctaacaagggagccgtcggcgcgcgcgacatgtgggtctgtctctcccggca

SEQ ID NO: 16746 - DNA, 1501 bp, Oryza sativa
attgcatatgggttataaatacatgtgttcacggatgcatgtatcaatgtccatttactccaatgcataaataacgaatagacctaataaatgaacacaaatatgtagatcatttaggaaatcaatttgaaatggagggagtaataaatactccctccgtttcataatgtaagactttctagtattgctcatattcatatagatgttaataaatctagacatatattgataacttttgtggatatcatacattaatataatttatataaatattatgcatttaaacatattcactatgattagttcctaattttttttcccaaaaacgtcacatcaaatcttttgacatatatatggagcattaaatatagataaaaataaaaactaattgcacagttaggggtgaaaccgcgagacgaatcttctgagcctaattagtccatgattagctataagtgctacagtaacccacatgtgctaatgacggattaattaggatcaaaagattcgtctcgtggtttccaggcgagttatgaacttagttttttcattcgtgtccgaaaacccctccgacttctagtcaaacgtccggtatgatacccaataatttttatttcacgaactaaacagagtctaagcaattctcttgattgttttgtctcgaggagtaaatgagtcattaggggcgccggagtaaaagtctcgagaggagaaaaactgtttgaactctcttttagcaattcagatattttgttcacgcagataaataaaattaggggcaattgtgtttctgcccttgctttacaattcaattgtgattttacccttgttttttagggtttgtgattttgcccctgcttttttgaaatgaagcagtcgtctgcccctggttttgacagaagtatggtgggcccgaaattttagaattaaatgatgaaacaaaatgttattatcatttgtgaatgaccattctacccttcaatgaaagaggcaaatccccaatccctgtcccgaactcccgatttccactccaaacgctatagctaagttgcaagcggtggcggcggcgcacgcgacaagcggcggcggcagcgcggggcagctgccgcgggccagcgcgcggcggagtcggtggagtcgggcgcgggcagggaggcgcggcggcggatcggcgggcgcgcggggcagggaggcgtggcgccccccgcggccagcgcgcagggatgcgcgacgcggctgccacgcgcagggaggcgcggcggccggcggccccgcggccagcgcacggcggagaggagcggcggctccgtcggccagcgagccagcaagcagcgagcaggaagcttggcggcgggatggcgctgttaaaggaagcttgacgacgtcgcgaccgctactccctccctcatcgacaacaccgccggggagcacgtcgtccagccgacggagccgcgggcgcgggccttctcctgtggcttccggcgttcgtcgaccggagctc

SEQ ID NO: 16747 - DNA, 1479 bp, Oryza sativa
ttgtttcgactgtttcttccattagtagtgggcatttttttttgatagtagagcttggtcgtcttcactaattgattttattaatgccgctactgttctcaactctcaatccagcatttgcttgctggctagtatgaactatggtctgttctatctgttattctatcagtacaatttgcactgtcagtgcttgagagttgagtaaaaattgttgcttattgattggacggggttacaagtttttattaaaagtaaacacaacctttcttgaaggtttcgaactgctaactttgcaaccaatcttctgacttgtaatgttgtctcagtactcatcttttgtgctttgaagaatacatcagggttttacactttgttccttggaattggaaaaaaggtgaatccttttgctttgcaatgtactaactgaccaacatgctagttcttcagtttgcggaatgttcctagggagtgtgtttggcatgtcatggaatgtgagctatttacaactcgtgtaatccacattaggcatcatttacgttaagctgcctttacatgatgttagctctgtctgtgtgcatgttctcctttctacaatgtttgcacacatgttctgtatattaacttttgacctcatatgtggtgttgagatgtaatattcaagcatacagctgttaacaatatatcagacatatttaaactttgaagagatttatctagcaaatgcacaaaaggtgttttaccatttcccatagtcttgattgctgaatataattattgcaccatatatagtaacacgattattttattttgtatttgttctatgctaaatattttttcgttacattcaacctcagaattcaggtggctttggtaggcatattgcagattcatcaacgaatcatcagaagttaaatcaagcaaggaattgtacagcacaacctttttctcctggaagttacagaagctcagttggggtatgtttgtatatattcttatctgctgtgatccatattcttatctgctgtgatcctcttggctgctttaatattttggtttgtgggcatataacaaaatcttatggtactatatggtaatgtgtgttagtaggggtaagattttctatcttgtgattctgttgcgtttttcattacacatgtttgtgtctgatggagaagttttgggagtgtaacagtatgctttatcaagacaagtcattgagtagcctagcagtctaagctaatgcttctcgactaaaaataatcatgaatgattgatagtaattaaataatacatttgtgcatcgttttgtctgctcattctttatttagataaacagaagtatgaatttatttgctaggaaaaagaaagaacaatgaagtcagtcccatagtattttgcctgctgtctattgtagataacttgaaacttctctatatttcttgatgcaactaaatatgtttcccagatgtaacaaccagc

SEQ ID NO: 16748 - DNA, 476 bp, Oryza sativa
cagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcggccagcatcatcttattctctatttgtattccctccatcttt

SEQ ID NO: 16749 - DNA, 1501 bp, Oryza sativa
ccttgtattagttgcagtctagtttcgtgaacggttgtctgagctatttttagtttgttacaggtctgaggatgatgtgtttggggtttggtcatatgcttcagaaattgctgaccagatgtgtaggttaagatggagacaagcaacaatggccaacaattcttttagagttattactagtattatggaggtgcatccatctcgttgattttttgctggctgttgcattcggaattacgaggtttacatatatattgacctgatgttaaaagttcggtggacttgatctgagaaacttgagtgttaattatgtgtttcataaaatatgttctggtatggaaaacaacagataagtatatgaaggattcttgcaatggtaaccatgcatgatggtgcatgctgtcgtctgcgcctgctttgcgtgtcatgctagtaagtttgaattgcaatttgaatttgatgtggcggtagtttccaaatttcaatgttgtgcactgcaaggtcgattggttgggttgggttgggtagttttccaggccatcatgtattcatgttgcgtctgaactttgattctgaatttctatttcaccaacttcgctactacaggacagggctattataacataaacttgtagcacataaagatatatgttacatgagaataccacagtagcacaaagcatgcgttacacgaaaggctgtaacacatactacatctaatgtgaaacagtacagtattataggaagaactgtcgtagcacataatatgtgttactaatgctagttaccagtatacttgcaatataagaattgacaattgctcgtatattaattttaaaagtcactatatggacctaacaagagttatcactaaagagtttatactatagtagagttcatttacgagtttgaccaaaatgtgtatgtagataacaaagttatctaagaattttggtcactaaagtgtttacactatagtaaagttcctttatgagtttaaccaaaatttgtatatagataacaaagattagttctaaaatcttttgttgatgatgacttctatatagataacaaagattaaccaaaactttgttgttgatgactttttcagttgaaatcatttagtatttgaaaatattgtttgaagttgccataatttgaaattcaaattcaaattattataacaaagtcatatagcaaaatgaacaaaacaaaagttatagatattgatgcgttatacaactttgttgttgataacttttttaattgaaatcatttagtatttaaaatgttatttgaagttgtcataatttgaaattcaaattttgtatagatcaatcaaactcagatggagaaataacaaaaataagattggtagatctcaataagttatacaactttaattgttttttacaacgttttcacataagttcatttagtatgttaaaatttgattcgaaggtttaatattttaaaattaattaaaaggaggaaggtaaaa

SEQ ID NO: 16750 - DNA, 1501 bp, Oryza sativa
ggcgcggggctcgacgcggcgatgtgacgactacgcggcgcggcagggcgcggggcgcgaggcggcgacgcgacggcgtaccgcgcggcggggcagccgcacgagaggcgagcggcgagcggggcgcggggctcgaagcggcgacacgacggcgtaccgcgcggcggggtagcggcacgagaggcgagcggcgagcggggcgcggggctcgaagcggcgacgcgacggcgtaccgcgcggcggggtagcggcacgaggctcgaagcggcgcgcggggcgcgaggcgcaggcgcgcggcgcgaggcggcgacgcgacatctgcgcggcgcagcagcggcgacgcgacggcgatgggacggcggcgcggcgacgggacggcgcggcagcggtggtgcgcggcgcgaggcgcggggcgcgggcgcggcgacacgacggccaggcggcgatggcgatgggacggcgcgcggcggcttaatggcgatgcgacagcggcgcacggggctcgggacgacggcgacgcgcggacgacgacgcgacgggcggcggcggggcgcgtgggcgcgcggggcgacgagatggctgcgcggcgcggcagcggcgaagtgacggcgcgcggcggctcggggtgcgaggcgacgtgacggcgcgcggcgcggcagcggcgacgcgacgggcggcggcggcgcggggcgcaaggccggctagggcgccgggcgcgcggcgcgcgggcgcgacggcgacgggacagagggggcagagctaggggacgcactcgagcacctagcgggcaatgaatagtgacttttcctattgatcccgattttaatttatttcccatataaatttgattctataattcctaattttacatatatgcattttactcaatatgtgtattatcccaaccaatggatccacccctgattaattttacccatattttatttttatataattttcttgaatttaattagagttaattcttattcctacatttttaaattgaattgatacaaatatgatcgtgataatattttatttattactgtccacaccaaatcttattttaaattgcactttaattatttactttgtccatttattttttttttgggtttattcctaaccaattatccattattcgcgatttataaactccaaacccaactccaataaaataatcgaataaaatcggcatgatgcaatttatttaaaaagtttttgaaaatccgtatttttagagttttgatattttgtcggtcgaattttcagggtgttacaggcggatttggtgaggcgacgacgaccacgacatgaggagaccggacgaggaaatgcgcggggcgccgactcctccaacgcgaggcttcggcttgtggcttcgcggttcccgaacctaggcgtggcgcttgcaccggttcctctgcaagctcactgacagcctgcgagaccacccaaactcgtgccagctcggctcggctacgacgtggacctgcaagac

SEQ ID NO: 16751 - DNA, 1261 bp, Oryza sativa
gctaagtctaattacaaatctaataatcttatattaagactcaaataatcttgtattaaaactcaaataatcttatattaaaaatctaatagtcatatatgctaagtctaactgttgtatattagaaccctagacaatcatatatgctaagtctaattacaaatctaataatcttataataaaactcaaataatcgtgtattaaaactctaataatcttatattaaaaatctaatagtcatatatgctaagtctaactgtcgtatattagaaacctagacaatcatatatgctaagtctaattacaaatctaataatcttatattaaaactcaaataatcttatattaaaactctaataatcttatattaaaactctaacagtcatatatgctaagcctaagtgtcgtatattagaaccctagacaatcatatatgctaagtctaattacaaatctaataatcttatattaaaactaaaataatcttgtattaaacctctaataatcttatattaaaactctaacagtcatatatgctaagcctaagtgtcgtatattagaaccctaaacaatcatatatgctaagtctaattacaaatctaataatcttatattaaaactcaaataatcttgtattaaaactctaataatcttatattaaaactctaacagtcatatatgctaagcctaagtgtcgtatattagaaccctagataatcatatatttacatcacttgcctgcgcgaattccttcgagggctagctaccactccggcttgagggacgacgacgacgacgtcttttctgcaacatacaaaaaaatgtattaggctaaacgcaaagtaacataatttcacattcgcgttctcgttaagttcatgttccgttcacgatcgttcacgttcgcgttctcattaagttcatgtttcgttcacctacgttcgttcgttcacgttaacgtacgttaagttcatgttcgtgttctcgttaagttcatgtttcgttcacgtacgttcgttcgtttacgtccgttcacgttaacgtacgttaagttcacgtatcgttcacgtacgttcgttcgttcacgttaacgtacgttaagttcacgtttcgttcacgttcacgttaagttcacgtttgttcacgtccgcgttcatgttcacgtacgttcgttcgttcacgttcacgttaagttcacgttcgttcaacttcacgtacgttcgttcattcacgatcgtttgttaccgttcacgttgtcgtt

SEQ ID NO: 16752 - DNA, 515 bp, Oryza sativa
  unsure (1)..(515): unsure at all n locations
cgctggnnattaggactacaacagatgcacccancaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatcttt

SEQ ID NO: 16753 - DNA, 203 bp, Oryza sativa
gggcggtgacggggcgcgtgggcgcgtggtacgccgggatggcagcgcggcgcgacagcggcgaagtgacagcgcgcgacggctcggggcgcgaggcgcgcgcggcatggtagatgggacgggcgcgcggcgaggcaggggcgcggggcgcgaggcgacgacgcgacggtgacaacgatggcgcgcggggctcaaggcggcga

SEQ ID NO: 16754 - DNA, 1501 bp, Oryza sativa
tacccggctgtacagatctaatctccaaaccaggagctaagcaaattattatcaggtataacatccatagttatggtgagaggtgtgggactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatttccgccacttctcagtctggtgctccgcaatgaaccatgctatacaaaaggtaaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagaaattaattaaccaatcacgattgaccatcgtgagctaccattaaaccatcataataataatgaatcataagttatcccaatagtgtgctaatgtttctaagcatggctaagcaatcacatctaatatctagctgaaccaatatataaagctcaactagtcaaattataataacccaaggtatcaaggattaaagtaatcaatgcaaacaggccataacaaagggataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctaacacgcaaaacaaggaaaagactaataaaaaccaaataaacaatacataaaaagtaaacaaacatgtagatcatatttttagatgaattatgagacttgaacggcctcattctgatttcatatgaatttattatgaattttacaagatttaatctaattaaagcccatttaaaaagaattaaataaatttaattcaatttatggacaattttaatatgtagatctttattttatacaacttttgcaacttgacccacattaaactgagttaagatgaattagttatgaatttttaaagattaaatcggattaaaacctttatatggattttaattgaattatgacgcaataatgaattatttttgaaaaggaaaagaaggattattgcgtcagcggctagggttacggtggaccgggcgcacgggcgacggttcacgcgaacggacggtcgagatcgaaccaatccaaaacggacggccgagatcgatcgggtccacggcggctcacggcggacgactccga

SEQ ID NO: 16755 - DNA, 1501 bp, Oryza sativa
ccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgcaatgaaccatgctatacaaaaggtaaagtcgttgcccatgctggcttgtggttggcacggttaatgtttcacaacagtacctcgcgaaccggtccttaattgtcatgagcacgactctcaaaaccatgtgctcacaacccaccattatcaagttttggttggcaagtaattaattaaccaatcacgattgaccatcgcgagctatcattaagctatcattaaataataatgaaacattaattatcccaatagtgtgctaatgtttctaagcatggttaagcaatcatatttaatatctagctgaaccaatatatatagcccaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttctgaacactcccgacgcactcacgaaccttcacaacgacggaaacgacaagctaacacgcaaaacgaagaaaaagactaataaaaaccaaataaacaatacatataaagtaaacaaacatgtagatcataattttagatgaattatgagacttgaacggcctcattctgacttcatatgaatttattatgaattttacaagattaaatctaattaaagcccatttaaaaagaattaaataaatttaattcaatttatggataattttaatatgtagatctttattttatataatttttgcaacttgaaccacattaaactgagttacaatgaattagttatgaattttcaaagattaaatcggattaaagcatttatatggattttaattgaattatgacgcaataatgaattatttttgaaaaagaaaagggaattattgcgtcatcaaaggcggtccgggtgcacgggacggtctaaggaaacgaacggccgagatcgattctatccaaaacgggcggccgagatcgacttgatctaccgtggtccacagcgggtctacggggacagcgacgatgacgtcagctatgacgtcagcta

SEQ ID NO: 16756 - DNA, 494 bp, Oryza sativa
acccatgaattcagaaaccccagaagtccgcacattcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcaga

SEQ ID NO: 16757 - DNA, 422 bp, Oryza sativa
tgtaacgccccgattttcgttcgggaataaaaatcaattaataatacattttctagaaattaaataaaagttaaatcaacttaatcaagtgaattattgagggaattaaaaatttcctttaaaaattattggccgggaatattttgtaatattctttgtgccctaatgtactctccggaattttccgtgaattttcggagctcgagaaatagttttaatagcacaaagatcattgcatcaattaaaataaaaagaaaacaattaaaatcccccttcctctctttgggccattttcggcccaagtcttccttcttctcccgcggcccgcgcgccttctccctctctcgggcgggctcccctctcacttggcccgctcgcaaaagtctgttttgcgtccctccttctctcccttcgccgacagg

SEQ ID NO: 16758 - DNA, 1501 bp, Oryza sativa
tctatggtttttttggccatctaggggaaacagacttttgttgttgttgtttttcttttttcctttttttgcggcttttctttttctttttatgcacctttctgtttttgttatctcccttttattatttttttaaaaaacgacctcaaaataccttattgcaagattatagggactaatgtaaatataaaaattacagggactcaaatacaaaagtacatacccaaaaattaaaatcatataaaaatagaatgctctcgacatgtaggttccgtttttgcaaacagatctccaatccgacgcaacaatttttttcaccaagatgtatgggatatcacgggagattaaaaccgagcggagtggtgcgtgggatctcggactcaagcctagaggagaggtgccttttatttttcgtttttaaagaggaatcagatctagagttggatttttttcgtttagagatagagaatcggacagatttttttttaatttttgtcgtccttcttcttacccagagacggattcgtttttctttaatggacagatccggttttcccaccttttttcggccgtttttttgatcggacaggtttaggttttttctcacccggttttttctggatcggatagatttggttttttcgcccggtttttcgttttttcgccttttttatcggataggtttggttttttttcctttttttccgcccggttttttaggacagatttggtttttttgtccggtttttttgacggatgatgaaagcacctcttattttttaagtagtatatagacgttttggttctaatgtcacctcactgtcgtgtaggacgatgaccaagtcaaaccagctacgtaggcaccatgtcagtcgaaactactgttcaaaacatcttgtgatctcttttacactggtttttgggagttgggaaatgcgctatatatatggtattgtggttcagatatatgattcaaactcggcgacaaatggaaggacctcatgtgaacttattctttacaacaacgggaaaaatacaaggcccacagttgtagcgagctgcgggaaagcaccggccgaactactaacatacagtacgtgggaatacgcaaggtcgaaccgtcgctgcagaccgcaaaagtcatcgatgcccaactaggccgccacacctctacacggccccatccggcagcctcctgcccgcgcggcgcgacgcaccaccggctcactacgcgctagctgcatgcatcaggactgcggtgctacgatttgatatgtccctgttttgaatggttaccgtacgcaaatttaagctgcaaattaatctagtagtactactatatatgtattgcatagttaagctgcaaattgatctcgcatataatgccctcgtgcaaacgcatctattgcgaatccgaaatttgattgatctcgcatatgcaatatgaatatatatttggactctggtgttcctagtttctacgtctcctacctagctacga

SEQ ID NO: 16759 - DNA, 1501 bp, Oryza sativa
gtaagagtggcaaatagttaattatttcagtttttctcgtaaattaggtcaatctttttcgatttcagaccaattcgcatggtgcgttagcgtgacaggattttctggagtacattgcttgttcggtgactgtgataggggatggatagtgcctagccctctccaagactccaacatattattttgacacataattataaaccatctatctattatatactaaaagtccattaaactttctacaaacgcttctaagccacatggcatctctacaaatgcttctaggccgccaagtggcgctctaataaataacttcctacaaacgcttctaagccaccacatggcatctctacaaatgctcctaggctgccaagtggcgctctaataaattggagaaattctaagaaaaactaaaatatctaaccattgattttcatttaatctgtttgaacccatattttttaaccgttagatctgatattaaaaaataccaaatagatttatattagaatgcgtcacattctatgtcgatccatcccgtacgtgtatacatactttgtacgtactccctccatacccacaaaacaagtcgtttaggacaagattgtgcttaccaaggagtgattaatttgaggctattcttctatgtttgcccctattaaatgagggtgcgggtacattcatttgagaagcaaacgctagtgcagcgatgtttgaaggttgagtgcttgggttcgatacttggtgggctcattatttttttgctgattttgcatggcgcttgcgtgcgtatttttgggcgcgtatttttcgtttttttcgtctgggcactctgtttttgcgtatgttgggcatgtatttttcgttttttcgtctgggcactttgttttttttttctgattttgcatggcgctctcgggggtgttttttgggcgcgtatttttcgttcttttcacgggtagatgccgtttcagtttcgccatgcctatttaaacggcttcttctctttccattattgtgcttaacctgctcacttttagtccgcgagagtttccatctactgcatgcaatggctgttccagctgttgctggctttgatttgaatgtctgcctagaagaagatgaggacggcaatgttcccttccatctcaacgagccaatattggaggatcacaacgttaatggtaatgtgtttgttctttccttttttttatattcacagcaacaacatcaactaagtttctattctaagttttttctttcctttttccgacaggatttgatttgaacatgccactagatgaatttggtgtagttgatttagattttttacaaaaccacgctggtaatcttgatctcagtttgttctttcctttttcatttttttattaaagaagtggctagtttttttgaatgtgcttgtttttttttctttgactagaacatgatgtacagaaccaagctcctgttgaaggacagcatcgaaggaaggacatgacag

SEQ ID NO: 16760 - DNA, 1501 bp, Oryza sativa
aaatatgggttcaaacagattaaatgaaaatcaatggttagatattttagtttttcttagaatttctccaatttattagagcgccacttggcagcctaggagcatttgtagagatgccatgtggtggcttagaagcgtttgtaggaagttatttattagagcgccacttggcggcctagaagcatttgtagagatgccatgtggcttagaagcgtttgtagaaagtttaatggacttttagtatataatagatagatggtttataattatgtgtcaaaataatatgttggagtcttggagagggctaggcactatccatcccctatcacagtcaccgaacaagcaatgtactccagaaaatcctgtcacgctaacgcaccatgcgaattggtctgaaatcgaaaaagattgacctaatttacgagaaaaactgaaataattaactatttgccactcttacgagtggttctaaagaacttgcgacgctgaaccatatatcatagacacatgagggcccacatgtcatagatagcgagtgacaaattcttaattggcatatttcaaaagtggcaaataattaaatgtcccagaaaaactagaccaaaaaccatacatggttaatttaaaagaaactgataactgtcacaacatcctaaccaacccaatcgaggatcagaatcatctaggcgaaggctccaagaggatacaacctcaaagatgttggtaacatctgtcccaaacaacagataacgctttcacctgaaaggaagagagaactatctaagaaggcctctaaggagaaaaccgctgcccacggaagtcgacataatccacaccagacacggagcaaacaagacttttgccataagctctcttaactattgatcacctctgcattgattggctcgaggtattaagggttatcattgcccagctctcgtcaccctatgaacagttatgactccgtcacaaaacaaatgtcaccccccacctccggcgcaagcaccgtctgggacatctttagtttccaaattatacattgttcttctggaacaatctgtgatatttccctgacatccaatttgtaaattgttgccatatatttccaattaaattacatcaagcattcccaacctgcaggtaggctaacgatgcttaaatctgtccgctgctgatcgagcacatatgctgaaatctctaattccgctctttcaatctgttgcaacatgtgtaatatcagtaaaacaccatgccaatattagcatgaatcatgcgaaatctagcatgcaatgcagctcgtttgcatgctaagctagctcatggtcgttggcagattggagccaattaattaaggttcagatagaatacactctctcgatcgcttaatactccgtagctttcaattcagccattgcaatatatatagagtacagtgctttggccttcttgtgtgcatcctctctcaccttacagtgcttttcgttctcgatctcggcaacga

SEQ ID NO: 16761 - DNA, 1501 bp, Oryza sativa
ttttcatattatatgatatggtataataatgggcaaatatatgtatcagagactcatgtgtcattgtaaaaaaatatcaagttaaaaaagaagagtaaatttcataaaactgcaccaacgtggttcaagttgcaaaaaaaaaacatacacattttgacacttgacacttacctatatatattctggtattaaagtttcacaaaactacgcaatcaacgaatgggtccactcatgaggtgacatggttacttatctacatatatttaggatgctggcgtggcattatgagtgttccacctaggataaagctcccaagtccacatcctaggtggaacagacacgtcatcttgcaggtgggcccgttcattgatggtgtagttttgtgaaacttcaatctaaaatatatgtagttaagtaaccaatgtcaaagtgtgtgtggttttttgcaactttgaccataaaatatgtatttctataaaatttactacaaggtgggaccacctcccaatggctttcaccaaaacatccgcctatatttgatcaatagagaaataggtgatgttgaaagaaagatatagttggtatataaacgaaaaatagagggaaagtgatgttagtagattcgtcctgctgtgtagttatatttctaataatttcctatcgataaatatatgatatgataaaccaatgatcaaatgtattcatctgaggctggattggggctcatcaatataactggaaagtgtcttaaagttcatatcacaggattcatgttttacatttcagaggacagtttttacttagaacacatggcgtcctacaatatacacgttcaaacatcgaaatcttatatcattaatgcccaaaattattgagtaaaaaagtgacattactagatttgtcgtgaggtgtggctatatatttaatattatcctttcgagaaatatatgatatgataaagtaatgatcaaatatattcatatgagactggtttgtggctcactaatattggaaagtgtcttaacttaatagcataaaattcatactttacaatttagatgacagtttgtatttaggacagatgacatcctacaatatatatgcatttaaacaccaaaatctgtagtcattaatgcatgaaattattgagtttgaaatgtgaaattactagatttgtcttgaagtatagttatatttttaataattttcttttgataaatatgatacggtaaaataataatcaaatatatgtatcagagattgatgtgtcaatgttcaaaaatgtcaagttgaaaaagaaaggtagtatatcatttgcatacatgatttgtattagaattgttcatgaatcaaagttcatctgaaaaaaactatattaattgtttcaaatttagaatgtacgtatgatacatttttgttaattaatggattaaaaaacccagcatctacatccatgagaggatgacacagccaacttatatagatcattgtaatgcgcaga

SEQ ID NO: 16762 - DNA, 1501 bp, Oryza sativa
gtctgatgaatgttcagggtctgatactctctgatcccgctcgtcttttttgtaatgccattggatttggcgtctgtttgatactacttgattttagctgccgaagaacatactgaaatgaaggaacccattgggtttcttgtctgaatcttttgttgattctcaggactacgcatgatgatctagttcattgtgcctcttttgttgattctttcgggtaaaactgccatgtcaacttcaaagatgcagcgttggaaccacaagttattctgtcaatggtaagcaagacacttacttcatcgaccaccactccggcgaatactggtcctaaagcttaaagttcacacataaatgcatgattgcacactacaagttacagaaatcatggcaaaattgatgatcaaagtggccaatccatattaaagaaaattggcatgtttaaatgggttatcataatcacatagttgaaatgcattcatgacttcacttgaaaactacatctattactaaaggaggcttttgattttggaaaggcaaggtaaaaaaatcttggtgcttactttagttctagctttcctcgagtaaaagaagttcagacaactttaaagaaataaaagtataaaacacactttccctccttcagtaaatttacttgaccccgttgaatgcaccgtgcaaactttaaaacctcacattgctcgtcagacttaacaacggtaaacatcaacagtatcatttcaaactatgataaaacaatagtcgtcaaaatgtgtttaatgcaatcgatttggtcaagtaaaagtgaacaaaagaggggataactttagctttcagccgtttagatgtcgctaatttgttgtaaaagaaaaaagaagcagctttaacgaataagatctttattgttacaggtgatagtctgaatatgcatacatggccctcttgtgcatatataatgcttgactacattatcactgtggcatctatccaagattagcagcaaattaaggaacggccatgtgaagacataccaacaaactggttggtcccaagtagacagcaagaattagttgttgtacagaatgtagtgtacatgtcagcttgatgtcattgcataccaatctgcactcacttggtaggtagcatcacaaaagataaaagagcacactttcagaagatatggttgttggttatgcaatacacagtagataacatggcagaatacttcaatccctcaactagagtacttacaaatgacctgaaactagccataaatgctaagcaatgggattgtgacttcacaagttcatataatttcacagattatcttcttgacagcatacctaacaatcttaacagttatctaacaaaaacaatcttaacaggataattttttgagatgattgaaaggcaggtcgagaaaaaaactaactgttttattttaaaccttctttatgtatgatgttcgcctaaacttaactttattactgtagaagatattgta

SEQ ID NO: 16763 - DNA, 1501 bp, Oryza sativa
ttccgtctggatcgacttgatttgttgtgttctcatgatagaagagcagcttgacttagtcgtttccatgctgagcagatctcgagagtgcgcttgttgacctggatcgtcgcatccagtattggaggacgaagtttgaggtcgcggaactcgagaggactatactggaggtgagaaaggaccaggccgtagagacactccggggtcgtgaggtgtggttcaactcgtatctgaagagttgctgcacatccatgttgagagtctgtagagagctctgagtaccccgtgcggatcccgaggaatcggcggccggatacatctcgtggctgaatggggtctgtgcccagctcgaaggcatcggtcaacgtatcgacgagaccttgaagcaggagtgtcgtcgctcaagccgatatgctggggggtacgtgctggcctgtatacgagatcatcgtccgcagctgcacctcgagttcctccgcgaagggttttctcgttcttggagaactcctacggagatagatggcctggcgaagtcgatggactggcgttggccttcctggtagtctccgtgtcctgtgacaaatgtctttggaaaaagtgtaatatagttttggattttgatggaattgtaagaaatacttgtggaatagaaaagaaatctaactaagtgtcagagttatggataccacatacctaatagtagtagactaaatctcggtaggacccaccacataccatgtcttatacggaaactgatctcgagggagttctggataaggaaagaaaaccaaagttctacatggaaacgacaaggactacttggattgtatccatattggtttctctagttctacttggacaaggggacacctatgggtataaatacaagcacccctaggaggacagggggacacccaccatgggacacccaccatgagacgatcaatacggacggacaatcaacagacgaccacctcaatcaacaaccaccacaatatacagaacaacagaagccacaacatacaagccaacatacttcaagacaagacgtcggatatcgacttcatggataggcatggctagtaccctacggtgtctccggatactgtcaggagaaacgaaagcgctatctctgatctcgccggacacggattcgaggaggaaggctaccctgttgtcgactatgagtcagatcgtcagaccgccatgtcgacaacagttagataggctaccccaaacattatactggtgtgattatcatgaataagagctataccggctctggccaacaggatgtagggtcattacctgacaattcaggggcccgaacctgtataaaaatcctcgtctccatctcttttacctcaatctcgcataaatcctagcaccgacgatccccatactatgtaaataccataatggcgacatcaaacgtcgacagtggcgtgccaggtaggggaattttggtgcttcaggatttcgatgagatgggtttaagaga

SEQ ID NO: 16764 - DNA, 1501 bp, Oryza sativa
tttttcctcgcttctcacgcatggtgcggtccagctcggggtgtggagaatcttcaatacgcagaccctttttagaagatttcggcaatggaagtctgttaggacgagcagttctctccttcttatgacgccagtcacgcaggaattcgattgactcgccgtggcgtttgtatcctcctcgatcatctctatggaccgggatcttcgtgatatgctgggaagggtcgtcacccttggtctccttctgttgcttgccgccggatcctcccgggcgcttatcttcgacagtgtgtctatctcctgccgagcgcctgtctcatgttactcgcctgtcccccgttctccgcccgtctcgtgggacacgctctccgccgccccggtcgctggcgccacgctcgcctgcaaccctggatactccgtcttccctggccctctcaagatggttgcctgatgaaaaagtacaggatgatcaagaagcatcctaattccggtggctaaagaatcgacaatggatatatacctgcgatggagttaaacacctgaggcgccatattgcataatcgatgcacaggcatgaccagcaatatataggcttcatccaaattactcgtaactgccaaggatttggagtcctggccgatgacggtctagctttgtttttctttcaacgcacggccggagataagcttcaacatgggagtcctttcgtcgcatgactaaactctaccggacatgtatcgcatgagccgacacgacaccaagttaatttcgctcgctccacgatcaaaatttacttggtggggggcatgtgtttgatggtattttggcgattatatgtgtacacaagacttactcatgatggacaaagcaaacaagcagtttgtaagttggctagcttatcatttctacacaatgctcggccatgtatatacacgcaaataaatgcatgcacaggcagctgggaatatatatacttggattagtatatgtgcatgtataattaaccaataactagccgtgtgaagattggctggtgaggcaatcacgtgcatgcatgcatgtactacagtagacggtcgtatgtgtgtgcatgcctgggtgattaagcaacctatgcatatccgagtgattaatcatgggctcggcccatggccgaagacggtagctgcctacgcgccaagatttcagaagttaatatgcggaagagataaaaccagatgaattaagagataaccaacaaaccaattgattttatctctataacaaacttgatctagttagttacttcgcgcgagcgctggcgaggcgcttatcaccggactgtggcccagcagtagagaaacaaagcgaattacaaatcagatatttgacgctaggagaagctaagagataaaatcaaagaaggatatgaacaaataacaaattgatcgatcaagccttatctacaacgaacttgacgcggaggaaacggcgtgcggacgtggcgagcacagacctcaga

SEQ ID NO: 16765 - DNA, 1501 bp, Oryza sativa
  unsure (1)..(1501): unsure at all n locations
gcactttttcggaaaacataagactntttcagatctttaatttacacgcttacacctcttatagttttcacatacccaacngtatgtcttcttgcctcatnntgtgatcctntatacagtatatgcaagtnttcatgctctatctcattgtcccttagctgcatgctagtggtgctatgctgttggttaattactatcaatcgtttcagattagggtgatagatagacacatatatcatcaccacgacacatgaggaatagtcatttccttttgttaactcgttcatagctaaaccaaacacccttaaaaataggttcgatctaacccgacctatcttataattccaaccaaaatgtgtatgcttagtagattggcatgggaggcaccgagacatgcaaaggtgatggccctttggctttctcgagttgggatgggcatggtccggactgacccaccagcctcattggccggtcccaaaattctggctccaaagggtaacaagtttgactaaattaatcaaacctcacgtcttcgctaggtcttcctccatcgatcccctcgtacaagcacgcagcagtggtgtctcctcatcccttctcatgtcaccaacatcggcatggcagcgcctcctccctcctattgtcctccatgcatccgcgcctgcgtgatggcagtgcctcccgtttagtctagtcctccatgccgacgccacctgttgctttcctccacaatggtgcaacagcgtctcatctactccctctgtcccaaaaagactcagtctttttatgttcaacgtttgactatccgtcttatatgaattttttttatgattagtattttcgttgttgttagatgataaaacatgattaatattttatgtgtgacttatatttttaaattttttcataattttttcaaataagacggatggttaaacattagacacggaaacccagaaattgagtctttttgagacggagggagtacgtcctatcagttctctccctcgactttgacacaatcatttgacaaggaagagaacacttgggctcttctttgtaggtagccaattaacctagagttcctcttttattgatatgatcaagagagtgttggaaatatggtcataaatcggcatattttaatccaaaatattaagactataaacatgacatgcacagtgtgaaatgatctagtaataaagctaaacataaccaggagcatgcttaagggtaaaataagcattaacgttgagacaacgtaataacattgcgactgacagatttaacaaagagaaaggtagcagaaggatgtttataccctataaaagtccctccgctggattgtgaggcagaattgcctccgttggtgttctcgatcggtgcgccacctcctgttcctggcgcaccacctcctgccgcaccgtgcgcgccacctcctgttcctggcgccccatctcctgccgcaccggaagcaccaccaccagtagacatcgcgtga

SEQ ID NO: 16766 - DNA, 1216 bp, Oryza sativa
  unsure (1)..(1216): unsure at all n locations
cgctcatacgatcccgcatgacgttnnanccnncnnnnntgttgaannngccccccagctctgaccggngggagaagctgttaagtccctcattgttatgattgtattttacggagcacgccgcacgctgggttcaaattgactgggcgagggtacacagccgccgtcccatcggtcgttcgaccggtcacggacctatcacagatcggttgagtgcactgcacgccacattaaatgcggcgtggcgcaaccgctcagatcgccataaaagcgggtaggtgagcgcctggaggcggccatctaacccatcgcacgtggcgacctatagaggtggtcgagggagcccgacccctagtcacaggacggggcggctgccgccctacctcgggcccgatcccccctcaggggagggccacgtggcgcctggggcagcctcctccttctagtcttgattgggacaggtccgcctggaggcagccacataacccatcgcacgtggtgacctagagagggggtcgggggagctcgacccctagtcacaggagagggcggccgccgccctacctcgggcccgatcccccctcggtggagggccacgtgccgcctggggcagcctcctccctctagtcttgatcgggacgggcccgactcccaagcaagaagggggcaggtgccactccaccccgggcgccaccccctcaggggagtgccacgtgggttagggggcagcctccttgctccaaattcgataccctaagctgagggggcggccgccgctcctcccgagcgccaccctcctctagggacgccacgtgggtttggggcggcctcctccctctaaacatgatatccccgggcccatatcaccgacaggttgggaagagaatgttggtggagaagttgttattttttcggacaaatcttgatggctaaaatttgttatatttttggatgtagggagtaatattttaacatatatctctctatcattttctagaatatcatatatactttatccccacttaattaatgttttctatacgctctcattaaaccacgtcactttaattgtttctagcccttagttgattaatctatagtccaaattattcctttttttctcttataaaaatacatcaccttattttacttttactgtatactatttaaattatcataaatcacatcaatttaagtggtttatagccttttgaaa

SEQ ID NO: 16767 - DNA, 1501 bp, Oryza sativa
gcttcgctagattttattttccgctgcagttttcttcatggtgaggactaagtgcctcttaagtaagtatttatcgttttagttaatttgatgaatctgtatattaaattgtcagtttgtgtacctcggctgattcctggacgaggattttatgcacaaataagttcggaaattactagtgaattttcgggcgtgacagcgacgtagcctgcacgaatccacgccgcggcgtagcttacgcccgtcgtcgcctcccgaagtcgccgacgaaatctccgccgaaatcgccggacgagacgatgaggaaaaaggcaaaaagcaaaatgaatctctcacacactctctctctctagtctgattcagacaatctctctctccggtgcggatttcaaaatttgaatagtgtatgtgggtcccaccattaacacactctcacaaaaaaatctctctctgtcggcaacacaaagtgggtcccacaaaaatgtaaaaaaaaaaagaagcccatttagcccacgtatggaagcccgaacttacaataatcaaaagcccacatacaaaagaaaacaaaagtctagatagcacgaatctcaaacaaaatccaagggaccaaaaaacgaatgatacagcctaacaaaaacatgcgatagccatatagcctttccgataaaaaattggttaacattttttctttcccctaaatttgtgcaacttctgttgtatgttggttgatatgcagagatgagactatatcagcattattattataagttgttaactagttgtagtgatggatatgggcataaagaagcaagttatatgtggaggaatgtaggcagttggcatggccgcacatgcacgtatgatggaactgagagtgagttggtacgatggcaccacctctccacattatcattaatgtttcctattgtttgttttgtttgtgtctcgacgagatgtataaatttggttggtacaatattacaaatattaatatatatatatatatattatgaaacgtacattgtacgtgcatgtttatactagtataatatataaaacagagggagtactacatattttccctatcatgggtaaacagtacagtgaactcggcccatttaggcccacccacctgtatttggatcgagacccaaaccagcccacgaaaatttgggccgcaaaatacgggtgggccggcctatacacttttgtgatagtgaacatgcagctttcacttcaactggtttagctgcgacggccagggcacgtcaaaattaggcagtgtggggatcggatcgcacgcgccacggggagccggacgaaaacgagaagctcacagccaccgccgcgcgccaccagcttatactctctctctctctctctctctcgtcgacgcgccgatgcgccgagatggccccgatcatgagtggggcggcggcggcggcggggggcacgggcggcgcggtcccgctcatcaagaacgccacctccgcgtcccaga

SEQ ID NO: 16768 - DNA, 995 bp, Oryza sativa
  unsure (1)..(995): unsure at all n locations
ttggctgaanaataaggggcctatgntatngtannnccntngnnnngtagncagngganccaagcttaaccagttcgaaccccgctccggtggtattccctccttccgccgttcctcgcgccgccccgccgaggcgcgccggtgtcctttttacatctcggccagccttcgtcttcctcctctcgccatccgacgcggccgccacgtaggcgccacgtcggctagaccaagtcaacccgccagcctcgtccccgctcgcgtgcgctcggtccacggaaagcctaacggctgtgcgtgggcccgccacccttcggtccacccggtgcaccaaaccgcgcgccactcccatccgaaccctagcgcgcgccacatgcaccgctcccacgatgagccgcgccaccgacaagcgggccccactcgggaccccgcaaggtggactcggcccaccggccctctctctccctcactctccccgcgccccttgggccgcctctctgggccggccggcccattagtttggccgagccgcgcctctcctctcgggccacgcccaagccgcccgagggagtctaaatcacatccctccaatttctttccaaaaagggtttaataaattattaaatcctttttcctttgattagtaaatccaataaactttgaaaatccatatattcccaaccgctcatccgattgactccgttccacttccagtaattccgtaaaattgagatctatttaatggcactattaattaggctaaataggatctttcttttgggtcttgtgtaggttttcgattgtttgcgtatagttgcggttaccggattttcgtcaatcgtggttttctcggagattcgtgaagcttcgtgaagaccttgagcaaggcaagtcaccctttgatcaatttctcctataattggaaagtcattattattttgtttgcaacttgcattattagaatcactcacgtttaacttgcttggcctcggtttgca

SEQ ID NO: 16769 - DNA, 1501 bp, Oryza sativa
atttaaaccctccccgcacctcctccgtccgtttccgcctctcgccgcccttcctcctcgccggaatcgagctcgcgccgtcgctctctctctccgccgtcgccgccgagctccggtcggccgccgtcgtcgccccggaccacctcccacctcggcgccgcctccttcggcttcgccgcatcctcgccgacctcgtccacccctccgtttcgctcgccgaccgccggaacgccgtcgaccccgtcgacccgagccgcaccgccgccttcctccgctccggccacctttttcgtcgtcgccgtcgacctagggtgagccgtggaccgccgcttcttttcccccttcccttcccctctctcggccgccgctccgccgtgcctatggccgccgccggcgaccataggggcgcgggcgccgcctcccgccggctacgccggcttggccgccctcgggcgcgccgagtggctgccgcgtggggcccggcagtcagccgcccgcgcccttgggtgcggctgacgcgtgggacccacggcgccggccggtgtgagcccgggtgcacccggtctaccgtggaccgtgaggctgccgcgtggggcccggcagtcagccgcccgcgcccttgggtgcggctgacgcgtgggacccacggcgccggctggtgtgagcccgggtgcacccggtccaccgtggactgtgaggctgccgcgtgggccccactcctgtggacccggtccgcgagccccctcccgtcggctgacgcaataaacccttttaaaattaaaatttaaatgaagaaattcgcaaatattcgtttaaagagcatataaacttcaaatgaccataacttggccatttgaagtcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattatgttgatttaaattattgcattatcgctttatttaaattcccgcgttatcactattttatctagccatgtctatttacctttgttatgaccttattattgttattgttattatttccttgttcaccatagaataaacaaaacctcaactagtggacactctactcatggtaccactagtatgattttaggtagatgcttcgctggttgattaggcaacattaggtggttttacaactctagactttgggatattcatatcacctggacactatggaatggtttgattattgtggaattggattcacacctccccctctattcaaaatcctcaaaatggttttaggctgggctcgggatgcatggttttgttagtagcacctcggccatataaggaccggt

SEQ ID NO: 16770 - DNA, 1462 bp, Oryza sativa
cgatattgtgtacctgatatcaactttgttggagtagaagtaatgggagtatcgctacacctctggttgaaagccagttgtagccccaactcgactacttgaagtaaaagtagtgggagaatcgctacaccactggtcgaggaccaggtagtagtcgtaactcaaccacataaagtggaaatagtgggagaatcgctacaccgctggtcgaggaccaggtagtagtctaaactcgaccacttaaagtggaaatagggggagaatcgctacaccgctggtcgaggaccaggtagtagtctaaactcgaccacttaaagtggaaatagtgggagaatcgctacatcgctggtcgaggaccaggtagtagtctaaactcaaccacttaaagtggagatagtgggagaattgctacaccgctggtcgaggactaggtagtagtcgtaactcgaccaccagaaataaggtgagagagatcactacgttctactggtttgagaactaggagtaggagtctcttaatcacctataggggcgctaaagttggtttattacatgtgcatctcatgtggccagcatgattcacataaccaacttatagcatatccggatgtccgctcgcaatcatgttggggatcaagccgacaacgtttgcgagaatttatccgttaacaaccttttctcgaatagcccagccatggtcggcgctatgagataggtcgtcggtcttcgttggcaggttaggtgcgataactccacatttgtcgagaatgttctcgataatggggtgtactcgaccacagcttactcgagtgctcaattgttcctgaaaaatattttctagaaggcaagacatatagcggataatatcgagtatgtactcaaaaaactgcatggatcttctagcattatcaggatataacgagcagattaaacatcaggcattatgtaaaccgtaaacaagcatgattcatacagaagagaacaaagtgagcccccagcgttagaccgtagttggcctaacatcggggacacttgcacaatagatattgtataaaaaacatgctctaggtaaacataataaattatagatctgataatgctgtatgatctgaataggtacgataaattgcatataacatattgcgtaccttcgtagatacatgccggatgtatctacgaaattagtagattaatttaaaaaaccaatctaccaattaccttgttgcgtactcgttcgacatcatacgttctgacatcttttggtacatcttaaggcttggtcgatctcaagagatcgagttgttgatgatgatggttccgatctcgtcgggagacatactctggtcgggttaaatctccccacagccgaagtcgtcgagtagtttgttttcggagaatccatctcttgaacccatctcgtcgaaaccctgaagcaccaaaatccccctacctggcgcgccac

SEQ ID NO: 16771 - DNA, 1501 bp, Oryza sativa
caacgcgtatcggcgtatgccgcgaaaccttcgcatgctactaccgatttccttccacgagagtcgcgcgagaaatagaaatgccagttgttatctgctgcagcctgcatgcgctgctatagtggtcacgtacggatggtccaatgatgcatgcaaatatgcaaatgaataaatgatcgccagcttaagctccatacagggttgcatgcatgcatgcatgcacgcacgccgcttctctggagcatgcttgccgggaatccatctccatgctagcttgccttgtcgacacgactattgtggagaggctacggcgagcagcctgtgggcgcgcgcttcggcaagggctgcgtcggagacatgcatgcatggagcgcagctggtcatcgcagacgcactccagccggtgtccatgatcgtggtttcgtgccaacgtcggccatgccatgccagccggcatgtcgcgaccatgcatggtccgttccacgccgcggcgtggctgtggttggcgtggacgcgaccgcgcgcagcagccggatctcgttggaggcctgctgctcgcgggagcttgagctcgccgagctgatgcggcgggaggccaccagggaatggatcgaggccccacgagcagctcctaggtgcactgcgcgtggctacctccaccgccttctcgtcggcgaccttggctagatgtagccacggcgagcagcctttgggccctctcgggtaggggcaggcgtcgaacatggcatagctggtcggagtggacgcgctccggcctccgggcctctggctggtctctgtggtggtgctggcggcgcagtctgcactcctaggagacgcctattgtgatggctggaggtggagctcgccggtgccggatgcattggtttagtttggttggttactatgtgcgcctcgtcgtccgctgctgtacgtagtgccgtccgcagtcagggaacgcctcgcgtcgcgaggtggtgtttgcaggtacgtcgagccgcgcgcgcgcccatggcaacctcgtcaggactcgaacgccgcagcgcatccttgtctatgtggatgcgctcgatctagcgtacgtccatccgcgacatggagatagtaccgtctggcgccaactggccccgcgccaactgcctagcctaggccgttcatcccttgtccgtgccgtcgtcgcgacggcgccgcagcgcacgctccgttgtgattgttgtgtccttagagcgtcagctgcatgtctcgccgccgccgtcgcgcgtgtgcgcgggcacgcgtatgtcctgatcctggcattgggggcgacggagtacgcgaacgcgagtcatgaacaccagacaccgcagctagcgtgccggcgccggcacagaatcgagacatgtactcctagatgcctagatggttgcatgacgtacatgctgcatgcgcatgcatggcatgcatgcgtccacgtatatatgaaatcctcgtcatccacaagtaatactagactactgaagtt

SEQ ID NO: 16772 - DNA, 1501 bp, Oryza sativa
ttccttcattgacatggtaatttcttcatggtgatacactgatacgacaaaataaacatgtgaaacccgtttgcttgttcatggccacatttgcgggttaccttagttttggtgttcaaattgaaaacccatcatactcggaagagtcaaaatacgtcaatcataaaagggtaaatctatctatctattatattattaaaacagccttgaaaggaggctccacgttcattgtgggggctagaaattccaacattaattagagaaaaagaaaataagagtccaagtagaaatacaactcaaaaattgctgaaattcagaattaaaaataagaaatattgaaagaagtctccatataagaaatcaatacgagattaatcaaaattcgaaataaaaataaaataaaatccgaaattagaaaataaaaggagagtccaagtaggaatataatttaaaaataactgaaactcgtaattaaaaataaggaatattgagataagggtccatataagaacccaatacgagattagttaatatacagaataaaaatataaataaaatccgaaattagcaaaaagaaaagaagagttcaagtaggaatacaatttaaaaacaactgaaattcggaattaaaaataagcaatattgaaagaaaaatccatataagaacccaatacgagattaattaaaattcaaaataaaataataaaataatatccaaaatgaaaaaaattaaaagagttaagtagtaatacaattttgaaacaactgaaattcaaaaaataaaaattaaaaatattaaaagaacactatacggtattaattacaatgaaaaaaaataaattcataaattataaaaataaaaaaattcaattaggaatacaatttataaataataaaaaatgatgataaaaataaatactattaaaaaaagaccatctaaaacacatgacgagataaattaagtaaaaggcctataaaaaagtagagtgctggcggttgatacgacatataaaagctgttagtaaaacatcaaatagaattctaatgatgattaaaaggagggatgacaagcaggcagtgaagcaaacgagtaaggcggttgccgggacttctagaaagtaagaaaaacaaaccccattgataatcatattcgatttttaaaatctcaatgacaataaaaaggagaagcagcgtgcggggtgtataggagtacagttgcagagccgccgacggttggcaggacttctagaaaataaaaaaatgaattccaacgatagttatgttcgatttttagaatcccaatgataataaagaataggcagcggataggccgtagaggagtatagtagcatcgtttgacgggacttctaaaaaatataaaaaaaagaaacccaacgagacaataaactctaaaaactacaagatccaatttttaaaggttcagaacttctaaaaagtaaaaaaaaattaatgataatcatgtttgattttaaaatctcaa

SEQ ID NO: 16773 - DNA, 959 bp, Oryza sativa
ggcaagtaattaattaaccaatcacgattgaccatcgtgagctaccattaaatataaccataaatgatagtgaaacattagttatcccaaatgtgtgctaatgtttctaagcatggctaagcaatcatatctaatatctagttgaaccaatatatataaagctcaactagtccaattataatcacccaaggtatcaaggaataaagtaatcaagaacaaaagggccataacaaagaataggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcatatgaatttattatgaattttacaagattaaatctaattaaagcccatttaaaaagaattaaataaatttaattcaatttatggacaattttaatatgtagatctttattttatacaacttttgcaacttgaaccacattaaactgagttaagatgaattagatatgaatttttaaagattaaatcggattaaaacctttaaactgattttaattgaattatgacgcaataatgaattatttttgaaaaggaaaagaaggattattgcgtcagcggctagggtttcggtggaccgggcgcacgggcgacggctcacacgaacggacggccgagatctaaccgatccaagatggacggccgagatcgatcgggtccacggcggttcacggcggacggccttga

SEQ ID NO: 16774 - DNA, 1501 bp, Oryza sativa
acaagcagtagctactcattctcataatatattatataagctaagtggaaagaaaagagaaagataatctactcctatacttctagtatacatagtatacatacattatagttatccaatatactagctaatcccctctatccgatgccctcctcgtactttgagaagccacccctgactgccgagttccttacgacagcctgtatgaccatacaaccggggctaaatacggaggagtaccctccccaaggatttaacttaggattatatacacgcgcggaggaatacccgtactgagctgtcaccatctgcggcccacctttcatccacagcatataaccccaaataatgatatcccgtaatctaaataccatgtctaaactacaatactattctaatatcatcgtcatgacatagagcaattgcataagcaaacattatacccgcaccaaagcatttcccagataagctagcagcatattcagtataacatgaacataatgtaaagtaggcatttatatactcggaaagtatttcaataccataaatgtatatagaagagtattctaataaaagtacaaagcttacaaaagagaaaaggaaagctactagagccatacccgaactcttctgaagacttccggactcctgatttctactctattcctattctactagcttgatactactaaacttaatatgagagagccttgcttgaggtgtgtaagtgaagtgagaaggtgaggggtttatatagcctcccaataacggttgtgacggttggaatggtcggaaataccctccaaccatcattgggagctaatccacaccgtccagccgcaaccctgcatccaacggcgccaggggggttcgggcgaaccccctggttcggccgaaccaggggccggcccaacctggccctaattcggcaggtggcctcctccgttgttcttctccgcagacttgtgaattttagcccaatttgtcgtgtcaattctgagttattggcccattcatgcataagtctgattctcgacatcgtccgattgatttatcgtctgtgttgatatcgattctcctccgtttcatggttattctctgcaaaaggttagtaaacctaatactaatggaatattattattctaacatatatatgcattgcaaacattactagttcttctctattttggtaatattgacggtcgaagctgatcgataacgaccgtcaacaaaaccccccaaacttaaacctttgctcgtcccgagtgaaggacaaaaggaaacaaaaactttgatcaggagttgcaactatgttgtatatctcaaaggtataggtgcaaggtatatatactctctctcatattaaataatcaacaccttgtttctgttattacgattgtctgagatggaatttggagatcaaactggatccgttggaaagagaattccgagagcttaattgttgggtttttgtttttgattaattgttgggtttcagtag

SEQ ID NO: 16775 - DNA, 1501 bp, Oryza sativa
gtaatctttcggaaaaaatatcaaaaaatctgtagcaaattttatctttcacaaaatatcaaaatattatatggaaggtttagaataaaaaaaaatatatcatattggaaacaaatagaagaagatctgtagtacatattccatttatcatcggtggcttcgaaagtccgtttcaaatatgtgccttatgagagaagggatagaaataacatcaccttttaagtattgatgagtaaattgcaccagcggttttttttcttaacatgtaaatagattttacctagattcatgaacttgcaaagcacgtattgaaatccctaaacccggtttattatatcatcccggtccaaagccttatttgaccatgatcttgcctacgtgtcatgccacgtggacaataatatgccaaaatttcccctttccctcattttattatttattttttgggagctcctcttcctaaccaatctcctctccctctttcctttcttcccttttcctcctctctcaccatccaaccgtcggctgttgctgcttcgatgttccagttgcagcctcttctccgttgttgctgtagtcatcgctgcctgctgttgctgcttcgatgctgccaccacctcctctccctcaccgccgttgtcatcgcctgctactgcttctggaaagttaggggtgagggagggtttctctacagccaccgatgcctcctccgccctcccatggccgcaaacaaccttatcgccgtcggatatccacgtcgggtcatcggccactccgcccttggggcagtgtgtccttgctccggccggctggtaatgaggaggagcgcatattcagcgaaaagtcgaaggaggaggcacagatccagtgcacgcaacggtgaggaagagatggagaagaggagaaggtggcgcatacccgggggcacatgtgaagaggaggagaggaggtagcggatgagatgaagagacaaacaagaggaggtgactacaatgaccaggggcacccgtgacaacaacgaagggcggcagacgagacagataagaggaggcggcgacgacgaaccagggacgcatgtgaaaacaacgaagaggcgaaggagcggaggtggtggcgtccactaggagtgcgcacgatgaggaggtggaggaggaggagaagctcttggtcaccgtcaagtggagctcgaggtggagagaagggagacgacggggagctcgtgatcaccatcgtcggctttagcttgagcatctgctctgccgtcgggccaaccccgctaccggtgcctctttctctgatggccaacaccgctctcttgctacctccctatctctgctacttgcatgacgctgccactggcgcatccaacggtgggggatgaagagaaaagaagggggaaaagggggaatgggaaatttttccatgtcatcatcctcatatgcaataccacggtcaaacaaggcttaatagagtaaaaattgtttttttcccttttatgatc

SEQ ID NO: 16776 - DNA, 1501 bp, Oryza sativa
aacactgaatatttgtggaacacccaggctgaagcagtttgcacggatacattcataagtaaaagaagatttctcaggtggaagaagagccataagttccatgaacagtgttgccttcagttcatcttccgtggaatgactcgataactcatcccaggcaaatgattccccaaagccaaatgtatcctctgggctaactatgtcttgtaagcaaactgaccatattttgtctacctgcatcacagtaaggattatttgttaatgcatcaagctatctgttaaattgttctcatataatatatatgaactaagtaaaatttactgctcatcctgattgactaaagtgagcacaataaagatcaagaaacaatcagtcatatttctgttataacgaaatatactaaacataacaacggtaaataacaaaaaaggcctgaatgcctcactttcaagaagacaaaatggaagtcatattcgaagttcttggcagataacaagtccaaatcaagcaaagtaaactagagctattgaatcgattacttctatctagcatgcaaaggagaaggtttatggacgccttacgagatccccactgagaaccaacgaagaggcagctggtccagaagaaagatggcgccgccatccatagaacttccccaacttctcctcccctcctcctcctcctcttgacgacttcaccaatgcagatgccgccacaagcagcaacagaaacaccactctcttcatagccatcttcccccctatttccctcgaaaaaggaccatctttttttttgccttcaaagatgaagaaatctttggggctgtgcaaaatgagatttgctccaagaaatggccgcggagaaggatgtgtatctagaaagagctcagtgctatcttagcttctccttctccaggagtcaaatcctattgcttcgtttaccactattcattaatcagaaaggcaataaaagaatcgaagtcgtagatactcttactttgaaagtcacacgagttaggccacactgatggctcaggagtcggcaaaggagaagaggaggtggtgactgaagcaagtgcacctgcgtctgcctgcaaagatggaatttttttatgctgagagtgaggtctccctctatctatgcccattattagtactcctattttttaattaattctttagtaggatcggatttagatttcaatgcgattattaaccatttccattcgtgtcgccatgattaataatctcttttctttttgttttcttggtcttgccaaatgcataggaaaaaaagattcggcaaaattccaagtcgacgcagtagaagcagtggcttcgcttggagaggagaaagcaaaagaaaagacgtggcctttatctgttcggcgaaggcgcactcgagccaaaaaaaaaaacaaagaaaaagcgtagaaaatgcggtgctcttgaggtttcgcgccgaacttcactgcacccgtcaccgcgcggccgccggaga

SEQ ID NO: 16777 - DNA, 1501 bp, Oryza sativa
gagagaggaggccggatttggaggcgaaaaaccgggagggcctgatccgaaagaaaaaaatcgggagccatccgatgtgggagaaaaaaatcacaggtcccaaaactactacaggcatgcacagaaatattatttgtactcactgcatacacagaacatgcagccatgcatgtgtccactattttaaataaactttaaactactttttctctcaaattacttatctaattaacgatccgattgcaccactaaattcgttgcaattaaatctttaaaacaagaccacacatgaatataatcgatgaaatgcattcacagaacatgcagccatgcatgtgtcaagttttttaaataaactttaaactacattttctctcaaattacttatccaattcacgatccgattgcactactaaattcgttgcaattaaatctttaaaacaagaccacacatgaatataatccgatgaaaaaaaattttagcttattattgaattattacttttccaattaaattaatcactgaaatgatatttaaattgttaaaaatacttccaatgctctaataatttcaagaaaaatcatgaaattacatgaacactataagtatttaacaaaattataagcagaccatttaatgattaactaaatatgtgaataataactgaaatgttctttgtattatcaaaattagtaattgagctcagaaaaatccgagaaaattccagagagtataattaatcatggagaatttaataaaaattaaatccaaccatgccttatattgaggaaattttatttcccacatttaacttcacttgtaaattaatgaacatttaatataaattctaataattatttattaaataatttataaatcctgaaacgaaaatcaggatgtgacaatattgtccttcttttcatacttatagctgtatcagttgagtttgatcttatgagtcatgattagaatctcaatctctagcctgcttcttggtagccgattagggtagtatcagggtttcagccgatcttacctgattgaactacaatacttgttttatatgcttcgttgatatgttaaatctgccctttatgctaagatcttatagcatttaaatatattaggctttcgtttgatatattctgcttgctttaatatcttaatatagagtggtatcggagtattagccgatacatgctaaatctacctgattggctatgctatgaacctatatagtcccattattaatatatatttcgatctaagtgatttatactgtctcggcatggcgaccgatctatcccaatcacttgatttaagtatatatcgatataaggagtatatattgttaatatctacagccaatcgagtagatttggttccttcttgtttactcatgactgtcgatcgatacatatatgacatcggctcaaaaataaatgatatgtcatcggccaagggtcgatcggctgtcatttatgaatttaaccgcggttt

SEQ ID NO: 16778 - DNA, 491 bp, Oryza sativa
acccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaagtcgtaccttatcgcccagcatcatcttattctctatttgtattccctccatctttcaga

SEQ ID NO: 16779 - DNA, 1501 bp, Oryza sativa
gccaccgccggcgaagtgttgtcggaggaggagggcgacggggcgccgccgccggcgaaaagaggaggagggcggtggctggggtcgccggagaggagtgtcccgtttgcttcttccagcttgagaccgacctcgtcgcgtggcccgggtgctccgtgcgccatgtcttccatggcgagtgcttggagttcactctcgagaggagtgacaagtgctaggaaggacctggttataaaaaatttgaagggaaactgttttaaacactcaggtggacatattaaatggttataaaaaattttttaaaaaattgacatgataggttaatatgtaatatatcatctcacaaacatgcaagttcaaattcgacttctacaagctgtaacaaaaataacaaatttgactgtgaatatacatatactagttagagttaaatttgttatttttgttatagcttgtagaagtcaaatttgaattttcatgtttatgaaatgatatattacatattaacctatcttacaattttttttggaattttttcataatcatttaggtggcatgcaagaaatgggtggacatccacccgagatattaaaatccatctccaaaatttgcaggcttgagttctggagccattgatcattgatgctgctgtctcaaaatatagtaacctaaaactaagggtgcgctcgtttcagtaggtgtggtggactgattagccacacgtaaaacgagaaatgagattagcatatgattaattaagtattaatatatattttttatgaataaatttgttggatttttttaaacaacttctttatagaaagttttcgcacgaaatataccatttagcagtttgaaaaacatgctaacagaaaacgagtagaatttaatcctataagctgaaaagagcgcaacctaaatgagacacatataatagtacaatgaatctgaaccgaggtatgtctaaattcatacgagggggccaaacgacaatgaacatataaaaacattactatatgttagtattatgccaggaatctaagcttgcaatggtaaaataaaggataacaacatattatatatgtttaatttggttgcttggggggaaaacatttgcccttatatttgacctataagcgtaatcgaatgttctctttttattcattattggacaattaagtactactctctccggtttagtggaacaaacatgtatacaaaatatccaatgaaattctcaaatgcttttacaaattttgtccatcaatttaccaacaaataatggagctcaacaaagtgagtttttaaataaaggaatatcactacaactttgatctatatgaagtttagtttacgttcatttgaatggatcaagaaacagagtcctcggctcggcaaagtccttatcatgagacaagagtcctcagcttggcagtgttctcaacacaacaaccattcagaaacacggaggagggggaggcaatctcatccattcgatcta

SEQ ID NO: 16780 - DNA, 1501 bp, Oryza sativa
ttttggaaggagggagtaaaaaaaatgtatggagtaggataataataatgtggacacttctatatgagagcttcaaattagtatgaagaaagatttctgatacaataacaagattattaatttctatggtattatggaacgttgagagtggccttgtatatgcaagaactataaatcctcaagaagatcctagagtcttagaccaatcgtaagtcaaatgcgagatttaattttgcagaaatcttgaagagttgtttggatcccaagagaagtgaaatgtttgtctgacaagttagcaagagaagctagaagtcatcagatggactctcctgtttatgactgtcaaattataacacatatagcttatcctggaagctcatgctattcctcggctgaaagactgtttcagtgaaactaattgcacaataaaccaatttttaaccttaaatttggagctgattttgggattttttttatcgaagtttatttttcaacctttgcttttagatcgctaagaacatgtatataaaaattttattcacaaattacttttcgtttgcaaatgtcatttgccatttgggttatacacttaagtcaactataaaataattgactcggttatctaaagatgaattaagtgcaaagccttattaattacctctcttttattgtctcctgtaaagttttatttatatcgtgctttaacttttgattgaagattaatttcttgatgctttgcagtaactgggaaccccaaattttggatcagacagaaagctcttcactttccttgtctgctccaggagtaagtagccttgaaaagttcatatttactaaaacagaatttagtcagttcccgggatgtgtagatgtgtcggatcagaaagaaaactcttcactttcattgtccttgggagtaagaaaccctggaaagtgcgcagttgatacagaatccagtcagttcccaggatgtatagatgtgtcggatcagaaagaaaactcttcactttcattgtccttgggagtaagaaaccctggaaagtgcgcagttgatacagaatccagtcagttcccaggatgtatagatgtgtcggatcagaaagaaaactcttcactttcattgtccttgggagtaagaaaccctggaaagtgcgcagttgatacagaatccagtcagttcccaggatgtatagatgtgtcggatcagacggaaagctcttcactttcgttgttattgggagtaagaaaccccggaaagtgcgtagttgatacagaatccaaccagttcccaggatgtatagatgtgtcggatcagaaagaaagctcttcactttcgttgttattgggagtaagaaaccctgaaaagtgcgcagttgatgcagaatccagtcagtttccaagatgtgtagatgggtcggatcagaaggaaagctcctcgcattccctgtgcgcttcggtagtaagcgatgcttcagaaatgctcgcagctaacactgtaaaa

SEQ ID NO: 16781 - DNA, 1501 bp, Oryza sativa
tatctaaatttgtttttttttgtttcttgatttgtagatcgaatttgaacatgaattttggtggactagtaggtaccattatactctacattgtcaatttttttcagattttttcacaactatttacatcgaatttagaagaaaaagatatacgaggggatatcctctcgagggattagaatccactcccatgtattcgttttgtgatggtccgtacgtgcaagggatcatctgtatcaattgtgcatttgtttgcggcaaattgcacggtttgtggttggaaacatgcgagatgataacgaactaatcatgacaaccttggaacatgccaaactctctgaaagtagacaggggaacacacgcgattaggttccttgtaaatctgaaccacgttgatgcagatgttattcacgtctttaatttatctaggatcaatgcagacgcagtccttttcaacagatgtccgcatgcaggcaaggtgatcaaacccctaaaaactggctcgatttgtgcttatttaaatacttgaactggtcaatttgctccaattaacctgcctattcacaagtatccatgctatctgatcctgttaaaaacattacatgccgaaagaaagcattgattttttttcacagataatatgcattcaaatagtggataaaaatactaaaatagtacacctttttctagataatggacatttcattcatccggctagtgcactaggataaaaatagcacactgttaaaaattgttataaatacgtaccctgatctcaaatttatccattttttactccattccatggtacttatttaatacattaatttgatgccccaatagaagcacgccaatcatgttataatcaaacagcaatcaccatttcatagtagttacaaatttaaaatgtttgattccccaataataacactgatcactgatcaatcatggcatcatgcaagcaggactagcagaatgctttctcctcccacactttcgctgttccttcatttctcacctaaccaaaggacctcatcgtctaccctagtacttataagttgttgccaaaatttaaattttaaaacttgatttggatcaatgcttttctaacgtagtttttcttcatcattagtttttgagaaactttatagtccttaataaagtaccttatggtacttaaattttacactacaatttttagtatttagaggtagcaaattatacactataaaatatgatatctctagatatcttctcaaggatggtaaaataaccattagttttttaagccgtcaaaaacagatttgtaaaagttcttatctataatgttttaatcactaataaaccattacggtcacaggcaaccgatagagtcccaaccacgcttcacacttccatcccttaaagcaagagctcactactacatacatacacaccgagagagatcacatcccaagcgaaaaattggttattagtgggagcgtgcatgcctccatttctg

SEQ ID NO: 16782 - DNA, 369 bp, Oryza sativa
  unsure (1)..(369): unsure at all n locations
gtgggatggggtaggcctattcccctttttttgaatggaatggtcccagttgtggggtttggtttgtggtaaagaatggttatagtttttggttgggaaaaagggatgaggttggnatggaatggccattgtttcacggccggtaaaattggggccgaagaaccaggtcgccccaacgaaagaaaggccaccccccaccgaacccgaccggaagccgccggaacttaccacgaccgccgcggccggtcccgaagccggtcgcgnacaagccgagccggggccggnanataggccagganccggtcgagcggcggcggccggtcgcggatgaggcggcggacgtggcggagagagcaggcgggggaggga

SEQ ID NO: 16783 - DNA, 722 bp, Oryza sativa
atattttgtttatataatttatttgagttttaattagggtaaattcttattctatcgcaattaaatttaattgatccaaatatggtcgcgataatattttatttattactatccatacctaatcttttatttttaatttatatttattttaccaatttgtttttaaggtttattaaagattctataattttctaatgagacctgttattaacataatagcacattagctcaatttatctatatgttagtttattttatatggaggggtttaatatataaaatttcaatccctaaatgcaattaggaacttggtgcaaaatcgatctacatatcgaattaaatactcccgtatttctattatatatacagagagctcagttcatttgaatgatcatcatttcatgtgtactcgtattatcgcacccacctatattattcaaatattttaatattttataaaataggttaataataacttttaatttatttgattttaatatcttgcacataattatttgtaggattaaatatattctcatgaatcatatctattgcttaaatgtagttcttttctttaccttcttggtgatcatttacggtttggcaagcaataggaatcataacaatcagcatgatgcaaaagttttttttttaaaaaaagtttgaaattttagtgatttttattgttgggaattttcaggatgttacaggaaacctgtaga

SEQ ID NO: 16784 - DNA, 1311 bp, Oryza sativa
cacgtagcaaaatcaccactgcgcacaggttaattaatttcttggcaactagcttctcaattcgaaggcgaaatgagccatctatatatgagacgatgacggcatacaatgtatttaagtgtttattaggtttcggtgcatggaaagctatcaaattgaatcagttcttaatgtccatcaattgatttttttttcgataatggaatactccatcaattgagttattagttcatagttttcatacaaaacgacgtacgtcgtcggcatgtaacctttatgagtgaaaatatggtattatgtacgtcatgaaacatatttccatgttgtttcttagtgcttcatgtgaatacaaacaatcaaatatatgcattaaaaattgtatcgatatcaccctaaagaacaaacaaaaaagaataatttgaagctgattttaattaaattctaaattttgattttataattaatttacagggccggattttcttggtcgcattcatcgcaaactcttttcatgatcgttgctaattaagatgataactaaaaaccaatctaaaatatatcgttcttaaaatccattctaaatttattaggctatagtcctaagttgtgctagctagtcagcaagttcatgcacttcactgccagttagctaattagctggatgcattgcaggcaggcaggcatgaattggcatgttgccgacaacggcaatgtatcgacggcattccacatcacacatttgatcagctcccgccactaattaaattaagctactaatagctgcatgcatgcacagtaaatgttcatgttgaacctaacacagtcaagtactgcacgtccatctgaaatggacatatcataaggtacaatttaatgatcatgcatgcatgcatgtaccctgtgtactggctcctcctgagtctgcggcaatatatgcatacatggaatgacagagaattgacctcgagaaaaatggggtgatatacagggaagcagaccacaagggatgttaattagtaagatgaatgtcgacacaatatgtacttgaaattagagcagtctcaagtgcaagatactagtaccaattactccactagagaaatggtcatctgtgtaagttacagtccaacaagaacatgacggttcagtcacccgttgcagtcaattgatcacgtactgatgatgactagtcgcatctctgactgttcatatctattgaaccatcgaaggttgtgtttagttcagcgcaaagtttggattttggttgaaattaaagatgatgtgactgaaaagttgtgtgtgtatgacagg

SEQ ID NO: 16785 - DNA, 1370 bp, Oryza sativa
tgactagctaatgggtttggaaaaatatgccccacccatcaggtaagattcaattctagccatccattcttttcatctcatttaatcctaggcatcctctccttttcatttcccaactccacctcccataaccattttgccaaacagggtctaagtgttgcacattcagtccttcatgtaattaacatgctgcaaaatttcgtatatgtatttacgttattttgattcataaatgttttttttccttgtagaaagcagggataatatattgggatgatatatatatggaataggggtcacaacaaatgtttacgagccaaaggtgaagcatcattgggttcctagtggatcatggatacaaattgaaaatggcacaggatgtggagatgtggttagtgctagctcttgggtctagccaaacttcagcgatgataactttgctaggtttcatatttttgtcacgcccggaaattcactggtaatttccgaacttatttgtgcataaaatcctcgtccaggaatcagccgaggtacacaaactgacaatttaatatacaaatccatcataataataacgttacacacttataatatcccaaggtatcaaggaataaagtaatcaatgcaaacaggccataacaaaggaatagattcacaccacccagtgacattcgaaaataaatgcatagttgaaataaatagagaatttaaatataggatcaacatgctcaaaggattgtgtttaggatctgtgtgacttgccttgcaataatcggtcttcaattagtcttcttgaatacttccggcgcactcgcgaaccttcgcaacgacggaaacgacaagctaacacgcaaaacgaagaaaaagactaataaaaaccaaataaacagtacatataaagtactcaaacatgtagatcataattttagatgaattatgagacttgaacggcctcattctgacttcatatgaatttattatgaattttacaagattaaatctaattaaagcccatttaaaaagaattaaataaatttaattctatttatggataattttaatacgtagatctttattttacacaacttttgcaacttgaaccacattaaactgagttacaaagaattagttatgaattttcaaagattaaatcggattaaaacacttatatagattttaattgaattatgacgcaataatgaattatttttgaaaaggaaaagaggattattgcgtcagcgggctcgggttcacggtggaccgggtgcacggcggcggctcatggaaacgaacggccgagatctaccctatccacaacgaacggccgagatctaaacggtctacgaccggtctatggcgaacggcaacga

SEQ ID NO: 16786 - DNA, 1501 bp, Oryza sativa
tcgggaagaaagatttccaaccatgcttatagagtcgaacagtaacaggaggtcactataggacgggccaaaactttgaatctgtttgaatttaggaaaactagaggatttcccgtgtaattttgcacgaagctagattttaaatgctaaattgggtttgatataaaaaccttaactcatgtttccaaacttatataggtagaattataaaatatattgtgtacacaataggtttgtgaagtaggattatatctgatatatacttcctcagttttttaatgtataacactgttgactttttaagatatatttgatcattcgtcttgtttaaaaaaattatataattattatttttaatttattatgagttgacttatcataaaaaatctttaagcataacttaattttttatattcacataaaaattttaaataagtcaaatggtcaactttttttaaaaaaaaagtcaatgacatcatatatttaaaaaaacagaggtactatagaattctcaaaaagagccgagaaagtggtgaattacaaatatgcccctctttccccttcatctattattcctcccttcctactctactccctcgacttctcgagtctcgattctactctgtctccaatctacgcagcgaaagccggcgccgccgtctcctcgagcgcgccgacggcggagaagaccgcaggcacggcgtcgtctacggcctcctccccttccttccagaccccggccacggccgcgccgcgccccgccctagcctccgccgccgcctccccagtccggccgcctggcctctccacgcgcgcacggccggggcgagcaggtcttttgggggtgggcgacgccgcccgtgccgcggcctcctcccacctgaatccatcccagctcgcgccgaattcggaggtactcgtctcctctctctctcttctctctctctttccctccaggtgtcccgtacaattccttctggatttccatcattccatgatgcctggtggattgtagctgctcgtgtttccacgaaagaaggtttgggggtttatctccgaatccttcttctgggagggatactctaattggtccggtttgctgcggaaatctgtggagctcgggtagatgctccgtgttagtttcgccaccgcgcactgcaaattctagtggagtgaagaggaatatggtagaggggttgccggcggagttgccaatcgtggacgtggccgctcgtttggatggcaagagctcggagctgccagagaatggtgcattgctgaagggtgctgaggaatcccaggtttggaatgttttagcttactcgggaagtgccaaatatatttgcttctattcgaatgatttgtgatgctttgtttgcttgctaggatttgggaggtaatcccgtggcggagttgacgttgcacgaaggcaaagaggtgatcctcgtcgatgacaatgatagtgagcaggaagacggtgggagtggcaaggtggatgaga

SEQ ID NO: 16787 - DNA, 756 bp, Oryza sativa
  unsure (1)..(756): unsure at all n locations
gggccccnncctgtcagcacccgagggagaaagggggaggcgacctggacttcgggagggggcgggagagatgggccggcggcccaaaggaggaaaagagggggaaaaaggaaagataaaaaggaaaaaggattttcccagggatttaatattgcactttgcttattttaattggttaaaattatttccaaggctctgaaaattccactaaaaatcctgttagcatattttgacatgtagaatccaagaaaaattccacatgccgattccgatgattatttgcatttattaattaaggattcaactctaggttaaattaaacaatttcttcggacgatttattttatgaatttagagcaagggaggggaacttcagggcgtgacaccaatggaagtttgcgatgcgagagattgctacgtactggttcaagaaccatggaagttgcggtgcgagagattgctacgtactggtttgaggaccagggagcgagtagaattatctctcgaacaccaatagaagtttgcggtgcgagagattgctacgtactggttcgagaaccagcgaacgtgtagagttatctctcgaacaccaatggaggttgcggtgcgagagattgctacgtactggttcgagaaccagcgaacgtgtagagttatctctcgaacacatggaggttgcagtgcgagagattgctatgtactggctcgaggaccagtgaacgtgtagagttatctctcgaacaccaatggaggtgc

SEQ ID NO: 16788 - DNA, 194 bp, Oryza sativa
gggcgcgcggcgacgggacgggcgacacgacggcgctcggctcggggcggcgaagcgatgggcgggcgacgcgacgggcggtgacggggcgcgtgggcgcgcggggcgacgggatggcggcgtggcgcggcgcggcagcggcgaagtgacggcgcgcggtggctcggggcgcgaggcgcgcgcagcaggggaga

SEQ ID NO: 16789 - DNA, 1501 bp, Oryza sativa
acattcgatagtttttggaggaaaaaaacttgtactaaactatagtataattaaagtgtaactaaaatatgtaaatttattttgaaatcaaaacttgcactattactccagtgagtaggagggtgcgggttcgagtccacaaccaattcaacagcctaaaatcaaaagtttttccctaaaaaaatattgcaagttacctggcaatttctttggtttgtactgccgtgtcggcgaacaagtaagacgtgatcattaccgtgcagcaaacgcatgcgcttttcccttttttttttcatggcacagtttttttttcctgctaagtgtgtatacatcaagagtttgtatttctaagagtaaatttcacaaaatcacaaattctttattcaaaatatcacaaaactacatatttaaaacggtgtatcacaaaaccatagatttaacaacaaattcgccatgaaactacatgtttaagataaagtactataaaattatagatctagtaataacaaaattatcacaaaactatgagtctagcaccaatttaatcgcaaaagtacaacatttacatcttcaatataacattagttctaagagtttaaactctaaaatatgcaattttgtgataacatcaatattaaatatgtagttttatgatacttggtattaatttgtaattttgggataatgcctttaaatctctagttttgcgatagttttgttaaagtatatagttttataaaatttactctttctaattcctgttcggatttcaattcaaattcagatttacatgttttatatctatattataaggtttagcttataaagtttttttatataaactttctatgacaacttatcatgatgggccagacgcacgtggggtcggccgaaacatattcgtgttcctggccgcgcccgaacattcacacattagatctaccgtcttttttttttttgaaaactaaacatccattaatataaaccgacagagttcacgggaataaatcccagtacattgccaaatagataaagagagagcgtaaaaccatccgtttctaaagaatggaaacctgcactaaggctacaaacttcataatgaaaccacacagcagataaggtgcacatcgatagggagctgcggcaatgccgcgacgaatgcaaccttgggcctccttcggcgtgcagcccgcttgacaaaccggtaatccccatccggttgactccacaaagactgcacaaaacggaggtctgctgctgagccatagattttggagtaagcaacaccggactcagcaagaggtgtccacggagttcgtcgttaaatctgaggagcgtgagctcaacccaaacaacaaaccctgcatggaacaagctgataggaaacatataggaagaaggagcccaaatccagatctccaaacccactgaaaaactcgaatggtggcaaacgaactgctgtcttcttggatcgacgtatggggatggggaagagtaatcc

SEQ ID NO: 16790 - DNA, 1501 bp, Oryza sativa; identical to SEQ ID NO: 16744

SEQ ID NO: 16791 - DNA, 1501 bp, Oryza sativa
ctcacccgcatatctcgtcaagtagtcaaactcaaactcccaagttacactctctttctctaaattatccatctccctttgactcgtctccgaatattgttctcttccttgactcctttctattctcccaagaccgagtatcgacttcgaaattcaagtccagactccaaccctaaaaccttccaattaaatctctctgtaaaagtctagttaacctcccccataggttggattccttcttcctttttccggtccacctcttccttctcttccatcccgtctctctctgggtctcgacctatcaacctatctacctatcaatctatctatacatcgatctacctaacgatctatctatctatcgatccatctatctatctactatacctatctatctgtttatctatccatctgtctatccgttcctctacctatcaacctatctctctgtctatctatctatccttgaactccttcccaaatatttgtcccatggtacaagatttctttaaaccccccctctcaataatccttgagccaccaaatacaaatatatccctagaatatcaattctcgctttgaactccaacttcccatcgacatcgagaatcatgcctcatcgaaattccttcccatttccgaaagtatcaaattcgctctttgaatcccctccttggcttctccaaactttgttgagctcaaatatccaatttgaattcaatccagaaagtcgatcccttcctttgaatccttgccgaatattcgctccgactacaaaaatattcaattcccgttttgaatccttcttcgactcttccttattgttcctagagtccaagtatcaaggttaaattccctccaattcaaattgtctccacattcaatccatctaaaaaagtctattttgcctccctctgctttgtgggccgaattcctctccctcggcccatcactctctctcagtccgtttcctcctctctctccacgtgcgccgcgcgtgaccaccaagagagagcgccgtctctctcccctctctcggacgttctctctctcgttctctctcactctccctcgccgcgcccaaaccgctccccaccagcgccccgccgattcaaaccgccaccattcgattttcgccgccgcccgtcggtttcccgcgcgcgcgcgcgtggctaaccacgctcggtcggtcgccgcgctcagttgtcgccgcgtccgtccagacgccgcccgtgccctgttgccgcatgcccggccgctccaagccatgtgcgtccaactcccggaggcagagctctctctccctcctcctttctcccagaatggcatgggcagagccccctttcctccctcccctttttgcttttttccccgaccggcaccatcgacccccccctctgccgcccgtgactgccaagttcgccacccccaccttgaccacacgcgacattcgagctcccttgaccatctaagtcggttccccctcctaaaccgcctcttc

SEQ ID NO: 16792 - DNA, 1501 bp, Oryza sativa; identical to SEQ ID NO: 16774

SEQ ID NO: 16793 - DNA, 1501 bp, Oryza sativa
ttatatgttattatctggaatcaactggcgaaaaaatggaatctttatcatgtaagcctgatttgcgatttttcactacgtaggtactttcatgaaggtaagtagcagaaattcggtgcccgtatcctgttgtttctggttgacgtcttcagatcctcaacagaatcgaaggtaaacaaactattttccctgttttccttgtgtgaatgatatgaaaaaatattttgcacttgttcagtaatttgtgcaaactggaaatactgaaaatactaaggacgaagaataatattcgaagccaatccaaaagcattgcaaaatgtcgaaggacaaaaactcccagtaatgcttgcatgaaaatagattaaaacaggctctccgcgaacaaaatacatttcttaatattgctcatttgataacgaggctggaaacctaagcttttttttgttatcaaatgttgcacatttgataataatccatatttcttaatattgtctgcacctttcgtttgcaagctccaagttgtaaaatccaatcctgactgcaagcttgtttacaattgtttggctagcagtttgaagcttctggagtattaccactagcaacagtaggagcaaggtctgatcgggtgctccctgtgcatagctgctattggttcattgttgttccaaagtgagcaatagtatactttagaaggaaatgagggtgttgaggcgattgtcaagcaccaaacttcttccgcaataaccctgacttccatgggaaccgttctgttatttgttttgctatagaatgagaaccattgtgtagaattttgtaaacaactttaaccattgcttctcagcatgcaaatgcagatccattcctttccaaaaggattaggtaccatttagttttttaaatatatgattagcaattgtctataagcattaggaatgagaagtagatgaaactatagacaaactttctaatttgtggtccttaatgtgccgttccattcattaattttgttatatgtggtactagcatgtgaatactataaagatgtgaaaattataaatatgtgacatacttatcattagttctatattaatgtttttgttacatccgatttacacccaatgattatttaacatcatttcacttggtgtgattttccctgttgcaatgcacggacaccctactagtatttataatttttaaacatatggcatataactccgcgaatacacaactttaaatttgtctttaacaaatataaccatgaacacggatactagtcagagtttaattcattgttttgttacagcttgtaaaaatccaatttaaccacgcatatttgtgaactgatatatctcatattatttaaaatatttttttatatctagataaaatgcaataaagcgaatgagaggacgcttgaagaggaaaaatcattattattattattattatttattattattattattattattattattattattattattattatttt

SEQ ID NO: 16794 - DNA, 491 bp, Oryza sativa; identical to SEQ ID NO: 16523

SEQ ID NO: 16795 - DNA, 1501 bp, Oryza sativa
aactgaacatgttctatccccacaaatttaatttttgtggcaatttgcatagtacatggtactttcactattttctattgccatatcaacaaattcgttgcgataaaaaatttatcatctcataatttagcttattattttcgtatggatacggattaggacaaattttatatgaaatttatacctctcgatgagatctacaacttaaatttttcatttgaaatcttttaaatactcaaattcatgattcaaatctcagttaagcagtctcaaatggaattatatacatttttaaacaaaattgatgcttaggtgagttggtcatgaagagcgcgcgtgagggagaaatcttgggttcgaatcctagccatgacaagatatcaaaagaaaataattaggatgataaattaatattgaaacatttaatttggtacgtagaactaatgtcacacatggagtggtggcaatagttatttattgcaacgatgtgaagtgttgtaatatatattttttgccacatacattttatggcaataacaaaatttattacaactaaataaaaatcattgcaataacctattaccatgctatttattaccatggctagcaacgattttaagattgtggcaacatgtatctattgcaataattttagcattgatactacgattttttttatggcaataaattatttttctaatagtggatggaggtggtcctgctcctccaaggtgtcgaggagctcctcaccatcaccaatatgctctttgtctcccaattgctcttcccctcgggccactcggacccgacttgccatcgtcacgcacaacccctgacgtcagctcagatatggtatcaatcagtattgcattgatatctataagttctgatggtatcaacgggtatcaacatattgtacttatggggtatcgactgatacctatgcatgggtatcaccttataccaataggaattagaacatgatacctcatatgtaccgatacctaaccagtattattgcatccaaacgggattctaattttaaaaatcttcaatcttattcttttattgaactgtctaaactagtttcattatgttccaataagtgttcgatgataatcatgaccatctcgaaaggctatagctcatgtgttccattttctgcttaataaaattcatatcactacatcaagatatatttttttccaaccttccttaaaaggagagtaaattgcactgacggtactctgaggtggatgtaatttgatacacaaacttgcaaaatgcatgaacttgtgtggtgcatgtgaacccagccaaagaagcataccatggttaatcctacttaattgaatattttattaggatgccatgcaggcacatatatcaggatgatgtcatctagatatgcatgtactcaatcaaatttatagtaagggatgttgattatacaaacaaataatttgtagcatagatgaatgatacaatgaattgaaaacag

SEQ ID NO: 16796 - DNA, 821 bp, Oryza sativa
ctgctgatgatgatcttgttgtgttcttccaaatggagatcgaatcgatcataattcttggattattcttcattgctcaggacgatgcactgccgcgaagcgcgcgcgccacgcccggcccgatacatttgctatttatgttagatcagtcgtttcgtttctagtgatcgatcaatcagtccatggtctttctctcatctcatcttttgttagggtttcccttttctctgtagaagacaatgagaggttggtcaagaaattataagggttttgcaactgagatgcatcaaacatcttcctagtaattctttagtttctctactagctatctatccagcccatgccatctgcaagctctggtcttatcaagcttcaggaggaagctgaagctagctgctagcttttccaacgcatggatggagatgcatttatgcatgcctttgcatgatcaatcgatgtgctatctatctatctatctatctatctatctatctaactatctttctttcctctcttctcaccatgagtccaccatgaccaccactagctcttcttttgaagatgatcggtagaatctctgcagggaaaaaaatggtggtggtgtgtgtagtgtgtacgtgctccccttaattatgtctgcttttcagaggagatcgatatctctctctgtgcgcaggcagaggtgtagcttttgggcgacatggtctcgctagatctctcctgcttttcagttgcatggtaaagagatttgcgtctgaaaagtttctctcttggtgagagaagaaaaaagatgtgtggatggagctaagctacgccatagg

SEQ ID NO: 16797 - DNA, 1137 bp, Oryza sativa
caagatatcccataaaatcaggaaaagaaaaaggaaagagttcttaatcttaggtttgccggattttattgcacactgtgtacctgactctcatgaatcttgcaaactttataaaagattaaccggttgcatctttcatctacattttatggagatcaatatgaagtacctaaaaataataataatccttattactatgtgatttttccagaaaagcatcagttcattagataagatttctaaaaagaaaacaaaggaaagcatcccaagattccatttggaatacaagtctagaggatgagctgaaaatggataattagacagatttctgaaaagaaaacaaaggaaagtatcccaagattccatttggaatacaagtctaaaggatgaagtgaaaatgggataattagacagatttctgaaaagaaaacaaaggaaagtatcccaaaattccatttggaatacaagtctaaaggatgagctgaaaatgggataattatactttttaggcttcattcggcactaccatttcccagcttatattccctcattttccacgcgcgcacttctgaaccactaaacagtgtgtttttttttttgcaaaaattttctataggaaagtggctttaaaaatcatattaattaatcatacgctaatgagccatttcgttttgcgtgctgggatgagcagatcctgacctgctcatccgaacacacccttacttggtagagaactgcgagttgatatgtgttcagaaagagtacacgcaacacaagataataagatggaaaagtgaaaaccaaatatgtgtacctgatgcccaatgaacctggccctccttaagcattcacggtacagctacaacatgaaaaaaaacaatgttcaacagcaaatgacatttttgcctcatctgacattatttcatttcattgcaatggtatctcataaataaacacaacgaaaaatcaggctacacgggcatgacagacatgttttggaaaagcttttgtaaagttttagggtgattcactgatagagctgctctaactatacatgtaaaacatttacaagactgactgtagaactgttctaaccaaagaaccatacatgtagaaattagggaccgactatagaaa

SEQ ID NO: 16798 - DNA, 1501 bp, Oryza sativa
atgccagatttccttgcaggggcagcccatctgcaaaatgtatcaaagaatgaagtatagagtacctcatctgcttaaatgctgacgtaaccatgtactccctccgttcagctatataaggtgagttttctttttgcacgtagaacaatgatccagcagaaaggactaaactgcccccaattagtgccttaattacatacatgcaacttcataactcctaccgcgaaaactactatggcacgcatgcacattcaatgcaataactatgaagccaaaacaactgcatgcatttcatcgcaaagagccagatcctcacgtcaaaacagaaactaaattgtcatttgaagtattaaatgctatgctgcagaaccaagttagcaggggaaatggagcaaaaaaaatattactctgaaaatagtgtgtgccttatatagttgaacatgcatacaagtaaaccatgccttatatagttgaatggagggagtaacaattaaaggaactaccttgagtacacaagcataaaaggaatactattgaaaaataaaataaaatatacagtcttgaatggtaaactgatggcgcataatcatctactatgcaaagaaaccgcgggaatacccaaaggcgttttagaaaatgccatcaacaaagaagcacatacacaagaaatgatgatttcatttaaatcgcatgaataattgtgtctgagaccaaaaatccaaacgacagcaatatgccaaatcgtgcttgacgacatatgtcacaacaaatcttccaactttacgtaaaagccacttgaccaaggcgcaaaagtgaaatcagtagacctatagaactggacagttggataggctttggaattcctcagacatgcttactgcgaatggacgaaacctaacatggtacgaaacctcagttatcgcaaacttcatgcatgcacgtgtacaacacacgtatgccaacactgaacactgcacatttctaaattgtccacactgaataaatactaagtagaacactctgttcatagacgaatagataactacaatcattttcttaaatatcattctcatgccaccacactggtaaaaccatcttctgaacatctcgcaaccgttgcccattgcccccacaaacactagatcggaccaatccacccaaagaacacatgacctatattacacaccaccagaaactactatccacacaaatcaaacgaaaccaaagcttcatataccagcataagtgacaccctatcaaaccggtggtaaataatctaaaattttcctataatttcaggctattacacaaacataaccaaactctccgttcgcaacaatgcacagatttctacatgcccaacccatccaacatcccgctcgcgacgattaaaaataaaaaattaaattgaatcgcccgaccgcacgagggcggcggctcggggcgggtgatgagggatcgcgaacctcttgtccgttgtgagcaggctcgacgccatagc

SEQ ID NO: 16799 - DNA, 1501 bp, Oryza sativa
attctcaaattagtacactttacttcttttccaaccactgttgagtgaccacgtctttcgacgaatgtggttgtcgtttcgacaatatatatatatatatatacatatgtatatatatatatatacatatgtatacatatgtatatatatatatatacttatatatatatatatatatatatatatatatatatatatatatatatatatgtatatatatatatatatatgtatatatatatatatatatgtatatatatatatatgtatatatatatatatatatatatatatatatatgtatatatatttatgtatatatgtatatatatgtatatatgtatatatatgtatgtatatatatatatatatatatatatatctttatctttatctctactacttaaaaaataagagatgtttccatcgtccgtcaaaaaaaccagacgaaaaaaaccgagtgaaaaaaaccggaataagaaaagaaaaaacaaacataaaaaaacgcaaaaaaacaaatatgtctgataaaaaaacccaggcaaaaaaaactcttaaaaaataagaggtgtttccatcgtccatcaaaaaaaccggacgaaaaaaagggaaaaagaaaagaaaaaccaaaagataaaaaaacaggcaaaaaaaagaaaaaaagaaatatgtccgataataaaacccgggccaaaaaaaaccagaaaaagaaaagaaaaaccaaatctgtccgatccaaaaaaaaaaggcgaaaataagggaaaagaaaaatgaatccgactccgtcaacgcggtaaaaaaaaggcaaaaaaaaattaaaaaaaaatctctccgattctctatctctatctctatctctatctctttttttaaaaaaaaatagatgcttccttcatccgtaaaaaaagatagcgaaaaaaataaaataaaaaagtccaactcatatatccgattccctcttacaaacaaaaaaaaaagtccaactctagattggtgaaaaaaattgatgcgccggattgaagatctgtttgcaaaaacagaacctccaggtcgacgagagcattccatttttatatgtttttaatttttgagtttgtacttttgcatttgagtccctgtaatttttatatttacatttgagtccctaaaatcttgcaataaggtatttgaggttgtttttgttaaaaaaataatataagagagagaacaaaggcagaaaggtgcataaaaagaaaaagaaaagccgcacaaaaaagaaaataaagaaaaacaacaacaacaaaagtctttttcccctaagtggtgaaaaaaaatgtagatccgaacggaaaaaaaaatctgattcatataaaaggcaaaaaaaaagtgatgaaaaaaaaaggctagatccgattcctttaaaaacggaaaaaaagtctgattcctataaaggcgaaaaaaatctgaaaaaacatctaaaaaagttcgtccgattccttaagaaagtggtgaaacaaaatcc

SEQ ID NO: 16800 - DNA, 1501 bp, Oryza sativa
tcctgcccgcccgtcgcccatcatggcatggtcgtaggacacaaccggcggccttttcttggcttccggtatgtatctatgctgatctagctcatttgtgattagtgaatccataaatattccactgccaatttgtgattttattggcaatgaagtctatccaatgggtgagagtcggttgaatctctctccaaacgcgatgacgagctactcccgacttggtggtgtttgttctgaagatgaagataaagataaagattaagtttttcacgtaaaacgatgtggtaatagcatgtaattaattgagttttaattattacaaacttgaaaaatgaattaatcttatattttagaacaactttcatatagaaaattttcgcaccaaacacaccgtttagcagtttaaaaagcgtgccacgagtttccaaaaatttatccaacctttattagagaaaagaacaggacggtgctagatgcttcttgtattgaagcatgtcataaagattgacaaaacagccgctataacataacagactttgagttgagtcgtgacttctactacctccgtctcaaaataagtgcagccgtggatatccgtatccaacctttgaccatccgtcttatttaaaaaatttatgaaaaaattaaaaaaaattagtaacacataaagtactattcatgttttatcatctaatagcaataaaaatactaatcataaaaaaatttctaataagatgaatggtcaaacgttgaacatgaatagtacaaaactgcatttattttgggacggagggagtacttgttttgcatttgtatcaaattttaactaattttatacttgtacacatgttttatctgtgttcgaaaattttattatgtgatataaacctgtgaagtaggactatccaacgaaaacttactagctacgccattacttgtcgcacatttttttttaaatgtgctaggcatgatgtttaccactctctaagctggactgggattactggtattcaatgaagaccagatcagtatgtcgtgccacccatcattctgcttcgtttgcttgcttgcttacacaaacccacagcttggtgtttacagctgtactaacggctttttcaatagagtacgatcagtttattcaccgaaagataaagtatatatatatatataaaaaaaaagaagccgaccagcttaacggctagtcccgtaacaggcggaggagagagagactttccgaccagcccgttacccatccatccccaccgtccatcccggatcgggctcatcctgatcctgccacgtgtccacgtgccctgaactagccgttacgtcctttcgtccccgcctggtccccgccgtgagacgcacacacgttcgctgccaggtgggtcccacctagccgggcccgcgtgtcagcgtcgtggtggcgtgtccccaggtggtgtgccccacgttggtggaagggaatctgatctaacggctagttttctccgccgcc

SEQ ID NO: 16801 - DNA, 1244 bp, Oryza sativa
  unsure (1)..(1244): unsure at all n locations
aaaatctcaatgacaataaaaaggagaagcagtgagctgggtgtataggagtatagttgcagagccaccgatggttggcgggacttctagaaaataaaaaataaattccaacgataggtatgttcgatttttaatcagagaaattcccacattaatcagagaaaaagaaaaggagattccaagtagaaatacaaaatcaaaaatagctgaaattcggaattaaaaataatgaatattgagagaatagtcaatataaaaacccaatacgatattagttaatatttggaagaaaaataaaaataaaatctaaaattagcaaaaagaaaataagagttaaagtaggaatacaatttaaaattaatagaaattctaaattaaaaataagcaatattgaaagaagaatccatataagaacccgatacgagattaattaaaattcagaataaaaaataaaataatataaaaattaaaaaaagtaaaagagagttgagtaggaatacaattttgaaacaactggaattgaaaaataaaaatattaaaagaacactatacaatattagttaaaatttgaaaaaaaaataaattctgaaattagaaaaggaataaaaagatttccattaggaatacaatttattgataactaattggtgatagaaaataaggactattgaaagaaataccacctaaaacatatgacaagataaattaagtaacatgcctataaaggagtagagtggtggtcgttgaaacgacatatacttgttgataaaacaccaaatagaatcctactgacgattaaaaggagggacaacatataggtcgtgaagcaaacggacaaggcggttgctaggatttctagaaagtaaaaaaaatanaccacattgataatcatattcgatttttaaaatctcaatgacaataaaaaggagaagcagcggactaggtgtataggagtatagttgcagagccaccgatggttggtaggacttctagaaaataaaaaatgaattccaacggtagttatgttcgattttgagaatcccaatgataataaagagtaggcggcgggtgagctgtagaggagtatagtggcatcgtttaacaggacttctaaaaattataaaaaatgaaacccaacaagacaataaactctaaaaactacaaggtccaatttttaaaggttcggaacttctaaaaagtaaaaaaaaacccaatgacaatcatgttcgattttaaaatctcaa

SEQ ID NO: 16802 - DNA, 1308 bp, Oryza sativa
aggggggaaaatgaatcctagggttagggtttgggtatgtttatttaggttaggattaatctggaccgtccattcgatcggacggctccagctgctcccacgtcgggccgccggcctattgggccaccgaatggaggatgcaaaatagacatcaatggagaaaggaaaaaggccaaacacatagaatagacaaaagggagggaatataaactttgctatattcagcccaaacatagaaaggaggattttgattttttttttccaattaaataattattaaattatttttgtattattcaaaattagcaattaagctctgataattccaataaaattctaaaaagcgtaactaatcatggataatttaataaaattaaatttaaccatgtaattttatttttcacacttgctttacttgtaaattgatttaattatacacctacgtacttaaaaataccaaatattttaattaattacataatgtaaatttttctttaactttttctcaattttttgttccgtacacttcccgttgcaacgcacgggcacatttgctagtggtacgaaaaattccaaaaaaaaagaataataaaatacttcaaggtttcatagtacgaaaaatacaaaaaaaaactaagaataaaaattacttcgaggtttcatagtacgaaaaatcaaaaaaaacaaaaaggtcagatccgacctgccggattcgaaccagcgacctaaggattgatctgcaacgactacagtcctccgctctaccaactgagctaaggtcggacactgcttcgtactacgagataaattttaatactttaattttcaaatttatacagaaattagctagttccttctgtcgctaaatggtgactgttattttgtttgcttactatataataaccacgataattctgtgtcccagaaaaaaatatctcttctcaaaattttttttatctaagttctgattctaattaattgctgcatggtatcacgtcaagtatggcccatcattggcccttgggctacacatgatagaaattttccgtttggacccaaattatgattgttgtctgcagcagtgtcagtggaaaactgccgtatgtacggtgtcggtagcaaaactgaggatatgtaatatatatcctacgaatctctctaggggaacaagctccctacggtttaatgtcctttccctagtataattctccctagggaacctggggatttccagtagattgttaggtctcctttgattcaaaggtaattcataggaattttatagaataccatttatataggaatttt

SEQ ID NO: 16803 - DNA, 1501 bp, Oryza sativa
cggtgaggagcgacggccaaggtgcggatgtatgcggcggcgccagaggtggccacggcgcggctcaggatggccgggagcggcggcaaacggtgaccggaggcgacgaatgtggcggtagcctcgggtttgcaatggaggtggggattcggcggtggagagagggaaataggtggcacaacctgaggtagacggggatggcggcaataggcggctgaagtgtggcgggcggtggtggagctcgggtcggcggtggaagtggtgcttcggcggcagattgaaggcgcggagcggaggccaaggtgcggcaaggagtggcgatgctggtggtacaagcggcacggaacgaggacggctgagcggcggtggcacgtggccgaagctcgccggagtgcggcggaaatggcaggcggcgtggagagagcggaagggggcgtgagaagctcggggaggaggaggaaacggacgaggggatcccggggatggattttataggctcggggagggaaaaccgtggccgggcgtggcggcaacgtggagcggcatcgtggggagagagaggcggcggcacggcgccgaattccgcgaagggagtgggggaaggagagtggagggagtggggcagcgtcgggcccgcacgggagagggcgagggggagctggaggaggcggcgacgtgggcggctcaggcggccgtggcggctgccagcccaggctagaggttcaaggagagcccggcaatatgggcccatctgtaggcaactcggggagaggagggaggagaagggaggcggcatggacttgcgagggagggaccaagctgggccgacagcctggtaagggagaggagtaggaaggccgcggggaggggatggaggattggtccgatagcggcccaaagacaaggatggagatttaaaattgtttgcttttattttaattgattaaatgaactttgtaactttaaaattatttcttgagctctgaaaattcgtggaaaaatccagagagtacattagggcacagagaatattacaaaatattttcggccatgatttttaaaggaaatttttaattccctcactatgtcacttgattaaattgatttaatttttaatataatttctggaaatgcattattaattgatttttaatcccgaccgaaaattggggcgttataatgtttcattggtcgtaattatccaactaaaatgcgactgaatggtggttgtgggtgcatggttttgctagtcgcacctatagcaattaaggaccagttcacgggaaaccctggaagacatacaacgcttaccacaagcgggagtgggtaattgcttgatctgtagtatagctcgaccctgttgatgaccaaatttggtaaatcatgcatcaaattcaaagctaaagtcgaagcggatttgataggagatcgtttctcataaacagagtacgtgtcggctacgggggcacgtcggctaacgtctgcatcggctgacattgga

SEQ ID NO: 16804 - DNA, 1501 bp, Oryza sativa
tgaaaaagttagaagtttgaagaaaaagttgggaactaaaccaggtctaagacaacactcagaaagagttttgatgcgatgaaaaagttaaaagtttgaagaaaaagttggtaactaaaccaggcctaagacaacactcagaccacgagaggctaaattggagaagagatggtgtagttttgaactgatagcttctcttcactcttctgttttgggtgtgtttgatagtaagtgttggaaacttttttcccgaaaacgaggtggtatgattaattaaattttagcttaaaaactagaaaataaattattataatacaattttgaagtatttttttaagaaaatcatacatttaataattaaataagcatgtacatgacaaatgagtcgtttaactatttatcacttttaagatgtgacaattaaaaatttaccactcgtaatatgagacatcttgatttttatgtgtctgtgacatataaataaaacggtaaatttttaattatcatttataagagcggtgctgtaaatagttaaatatctcacatctggtgttgtgcaagctcggagaaagaataggagcccaccatctcacaaacagacagagccctaaattaagccgaggatcgattgtttagttggtaagtacttaccactgctaattaagcatggagacaacagcagaaccgaaatctgtagccttttgacactttaattggtagacaaacactgccaccaacaactaaaaaccaccaacacaactaccgatctccagcccctttttttttcggaaaggagtaatctgtattgtactattggtttttatcggtttattcaatagttcacaaatattggagtcctttaaaagttttacaaaagaccggcctaaagaataaaaggaaaaaaaccaaaaatatcatattctcctaggaatgctggagtatgacacaaatgttctctatcttttattctcgattttggattaattttcgtttgcacgcttcctaaatttatattaaaaattgttcgaatatttttctaaaatattttttaaactctttaatatatataatttatattttatatccataaataaccttaaaaaaatcaactcattcatgaattcatgttaaaatatcaaaagataaagaagaaaaaaaaacaaattaaaggtaaaacaccccttccacctccctccctcttgctttcattccatcctccctccctctcttccccaacctctccaccccaaaacactttgctttccttccctttttccttctcccccttccattcctcctcgcttgcgttgcgtgcatcccttcctctcgccattactccccatctcgcgagctcgctctccccccagcaatgccgccgtggagccaccgcggcctccggcggtgctagatccacgccacagggagctcgggcgccggcggcggcggcgccggaggtgtggggatatatcaagaaacgggtgtggccgggacaggcgggcgc

SEQ ID NO: 16805 - DNA, 1501 bp, Oryza sativa
ccgcgccgccctttctctgcctcgccgccgtcgtcgggagatgacggcctggccctaatcttctctgctcctctaattggtcccaaaccggcgcccgcagcgcgtcgtatgccgccgccgccacccggagtctcgcgccttggcgtcctcgccgccaccgcccgggcctctctgatggcccgacctcgaggtcgcatgcgcggtgagcctgtgacgctctcccatctcccgcatcgtcgacgacgccgccgccgccgccgcatcgccagccagccggatgtcctctcccacctcgcctcgacgagctccccacctgccgagcatcctgcagaggggaaaagagagagagagagaaatagagagagaagaggaagggggagaagggggaagggagaggtgctgactgtacaccctgacatgtgggacccacgtgggtcccacgctgactcagccgccacatcggacgaaaccgggatcaaaaccaccgaaggacctaaagtgaacagttttgtaagttgagggatgtcctatatctggttttgcggttggaggatgattttataattcgatgacaagttgagggaccttcggtgtactttttccaaagctggagcgccgttttccttggatcggcccggaagcttagtggctcggcccagttgcgaacaaaacgaaggggagaaacgatgatcggcccagttgtggcaggtgttcaagccggagtggagcggaagagaagaggagacaatgacatgagtaaaaaatcagcagggttgcattactccaatggatcgagctgctgttcgttgcctcctccttgatttacctctgtcgcaacgaatcagctagcatcttcttcttcaaaaaataaaaaaataaaaataattaaaaagaatcagctagcatcttcttcttcaaaaaaataaaaaaaataaaaaaaaagaatcagctagctagcagaattaatgtggcggaggaaaaaagaaaaggcgagcatgcgcacgagttgagtaacgtgagattacttgctgaggttccaaagagttgccggtatggaggcattgagtgtgcatgggcgcgggcgcttgcgcttggtcacggtcacggggacatgatgatcgagctagctgccggcccagcgcgctgccattaaatctcgtcacatatatagtacgtgcatacatgtatgcgaccgtgtacaagtttatttgtgcgtacgtgggcccacacgcacgtacgtacgtacgtgagcttctacactcacacactccatacatgcatccacgcagatagacctgccgtaacttactactactactactactactactactactactactttgtgttgtgacaattaatgccatatgcatggcagattggcatatatatacatattcgatatgtgctaacctagccaagccaagacaagccaagccaagcaagccgtggtccgtggagctagcgcatcgacaaggtcgtaagtaaattaattaagtta

SEQ ID NO: 16806 - DNA, 1501 bp, Oryza sativa
acctcgagatggaggctctcgagaagggcgatgatcctgacgggaggggcgcgcctagagagcgtgcgaagaagcacgttggcgccggagatcctagcctccacgtcggccatgggggagttgcagcaggcggcgagctctgctaccagctgcagctgctgcttattttcgtccttgggggagatggaggatgagctgccggcgctgctgccggcggcggcagtgggagagcaggaggtgatgagggagcgcgggctgggcgtggggctggggctgccgccgccggaggccgatatcgatgccggcgagattaggtgcgcctgcggctgctgcctgcgcttcttctgggcctccagcgattgcagtagcgtctgtagctccttgatgaagtcgatggcgccgccgatgatcgacgcctggtcgccctgcatgcatgcaccatattattatatatttgtttatcatttccatttccatttccattagaaatattaacaacgtggagtacgtacgtacgtacccgtttgatgtagaatgcgggcgtgagcgagcggagcaccttgaggtggtcgttcatctgccgccgccggttgcgctccacggcgatgtgcgacataacttaattaatttacttacgaccttgtcgatgcgctagctccacggaccacggcttgcttggcttggcttgtcttggcttggctaggttagcacatatcgaatatgtatatatatgccaatctgccatgcatatggcattaattgtcacaacacaaagtagtagtagtagtagtagtagtagtagtagtagtaagttacggcaggtctatctgcgtggatgcatgtatggagtgtgtgagtgtagaagctcacgtacgtacgtacgtgcgtgtgggcccacgtacgcacaaataaacttgtacacggtcgcatacatgtatgcacgtactatatatgtgacgagatttaatggcagcgcgctgggccggcagctagctcgatcatcatgtccccgtgaccgtgaccaagcgcaagcgcccgcgcccatgcacactcaatgcctccataccggcaactctttggaacctcagcaagtaatctcacgttactcaactcgtgcgcatgctcgccttttcttttttcctccgccacattaattctgctagctagctgattctttttttttattttttttatttttttgaagaagaagatgctagctgattctttttaattatttttatttttttattttttgaagaagaagatgctagctgattcgttgcgacagaggtaaatcaaggaggaggcaacgaacagcagctcgatccattggagtaatgcaaccctgctgattttttactcatgtcattgtctcctcttctcttccgctccactccggcttgaacacctgccacaactgggccgatcatcgtttctccccttcgttttgttcgcaactgggccgagccactaagcttccgggccgatccaaggaaaacgg

SEQ ID NO: 16807 - DNA, 1501 bp, Oryza sativa
aaatgttatatgcatatcatttattttgttgtaatttttaatcaaccgaggagttattactaaaattttgaataaaacaaataatcgaacgttatataaaaaatcaacatattttgtgatggagatagtacatacgagactcggataagcaccataatactacagtcccatcacaatattcaaagctggagtttactggaggcatggaaatataaaatgattttcagctctatgtacacacgtctgtatgcgctatataaagatgagagtaaattacaaaataaaacggtatcccaccaaattataaaaagaaaatgtatgataagccactaacaaatactacctccatcccaaaatgtttgacgctgttggctttttaaaaaatgtttgaccgttcgtcttattcaaaaaatttaagtaattgttaaatctttttctatcatttgatttattgttaaatatacttttatatatacatatagttttacacatatcacaaaagtttttgaataaaacgaacggtcaaacatgttttaaaaagtcaacggtgtcaaacatttagggaaggagggagtaccaaatgttgactacttgtcaaattagccgctggtttcctcttatacagctggaaagaattttatgtcctaccccacgtagaattttccacctatagcgcaggccgctataagagcaggtacaatagcaggctataagccagctgtaaacatattttaataagataaaagatgaaagagatgagcaacgggctacagatctatagccagctgcagcacggattccaagatgtaatgtgtgtatgacatgtgagaccatatattaatagtatagtaagcaactattgtataaattgtctattagatcggctatagatgaattggagccagtagtgagctatactattataaacttgctctaataattgaataatttgatttgttttatttaaatcttaatttcagttcctatccagtgacgtttcaaaccccgagcaggcaatccacgccgtccatctccgcggccgcgtcacacccaccccctcaccgctacaacgagattctctaattccttaaaacaacacacgagattctctaatttattaataaaaaaataaaaaagaatctcgattttcttataaaaaaacgaaaagaaagactaaaaggcaagagatccctccaaaggttccagccacttggatgccctcacacaacgcaacaaaaccagaatcggatcatccaggtcgcggtccactagaccacgccacagacaggtgggccccacaggaatcctcgtacccaccagtccactggaccaggtgtacagatccactcccacccgactcagatacccgaatccacgtcagcccagagccagtggaggcgcagcccacgcgcacgcgaggaaggaaggaagcagacgcagaaaaggacaggaggtctcgtcacgagcgcgaggaggaggaggaggaggacgacgatggcga

SEQ ID NO: 16808 - DNA, 600 bp, Oryza sativa
aaacaaaacacatccgaatcccgcagcaaaacaaaactgcatttcggaatgtttccaaaacaaaacacatccgaatcccgcagcaaaacaaaactgcaaaaggaggctgcatctgcgcaagggtccctacgtggcgaggcaagtgagcgcgcgtgtttcccctcttctctccaccacacatgtttcaagtagcaaggagggcatcctcctttttaaggaggtccccctctcctagaataagcaaggtggtactaaactccacatgcatgccatcccatgaggtgggcttttgagattttccaaagaattaatcttcgaatgggccttagcccatctattaattccaacactgtatccggttttgcagtcaagatatccgaatgtaactaagactcatacttgaggtatctatagtggacattttcctttttttatctatcaggacacccaacgacccaaagcccatgcctaatttgttctgtggatagcggcctattcctaaattaacttgccagttggaatcaggcctgataggtggcccacgtctggtgacaatcaagtaaggcccattgaagagtgaaaccggagttgtcgctgata

SEQ ID NO: 16809 - DNA, 270 bp, Oryza sativa
gccgcccgcttcgtcgtcttccacttcgcggtgttcttggcttcgcttctgcttctgcttctattcgttgcgtgcgcggagcgggaggagggagagaggggcacgcgtcccaggagagagagagagataaaaagctccaactgactgacaggtggggcccaagcgtggagggcgacgtaggtgtgtggttaccccttcgaatgacaggtggggtcgggttaaggtggggcccacctgtcggtgggggttgaggcgcgaggtgggagtgga

SEQ ID NO: 16810 - DNA, 489 bp, Oryza sativa; identical to SEQ ID NO: 16613

SEQ ID NO: 16811 - DNA, 327 bp, Oryza sativa
cagctatcccaccgaaagcttctacgcgcttcctcctcctcctcggtgcggtgcggagccgcccgcttagtcgtcttccacttcgcggtgttcttcgcttcgcttctgcttctgcttctattcgttgcgtgcgcggagcgggaggagggagagaggggcacgcgtcccaggagagagagagagataaaaagctccaactgactgacaggtggggcccaagcgtggagggcgacgtaggtgtgtggttaccccttcgaatgacaggtggggtcgggttaaggtggggcccacctgtcggtgggggttgaggcgcgaggtgggagtgga

SEQ ID NO: 16812 - DNA, 1501 bp, Oryza sativa; identical to SEQ ID NO: 16807

SEQ ID NO: 16813 - DNA, 1501 bp, Oryza sativa
ggtcgacgatagtaggaggatttctggtattttgcttggaggtttcacccaacaccgattatttatagccaatggtactcgttggagtacaaaaggcgaaaagataaattagttagggactaattatctccattcatctttgcatgcatgcacgctatgaaccatacaagttagaattattccgcatgcacgggagattgaaatcattccttccatccatccccgcatgcatgttgccatgcgaattaaactttccaaaaatagagattttcttattagacctattcctttcattgtgacattaaaaaactaaattttatattagtagagatgtgtatctattatccaatcttaataatattatttataaattccaatattaaaaaaaagaaatagtattgtaagccaaatttgtattatcttttttttaaaaaaattgacttgatatgtggggtaattttatttgaaagtttttaatatcaaacatgtgactttttaacacgtatgtccaactattggtcacgtagtgcaaaaacgaatttataaatcttttttcgtttcttcttaggctagaaggccatttttcaactccatgaacaacaattgctaacaaataattttcgaactaatttatgcattaatatcctcgtctaggaattagccgaggtgcatgaaaggacaatttaatatacagaatatcataataagtaaagcgataaaatacttacagaagaataacttagtcctcaccacgaagaaaattgcagcggaaaaataaaatctagcgaagcttcaactcaaataggatttaagacaaaggttttctccttctgaatcctttgtctccaagtgaggtttgatgattattgcaaggcgagtatatgaaatacttcacaaagcacacaacaagtatgcaagtgcacagcgataatataggatggcataatatagggttcatttgcaaaagaagcatttggcaaagagttgagaatttgtaaaacagtagagtaattaattaaaaggtattaatccaatgatatacaacatacctgttgcatatgccccaccatatctgaacaaccatgctcggttgaacagacccaatctccaaaccaggagctaaaccaaagcatcatcatttatcacattattatttttaatgaatattctggtactaatcacgaaaaaacattgttaggctcgccccataaccggaggtgtataaatttacccacaagacatagcccataacatgtagccatgccatcagtagcaccacgatacctcgaaacaggattgtgacaagacacctcgcatgacacaattaaaagcaatgcactatccccggatcatagtcaccctttttaaaggtatagactccccagcaaccctgtggactctctgccacttctcagtctggcactccacaatgaaccatattgctatacaacgcatccagacgttgctcacgttggcttatgtctgagcctttacgagtagg

SEQ ID NO: 16814 - DNA, 307 bp, Oryza sativa
acccccccccccccaaccccaatctgcatcaaggcctcctctgactcgcgcgagttgcgagagagatgtcacgtaggagtagtaataaataaaccccccgcgccttaattcccccaccccaaccgtccccgcctcctctcctactcggaggctcacggagtccaccaatccgatctcctcccctataaatccagcgccccacctttccccacaaacaacgcaacccaaagattcccagtatcccaccaccgcattgtgcatttgtgaattgtgagtgtcgaatccaagagttggagttcgtgttcga

SEQ ID NO: 16815 - DNA, 1501 bp, Oryza sativa
tttgtctccctcgagttcatgggccgatctcttctccccggtccatttccctctcagcccatctctcctctcccctccatccttgcccgcacgtgcgaggcacgtgcgccgctcgggtgctgagcaagagagagggctcgctctctctttctcttctccctccctctctgctctcgctgccgcttcccgccgacgccgcccaaatcgccgcgccgttgcttcccgcgcgcgcgcgcgccgtggtggccgaccggccagtcgccgccgccgtcagtgcctgccgcgcctgagcccgcgcctgccgccctgtagccgcgcccttccaaaccgccccgccgtcatcaccgtcatcatcgacccggtcccgccactccacgcgcatgcttccaaggaatggaggcagagctcctcctccatctgcctcatcgctctctctccctctttcttttcccaaagaggcaaggggcaagccccctttcttccttcttttttcccttttatcttcctccgccggcgtcatgccctctgtcgcagttttggcctcgaccgccgagcgccaactcgctccttgaccaccctaggtcggtttccaaaccgacattgccctcctattaaaccaaggtgccctcccttcctttccctctcccattcgcctcgcaccaccgcgccattgctgtcccctctgtctttctatcgccaaccgccgccgtcgcgtgtgccggaggagccggtgcgcgctacgacgcggaaggggactccgggcactcgtcttcttcctcttccccggcccgaggccggagagatcactcccgtgccgtcggcctctcgtcacagcgccccgcctcgtctcggtagggcatccctccgttctccctcctcgctccatctcttccccttagctttgagtagcagctcgagtaataccccagtagctagttggcgccaccccaagccgcgccgccgctcgcagtaggctcgccgccgtcgccgcccgcgctcggtagtagccgcccgtcgccggccttcctcggcaatgaccagtccaatccgacgctagaaacggattcccggagtcgcgtagatgctctagctcgcccgaatcgatctcccgtcgcgccgtcgccgttttcccattctctcgccgccggttgctgccgccgcaatccgccgccgtcgagcctcctccggcgaatccgagcagttggctcgtctcccctcgtcccgtgcaacctcccggtgcgctcgcccttgcctgcatcgctgtagatcgccccgccgctcgccgccgccgtccgctgtctattccggccgacgtcgtcgtcttcctctcgtcggcccacgtggctgccacgaaggtgccacgtcggcgccacctcggccgcgaccgggtcaagctgaccccggtccgccgctcccctccgcctcgctcgcgcgcgcggtccaccgcgagccatgaggctgcacgtgggcccgctgcatccgcacccaccgcgagccgcac

SEQ ID NO: 16816 - DNA, 1501 bp, Oryza sativa
cttctaatatttcttatttttcaattccaaatttctactttttttcttaattgtatttctatatgaactctatactctacttctaatattccttatttttaattcagaatttctattatttcctaattgtatttctatatggactctgtactctacttctaatatttcttatttttaattccgaatttctattatttcctaattgtatttctatatggactctatactcctcttctaatattccttattttttaattccgaatttcaactatttctaaagtgtatttctatatagactctagtctcctcttctaatattccttattttttaattccgaatttcagctatttctaaattgtatttctatatggactctgttttttctttttgtctgattaatgtgagaatttctaagccatgagagcgaacgtggaggctcttttttctattcctttaattatataatagatagattgtgcatgggcatcacgttaaatgaagactaaatcaatataccaaaccaaatcattcgaaactaccctcaataccattaagcaaatcgatttatattggttttcaaagttatggaacgttctatacctatgcgaaccaaattccaccaatagttggaggtctcaaagtggacttttccaatggcatttctgtttcctgctccctagtcgtccctactgtacgctccatgtgatctgattgctgtgtacctaaaacctaccagctggtgtactcatcatagtactactgactattgactattatagcaaggaattcaatacttatattatatacacatgtttaagttggaaactttttttcaaactttcaacttttttatcacatcaaaactttcctaccacataaacttccaacttttccatcacatcgttccaatttcaaccaaacttctaattttagcgtaaactaaacacacccatagtttaggccccatttgattaaaaaaattcataaaattttagaggattttatttctataggaatttttcatatataaccctttgaattaaaggaatggatcttatataatcctatgaaactcctatggaatgtctaatgccatgtaagttttggaggaaacctaacctgaggtagaacctcgtggaaactttcttttgagtctttatctctcttctaattcatgtgtttttcctgtggtctaatcaaacggtcattcctgtgttttttttctgtgttttgcaattatctgttttacacttatattcctattaaaattttccgtttttcttattcctacgtcttctcaaattgttgcacaatgagaaaacgctactaatattttttatacgtttatgctgtaccaacccaatcatatgttcattattttagtatgataaccagcaatcgtcgaacctcagcgaaaaaaacctgttcatcatcagttcgagtgttcaacgacctttgccctccatcccaaaatctcaccgtcaccagcaaaggcagcca

SEQ ID NO: 16817 - DNA, 1501 bp, Oryza sativa
tcactccacagaatgacatgtattttacaggagatcgagcaaaaacagcagacaaaatattaatggctctcaatacgacatatatatcatgctctgttcacagcagacaaaaattaagtcaaaagctccattcaacgatagatcatgccctgtaaacagcataaaaaaacagacgacagatgagcttaaaattttcaattcaaagattaaagtttccagcaaaagcttgtgcttttctcacaaattcattaaaaaaacatggtagattgaattgttcgttacaaaataactagaccatatggtggagtagtgtttgagccgtaatgggggcctaggctgcgccgatggcagcggaggaggttaggtacttgcttgagccgttgagggagggataggggacacagaataccaccacatcttcgctcgtgaatgcggcggcgttgctggtgacggagcgcgtcgttggcttcgctgccgcggacagcagatggatggggaaaaaatcagcaccggcggaggcgtggatgcggggcgagcgtgccattttttccagtaccgcgatcgtagacggcagatggatgggaaaaaatcgtccggtggggcatggatgcggcgcaactgctccgtttctgcgctcggatggaggaatagatgagaaagaaccgatgcggagagggaggaaagaaagagcacagcgagggagaaaagcggcggtgtgactccggaatcgttccgcttctcttttctgtttcccaatcgtatcctttcaagatggacggccagatttaatcttgtacctcccggtactagtaccggccggttcaggctgtcagacgggagtaaaactcagaggaaaatcttctactggatggttgaggctaaatgctacatagatgcactgtgaaaggccttaaaggagtatagatgaaagttgcagtgagaaaaaaggcaaaaaataaaaacatagagagaatgttgaaatatgttacacatagaaacttagaaaacacgagttattttaacttgtattttgtttatagcacagatgtggatatattttggaaaagatttatgtaagcaatgtttaataattttctaaaaagtataggagtaaaatctagagcgggtagcagatcttcttcctttgttatggtattggattatctttttttttcaactgaatattatgactaatcctaattaagcatgctacactatacgccaattggaatctttctgggtaactgttttggcaaacaaaaggacaagacaagaatatgaaaccgtgaggtgagtcgagcttgtgtacaaaaaggaactggacaacatactgccggcgacctcagtattcaaatgagcactaacctgaagaattcttcaaggttccaatactaatagtttgagcatattatccttccaccaactgaggccctgaccaatataagcaatcgagcaccactctaatctccctcacattggcagaaacacagcaactaaacca

SEQ ID NO: 16818 - DNA, 1501 bp, Oryza sativa
ctacgtcaattacaattcaccaattattaagttcgaattttgaaattgaattatgattccaccgtcgtgctgccctgctaatatggatccgatgttgtcacttcagtgccctgtcctgtagcaacaacattgctcgacaactaaaccctgacggcggcgaagcagggaaacacgtgcgacaactagggtttccaccacattatttagcagagattactccgtccgtcttaaaaaacaaaccctaagtttccgtgtccaacatttgaccgtccgttttatatgaaatttttttataattagtattttcattgttgttagatgataaaacatgattaatattttatgtgtgacttatctttttaattttttttataattttttcaaataagacggacggttaaactttggacacggaaactcagggtttgtcttttttttttggacgaatggagtaagttttaagaaaaaaaaaagactagtactattcttttactaatgctattcggatggaatacatgtacggagttgaattccgatgtttgctttttttattcggattagttattcagaacgatttctgctcacactcggcctgtgtcatatctataaacaaaacacaggagtgactaatttatagaattaatcaatcgtaactagttacgtgacaacgatcaatacgctagtattgcaactcaccggcggcacgtatacgtacacgatgtttctgctgtgtggctgtggcaccggctcccagccgacgcgactgcggtcccaagacaacaacggcggcggcggcgcggcggcgttcacgttcctgtggggcagaccacggtggaatcggccggacatgcggctgacgtacgccgtgtcgccgttggccaccgccgaccacctcccgcgggacgccgtgcgggaggcgttccggagcgcgctcgcgcggtgggcggaggtgacgcccctgaggttcgcggaggcggcgcgctacgaggaggcggacatcagggtggggttctacctccacacagccgacggcaagtgcgacgcgtgcggctgcgtctgcaagggcggcggcgaggaggcgctcgcccacgcgcacccgccgcaggacgggcggatacacctgcacgcggcgcggaagtgggcggtgacgaacgtggccggcgccggcggggacgcgccgccgctcgccgtcgacctggagtcggtggcggtgcacgagatcggccacgcgctcgggctcggccactcgtcgtcggagagctcgatgatgtacaggcattacagggggaaggtgagcctcaccgacgacgacgtcaagggcgtccaggagctgtacggtgccaaaccaccacgtgtcgacttgacagccgactccaagcccaagcgcgtcgaaactataagggaaattgaacagcacatccagcagaaaaaggaaacagcaaagaaaaaaccctttttttggcgactcgtacgtctaccactctaccctccatgtcttgcc

SEQ ID NO: 16819 - DNA, 1501 bp, Oryza sativa
cagaggtaaaccaaccactccagcaaatgattatcagtttgcaaaaagaaaacaagatattctgaaaagttcatcatagagattccaatctatcatacaaggctaaagcgctaatggttgtatcttaactccactaggaaagtaggaaattaaagtgagctatacagctcatcatatatatattactcgttacatttcacaaacaaaagtactattcaccgtgtactagcatctagtaaaaggttattacagcactatttacagagcagaaatccttctgcagagagaccattgtggtggccttggcagaacaaatgaagaatctgctgcgtgctcatcgaaccctttacatgagctttatataaagaagaatatataattctccgagggaagaaaaaaaaggaaaagaaaaggcaagcatgtagcaaaaaagtagaacaaaacacacatacgttgctcacagaacgatccttgtggtgatcatctcttccagctccggcagcgcaagacggcgtcgtcgccgccgacgatccacgtctccttggcgatgtcgacggataccttgaagaagtcaggggcgtagctcatgagcacaagcctctcctccttctcatcctcttcttcctcctccttcttggagttcttgatcacctcctcctctgcatctcctcctaacctcctcggcaaccccttagccggcgccgaccggcacgcatcagcatcagggcgttcgccggcggcgccacgtccgcttccttcttgtcctgctcctcctcctcctgctgcttctgcggctcttgctcccgcttcctgcttgataccttcttgccttcctcgagcaccatgaaccacttggccaatgcagccccgtgctctgtgtccttccccgccgcgagctcctcgtcgtcgtcatcctccccggaggtgtactccaccacggcgccgggaaagctaccgaagcagccggcgacgttgaggcggaaggcgccgtgcacggcgttcaagaacggcagcgcgtccttcttgatgccgagcgcctgcagccacgtcgccttcttggccgccttcgctcccccggcaccgccgccggcgccgctgatcttgggcttggccgccggccgccgtgccttgatctggccggcgcacgtcaccttcggcgacgacggctcgttgtcgacggggacgtccgcggcgcggcggctcgggttcctaccactggccgccgccttgaagagcgcggccgacggcggcggcggcccggacctgctcgtgctgtgccggcgcttgaccggctccgacgccgacggccgcgacgggctgcagatcgccttgggcggcatcagcgccaggtgcgcccgcgacgggaagcagacgagcaggtcggtggcggcgccattgctcccccttcctcccttcatctcgttcgttcgactgatcgctcgatctgtctcagcgctggtcttaaaagcagaggagagccttccaccttccagttgccgct

SEQ ID NO: 16820 - DNA, 1500 bp, Oryza sativa
ttaggtaacaacccaatatatttaatcaccaggcacttaacaagaggagataaaatattcgtgagaaattattcctatggtcatcctcctcaccgaaagagggcattaagagcaaccaagaaacacacattgagataaaaaaaaaaacaaggtgcaattctgtaagaacatgcattacgatttcttgcaactggcaagtaatgaccaaattgtcaagcatgattcctatgcagcagttatacatatttctaagtcagtgctcagtggcaaaaggggagcttttagtccctaaacttaccagaagacaaaaatctcacaaacttttcgccaatcgagaacgtttccagtacttcagaaaaccaaagctgaaaaggaagcaaagcaggttagcacaagaaagctggaaaactatgaagtctgaactgaaaaagagcaactcaaattgtcctagcatctaagaaatcaagaagcattcacagaccttgagcctgcaacaaactaggaattcagttcgccgtcgatcgcctcgcctcccgctcagtccgctgtgatcaaacagaagcaaatcaaatcaaatcactgagcccaacaccaagacagcataagaacacctaactttaccattcaacgaacctttcacctcgaagtgaccctgaaactcccacaagaaactccaattctctgtagtcccgattgaccacgcaccaagaaccgagacaaagggtaactaatcgagctcgggacaggcgaaccaccggccacggacagctccggttcttgatctctccccacccaagaacgccttccacaggataaagaaaagaagaagaagaataataagaggcgagaagggatgagacggagacgcgagagagacccttgagccggcgaggcgacaggtaggaatccagggggaggggaaagaggacaagggaggtgaaggaagcgtgacatggacgggaaggaggaggcggacttgctggcctggtgcctctgcgcctgggtcaaagaaaaaagggtgacgtccacctcgtgcccgcacaggtggcgcggtgacgtctcgcttgtgcgcccgcgcgcgcggcgggcggcgcgggaggcgtctgcccccacgtgggggcggcgcacgccgccgccgcgcccggcgtcgcattccgtcgaacgcctcgcgggcgaagcggggtgtgtgtgctgcgtagtaattggaaggaaaaaggcgagggagaccgtgcgagtcgtggtggagtgttgactcgcaagttgactagtcaacggtattaggaagtactcgtcacattcctcgtgatcacaatccgcatatttttcaaccaggttggaaaattgaaaattttggaatgcacaagttatcatgataataggttggttgcttatcaattttgaagaaaatttgtcaaagttcattggatttttttttttgagaattacatagtacaacgcagacactcatttgtcaaagttcattggattttttttttgaga

SEQ ID NO: 16821 - DNA, 472 bp, Oryza sativa
tttgaccgtgagagagtgagagatagaagagagagaggaagagtgagagagaggggggaagaggggagagagagtgtgtatatatgacaggtgggctcactatgttttaaaaaatgaaaatgttgactggactgccatgcgaacgccacgcagaccaaaaccaccgcggattgagtcgagggggtaattcgtccgatttgtatagttgggggtgaagaatgtccggttttatggttcagggggtaattcggacgaccgcgatagttcccggggggaggggggtaattcgtactttttcctttcattaaaggaggggagacagaaaagtgttagtgaaaatattgatttacctctagtttattgcggaaatttagctaataaagatggcttaaagtgaaatttactctttattttcccaatttattgttcttgcatcgaaatcgagcgagaggataatttgttaacaatggta

SEQ ID NO: 16822 - DNA, 1501 bp, Oryza sativa
gtagaggaattaccactagtagtagagtagtacattccaattccaattacttgagtagatccttggattattcattccatcaagggttggattcaaaaactagacatccaaattcattcattaattagaggtaggtggagtagtaagtaaaagaagaaaaaaaacgaaaataaaagaaagaattaggagcagattgggcaaagcacgaggccgttctcgttacactcgccgcagcgcaccaccaccaccgcccgcgtcttgttgctccttgcagccgccgccgccggcaccggcgtggggagggagaagcagagcttgcggctgccgttgcagtcgaagcagggcaggaatcgcatgccgccgcatccgtcgcagcagccaccacctgggcgcgccctcggcaggccctccagcagcgccgcaagcttgccctcctcctccaggcgcgccacctccgcggcgccgccgacgtggttgccccggacgaacagccgtggcaccaggggcgcgcggtcgtggtggtcgagggagatgcggtggcgcaactcctcccggaagccgcggtccatggagatgtcgcgctcccggaaggcgacgccgtgcgagtggagcgcggcgcggacggcgttgcaggcctcgaaggtggcgcgcacgccgcgaagcgtggtggtgtagagcagaaccccagcaggaggagcaggaggaggagagtggtgcgtgggcctccgtggtttctgtggggtggcggggtcgaggagaccggccatgagctcccacgagttgatgacctccgcctcgccctgcttcttcagatgcttctccggcggggctgcacatggtgggttggtggtggtggtgggtcggggaggcggcgtgggcggaggaggaatcctagtaggggattgggattgggattgggattgagctgatgatactagaatgttgtcgaggatgccgtaggtggaggaggtgagggagacgatgtgggaggcggagacgccgatgatgcgccggcggcggtcatcgtcgtcgtcgtcgtccacgaacgcggaggcagcgcaacccatggtattggtattggtatggtaggaaggaaggattcgattcgaggatgattaaggagaaaggagagtgaagaagaaaggaatgcattcaaatttcaaaacttgaaaccgccatgccattggatggcactgtactgtactactcctacattactctattgggcctgcctctctggtcgttgggcttggcctactcctgcatcaccatgtatgggcctaacttaccatgctttaagatggtaccaccagttaccagaagtaatcatttagatcctctttattttaggcttttaaccgatcttttagcttactagacaaaaaaaaaaaccgtgcgttacaacggaaataaaacacgagaacattaagaaaaagttgagaaagatttacattatgtaattaattaaaatacaaatttcaccatccttcatataaagaag

SEQ ID NO: 16823 - DNA, 1501 bp, Oryza sativa
gctgtcgcgccagcttcttcgcctcgacctcctctccatttcccctcaagaatctcgaaggatggtgctacgagtgtggagatcgtccaccgtcttctccacctccggtcaccgtcgccgttgccgaatccaccccctccggtgagtaccaacccaattccatgcatcagtagcatctctggggcctctctaacctcatggacacacatgcatgatagttcttggagctgattgagccatcgccgttcacccggaggttcttgccgccgccgagccgttacacgagccaccgtcataaacctagctaccccagccatgtctaccatctcggtgagcacccttccgcctatagaacatacatgcatgcacccaattaaccaatacatgattgtagaagcacatgcatcaccacccgaaaacatcctcctttcggactcgccgccggcgttactccgatgtccactgaccgagaaaagtagaggaatggaatcgcaataacatgatcttcattttgtattttggttgcacccccaaacgagccatcgtttgtcgccggtgagctcgagatcgagctcagccatggctgttctgcctctgtgcgtgagaaaagaagtcagggaccttgtttcgagaatttaaacaactataaggtttaatgtgcaacttttcaactcactgacatatgaggctaggtcggcgggttgattcttagaaacctcagggatctttttgtatattgatctttcactgacagtggaccccttggaaacaaaaatctgaaattataaaaggaaagtacctaaaacttgtaaaatccatataaaattaaatatagctcattttaagatgatacaaatttctgtcaactcaccaaattgtgaactatagtgttatggaataaaaacttgcactcacagtacaaatttagcctctaaaatttatccaagttaaatcacacataaagcatgcacaaatttataaaatgcatacaaaattcatttcaactcattttggagcaaactcagtttctacagatccaccaacttatgttctcctataaagcaaaatgaaatagtatacatactatacatcgaatgcctctaaaactattacctttaaaatgactagttttacataagctgaactttagaagtttatataaaattcatcttagatcctttttgagtaaacccaaattcagtagaatcatagggttgtgcacttcaatgttataaaataaaaagacatacttacagtataatgaaaacccctaagtatttaagtaaggaataagcaacatggagcataccttaaattgtaacatttgtagaaaattcatctatagtctaaatgaagtgaaccaaattttctatagaaccagcaagtaatatacttcaacctagtagagtgaattatagcaccctcttacagaccatggctctgaaccttaatttggtagaataggtactaaacacatagtaatggttaaacaatacatatg

SEQ ID NO: 16824 - DNA, 1501 bp, Oryza sativa
tctccttggcctcgctgctcgtcatcgtgctcgtgctctgcgccatacggtgctaccgcatgcggcgcgcggtgaaccgggtcacggtggcagccgcgtcggcggcggcggcggcggcggcggccgggaacgtcaccaacaagaagcggccggcgccgggcctcggcgaggacgccatcgccgcgctgcccaagttcgagtaccgcggcacgggcgacgagtgcgaccggtgggagtgctcgatatgcctctgcgcggtggccgacggcgaggtggccaggcagctgcccaggtgcatgcacctcttccaccggggctgcgtcgacatgtggctcgtcgcgcacaccacctgccccgtgtgccgggcggaggtggtggtcaacaaaccgccggacgaggacgacggcaggtgcgcggagacgccggaggatgaggccgcgccgccggcgtcggcgctggagccggcgagattggagaatggcgagagggacttggaggcgcaatagcagcgtgacagagtacatgaccgcgcgtttgcgttttcattctcaatcttttccttttcctttgggtagacatgtgtagtttttgcgccccattacggaggtgatcatttttttaacaccgtttgattttacgcaagcggtcattagaaaataagaaaatgatagattgattctcattagaatttgcatgtaaaaaagaagaagaaacatagtgtataatttgaagtcttgaacgaatcaatgatgaaatgtaattgctccgttcggcatcagctgctgtggatgcatttagctacgcagcacaaccggtttgaaaaaatgtgtgttggctttcctgtaccaattggcagccatcgcttctgatttctgaacattcccattgtttgtatgtcagggacttgatgaaagtaggctgtaggccccgttattttctgatgttcgggctaatagcactcctttgaattattgtgggtacatttttcaaaccactaaatgttttagataatgtaaaacattttcattatttaaaaatatacaagttttttaaaaatatataataaatgtatttttcaaataaatataattatattaaaaacttgattaattttgctcttaataatccaccttgtttcgtgtgcggttagtaagctcagcttatcatctaaaatgaaatggggccttaagcttacgtgcttacggcccaaagccgagaaaagcctggccctcagatcgattgtagcccaaaatgaagtggtttagcccctactttttcgaagactaatttggcaccgatcgattcgaatgttgtacatgtatagatcttcaaaattcaaatggtacaggaaatttcaagcatacaagtaatacctatactaatattaaactttcctcttatttttgttaataaagatattccagctacggttatatgccaaaaatgacttttcttttgcggaattaattgcggggaataagatgtattactaactaacttc

SEQ ID NO: 16825 - DNA, 490 bp, Oryza sativa; identical to SEQ ID NO: 16716

SEQ ID NO: 16826 - DNA, 1501 bp, Oryza sativa
acgtagtcatcttacttgatcatcggccgatcacgttctctcacctcaatttcctatgttttattcccgttgcgacgcgcatacacgttgctagtcctatttaatattgaagctaagaaggtggtgaatatttatatatggacgtaaggaaatccttagtacttctacttaccaatagagttagacgaagcttccacactcaagcttaaaaattacaataatgctcttaatcggagaaccgatcctaggcggaaatttaaatgtccacactactcaatcactcactcatttttttatgggcttctaaattaagagaaaagtacaaagaatcccttgagaaacacataatagggataaactcaaagttgttttctatcatatatcattataagagcaagttttatagtggagatggcaactatatctccagttttagttgcatcatccactcactgattaagaggcaacatgtaaaacaatttaccttctacacacaaactccaataatttttattggttcactctcacattatctcactttatttttggtgtttgtataaaggttgctctgtgcatgagtggtgtctcaccctctcttctcacttctcttctccatcttatcacataattctttatggcatttctagaggtggcatttttagaggtagcacaaaaatctgatctagtagtacttgctctaagtgttccttcttattattaaaatttaaatggtaaactagaatttctgtagtggtatggtcagactttttttttttaccgagaaagataatactccctctgttttaggttataagacgttttgactttgatcaaagttaaactacttcaagtttaactaagtttatagacaaatataataatatttataataccaaattagtttcattaaatcaataattgaatatattttcataataaatttgtcttgggttgaaaatgctattattgtttctataaacttagtcaaaattaaagtagtttgactttgaccaaattcaaaacgtcttataacctgaaacggagggagtagctaggaggagccgaggagctaataatctttaaattatttaagtttacgagtataagaaatttaaatatttaaattaaggtgctaagaaatctctacgaaaacaggcttggttctaggttcaaacctaggatcatcattaaccgacacacaccaaactatagtttccatgtggtatgactgacaggtgctttgtcccgtactttcctattcatatttatgcatgtgaggttgatgcctgccatgagcatcaaattcaaccgggggtgcaatgcatgttcgaaggttgttgggtgcaatgcatgttggaaggttgttggattctgcatgcacatcccatcaaacctacaaccccctgttgttaccaaagggattaattagaaaggtgatgtgcctgccctcttggtatattatttgaggcacaaattaagtgctcaatagctcgttctatca

SEQ ID NO: 16827 - DNA, 811 bp, Oryza sativa
aaggacttacaaagaacatattgctcatcttgaaatattttttagaaaggtggaacaaaatgggttaatattatccaaaaagaaaatggaaatatgcaaagaaaaaattaacttccttggatatatgtatgtatgtatgtatgtatatatgtatatgtatatgtatgtatgtaggtatgtatgtatatgtatatgtatatgtatatgtatatgtatatgtatatgtttatatgtatatgtatatgtatacatacacacacacacacatatatatatgtatatatgtatgtatatatgtatatatgtacatatctatatatgtatgtatgtatatatatatgtatatatatatatatatgtatatatgtatgtatgtatatatatatgtacatatatgtatatatatgtatatatgtatatatgtatatatatatatatatgtacatatgtatatgtatatatatgtatatgtatatatgtatatgtatatatgtatatatgtatatatgtatatatatatatgtatatatgtatatgtatatatgtatatatatgtatatatatatatatatgtatatatatatatataaaatcttagtctaaagtgatatgacataatggacacaattttaacccattgcattatatgaggtatgtttgtataatagaaaaatcataaaaaaattataagtgttatttgctttggtataatatgcgtaaggattgatagaccttttttctataagaaagtccattacaatgtgcagggtattttttagtagattaaacaaatttataagcgaggaagcaa

SEQ ID NO: 16828 - DNA, 1501 bp, Oryza sativa
gcacacgaggcacgaggcgtactgcgtgaaggcgctgtcggcgaggccggagagcagggcggcggcgttggacatgccggcgctggcggaggcggcgctgtcgatggcggcggagagcggggcggcggcgacgtcgttcgtgaggaacctggcgaagatgcccggcggcatgccgccggagtgcctggaagggtgcgtggcgaagttccaggaggcggtggcggagctgaggcggtccgaggcggcgatggaggtgcgccatgacgccgccggcgccaaggcgtgggtgacggaggccagggcggacggcgagacgtgcatggacgagtgccggatgacggagggcggcgccgccccggagatcgccgacaggatcgacgagctcgccaagctctgctccatcgccctcgccctcaccaatgcgtccatgagcaaacatccgtagcaaatcatcgtgtataacaaaaacgagatttggagggggagacctctatccaaacatttattaaaaagaaattatgagcgtgttaaagattgaacacgagatctcggaatcgggattgaaaccatataccctttaccactgtactatcatgtgcatttcatgtatcctcgtgtatatatacgaccaccaaattctctcttgttatattcatgacttgagcacgtctcattgcaacgtttcaaatttccaacaaaatttatgttggacacatcaggctatgtaaatctgccaaatttcaatttcaagagtaaatattgtatttatcatgcattagcttgtgaaatagatggtatcacctatcacgtaacagaccaaacgggctaaaaccggtgacgaatgtggtacgattcgattggtttggaattttggatgctgagtgagattcacaaaaggccagaaagggctgagtacttagaatcatcatttttacagttttcacacaaaatcaatttaaatcctacaaaaactatcccaaaatcctataatccagatgagccgaatattcttggatgggccgtggagactattgcagcccacagtcgcccgtcccactttcggaataagttcatctgaggtccataaacttgtcaacgaatccgattttagtccttaaccccaaaaccagatacaacgggtccctcaactatcaaaactggtacagataaggtccttctgtggtttagatggcagttttggctgacaaggcgcctgcgtggctattttgactcggtcttcatcggacatggcactgacgtgacgcttatgtggcaattcgatatagaaaaataataaaacccgtgggacccacatgtcagttacacaaaaaataattaaaaaatagtggggcccacgtgagccccacatgtcatcctcaccctacccttcttcctcatctctccctatctcccctctcctctctttccacgcgccattggacggggaggttcggcggccggtggcggcggcagcgacgcaagagaaggggcggccggctgg

SEQ ID NO: 16829 - DNA, 1501 bp, Oryza sativa
aatggatacccgcgagcatatgccatcgccgaatgatttctatccattgccacatctggtttactacacttgtgtcatcgccgaatgatttctatccattgtcacatctggtttactacacttgtgtcatcgccgaatgatttctatccattgtcacatctggtttactacacttgtgtcatcgccaaaccagatgtggtgtgtggttggttcaactaaaagaaatggatacccgcgagcatatgccatcgccgaatgatttctatccattgccacatctggtttactacacttgtgtcatcgccgaatgatttctatccattgccacatctggttattgtgcaactaaaagagatggatacccgcatgctcgaatgatttctatccgttgccacatctagtttagagaattaaactactactcaactacacttgtgtcatcgccgaatgatttctatccgttgccacatctggtttagagaattaaactactactcaactacacttgtgtcgccgccgctcgcgggtatccatctcttttagttgtaccaaccacacctaacagcgtttaagcgcaaattttaagcgcaaccatgactcttctgttcaactttaatcgtccatcttatttgattttttagaagaacaattaaaaaaaagtcatgcataaagtactattcatgttttatcatctaataacaacaaaaatactaattataaaaaaatatcaaataaaacgaacgatcaaaattggacacgaaaattcatgtttgcgcttaaaatgagacggagggagtgtagttgttgaattgtccatttaattaccatgaatacagctgttgaaacgactttgaaattgaatatgtgatttattagttatgatttctaaagatcattaattttaaatagacaactatcctaaagtggatgagaaggtcgtatgtacctactcctaattacgttctttaatcaactggatcgtattgttcctcttgaaatatccaacatattctctgttgtaagacctacaaatgatttttttttatttcattgaaccgattggctaaaggcacgcgatgcgtagcttgcactgctacaatttatgtggtattcctgctgactatatacacataagtggggtgttccatatctactacactttcatatgtgtagattagtttagaaaaggacactataacaatacaaatttttactaggtactctttttttttaaaataaacacattacaaacacaggtgcccccaatgcgtgtgcactcaactatatgaatacatacgcacattctatccttatgagcacctccgaaaaactgggcccgacatatcttgagattgattaagttaccatgaacacctcactatcgatgggtacatcatctactactggaaaaaaattagccgtaaatactctaactctgttttaatatataatagtgattaaagttgtacatcaaagatcacaaaaagtgatatgtaagagc

SEQ ID NO: 16830 - DNA, 1501 bp, Oryza sativa
tcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataatattgtgtagctctaggatcgtctttataaatggctttgagcaactaagtgacttttaaatgcggttttctgcaaaacttaaccccgatattattatccccttgtactcccttgcattaatcatgcatctgccggtgtgacttgctgagtactgtggttgtactcattctcgctcaatcttccccccccttcagtaagagaagctttggagaagaagtcttaggtggagtcctggcttataccccagttgagcgcctgtgaagatggagccgtaggcccgctagtccgctgctgtttatttttgtttgtcaggtcttaagtgcctttataataatgtaaatattgttgatataataaagatgtgtcttttatatcatgtttatgtggtgtaccccggcttttcctgggacggggattaatacactagcgttcgggaaaaggcaattttcccggtcgcgccagtagggttctaatatacgacagttagactacgcatatatgactatttaagttttagtataagattatttgagttttaatataagattattatatttgtaattagacttagtatataattattgactagctagggtcctataatatacgtcacctagacttagcatatatcactatttgagttttagtataagattattagatttgtaattggacttagcatataagattgtgtagggttctaatatacgacagttacacttagcatatatgactatttgagttttagtagaagattatttgagttttaatataagattattatatttgtaattagacttagtatataattattgactagctagggtcctataatatacgtcacctagacttagcataaatcactatttgagttttagtataagattatttgagttttcgtataagattattattgttttaatatacgattattagatttgtaattagacttagcatatacgagagttagacttagcatatacgatagttagactaagcatatatgacttcgcatatacgacagttagacgtagtatgtatgacttagcatatatgattgttagcatataagattgttaaaacataaatgtctcatgacttagcagcagtttcctgtatgaacatatggctgatcgcgatgagacatagtatgtatgacttagcatatatgattgttagcatataagattgttaaaacataaatgtctcatgacttagcagcagtttcctgtatgaacata

SEQ ID NO: 16831 - DNA, 464 bp, Oryza sativa
ggatcccccggttttattctttcccaatttttttatgcttctctacatacaagccatatttcgctttgacacatcaataaatgaatgtcaatgataattaaacgaatttactaaattccatgacttgcatgtataagcttctaaggtatcaatacaaaatcaataaattaaagacagcaggatggtagaaaactatatttatgagaaattaaagtttcttaagattttttaagaaaaaataaacaatgagcattcaattaagaagggaaatacataactttaatttaaattcattttgttagacctgttttcgaaaagaaataacaagcatgcccgtgcgaatgcgcgggctaccttcctagttatatataaagagtatataattaatatgatggtaatcagaaaactttccaggtgtttttaagctctcttttttcacaccactaattttgtgcgtctgcagg

SEQ ID NO: 16832 - DNA, 1501 bp, Oryza sativa
aatatagtctcatttgcgaaagcagcatttagcaaagagttaagagtagtaaaacagtagagtaattaatcaaaaattttaatcaacactggacagcacacctatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaataattttactctggccagaggtgtaccactgtacccacaagacacagccccacaacatgtcaccatgtgcctcaatacaaccacggtacctcggaaaggagctgtgacaataccccttgcacaacacaatccaccacagcgcacctttcctggatcataatcacccccttataaacaaggcatggactccccagcgacccccgtgggcttatctccgccacttctcagtctggtgctccgcaatgaatcatgctatacaaaaggtaaagccgttgcccacgctagcttgtggttggcacggttaatgtttcacaacagtagctcgcgaaccggtccttaattgtcatgagcataactctcaaaaccatgtgctcacaacccaccattatgaagttttagttggcaagtaattaatttaccaatcacgattgaccatcgtgaactatcattaaaccatcattaaataatagtgaatcataagttatcccaataatgtgctaatgtttctaagcatggctaagcaatcatatctaatatctagctgaaccaatatatatagctcaactagtcaagttataataacccaaggtatcaaggaataaagtaatcaatgcaaacaggccataacaaaagaatagatttacaccacccagtgacatttgaaaataaatgcacagttgaaataaatagagaatttaaatataggatcaacatgctcaaaggattgtgtttaggatctgtgtgacttgccttgtaataatcggtcttcaattaatcttcttgaatacttccggcgcactcacgaaccttcgcaacaacggaaacgacaagctaacacgcaaaacgaagaaaaagactaacaaaaacaaaataaacaatacataaaaagtaaacaaacatgtagatcataattttagatgaattatgagacttgaacggcctcattctgacttcaaatgaatttattatgaattttactagattaaatctaattaaagcccatttaaaaataattaaataaatttaattcaatttatggataattttaatatgtagatctttattttatacaacttttgcaacttgaaccacattaaactgagttacaatgaattagttatgaattttcaaagattaaatcggattaaagcatttatatggattttaattgaattatgacgcaataatgaattatttttgaaaaggaaaaggaggattat

SEQ ID NO: 16833 - DNA, 268 bp, Oryza sativa
gggagggcgcgtcgtggttcggcggggtgtacgcgtccacggcgccgtaccgcgcgcaggtctcggggttcttctcgtccatcttccccaccggctcctccaccccctcgccggagcagcagccgccgccgccgcgccgcggcgagggaggcggccaggtgagtagccatgggatcgatgagcacgcgcgggtgcggagcggcgcagcgcacagcgtccctgtcgatccagctgcgtctaccaagcattcgggaagtggaggtggagg

SEQ ID NO: 16834 - DNA, 1448 bp, Oryza sativa
agtattaggtatttaggttgaggaaaacccaaattaatctaagcaataaatcaaatcgaagatttagggcctatttggcacagctccacctccacctccacccctcctggagttggagctcagccaaacagtttcagctccaccaaaactgggagtggagttgggtggagttatctcacaaaatgtactagagttgtagagctgggtttaggcagctccacaactccactctagcctcaactcctagagcaatatttaggagttggagctgtaccaaacagacccttactcctacataatttcaagttctattatcgatgtgtgacaggaaatgtgcgaaaagtgtatttatttctcccaagtatatttgtctgttttccagcaaataacctttcaaaatatttatccattgaggagactaagacgtaccacctctgtagaattttatagggtgtattttaattgataaaactcttaaggtcacactttgacagtatattcctgatatctataaaactaacattttgtgaaagtatttgaaatataatatacttgtactactacttccatcacaaaatgagttcatttttcacccactttatcaaatcccatgtaattgtttttcactttatctactttcaatgcatttgtcccctacttttacaaattccaatgcaatgattgcttaaaaatgaacttattttgggacaaacgggagggggcaaaaaatatcttattttgggatagaggaagtataattttatacagtaaatatacttataatttgaataatcattagtcaaagttcacaaagtgacttctttttcaaatcaaaacacgtggagtgtgtagttattttagacttttttattttttgccctaactagttattttagacttttttattttttgccctaactagattctttgaaagacataattaggttatattatggcggtgtcgtcatgtttccttgttaactttttcttaattttttttttacttcatagatataggcacatggtgggatataaacatataaggtgaaacagatgaagtagtttattaatgaaaatgttttgagagctgcttatttgtgcatgatttatgtgatggatgagcattgctctctccatttaaaaatatagggcatataagctttgacacggtcttcaacatagaactttgactattagttcttttgcaaatattaccaacgactatgaaatgaatatcatacaaaggtattttcaaatatgaatttaatgatatcacatacgtaacacacaaatacacagcataaagacactcctcagatgcgcagtctattgtatcacataggaattttgaatttttcaattagtgtagctggagcctggaggatatcatattcccatggccctaacttactctgttcactgatgctttcgtgaacatgaaaaacagg

SEQ ID NO: 16835 - DNA, 1501 bp, Oryza sativa
ccctgattggggcgtgtagggtagcgcgtgcatgcgcgcgtacatgcgaggatgggagcgagatatatatccagatatgtgtggcggagccgatcggggtgcgggacccccccgtgccgggtgccctgggtacctgcccgctggctacgcgagggaccaggcaaccactcgcgcgcgtcgcatccgcatgcgccccaatcaaccagactctccttctctccttcttctgtttgctcgcgcgtcgtaggacccggctaggcagtacgtacgcctctcagcctctggctgaatggctggctaagatccgccacttctagcgtgatcgaatgcgcgatccatctcccctgcctcgcgcctcgtcgtgttgctgcgtacgatgtgtgccacagtgcggccagactagataccggacagagaatttgaggtcctgtggctaagctgtgcgtgtcaggggagggagtccgtcgtacgcgtgcatgcacggttctgcacggaacggaacgtcacgcgagggagcggctatttttgtagctggaccaacctgttatttgttgcgtacgtacctcatgcatacacatgcatgcagccatgcatgctgcggcagtttcacaatgtcaatatgtttgtactgtacggtgtatctagatcggccggttagctgatgatctgataatccggaacgtatagctaaaaaaaaaaaccccaaaaaaatacattagattgggtacggcgaggaaacaggatagatgcctatgtgataaaaagcgaaggatatccttccaatattgagccagcaaacaacgaacagtcgggacaaaagttacatggatgatatgtgccatactttctgcaatttatctatgcagaaaataagattgtgagcgtacgtacatagtgcgatgtgccgatgtagacatgaatggaagtcgctgtagtgcttgtacacacccaactaaagtttagcgaaacaaagattctagatatccaggagacctttcgatcgtcttatgcagacaaataatgcaacggcactaactgacactcgtaacgacctgcttcttccaacatcaacatgtacctttccatggtatattgtgatattgtctacatagacctgtacgaagacctggtcccagcagagaccgggtgtaaatgaggtgacgggggacgtaaaattcagagtctagtgccgacttgcaggggcaatttaaccactgcaatttcctttgatgaaaattctaatgcgtgtgggcgagttttaaattgaaacaaataagagtacaatgtactgcaggaactaaccggcctcttgtcacaagtgcaacaaatgggtcgccgtttaaagttacttagaacaatgctacttacactatgctgggctctcgagggaggttgggctgaaaaaaaaatccctgtcatgaacgtttaccaaactactaaatttcgtgcataagtttatgtataattttatttaaaagaatcaagtaaatctattttgaca

SEQ ID NO: 16836 - DNA, 1302 bp, Oryza sativa
acgaacacgtcaacgtgaccgagaacgtgaacgagggaacgaacgtgaccgagaacgtgaacgagggaacaaacgtgaacgtgaacgagaacgatcgaacgaatgtgaacgtgaatgagaacgagcgaacgaacgtgaacgagaacgaacgtgaacgagaacgtgaacgaacgtgaacgcgaacgagcgaacgagaacgagggaacgaacgtgaatgagggaacgtgatcaacgagcgaacgaacgagaacgagcgaacaaacgagaacgagcgaacgaacgtgaacgaacgtgaacgtgaaatgcaatatatatatatgtatgttacttcgcgtttatcctaatacatctttttgtatcttgcagaaaagacgtgttgtcggagtcgttcctcaagccggagtggaagagctagccctagaaggaattcgcgcaggcaagtgacgtaataatatatataattgttatatttgtaatgcaattaagattattagatttgtaattagacttagcatataagattgtgtagtgttctaataatagtcttaattgcatatacgacagttacacttagcatacatgactattttagtcatttattactattggtgcgactccggtctaactacggaattggtgcgactcctagcaattgactattttagtcttaattagacttagcatatacgacagttatacttagcatacatgactattttagtcttagcatgtaagattatttgagttttaatataagattattttatttgtaaatagacttagtatataattattgactagctagggtcgtataatatacgtcacctagacttagcttatatcacgatttgagttttagtatgagattattgactagctagggtcgtataatatacgtcacctagacttagcatatatcacgatttgaattttagtatgagattattagatttgtaattagacttagcacgtaaggttgtgtagggttctaatgtacgacagttacacttagcatacatgacttagattgttaaaacataaatgtctcatgacttagcttatatcacgatttgagttttagtatgagattattgactagctagggtcgtataatatacgtcacctagacttagcatatgtcacgatttgagttttagtatgagattattagatttgtaattagacttaacacgtaaggttgtgtagggttctaatgtacgacagttacacttagcatacatgacttagattgttaaaacataaatgtctcatgacttagcagatgtttcttgtatcaacaga

SEQ ID NO: 16837 - DNA, 474 bp, Oryza sativa
aaccccagagtccgcacatcctcaaatacaaagcacttccctagttagatgtaggttagacttcccgttcgagaaactctacctttatacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatcttt

SEQ ID NO: 16838 - DNA, 1501 bp, Oryza sativa
ataacttgtagaggcagaggaaacaataaggaggaagaagagaggagccactctttctccaattcggtcaccactgctacgattcggtctccgccgtacctcatttctcctatgcgagctccgcctggcctcctcttcctcagctgctccctcatcaacgtgtccactagccctgaggagattgtttgcgccaatagcccaaagcccgtcatgtggaacaacgtcactatgaccggcaacgacggcttgccacttcaacttcgatggcttggcggatggaggaggagcaacactgtcaagccgtcttgttttgaaggaaaagagacaaggatttggggagagatgttggagagtcgacattagcgaagatgctcactcccttgaatctggaatcgtagtttgaccttggcgacattgcgacaaggtggcgcagcgcaagcttgacgacgaggtggcccaactggcccttttccgttgcctctgtcgtatcctcctacttcaccgaagacagctatgaccccctctcctcttctaccacttaggtccaccggagcccctcttcgctaattgcccacagcaatcaccaccagccgcatccggggaggaagagaggagaaggggaaggaaagtgccaccgcctgggggagatagaggagagagagaatgaggtggaggaagtgggccgcactgaaacgtgggtcccactattttttaatcttattgtttgactgacatataggcccacatattttgtttttatttttaaattgttaaattttgcttcatgtgtcacatcagatgaagactgagtcaaattagccacgtagacaccatgttagcttaaacctcagtttaaactgtcttaggacctatattgcaccagttgtgatagttgagggactcgttgtttttgtattgcagttcaaggtcgaaaatgctgtcaagtaaagggacctaaagtgaacttattcctatatgtatgtacgcatgaatttgctttgctgaatttctgttgaatcaatcacctctgagcagagctttgagaagaggaaagtaaaagatcgggaagataaagatgagtcattaacgtctaattaattattaattattttaaattttaaaaaaagttaatttgattttttaaattaacctttatatatatatattttaaaataaaaatgtaccgtctcgttgtttgaaaaacatgcatacaaaaaacaagacaaatccttttttgcgttgtcgacagtttaaaaagcgtgcattcgtaaaacgcattcgtaaaacgacacacatcttcctttcttgttttttctcctcttgtcgacattacactctatatataaggggaaaaactacattaataacaagtttcggtccgtaaaagaaacagcagacctgacaattcattgcatcacaaaattagtactagcatgtcgtgctgtgccaaaggagtataatcctacagtggaaggaacaagtgataaacagatagaccaat

SEQ ID NO: 16839 - DNA, 1501 bp, Oryza sativa
cctctcctagcttagctactcctttctcggctgatttctatgtagattcattagttgctttgagatgctaggatttatataggcatatagcactggaggaatcatttaatcacaatgaaaacgcgtggttgctatgcatggcagcatgggaatggtgtgcttgatcttcttgggggcgccgattcggtgattcctgtgaagttgaacgcgccatgcatcgcatgcaggatgtgcgttctgtgtgatcatattgtagcgtttaggatcgagttggcatcgtgcatggtgtgcatgtagtaccatgtactgatcctctctaggtcggtgtgatttctattgaaaatttggaatcagctgttacaacttaccagccgcttgaaactgctaccttgcatgctgctgatagctaagctaaggttagcagagtttagtttgatgccaattttggcgatggctacctcttatcaagctttgataggagtgaattgatttgtggagcatttattttgccgctaaaatttgggaatatagcttcctcacttggatctatagtttgattcatccccaaaggtgaaccattgttgggagtaaattagtaagcttggtttggcagacttgccaatgcatttcccaattggtcagtcgctctcctctagctcactaactagtgagaggtactgggccacgggttttgctgggccctttccgattgaatgctattatgaagaaggccacatcttcgcttgttgggctgtcgtagggatggcaacagggctgggttgggcaggaacgcccccagccccgctaccttgttcggggcaaaaagctcgaatttttttcgtttttagattttttttaatatttacagaaataatctatcaaccaaaaaaattgcagaaatagcccctgccgcccacctctgggacggcaagctgacgtggcaaacgggggaggaacgggcggtgacggagggagggttttttttgcaggaaaacccttgccgccctctggtggggcggcaaggggcccgaatgcaaaaaagccagtcggggccggctattttgcaggcggccccttgccaccctctggccgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttagaattaatacattaccgttgcattggcttacacaagaagatattacgttgtagatgtttattgcatgaaagagtaatatgatctagttatttcgttgacagata

SEQ ID NO: 16840 - DNA, 1501 bp, Oryza sativa
tcataactaattcatttgaactcagtttaatgtggttcaagttgcaaaaattatataaaataaagatctacatattaaaattatccataaattgaattaaatttatttaattctttttaaatgggctttaattagatttaattttgtaaaattcataataaattcatttgaagtcagaatgaggccgttcaagtctcataattcatctaaaattatgatctacatgtttgtttactttttatgtattatttctttggtttttattagtctttttcttcgttttgcgtgatagttagtcgtttccgtcgttgtgaaggttcgcgagtgcgccggaagtattcaagaagattaattgaaggccgattattgcaaggcaagtcacacagatcctaaacacaatcctttgagcatgttgatcctatgtttaaattctctatttatttcaactgtgcatttattttcgaatgtcactgggtggtgtgaacctattcctttgttatggcctgttttcattgattactttattccttgataccttgggtgattataattggactagttgagctttatatatattggttcaactagatattagatataattgcttagccatgcttagaaacattagcacactattgggataacttatgactcattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttaccttttgtatagcatgattcattgcggagcaccagactgagaagtggcggagataagcccacgggggtcactggggagtccatgccttgttttataagggggtgattatgatccaggaatggtgcactgtggtgagttgtgttgtacaaagggtattgtcacagcctctattcgggtactttccagtatcgcgacgcatggtagacatgatgttgaggctgtgtcttgtgggtacagtggtacacctctggccagagtaaaaactattcgaatagccgtgcccgcggttatgggcgagttgagcaatgtttttcgtgattagtctcacacctctcacaataattatggatgttataactggtaataatttgcttagctcctggtttggagttagatctgtacagccgggtatggttgttcaggatggttgggcctgtgcagcatgggtgtgctgttcagtgttgattaaaatttctgattaattactccactgttttacttctcttaaatgttttgttaaatgctgcttttgcaaatgagcctatattatgccatcctttggtatccttgtgcacttgcatatttgctgtgtggcttgttgagtatgtcatatgctcattcttgtaacaatcaatcaacctca

SEQ ID NO: 16841 - DNA, 1501 bp, Oryza sativa
aaagaaacagtagcaacaaaagaagaatttatattcctccatggcgcctccaatgccacataaaagtatgctataatttcactgcacaaaaaatgatcctgctgctcacattatcgaagtcagtgatacagtaggacttattttggggggaaatgttgcagagttgcctgaagttggtccagtaacgacagaagacattgagcttgcactaaggaatacacggccatctgctcatcttcatgtacatagatacgaaaaattcaatcaagactatggcagtcatgtcctcagctaaaggtgagttgcaaaagcaaaggttatttgcacaacatagattgctgaatttcctccttgaagcttgaactgttccctagtattgtggaaatcctcctgacggaatcttgccgataagacttttcatttgcacctagtatggttgatagaatgctgaattaccgctgatgtatttacaactaatgagcattctctttacacaatatttgttcctgtaccatgtatattatcatttgtttgacgaataataagctatttgggtaatccttgccctttcggaatatgagagaaacattgtacatttgtactgggtaccaccaacccctgtcctcttgtccctgtttcttctatttgtggcaattaattatgctaatggactaaaaaacttcctccagctccgtcagataatgcatcggcttttgctatttgcatcgggtagccatgattctctctaggccactacctgctgcttagtccaaattagatggcaacaatagcgaaagaaacatgtatttggaatcaaacagtcctcttcaacaaccaactgcctccctaatatatcccgcgtgtggtactgtaccagctagccaacccctcgtttgctaccacgtaagatccactataactaacaaagtccatacattagtcatactttatacagagaattgtgatgccgatataggtacagttatacgatcgcgcaaattaagcgtctagtgcgtcatcgaatccccacatccaacctgcctttccgaccaagctgtttaaaactatacaagaatagcaccagagttcttttggtataatggtaccagccagtttaacttgtaatctgtgagatcttccaagacgtatgaggcatagttcccgtggcgaaccgacgtggaatcgatgatcccaagaactgattaacttaaacacaagagggcttgttaatctacggctccgtctgcgcgccacatcgaccgatcgatatgatgagcgaccgcacgtacgccctgagcaatcactagcctgatatcatctcctatataaagctcgtcgtcgaggctagcatacatccatcgacgtacacgcctacgtacctacacacagacacagtagctcgctcgctagctaagccgtcgacgtcgcacacacgcacctgacgacgtagttaagcagttgaaattaagctaactgtagcgcctagcacttgatttactta

SEQ ID NO: 16842 - DNA, 907 bp, Oryza sativa
taaaaagccaacggtgtcaaacattttgaaacggagggagtacgtactttcatcaagttctcgtacacaaaattaattggtttctatgcatgtcctaattaattaaggatctcttaaacatttattcttttgctaggtaagaatctcccaacaaaatctgcaggttcgatggctaatctgctctgtaccgctaattaattagtttatttttttttctcttccgacaaatttgggtaattgggttgtacgtcgtgctgagttatatatgtgcaatatactactagtagtcatttacctctaagttagaactgaatattaattaattaaacatttttaaaacatgtattataaatatgtacttggcttctaaagtcacatacataatccatcctcacatgtttttcattagacttgttttaattgttcagtattttcataattaaatataaagttgtacttaatttgcttggaatctgaattttaattttataatactataataatgaaattggagtgaatcattaattgtgaagttgtacttgctttgactcaagtttagtattttgcagatttttttggaactattttgtaaactaacaagtctaaaaaatcaattaagaagtgcaaagttgcaactgatgtgaactctctcttaatctgagctagtattataattcggtgtcatctagagatggccatatgcattcaatttttttccaattgattaacatggatgtttgctcagattaatttattaatagagggaggatagcaaacaggttaattgtaaagctactatatgttttcttttttactaaacactgtaaaactagtatagctggaggatttgtttatttttctctattttcttcctttaggtaatttgtctgttctgtgcttgttaagg

SEQ ID NO: 16843 - DNA, 1035 bp, Oryza sativa
tagttcatcaatggtcaaagacacgttgatctaatggctgagatgattctgatgacgtggctagctgagagatcttctttatagcaatcattgcacttagtgggttccaattatataggaagaatggatttgtaatcaagttgttgtaatcaagttgtaattttatagttagcagttatttgtcctctaaattttatgataattggtttaatcttatttagagtaaaggtgggaacggattctattattaccttaaaaatattgttacttactataaaaaatgcatgtgcgttagaacggaaaaaaactaatgttatggtaatgatctatctatctattaacctattaacttaataaagtaatagaaaaaattagcctccacgttagctctccaagaactagaaattctcatattaattagagtataataaaaaaataaggagaactcatttaagacaaggactctttttttcctttttttaaaaaaatcatgttatatatgtgtagtgtccgatcgaatacctgcatagaacaaatcttttgcaaggaaaaaattacctgagctggatagactaatctctctatgtaagtaatacaacataatacaaagtattcctattttttattttttttgttgaatacaatttaagaaaagaaattaaattcggaatttaaaaataagaaatattgatagatgagattagagttcatatagaaatacaattaggaataataaaatttcagaattaaaaaaataggaatactggaagaagaatctagagtccatacagaattaaaaaataattaatattattaatttttagtttaaatttaaattatatatcatgacaaataaataattacatttttttactccatttagctataaatagtttaatttggagaagaaaaaactatttcaaattttagcaatttttaatgcagaaacagtttaaatcgattgagaataaataaaacgtaattaggcccatatttagaaggacggctcaaatatctctttttcacatcatggca

SEQ ID NO: 16844 - DNA, 490 bp, Oryza sativa
tacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcag

SEQ ID NO: 16845 - DNA, 1501 bp, Oryza sativa
ataaaaaaaattactcttctctaaaaaaataaaaaaagtaatgcttaggcaagcggggtggggggtgagtgcctgtttggttgatgccctcgttagcatgccggagaaatttgcatgcgtgataggcatataagatgcggataaattgcctggccaggcagcctgacaccttgcttgtttggttgtgcacctctgcctgggaggaaaaaaaacatgattaggatctagattggatctgctaactcacatactagttgaatgacaaatcttggctttttaccgcccctccaaagaattcaacgtaatacccagttttttttaacaacttgcatacatcaataagaaaaaaagaacagaaaaacacatgaaaaaattaatccccaaatccacgcatctatcataaccttcaacgattcctcccagctagttgccaattgattcaatgaaacaaaccgttgaagccttcagtgtcttgcatccggcgtgggcgtgtggctttagcgcatgcttctgtgaaatcattgtcatgattaatatttgtgatgaacaattggctattcaaatgatttaatcaaagaattggtttgagagtttgtgtgaatgttggtatgagtgcgtgtgactaatgtgggtcaggttgtgatatctgtgtccagaaacggttgttttgtctgattgtgtgcaggtgacttgaggtcagccctagtcaatggtgaggaccgggactatgctcagggaggagcagaggtctattgcggtcgggataccatgtgagaaggtgactagagtctggactcttggaggtcaactttggtcaacggtggggatcgggactagactcaaggaggagttgaggtccagacagtcaaggataccgggtgacgaagttggatacaagatggcatacggtggatagacatcgtgtgggagagatcttcgcaatgggcttcatgaggtatgcgtgcaagtgccggtattcgcgaagggaattgtaaagttggagtagtatatggtgctacagtacacgaggtactgtagcatgcaggtatgcatgcatgtacggtgctgtgcatgtatgtgtgatcgatacatgcatggtgaagcatgtatgtgtgcatgaatggttggccgagcagcaggagagcggctcggtgggcctcggtggctgttggcggcatgccaagtcggcccaggagaagcaagggcccagctggcagcgagtcggagacggtcacgcgtggacgtcagcttgggagcgaatccgttttagatttctggtgcggccggttgtttgctgcacgtttggaaattgtaaaacgtatggaaactgaaggatggagtcctattgtgtataggagttctacacctactttgagtaggggatttttgtggtataaatagagagggagcgtgaggtttcctgtatcgctttagagagcaatagagttgagttttggttttgggtttcgagtttagtcgaaatttttgtaaggagtgctgt

SEQ ID NO: 16846 - DNA, 474 bp, Oryza sativa
attcagaaccccagtagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttattcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctcca

SEQ ID NO: 16847 - DNA, 592 bp, Oryza sativa
tatggactctatactctacttctaatattccttatttttaattccgaatttcagttatttcctaattgtatttctatatggactctattctctacttctaatattccttatttttaattccgaatttcagttatttcctaattgtatttctatattgactctatactctacttctaatattccttatttttaattctgaatttcagttatttcataattgtatttctatatggactctagtctcctcttctaatattccttattttttaattccgaatttcaactatttctaaattgtatttctatatggactctgtattttctttttctctaattaatgtgagaaattctagaccatgagagcgaacgtggaggctcttttttctattcctttaataatataataaataaatgcttcatgtatatatctaaagattcgatgtgatatttttagaaaactaaaccaggcctgactttgcattgactgcaaacttggatcgacgactcgatctcacaatcacgcctgcagcatgacggtaacatgtttttagccctgtgctgcagttaaaaaaagaagggcacgcgagagcca

SEQ ID NO: 16848 - DNA, 1501 bp, Oryza sativa
cggcgatctttgagattcgtgcccggtcgatcgatcgatcgatctttgagattcgtgcggagatcgatcgatcggacggtctggatggatggctagtcaactgccagctaggactaggggatggaggaggtggggcccagggatcagtgagacgtgtggctttttttggcgtgggaaggaagcgatcgagaatccaagggaccgaaataattaggtggagtggcgctgtcaaaaggggaggatcaagagggaggtggggcccacgctgcagtgacacaaagggctgcatgcattgcctttttttttttgttattttggtttggggttaattatcgcattcttttcctgtatcataatattggtggtgatcgatcgatcgatgcatttggtaataatttgagctgtaattttttttttttgtatatgtactaccccatgatgatgattgagaagatgactgattagtttgcaaggcatgcagatatgaataatggagacactagttcatgcatgcatcgtgcatgtggtgtgttttcctcaggatgcagacaagtcgtatataatgatcatccatgcatgcgcttatatatgggacaaatatgttactgtaactaggggaaaatgctattaccttcctaatatcgggacgaagaggtaatattgaataattatactcaatctaaaacgaacgcatgtgcataattattagaccaattaaccgtttatcatatacacgtatactcaaatacaaagatccattattcttttagtgtatcatataaactagctaggtgcctgggtggcccgcgcaactgcgtggttagcacccatacaaaattatatagtttttaatatggttttacttaaagtttattaaataggtatcttgttgtcttaagattttgaaagaccaacccttatcatccccgtttttctaattttatagtttttatactcctatacggctcatccactgtctcttctatttcgtgtcattgggattttaaaaattggatataattattgtttgggtttttttatactttctaaaagtcccgtcaaaccatcagtggctttgccactatactcctctacggcttgcccggtgtctcccttctttattatcattgagaatttaaaatcaaacatgattatcattgggattttttttatttttagatgtctcgaacctttaaaaattggaccttgtaatttttagagtttattgtgtcgtggggtttcatttttctataaaatttcgaagtcacttcaaacgctgccactatactcctctacggcttatccgtcgtctactctttattatcattgggattctaaaagtcgaacataactatcgttggaattcattttttactttctatatgtcccgccaaccgtcggcggctctgccactatacccctgtacaacacgcccgctttttattgtcattgaaattttaaaaacgaatatgattatcatgagtgttttttttacttttta

SEQ ID NO: 16849 - DNA, 585 bp, Oryza sativa
atgtgtatatatatatgtatatgtatatatgtgtatatatatatatatatgtatatatatatatgtatgtatgtatatatatgtatgtatatatatatatatgtatgtatgtatatatatgtatatatgtatgtatatatatgtatatatacatatatatatatgtatgtatgtatatatgtgtatatatatatatatatatgtatgtatgtatgtatatatatatatatatacatatatatatatatattcattaattcttagaagtacctaatcttgagtctgaagaaagaattaatgaatatgagcttagtgagaatatagacaactattatatatcaaattccaatatagagtgcataggactacaagcatttgcaccaaattggtatagggatattaagtctaaaagggatatagaaaaaattattcaaagattagaagatatccaaattataggagaaattcctatgaaatattgggaaaaaaatgctattgagtgcaaaattaatataataaacccagagtatattattaagactagcccaatagaagcaactccgaaagacataaaagaatttaaga

SEQ ID NO: 16850 - DNA, 475 bp, Oryza sativa
gaaccccagagtccgcacatcctcaaatacaaagcacgttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccaccatcatcttattctctatttgtattccctccatcttt

SEQ ID NO: 16851 - DNA, 1501 bp, Oryza sativa
gctgtcgcgccagcgtcttcgcctcgacctcctctccatttcccctcaagaatctcgaaggatggtgctacgagtgtggagatcgtccaccgtcttctccacctccggtcaccgtcgccgttgccgaatccaccccctccggtgagtaccaacccaattccatgcatcagtagcatctctggggcctctctaacctcatggacacacatgcatgatagttcttggagctgattgagccatcgccgttcacccagaggttcttgccgccgccgagccgttacacgagccaccgtcataaacctagctaccccagccatgtctaccatctcggtgagcacccttcagcctatagaacatacatgcatgcacccaattaaccaatacatgattgtagaagcacatgcatcaccacccgaaaacatcctcctttcggactcgccgccggcgttactccgatgtccactgaccgagaaaagtagaagaatggaatcgcaataacatgatcttcattttgtattttggttgcacccccaaacgagccatcgtttgtcgccggtgagctcgagatcgagctcagccatggctgttctgcctctgtgcgtgagaaaagaagtcagggaccttgtttcgagaatttaaacaactataaggtttaatgtgcaacttttcaactcactgacatatgaggctaggtctgcgggttgattcttagaaacctcagggatctttttgtatattgatcattcactgacagtggaccccttggaaacaaaaatctgaaattataaaaggaaagtacctaaaacttgtaaaatccatataaaattaaatatagctcattttaagatgatacaaatttctgtcaactcaccaaattgtgaactttagtgttatggaataaaaacttgcactcacagtacaaatttagcctctaaaatttatccaagttaaatcacacataaagcatgcacaaatttataaaatgcatacaaaattcatttcaactcattttggagcaaactcagtttctacagatccaccaacttatgttctcctataaagcaaaatgaaatagtatacatactatacatcgaatgcctctaaaactattacctttaaaatgactagttttacataagctgaactttagaagtttatataaaattcatcttagatcctttttgagtaaacccaaattcagtagaatcatagggttgtgcacttcaatgttataaaataaaaagacatacttacagtataatgaaaacccctaagtatttaagtaaggaataagcaacatggagcataccttaaatagtaacatttgtagaaaattcatctatagtctaaatgaagtgaaccaaattttctatagaaccagcaagtaatatacttcaacctagtagagtgaattatagcaccctcttacagaccatggctctgaaccttaatttggtagaataggtactaaacacatagtaatggttaaacaatacatatg

SEQ ID NO: 16852 - DNA, 355 bp, Oryza sativa
ctccttcccgcgcgattgcttgcacgccgccgccgtcttgttgcgggtgattctgctctaatccggccatcgccctgctatagtattggtcacctgcatggatgcacgtatgcatggatttttctgcatatcgatgagacgtggtttggttcctgttaagtgtgaacagccatctgccgccagtggccaactgagatttgatgctgatctagaaggagctactactatatctccttgcatatattcatgcagtttcgtgtatgcactggatataatatatcttaatattgaccagctcatatatgattatatgcatccatatatgcatgtatatcattggatattgagtgtagga

SEQ ID NO: 16853 - DNA, 1501 bp, Oryza sativa
tatagttctaaaaaattccaaaagtttatgacctatttaatttttttggtttttccaaaagtctaaaccttatctatagtatctatgtgctaaattaaattgttaaccagaatcaagaaaccatcttaatacttattgattgcatgcatgcgtgcatgtgtatagtttagagtaggtacaatagcaaactataagtcagctataaacatattttaaggagataaaagatgagagagaaaagcagcgggttacagatttgtagccagctacagcacggactctaagatgcatgtgtgcatgacaggtgggaccagacataggtacatattgtatgaattgactattaaattgactatgtaatttagagccaatagttagctgtactattaaacttgcttttataggttttgtcacatgatagatgagttaattacttcttagtcttggtgacagaagaaataggtctttgaacttttggatgaagggagtatataataatatcaatgaatacatgtttttgttaaagtattttataagactagtcatatggtttcatatatgtaagataaaatattttagatattatttgtagttaaaggttttaaattttaaccatagccttgtccgaaacaagagtattattaacctacataaaatactcatgcgaacttaccttacaacagcacgcgagtacttttctactcaagagcctaataatgatcaaccgatcaactaaaaactaaacatgcaaaacaaaacggcctctcaccaataaagaactactactagctaagtcaatctgcatatgtagcatatcatagttaacatttatatgctttatatataaaaaagcgaatattagggaatgatctaatatcacataatgaaaagaagtgagacttcaaacacagatcggctagcccacatcttgtggagctagctgaaaaatccctgcgcgtttctcatatgctttatatacaacacgcatgtagcgtttctcatacggttttgagctaattagactaatcttccatttgacggacgtccaccaaatagctagcctaccatcgtgcgtattggacaccgaagaaaataattaaagaggatgttcacttttaaccgtatcaaattttagtaggtaacatatacttcatccgtttcacaatatatagcactaccaaattttagaaaggttcaaactaaacatatccaatactaacaaaatttggtaacatgtccaaatttttttttactaaatgttggtaagatgattttcaagtaaacaaactcgaaaatccaaaatattgagtaagctattgggccaggacggcccaacaactcggctattaataagccctccctcccgttcggacagacacgcactaccaggcagcccaacccacccgcgagctagggttttccagagttccagaacccccacctccctaaccctaaccacccatcctccccggcggcggcggcggcggcggcgaagagaaga

SEQ ID NO: 16854 - DNA, 1501 bp, Oryza sativa
tccaatacgcacgatggtaggctagctatttggtggacgtccgtcaaatggaagattagtctaattagctcaaaaccgtatgagaaacgctacatgcgtgttgtatataaagcatatgagaaacgcgcagggatttttcagctagctccacaagatgtgggctagccgatctgtgtttgaagtctcacttcttttcattatgtgatattagatcattccctaatattcgcttttttatatataaagcatataaatgttaactatgatatgctacatatgcagattgacttagctagtagtagttctttattggtgagaggccgttttgttttgcatgtttagtttttagttgatcggttgatcattattaggctcttgagtagaaaagtactcgcgtgctgttgtaaggtaagttcgcatgagtattttatgtaggttaataatactcttgtttcggacaaggctatggttaaaatttaaaacctttaactacaaataatatctaaaatattttatcttacatatatgaaaccatatgactagtcttataaaatactttaacaaaaacatgtattcattgatattattatatactcccttcatccaaaagttcaaagacctatttcttctgtcaccaagactaagaagtaattaactcatctatcatgtgacaaaacctataaaagcaagtttaatagtacagctaactattggctctaaattacatagtcaatttaatagtcaattcatacaatatgtacctatgtctggtcccacctgtcatgcacacatgcatcttagagtccgtgctgtagctggctacaaatctgtaacccgctgcttttctctctcatcttttatctccttaaaatatgtttatagctgacttatagtttgctattgtacctactctaaactatacacatgcacgcatgcatgcaatcaataagtattaagatggtttcttgattctggttaacaatttaatttagcacatagatactatagataaggtttagacttttggaaaaaccaaaaaaattaaataggtcataaacttttggaattttttagaactataaacttttggatagagggagtatatattgtactgaaaaatggtgatcaaagttgctcttagagttttttttttttcaaaattatattactatcaacccagagaaaataatttgtaaacttccgcgtacacacaagtattcaaacttaaatgtatggcataaatgactcatgctaatactataaaatttcaacttttggacacaactgtctcctacttacccctcccaacatgtacttaccagaactagtgcatcctccatctctgttgaggcagagtagatgaggctattgtacttaccataactttcagctggaccggctggatgcattcagagtaaagtcatatagggtgtgtttggttgcctgcatcaggcttggcctatatccggagatgcaacttccgcttgtttggttagtaagt

SEQ ID NO: 16855 - DNA, 1501 bp, Oryza sativa
cgacggctaagtcggggtctgaccggccgtcaggcccggtcagaccggccgtgtgcgccgctccatcggttttactacccgtttgatctataggaggttggttagcagtggtagaggctttatcctttgacatgtaatcggccataagaggaccgaatttaacccttaaaaactcatcaaatttaccctcaaaagttgcatctaacttatctttaaaagcaatcatagatgaatctattgtagatgctacttgctgttgtatagattgtgttacctcatcattgcttaccaaatcggggacgagcttaggaagtagcccgggcttgatgatcaccccttgacgagtcctagtgcttgccctcatcaacgcctctcgtgtgagttcgttgatgtactcctccataactttgtggtcctctccttcgaaatcctccaatgtgaccggtatcacattggatggctccacctccgtcttggatggcggcttcgtcatggcgaagtcgaagttgagttgacgatgaacggatctctttcccagtggaatcgccaaaaatcgtgttggcatcttttttgacaagttgacaagcacgatcgcagcaccttaagccttgcggtgatcctagagtcgccaaccacctcgatctagcaaagagctaaacctagatgggttttgataactaaaccggctagcggagccgatttctagataactacccgtctcgtgggcaaaacggaagtttttaggacaaacctacaaagagatgtcgtgtcacgtcctgataaattcatcccgaaataaaaatcattccctaaaaggaataatagaattaattaaaattcgaaaagaaattggcaaacattaaaatacgtacaagaaaaattcaaatgtggcccggagaatttttgttaaattctccttggtctaaaaagagccctcaaattttagtggaattttcagagcaccgaaaataattattaagcaacaaaaacaaatattagagtttattaaaaagaaaaaaaaaacctaaaaataatctctctcccccctttggtccaagtctggcccaaagtcctccctctctcccctcggcccgcggccgaagtctccctctcctccctctccttctctccctcctcctcttgggcccctcttcccctcccggtccactccctcctcctccctctttctcccaggccgcctccccctcctctcctcctgggccggccgcccggcccaagccgcgcccaagccaggccgagccgagccggccatgcacacgcgcgccgcgcgtgcgctgaccgcgcgtccggccgcgtggggcccacgcgtcaggcgggtcatcgtcctcctcccgcccggccgtcctctctccctctcccgtgaaccctagcgccattcctccctcaaatccgcgcgattcaagcatgggattcccaaattgattagggggaattaatcccctttccctcctctctctttcccccttaattccccattgaa

SEQ ID NO: 16856 - DNA, 489 bp, Oryza sativa
catgaattcagaacgcccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcaga

SEQ ID NO: 16857 - DNA, 489 bp, Oryza sativa
gtacccacgaattcagaacctcagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatcttt

SEQ ID NO: 16858 - DNA, 1501 bp, Oryza sativa
gaacaaccatacccggctgtacagatctaatctccaaaccaggagctaagcaaattattaccaggtataacatcaaaaaatattgtgagaggtgtgggactaatcacgaaaaacattgctcaacccgcccataaccgcgggcacggctattcgaatagttttactctggccagaggtgtaccactgtacccacaagacacagcctcaacatcatgtcaaccatgcgtcgcgatactggaaagtacccgaatagaggctgtgacaataccctttgcacaacacaactcaccacagtgcaccattcctggatcataatcacccccttataaaacaaggcatggactccccagcgacccccgtgggcttatctccgccacttctcagtcgggtgctccgcaatgaaccatgttatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaatcaatcacgattgaccatcgtgaactatcattaaatataaccataagtgatagtgaaacattagttatcccaattgtgtgctaatgtttctaagcatggctaagcaatcatatctaatatctagctgaaccaatatataaagcccaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgcttaaaggattgtgtttaggatctgtgtgacttgccttgcaataatcggtcttcaattaatcttcttgaacacttccggcgcactcgcgaaccttcgcaacgacggaaacgacaagctaacacgcaaaacgaagaaaaagactaataaaaaaccaaataaacaatacataaaaagtaaacaaacatgtagatcataattttagatgaattatgagacttgaacggcctcattctcacttcaaatgaatttattatgaattttacaagattaaatataattaaagcccatttaaaaagaattaaataaatttaattcaatttatggacaattttaatatgtagatctttattttatacaacttttgcaacttgaaccacattaaactgagttacaaagaattagttatgaatttttaaagattaaatcggattaaaacctttatatggattttaattgaattatgacgcaataatgaattatttttgaaaaggaaaagaaggattattgcgtcagcgggctagggtttcggtggaccgggcgcacgacggcggttcacgaaaacggacggccgagatcgatcggtccacgaccggctcacgggagagggcgacgacgatgacgtcagcga

SEQ ID NO: 16859 - DNA, 464 bp, Oryza sativa
tagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagtcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctt

SEQ ID NO: 16860 - DNA, 1501 bp, Oryza sativa
ggaatgctagaaagtcttataacctgaaacggaggaagtataaaagaaaaaaaccaactcatgtggtgtttgcgaaggagggactaaactagtcatttttgtgattcccaaataccacctcaattggcattatctcacatttcagtaatgcagtgtccgtaaaaaaaacaaggcatttgcaaattgcaatagataatgtcttggaatctgatggatttgtaacagcagctttcagatctctctttcaatcatctcctatgtatatactgcactagttacaaaagtaaaagagggatagttctacacgttcacggaatccttctcactccctctcgctcacattcatctctcgctccgttcgtccacgcgtcgaacacctcgccgtgatccaatgctccaactccgctcgccgccgccggcgaccagctcgccgtcctccgccgtctccttcccgaccctcgctcctcgcctcctccccctccgccgccgccgccgcggcgcgggttcccagctcgggggcaaaacgtcgagcgccgtgcgcgcgtcgtcggcggcggcgccgggcgcgacggagccggaggtgatggtggaggtggcgcaccgggaggtggcgcgggcgctcgcgtccctggcggaggcgcggctgggcgcgcggctgctcccctccgccgtgccgcccgacgtcgccgagttccgcagcggcggcggcgccgggaacgccgtgggctcgctcgacgtgcgccgcggcgcgccgggatcgacggtaatggcacccctcctctcacttttgctcgtcagatcgtacagatttacctgttctgtcgattggagaacatcagaatcagtcatatgaattagtgaaatggtagtggtaaactggtaatgtctagagcaccatcagaatcagtcatatgaattaagtagtgaatcatatgaattaactaattaagtagtgaaatggtagtggtaaactggtaaaaacaggctggcacaaacagagcagaatagatcaatggcatgtcaaaagacttggacaatttactgaaactgttttacactgaaaaattgctgccgaactatttgtgatttgccctatcaaggtgaacttgcaaacttttagaagccaagatccataatccaactcttcggagcaaattatgacttttcattatattggcaatgctcaaattagttcatttgcttccaatatcgaaatggaaacaattggtctgttctagagtttgtacctcattcgtgattcttcctatcactcacagattttgtttcctctccaaaaacaaaaaaacaaaatcactccaactgaacggacacaattggagtggccaaaatgatcaacagcattcaaattatgaaactaatctcaccacttgaacacctgaattatgctccctagtgctcagtagcttagcgtggtagaatttcttgagttctgcaaggaatgacaaatggagttaaattattaatttttcttgtctacaga

SEQ ID NO: 16861 - DNA, 1501 bp, Oryza sativa
cgctacatttcaggattcatgtggcaggtgaaatgaagttgggggttcactgtaccagccaagaagggacagatgtatacttaaccaccaaagaacccagcttgtgcagtagtggttcttaatacgagtcttttacccctatgccattaaaaaagttggagcttacgtgtgtgccacgaaaaagttttgagttacctgtatgccatgacacaaactttcgtttacctgtgagccactttggatggaatcagcactaacggagactaacagaggtttgaaaagtctattttgcccttgctctatttcagccacgctggcggcggcggcgtgacggcgacgaccggcggcggcggcgtgccgcgccgggggcgaggcgaggcggccttggggcgccggcctgggcgcgccgccggcgaggcgacgcgagacgaagcgaggcggcggtggcacgccggcgatggcgacgaccggcggcggcggcggcttgccgcgccggcctgggcacgccagcttgggcgcgccgccggatctggcgaggcgagacgaccggcggcggcgcgccggcgatggcgacgaccggcggtggcgcgccggcgacggagacggagacgaccggcggcggcggcagctaggctagggttcgagtggaggcgcacgggagaggagtagagatgaaaatgctttaggggcaatttagtcattttcatacgtgggtcccacatgtcatagctcattctctaacagaaggtggatggaatggcacacgggtaaacgaaattttgtgtcatggcatacaggtgactcaaaacttttttgtggcacacgcgtaaccttcaacttttttaatggcatatgggtaaaagacttacagtaatatcgagtattggcaaatggcaagtagctaaacagagttatgccaaaatcaacaagtagtaagataagattaattccacacgtttcagtgagatactgacaactaatgagacaatgattgaactcttagagtaaagtcaactaacctttccaattaagctgcaacagtctagcttatcatattaatgctacattttcggactcatgtggctggtgagatgaaattggggcgtaccagccagagatgtgacaggtattaacgtataatggtatttgcttctcttcgagtggaacgattcaaacaagatggtcaccttgtaatttctgtttggaaaatgcgtttatgtgctcctgtatttgatataacagtagtagtgcttcatatttttgtcgccaaattgagcactaattagtaattactcgctctctccatcaaaaagatttaaatcctatcaacgaatctagaaaaagcgatgtttagatttatagtcataagttaatttatttttgaacggagagcgtattaaactaagggtcccatcgaatcgattacctaaaaataaattataagtcgtatcagcttattagtgataaaaactaatttatatgtaaaacttttaaatatgtg

SEQ ID NO: 16862 - DNA, 1501 bp, Oryza sativa
gaacaaccatacccggctgtacagatctaactccaaaccaggagctaagcaaattattaccaggtataacatccataattattgtgagaggtgtgagactaatcatgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctagtgctccgcaatgaaccatgctatacaaaaggtaaagccgttgcccacgctggcttgtggttggcatggttaatgtttcacaacagtagctcgcgaatcggtccttaattgtcatgagcacgactctcaaaaccatgtgctcacaacccaccattatcaagttttagttggcaagtaattaatttaccaatcacgattgaccatcgtgaactatcattaaatcatcattaagtaatagtgaatcataagttatcccaataatgtgctaatgtttctaagcatggctaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatactttcggcgcactcgcgaaccttcgcaacgacggaaacgacaagctaacacgcaaaacgaagaaaaagactaataaaaaccaaataaacagtacataaaaagtaaacaaacatgtagatcataattttagatgaattatgagacttgaatggcctcattctgacttcatatgaatttattatgaattttacaagattaaatctaattaaagcccatttaaaaagaattaaataaatttaattcaatttatggataattttaatatgtagatctttattttgtataatttttgcaacttcaaccacattaaactgagttacaatgaattagttatgaattttcaaagattaaatcagattaaagcatttatatagattttaattgaattatgacgcaataatgaattatttttgaaaaggaaaaggaggattattgcgtcatcaaaggcggtccgggtgcacgggacggtctaaggaaacgaacggccgagatcgatcctatccaaaacggacggccgagatcgaacggtccacgaccggtctacgacggatggcaacga

SEQ ID NO: 16863 - DNA, 1501 bp, Oryza sativa
aagcctaaaagagaagatctaattttaatttgctaaatctcaatataaaattgggctagataaaattttgataaatacttctcttgaatctttagttcctagatttttctgggatttatttgagccaaggaagtatttttaatcaatggaatatcatttcatgaataatttaaatagaaaaaggttttaaaatctttcttttggttttgggccgaaagtcagcccaagtctctctttccttctccctctctcctccccggcccagtcggcccagtccgcgagccgccgctctcctctctctctctagtcccacctgtcagtcttcgtcttcctcgcgccgccgccgctttccaatccggtcgatcctttccgtttccggtgaaatcgttagaggggaaatgatcttctcgatctcctccaccttttctcttttggaatcatcgtctttttcgctttggaagttcgtggattcgaggtcgaatcggatcggtctctttcctccgaaccctaacctttccttctcgtcgccggtcaccgtgggcctccgtcgccgcacgctagcccctttaaaaggacccccgagctctcctctatccgccgccacctttgccttagcccgccgtcgcgtctagcgccgcctccgcgtagccctagccgtcgccgtcgttgccgtcggttcagccgcgccgcgccgccgttgcagccgccgtcgtcggtcgccgtcgccaccatcgggatcgcgaggtcgtcgccgtccccgtccaccgcttcgccgccgccgaagaccgccggagcaccgccgtcaccgtcgacccgaagaccgtcgccgcctcttcctcatcgccggcgccgtccgttgctcttccgccgttgttttggtcaccggtgagttcgccgcgtcgccctctacccgttggtgtcctccgtttgcgtcgtcgcgctgtcgttcgccggcgagcatgcgttcccgagccgccgccggtgatgacgtcatcgccgacgtcatcgttgccatccgtcgtagaccggtcgtggaccgttcgatctcggccgtccgttttggataggatcgatctcggccgttcgtttccttagaccgtcccgtgcacccggaccgcctttgatgacgcaataatcctccttttccttttcaaaaataattcattattgcgtcataattcaattaaaatctatataaatgctttaatctgatttaatctttgaaaattcataactaattcattgtaactcagtttaatgtggttgaagttgcaaaaattatacaaaataaagatctacatattaaaattatccataaattgaattaaatttatttaattctttttaaatgggctttaattagatttaatcttgtaaaattcataataaattcatatgaagtcagaatgaggccattcaagtctcataattcatctaaaattatgatctacatgtttgtttactttttatgtactgtttatttggtttttattagtctttt

SEQ ID NO: 16864 - DNA, 214 bp, Oryza sativa
tagctgtacgtgtactacgtactctaccgcttgacctggggcgtgacagcgtgagggaggcgcggcacattgttctctacttctctcgtgtatttgtacaggagtacgtacgtagtgtcaaagttcgtcttgtttgactttgcaagttacaacaaaaaaacacacagtacagtactaccagcgctgcagtaatgagtacgtacgtacgtacgta

SEQ ID NO: 16865 - DNA, 1501 bp, Oryza sativa
ggaaatggagactggagagtgcagaaatgcagcaaagtctgaagaagaagaagaactgaagaagggtttcctttctgatctcgcacgccatctcgaggaaattttgcatgaccaaagtcagaaattgcgaagctaactatacctaagtacgtatgtacgagcatcctttattctgttagtctcaaacgaatttgaaacggattggcaaacttgggtgatgaccattgtgagagtccttgcgtttcatcaagagtgtacgcttgggtttgtgacaaaatttcatgctaaatgcatgcttgcttgggttcgcagcctacatgagccaaagttttgtcatttgaagacaccatttttatcctgatgtcaaaattttggtaaaatcatcttcgctgtaagttcacctttttaatctgcagacgatgtcaaaagttctttgattaacttttcacctacagcttcaatccaccgaggcctttgtttggataggccccgaaatatacatccaagtttgtgggccaggattttagcccaagtatctagcccacatatggatgggctagaactgaggcccatataagcaaggccctgagactgttaaccaaaacaggccacaagcccactcaacggcccaagaggacaaccaagcccacctccaagcactgaataggctgagtttgaggcccaaccaaacgaggcctgaggctcacaaccaaacaggccaacaagcccatcatcatcaacacaaaggcccatcaggcccactccacggcccaataagacagtccggcccacctcccaaaccgccataacttttcctccaagcaatacatcccaaccaaaccgtcccgaccccttacgccactgacaccacgaccccacacctcccgtaccccacatgtcatcctcctctgaccccgcgactccacgcctccccacatctacctccacccatcgacctcttctcccaccgacacgtgggcccaatgcacgcgtggatcggtgggtcccacgtgtcagccactgccctcccggggaaaatatctcacgtcctgtgccttttaaccccattcgcctctcccttctttttcacttcgtctcctctcccctccaaaaccctaaaccccccaaaccctagccgccgccgccgccgccgcagtcgtcgccgtcgtcgcagcagcagcggcagcgtcaccaccgcgaccggcggctgcagcgatgtactctatccttcgccgcgcggcgccgctccggcggcgcgccgtttccgccctggccgccgcggttctccggcgggaggaggcggcggcggaggtggtcgtgtcgcggcgggcgacgatcccggcggcgtggttccactcctccccggcgtggctggggttccgggagacgggggccgcgggggcggcggcgaggccgcagtacgcggcggatgaggggttgttctacgaggaggataagaggggggcgaaggcgggtggagttgctgcgggcggcgcggagg

SEQ ID NO: 16866 - DNA, 1501 bp, Oryza sativa
tcggataggatactcaacggattgctccgtttcttgaggggaaagatagaggagaacgagaggatcaaaacccctcaatcaatcggacacgaggagaccggattggggtggatttggaggcggaaggcggctcggtcgggctcggcatggcagccggccggaggttgaagagaggtccgacatgtgggccccacatgtcggcggctggaggaggagagggcgggcggctcggctgggccggcttgggccgcgcgggagagagagagagttgggccgaattcggcccaacggcttaggaaggggttttttgaactttcttcaattaaaataatttgtgaaatgttgtttcatttattaaaaatacttcccttgctcaaataattcccagaaaattctagaaaatagaggaacaagcaaagtatttaataaaattttatctagctcaattttatattgagatttagcaaattaaaattagatcttctcttttaagcttttaaaattatttctaataattccttttaaacaacaatttataatttaaggattttaaacaagaaaaactcttaacaattataattagatcattattgatcaaataattactgaaatgttctttgtatcatttaggaattgagctccgaaaaatccgagaaaattccagagagtataattaatcatggagaatttaataaaaattaaatccatccatgctttaaatttaggaaattttatttcccacaattaacttcacttgcaaattattgaacatttcatataaattctattaataatttattaaataatttataaatcctaagacgaaaatcagggtgtgacactctatacgctctaaggctgcctttttggcatccggagaaaaaaatccctcgttcgccgcgcgcacgcttctcgaactgctaaacggtgtgtttttcgcaagacaattcgatacaaaagttggttaaaaaatcctactaatccatttttaaggtataaaataattaacactcaactaatcatacgctgatgactcacccttttttgcgtatattctcttttcccctcctcacaaacacaccgtaagtaacattggcgaagtttgatgcctaggaacctgaatgatatgtttatagcttcacatgctattggaactttagtgaccgttgcgtagactcgtataagaatcgctgatgaccttgtcgaatttgttgccaaagtggttcttacctttgtttttctttgacaacacccctcgacacgtcgttcatgctcattcgcgtacctattgccaaccggacaatgtgttataagccattaacatcttgcgtacatataaatttcatatcggggttgtggaagtccagatttggatcctgcaggctcagtcaggacaagagatagcatgcactgcggaccgaacacttggcacacatgcatgcaaccaatcaattttggaccatgaagctctcttggcctttggttatcatggtacatgttt

SEQ ID NO: 16867 - DNA, 1501 bp, Oryza sativa
cactccaagacctagcaggtagcagcaccgcctccgcctccgcctcatctcctcccccaaccagcagcgccgccgccgcttcctctccaaccagcagcgccaccacctcctcctgtcccctcctccatctcccccacatcatccacgatgtattgcccccggtggttcatccatgtggcccatcccacatgaatccaccatctccacgcccccaaggtggttcctgcagggaggtcgcatttggctgcgattcatcaccaagagcacgacctcatcgctcctagggagccacctgcatctgtgctcaccagatctgcttcacctgaggttctgggcaccgtcgtcccttcttgaagctcaagacgacgtttctttgtccactgcaatcaacaacacaaggtcaagcttgtccccccattccctgcttcctcttccccttccctcctatgttctcttcccccttatcttaactttattccccaggcagatgtggtgatggagcagagttcattgttgtttgttctgttttatgttcagtcatgtgctaagatttttaatttgactactgggatagaaatgatagatgatggttcttactgtctttgtaaaaggaatatttttccaattggttgttgtcccatcccttctgagatgttactactcatgtgtgcttatttcaccctggcataaccaattttctaccttttccattgcagatctatcttcagtagttatggtggaatttgcttaattcttgtctacttgacctccctgacatatttagctaggtatggaagtggaactccttctctgtttattagtttatgactagggggctcctctaattatgtaagtaaagcagcagaccatcaaatgcgagcatccattctttgtctggatttaggtgtatagctgcctttttatttgtgctaacaattaacaaaatttaccttaagtgatatggtatctaactaacccattgtactgcatataaacagggtgactacttgattttgtttatggtatttcatctgaaaatacaaatgttcagtggcttaagtaaaaagaaatacagatgctcttttctgaacctgaggattgtcactcagattatttaatttttcaatttgcattgcacaagagcaaaatatatcgcagaggttgcatttaaaattttgtatttattatccaaaaatgtagaaggtcttgctgagtaatcggagacaccaacaaggttggcagcaaaccagaacaaattaacaagcaaacgcacaactaaaaggtacatatgtgtttcccttgctctttgacatcagtttttcttacttctatgtgatttactaactacttttacatactttagtttttttttacacgatgttttgccttttgattgtatgactggaatgcttgttgagcttgagagctatgttaaccatttgtgtttttgcagtatcataacgaatatttgcattttatattcagacatttagtatttcat

SEQ ID NO: 16868 - DNA, 1501 bp, Oryza sativa
acccaccggtcagcggcacggggaggacagaggaggcgtcggcccgcgggcccaccggtcagcggcacggggagggcggtctaccgtggaccgggaccacgcaggtgatccaccgccgatccacgggaccgacggcccggatcgccctcgggccgatcggacggacggcggcggcggcagcccccgggctcggatcggcatcaaagccgatcggccgacccggggctagcggcggcggtgcgtgcgcgtcgcgtcgctggcgacggcaaccggcggcggaggcgacgcgaaagcggcggcagcggatggcggcaacgacccaaagcgacggcgagcgcgggcggcggcgacgcacggggaaacggggaaggagaggagaggagatgcctcaccgagggtggccggcgcggaggaagacgatggcgaatggcgacggcaagccacggggggcgacggcgaccggcggacgagctccggcgtgccctaaggaaggagaagggagggattagagagagggagatagaccccggcgaccggcattcgaggccgaaagcggcggtagggtttagaccctatcggagcgcgaggagacgggggttccggcggcgaacctcgacggggaaggggcggccgaggtagatctcgaccccgcgaacccgacggcgacgacggaacggtgcggcggcgaccctagcggtggctagcagcggccgaagtagcaaaaacggcggcggcgggtggttgcacggcgcgggagcgttggggggctcgggagaggtcggcgcaatggggaaaaagagagagggggtgccggcgatgcttaaataaggggagagggggccggacgtggccgggagcggcgggaatcaccggccgacgtgggggagtggggaggagagagaggcgggattcgattttcgaatcccggccatctcgggcgcgggcgcgagcgggagagagaggggaatgggcgcgggggatgcggcgcacgcgcgggcgtggtcgacgtggcccggggaaggcggagacgtgggcgcggcgacggttgcgggcgcggcggcgcgccgggatcggcgggaggagggagacgggcccgacaggtgggtcccacctgtcggcgaccccgggagggagggaggcgggcgcccggctgccgggctgggcctcggcctgcggccggcccagcagagaggagggggaaagagaggggaaatgggccgacggcccatttaacaaaaaaggaggaaaaagaggggaaaaagaaaaagaaaaaggaaaaaggattttccctggaattaaaaattgcactttggtgatttttaattggttacaattgtttctagagctctgaaaattccattaaaaatcctgttaatgaatttcgacatgtagaactcaagaaaaattccacatgtcaaatccgattattatttgcattattttcttagggttttctcctgatttcacctgcattttcttagggtcttttataaattacaat

SEQ ID NO: 16869 - DNA, 491 bp, Oryza sativa; identical to SEQ ID NO: 16611

SEQ ID NO: 16870 - DNA, 1501 bp, Oryza sativa
gacagtagattaattatctaaaggctaaaaacaattgatgtgatatgacttaattagaggaaaaaaggagaagataatttgaccatagattaatcatttaagcactaagtgaggatgaactatatacctatatcataaaacataataaatatatacattgaaacattatgtgaattatgttggatgataatttaacatttttgtatttgaaaagctcttaaattataaaaactataaagatatagcatatttgcatgatgtttaaatgtgatgattgttagtggatgatgatgtggcatcttgttaattagtagatgatgatgtggcatctttgcatgttaaggttatggagttagtgggggataactttatagtaagataggattcccttcaagcctgtacgatgatactccttgaagatttttggctgtgttcggtagtttgggatgaaaactaatccctctcatatataaaacgatgtgactcattagtacataattaactaagtattagtattttaataatttttccatagatttttttttgaaaaaacacaatctatactctctataaagttacaacccactaactctaatgcttaatatgcaaccatgccacattatcacccactagcaataattacatactcaatctcattcaagcatgcaacatcatctacaatctatttaattctacaaatcattatgtatagtataaatccaatcatcacccctcacatcatttccacaatatttttacaaacctatcaatcattcttatgatatttaacataaacttatcaattaaagtgtgagttttatttgtttgtttcatgataaaaactgataagccttggtatttcatttattttttttacccctagcttgattgtagtgaaaatatatatattaaaaattaattttcacatcaaagcgctgaaaatcaactgtctttagcaaattgagaaccgtgcgtggggtagaggaggggagaagctgagaaacggtatcgtaggtaccgcctacgtagccgtgttcggccagatatttcacaagcctacaacatctatagcccacgaagtattttccaggacccaaaatgcggcccaccaaacttagccggcccacgcagttaaagcccaatcacccaatggaaacggttcaacttgcgcgaccgatttcaggcaccgcgagtggaccacggcggaaggaggagccgcacaagcgacgagattttcgcccccgcttcggattaaaaccctagccggctaaacctgctccgctcccccccgccgccgccggcgccgccgccaccaccactgccggagagagagagagctgcctgggaggagcagcctcggtgcgcgcgcgcgcgctaatcccctcctccactctccgtcgccgccgccgccgcagccatgatctgcgcaagtaagcttctctcactgtctctccgaaaccctagctgttctctccgtgcgtgcgctgatttgtggcctccg

SEQ ID NO: 16871 - DNA, 1501 bp, Oryza sativa
cataaaggccgcatacaactttaactaagtccagtagatttctttgtacatatatgtgttatttcatccgtgactaacttcatcgtcgttactatgtagcgatcattatatttgtttgatgatctacccgaagtacgacaccgtgacagtcttggacccccttgattataaccacatgatgtaccgtcaatttctaacaatcttcaaatagtaagtgatctgataaatgcatgtctaactttcatgaattataattaaatctcctccttaatgcgaatctgtaaatccatacaatgtgtataactactacaaggtaaaggtggagaactactgcaaacaagggagaaaccactagtgcatacatactggccagtaatactccacacacttaatgtatttcaattgttttacttgcaatatttaactagttccttctatgtgtatgtcatgaagtgtcacaagcaacttaaaagcggtgtcctctgcagttattacacatgcgaattcctcagggttaatgggaggtacatgaccaacgcagaggatgtaagtctctcgactcaacgtataagtgcaatggagaactgcacatctagatgttagtaatatattgtcgttttttcgtgcatgcagttgcctagaattgaacatcgaacaagctttgacgatgaaggcattaaaaatgtgcagcgggacctctgccacttcatccacaacgagtgctgtcatatccaaggacggttcttcgacccagaaggcaccctagcgacaagcgatgaatacaagtctcttcgggagtggaacaacgcgatgccataatgtatttattaattagatagtgcatttgaaatgacaaatataaaaaatattgtaacatattgatgacacttttcactaatgcaatatatgtatttttgtcagtattaattgtttgtaagttcctaatattatttatgcattatttaattagttgcaacattattgataaaaaatattattaaaaaattggcgtgtattttcctaggcgacgaggccttcttatcgcaggcgactcctacccattttcccaggcggcgcgtcgtgctcccttccacctaggaaaacatcttcccagacggaatggccgtccacctgggaagactgttttcggccgtatgcaaaaacattttttctacattttttctagtagtgaaggagaataaatgaattaaatatgaccacttggctgccttttgatgatgacggtttcgtcgtcggagagaaaattgccttattctggaaggtcaatggatgagaaaatgtattcacttggtatacttgctggatattgcgtgaggacgggtgaaatgtaggtccctattgacatttctttattttatgatttattttatatcagttcaaaatataggcattatggatcttcaaatcattggtttagttagattagaaattatatgtatagcttaaaaattatgcatattttaatatttattattatttt

SEQ ID NO: 16872 - DNA, 1286 bp, Oryza sativa
gcaacgtggcgtagcgttggacagtgactggttaatattgcttaattactacaactgtttttactattttcaactactggttttaaatgcctgctttatgcaaatgaaccccgtagcctccgttggttatatcctgcatcatacctcctcttccggtatgacttgctgagtacagtgggtagtactcagtcttgctcttttcccccacaccagagttgaagttcttctcagttggagatgtcttgaagaggttggtttcgtcgctgccgtcaagggttgcctgtggaatggaatcgcctgctgcaggagtcaagtcttcaggcttagctcgcttttaccttttttgctgcatttgtaatcttttatatttttgtaagacgtggatctgtatgtcaacaattgtcatttgtgtaccctggctggtcctggacaggggtttaatacacattcagcttagaaattctggttcgtgaatttctgggcgtgacaagttggtatcagagccgaccttgaccgtaggacaagccaactggaaaacctaagagccctctgaaccccttttcatatgcacatgcctttttcacttggatttgtttcgggaaactttggggtttgatcttttgattttgggagaaaatcttggtcgcctatttaatcggatctcttgactagggacagtccagggttttagcaaaactttatttggaatttatttggcagtcagtcgggaattgttaggtggaatgtattaagttgtgtctagattcgatgggatgcagtctttatgcgcatcattattatcatgcatttatttcatgcattaagttattgtttagtcagttgcattagtgtcttttgtctgggttcatgaaaaatgttccatgcataaaaatcatcatgcttggctagttgtttgggccatttgttgcgttgtttaaatttggatttgagcatgtattgattcctatcccttgtctaccttagaagtcagacctgttcttcgattgcaagcgccgctccgagcttccgagtcgtcgcccttagctttatcgtcttcttagtctgtttgcgtgctagtttttgtgtttaggtttgttgcttgtgggttagtcggcggtcgatatcatgtgtgagtggtatgacagccttaattaggaattgcgtgcctctttttcagagttttaatcaagattaagataattgcacttaattttataagaaagattagtttctgagccatctgttttcttcctttctcttatttctacctatcctcgtccagatgg

SEQ ID NO: 16873 - DNA, 1501 bp, Oryza sativa
atagaggccggcttggcgcgggaggcgcgaccgatggagggagaccggattagcgcgaggcgcgtccggtggaggaggccggcttggcgcagagtggcgcggccggcggtggaggaggcgacctaggtgtgaggaggagctgccggtgggtgtggtgcggtctttggcgaatgaagactggccggcgggggacaccggtgcaggggtcccacatgtcgacaaagcttgtgtggtggtggagcatcggtgcgtcacgcgtggattcgcaagtggtgagcgacgggtgaaaacccagtccggccttggtcggacagacaacgatggttatcccccctcctgagggcgttgtcgtgctgtctcacccctaaagggtgattgccgggcgaaagccctgtcttggctcttttgagtcctgacggatgacggcggcggtttctctgtcgcttctcttcttgaagacgtcgttttggcatcccctaggtggcgacctcgtctgtgtccctttgttggcctagtggcggtcggtcacgcttagcggcagccggtccggtgttagccttctcctggccttgtgtgatggcgatgtcgtcgtgtgggtggtggtatatttttttctttttcttggttacgatcctccagggtagtaacattataatttttttctgctctagaacttcgcaagacgtaaaaaaaaaaaggatgaactgctagatgctacaagccttgtgcagatatgcagactgtagtctgtagtgcgctgtgctctcgcatgcctgtgtgaaggcaaaactcgtccccagatgagagacgctctaacctcgaagcacgctttgccattgccaatgtcaagaagttcggttcatccgttcatgctggcaggaggctacgagcctgccgaaacaccgttccttgtcagaatcatgtctggttattgaccttgcaagaaattcagttggtatttgaatcttctgaagatggagatgaagataaaaattaagtgtttcacgtaaaaccaggtggtaataacgtgtaattaattgagttttaattattacaaacttgaaaaatggattaatcatatattttagaacaacttttatataaaaagttttcgcacgaaacgcaccgtttagcatattgaaaagcgtgccacgagtatccaaaatttcatccacccttttcatgagaaacgaacgctttaaaacagcgtttaatccctccatcgtaaaaaaactcaatttctagagtttaaattttatcccacaaaaactaacttctaccatcctacctatcctcagctaggggtggaaacgagccgagctgagcctggcttagctcgtgaaagcttggtgcaagggaagctcggctcggctcgtttatgggctgagctggctcgcgagcctggcatcgagtaaatctcaagcaaatctaagagaaatcgaacaacattttaccacatagaatgtgtaataatgtgataatttttctttaatatgtcatc

SEQ ID NO: 16874 - DNA, 1501 bp, Oryza sativa
ttgagccacgcaatttcattcagtttttgctttattgagttttgatccactgtcgagtcaagtgctggtttaagccctagattagtcttggatttagtttgcaagtgtgggttgcatgttgctctagagttgtttcagaaagtcgcgcagttccgccgccatagagaaagttgcgcagtagattgattagtaacagattggtttgagagctgaggttttgtttcattgagatttttttgggttgcatgtgtcagataattagggaaaatctgcttccttttgtttcttctttgattttctcgtgcaaccaagtgacgccgaaagaaaaaaaaatagaacagaatctgctgtcctacttgattgcgcatgcatgcatgcatgagtacttgtgtaatttccatcgtctcttcctgattccatgtgcatgcaaatctcggcctcctagtttgttgggtgtacacatgcatagaatttccttgtgcagattaattcctcggtgcacacacatgttatccaattcgattgatagctgccatttgtgaaatagaaaagtaaaaaaaaaagaaaaaaaagaaaaatagagaaaaggcagaaggtgcaaaaaaaaaagaaaaaaaagaagaagaaaaagagccgcaccaaaaaaaatcagaaaaaaaaagagaagaaaaaaaatcagaaaaaaaaagaaagggtggaatttttttttttaaattgtggatttcttggagagagttggttgacatagcgagttgttttggtccgagtgtgaacatttgcttgcttgagctaggattgagtctaggctaggccagcaattttgactaatactttggattattattcaatttcgcatatctgtttgatttttgctattccttgtgatatagttaagcctaccaagatccacatactactaacctttacaggtccggctttgcaatcgctccactcatcaagcgtgtcattgtgccacgaaccagccacggtgattgacctgatttgcattctttgagaacattataagaatttggtatatgcttgagtgttgagtgccttcaaaagctccatatatatatagattgttaggaactgacactttcttgtgagtttcttttgcttgctaacgatgtcaggtacaagttccgacgaaccaacactggagaatctagcacataaactgaagggcatggaaaattggtattaagagctgatgcgtaatagtaaatcatacaaggaaagcacagataaacatttaaaaactttaagtgaaagcctggtgaaagtagtggatcaaattgagcaaataaatcgatcacataaacaattaactgaaaacattcagaatataattattggacatgaaaatattgtgcgacgcattggtttacttgaggctgcaggtgaagaaggtgcaggtgccactgctcatcgacaccaaagatatgacgataaagacgaagagcaatctgttgctgatgatgaggaggaagatgagagt

SEQ ID NO: 16875 - DNA, 1501 bp, Oryza sativa
tacatgcaatacatcttatgctaatcaagccttgccgagctattcgagctcgagcttgctaggcttgcgagcctcagcctaggcttgagcttggcttgtctagtatttgagccgagctcgaatcaagcctgtaacgaatcaagctcgagcagcttgcgagcttcgagcttttttgatagccctacttgcaactattcgtgagacaacagacaatgtgttttatacagtttatgccccttagatgggtaatgactatatgtcctatttggccggagtcaagtgtttttcactatatcaattacatgagtacaaggtatgcaatggaaccctaatctagcctatgactatatcggcgagaatgatggtggtggtcggcaactagttgttgtcgagtttccattaatgtttactatggtggtggtggaattgccacacctactagttatgtgtagactagcgatatagtcagatcctagctataatgttgatgatagaaccaccacgtctactggtttatgtagacgatgaacatagtcgtaccctgaccactgttttgttgtttaggctgaaagttttatatgcatcccattgtttatccaacccttaaatcattatggaggtgtatcggtctatggtttgtttcaagcttttttttttctccaaaacatctttccaaccagactgcttgtaatgcacgtatatctctatgtttgttcaacggtatgcttggtattgtcgctatttgagatctctgcctatgtcatcatggtagatgttacaggcagtgcatcgggttctccgcttgatagcgaatcacctccttcgtccttgtcctgattcccgagtcgcttgaggccattcacaatgcgtcatgggccacgaacgaatttgtgatgccacataggaccaagctcctctaaagcaactcacctcacaatgcaactcccactcccacccacttttcatgggtcccactcccacacacttttcatctccccccctctctctctctccactatctcccccaccggcggaggatgggaggagcacccgaggctcacgtgctcgccgccgccgccgccgccgccgccgccgcgccccacctcttcgtccgccggtgcccctctccctccctccttccgcagagctcgcatgcgtggagcgggacggcacggagctcactagctccggcggtgcggagctcacggagctcaccggcgtggatctggcggagctcaccggggtggagcgggacggcgggagctcgtcctctccggcggcgcagagctcacggagctcaccggcgtggagctcggcggcgcggacggcgacgaggtcggcggcgtggagaggaggatggtgacgagcttggcggcgcggcgaggaggatggcgtcggcgccagcggagcggcggcggagcagcccagtccggcgctcgccgggtctagcctcgggcggcggctacggctcgtcgcatctcccctctcctcagctcgtcgg

SEQ ID NO: 16876 - DNA, 1501 bp, Oryza sativa
gattctcagttacgtatacttgcaagacttgacttcatgcatgctgaatcgaagttatcaagttgacctaacctaattgtttgagatcattaattatatagattataactgtaatatagtgagcacatggatggtctgctaggatcaataattggttagctagtagatggttccatggatgtcattgcaaacgtcaatgcatataggtcaagctaacataggaccaacagttatgcttcacttgtcaaaagagatattttcttttcctttcttcttttcttctttttccatgcgtgtgaaagagattttcaaagagaaggggatctatatgtctgtctaaacagaatttacctctttatgagaccggccagctgggttgctttagtaccctacagtttgttaaatgttaatcactatcttttctccctgtttaaattgcatacatgcatggtatatcatataacttttcttgaaagctagcaacttaattgcttgatagattgctagatatgcatgagtcagtcaactactcaaccacatgggtcctgtttctagatgatctagtaacggttgtcatgcatatgcaacaggataatggcactgtcaataacaaatactaacagtacaaagaatgtgatagatgatcggtatgtgcatgcagctgctaatgcaggagaaagtcaaaacggatgatgattagttcatgccatccaaaactagaggaattttgaaggatttaattcctgaggaaaaaaaactcatgttgtcctttggaacaaagaaataactccctcaaagtcttcaaaattcctatgtttacttttccgacagaaaagactcatatatttttcccatgtgccatccaaacgttagttttgaaactttttttgtctttaattcctatcgaatccaacggccatgacactttgttcccatattattattctgttcatgtatttacaatccaaccagagtcgtcttcaagtcctgttgtttttctctctgaacaataactttgtcatagctatgcaaatggcggattcacctcccggacagcactagcggctacccggctttgcgtgttcggccactggattcactgtggtaattaaagtccaccaattcaccgtctttcccggacaaaattagcaggttaaaattaattagatcttggtgtaaacggcgaggattgggcgttagccatcggtaatctgttgtggcttgcttgtttgccttcaaaatggacgtggaccactccaagtctccaaccatcggaatcaatggaatctcctagattaatgacaaaatcgtatatattttttcagcataaactggatcatgacttgatgattagcaaactgagcatatacacataggtttagtggcagtgtggcacggctttaattagacttatccaggttttctgaaagtcacagttgaataacttatgaaaaataacttcgtcatgacgttcttcccaagcatgtttctagattccttt

SEQ ID NO: 16877 - DNA, 1501 bp, Oryza sativa
ggctgaacagatctaactccaaaccaggagctaagcaaattattaccagttataacatctataattatggtgagaggtgtgggactaatcacgaaaaacattgctcaactcgcccataaccgcgggcacggctattcgaatagttttactctgatcagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcacccccttataaaacaaggcatggactccccagcgacccccgtgggcttatctccgccacttctcagtctggtgccccgcaatgaaccatgctatacaaaagataaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaatataaccataaatgatagtgaaacattagttatcccaaatgtgtgctaatgtttctaagcatggctaagcaatcatatctaatatctagttgaaccaatatatataaagctcaactagtccaattataatcacccaaggtatcaaggaataaagtaatcaagaacaaaagggccataacaaagaataggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcatatgaatttattatgaattttacaagattaaatctaattaaagcccatttaaaaagaattaaataaatttaattcaatttatggacaattttaatatgtagatctttattttatacaacttttgcaacttgaaccacattaaactgagttaagatgaattagatatgaatttttaaagattaaatcggattaaaacctttaaactgattttaattgaattatgacgcaataatgaattatttttgaaaaggaaaagaaggattattgcgtcagcggctagggtttcggtggaccgggcgcacgggcgacggctcacacgaacggacggccgagatctaaccgatccaagatggacggccgagatcgatcgggtccacggcggttcacggcggacggccttga

SEQ ID NO: 16878 - DNA, 1501 bp, Oryza sativa
tttttcagttgaaatcatttagtatttgaaaatgttgtttgaagttgtcatatttttaaattcaaattcaaactgttcaaaaaatgttatatagaaaaaaataccaaagtaaaagttatagatcttgatgagttatacaactttgttgttgatgatttttccatttgaaatcatttactacccaaaaaatatttgaatttcctatattttaaaatacaaattttatatagttcaatcaaacccagatggagaaatgaccaaaataaaaatggtagatctcaatgagttctacaactttgtttttgatagctttttcatatgagttcatttagtatcataaaatttaattcgaaatttattttttcctagaagtctgatttgcctcctactcatgataatacttgctaaatatatatttgatccaattaactcgatttgctagtgaaatatgtgatatgtgattgtggttgtgttatgtgaatgaatgtatatgaataggggatgctagggtgtgacatcctggcatagggcttaataagattaatagaatacccataccaacaaattcaatttctttctcggaagccaatcttcaaaaaactatgaggttaaacgtacttggtctagagcaattcccgatgggtgacctaccggaaaggcacacaagtgaggtttggatgggtgaccgaccaggaaggcaaacaaattttttttttgtggattatactcatctgtgacgggcaataatctaggcccgttagagatgagagtcattcgtgacgggctataatttaggcccgttagagatgagagtcatccgtgacgggcaataatctaggcccgttagagatgagagtcatcaatgacgtgctataacctaggcccgttagagatgagagtcatccgtgacgggcttttgtgttggcccgattgagatgtgtcatccgtgacggccggatgcccgattgagatattttctcacatcactgacctttgcttagtgacgggggccctgcccgaaagagatgatgctttaagcccgttagagatgaccaatcccgttctagtgacgtttggtgagaggttgtttggtaaatggtgaggaacagcactccaaagaaaacaaaaaaatgtgaagaaagcaaaagaattagcacgactgcctctcgaagaaattagattgacagaaacaaatggttagtacaacacaagccgaatggctgaaactgtatgctctaaaacacttcaatttcaataaaatggaaagaatgactataacatcaacagaactacatcctactacctcattacacagacaaattcaagtgaagttgcagcatgttgcaagatgtactgtcattcgctcagaataaggttagacgtttctatgctgctatctgtcatctcatcaaaatgaaggatcactgacggcgatcctccaaaattgtcatggacatcacgatcgttttcgccatcacaggttgcctgcatctggagcttc

SEQ ID NO: 16879 - DNA, 1396 bp, Oryza sativa
cacgccgccgccgccttcaccgccgcgcgcgcaaataccgccgccgccacgccacgccgccgggagccacgccacgccacgccaccgccgccacgccacgccgcgccgccacggccccacaacgccacgccgccgccacgccgccgcgccaaccgccgccccgatgccgccacaccgccgttatcgaacgagaacgagaacgatcgaacgaacgagagcgagaacgaacacgtcaacgtacgttgccgcgacaacgtgaacgagaacgagaacgatcgaacgaacgtgaacgagctagggaacgtgaacgagcgaacgaacgaggacgaacgttaacgtgaaatgcaatatatatatatatatatatatatatatatatatatatatatatatatatatatatatatatatacatgtatatatatatatacatgtgtatatatatatacatgtgtatatatatatatatacatgtatacatgtatatatatacatgtatacatgtatacatgtacatgtatatatatacatgtatacatgtgtatatatacatgtatacatgtgtatatatatatatatatatatatatatatatatatatatatgttacttcgcatttatcctaacacattttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttaacatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtt

SEQ ID NO: 16880 - DNA, 1501 bp, Oryza sativa
gcgccccagatggcctccatcctccccatcccgtactggaagtaggtgacgcggtcgccgcgccccaccgccgtgccgtcggggagcacgtcgtccgccgccgcatgcttcgagtcccacgccaccggcgggtacagccgcatcgtctcgcacagcgccgcgtggaggacgcgcatcctccggtagtcgtcgaggtcgagcccctcgccctcgccgtcgtctccgccttcttcccccgcgccgcgggcgcggcgcgtcgcggcgatctcgtcgagcacctgggcctcgacgccgcggtggcgcatgaggagccagaagaaccaggtgagcgccgacgaggtggtgtcgcggccggccatgatgaagctgatcaccatgtcgcggatcgcctcgtcggggtacccgcattcgatcatccgcgacagcaggtcgctcctcgcgccgccgccgccgccgacgccattgccgttgaccaggaggagcgcgcgctccttcctccggctccggatgagccccatcacggcctcatggatcaccccgacctcctccctcagccgccgctccgacccggcgtcgagcgcgcgcttcaccttccacacggcggccacgggcgccgcgcctcgccgggcgatgatccccgccgccgtgtcgaacgccgcggccagcctcggcgccggcaatgccgggtcgaggcatcccgggtcaacgccgagcgagacccggcagatgacgtcgaacgcgaaccgccggagcacgtcctgcatgtccaccaccccgcgcgggggagccccgcgagcgcgggaagaagcggttccgggccttggccttgaggcagggtgccttcaagttccggaagggcgcgcgcgaagaattggtggttaaaagcttgcgctgggcgtgccagagctcgccgtcgacgttgaagatgcccatgccgagcaggtcgccgagcacgtcggtgaacggcttccccttggggtagttggcgaacctcgcccggaggatgtgctcgacgttcgccgggttcgccgtcaccaccgtgcgccgcgcgcccagccggtcaacgacgatcgtctgcgacggcgacgccgccagcatctccgtgtaccagtccagcagccgccgccggttgcggtagaacgccaccaggcacccgatcaccgggtagctcctcggcccccacccgccatggccgcaagaagatccacaggacgatgaagctgacctactaagcctcatcgagctcaccatcaccaccacaaggaggcagctccaagccgcgacgaaccacgccatgaagcaaatcatgcttctcctctctctcgatccctctactactctaatatactatattactaataatgaaattaattttggtgttagaatttcgaagatgaggtagacgaagacgaaggcgaaggcgaagcatggggggagatggaggtatggactgttgggatgcatatatgcttgtgtgtttgtgtgtatatatatatgtgag

SEQ ID NO: 16881 - DNA, 482 bp, Oryza sativa
tcagaaccccagagtccgcacatcctcaaatacaaagcacttccctagttagatgtaggttacacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcacat

SEQ ID NO: 16882 - DNA, 1501 bp, Oryza sativa
gggccgctctgggccaccttcttgggccggccggcccgttaagctcggccgagccgccctttctctcgggccgcgccctagccgcccgagggaagtctatattccctccctctccccttttcttttcttttcttttccaaaaaaaaggatttaattaaatccttttcctttagaccaaaaatccaataatcttagaaattcaatatctttccaaccgtaaatccgtttgactccgttcaaattccaaaatttctcaaatctcgagatctatctaatggcacgcttagaggtcattaatagggctttattttcgccgtttgttgagttgtcccgttttgcgtgtagtttcggagcccgaagacccgcagtgcgaggatttcgaggatcaagctccagatctcgagcaaggcaagccacctttgaacattttgagcctatatttgaaatctaattatattgcttgcaaaatattatgcattgataggattgcacttaatctgttgttccgtctgcaaggcagattggcagacctacctaacttgttgcatttgatccttccattgttaattgctataccatgtccccttgtaaccatccagctacgcctcgatattcgtgcaccctgtgccagtatcgacggtcgccttcaaacttaaaatctgagtaacaacttgggtaaaactggagttttacaaaagacttggaaaacccgacacctgggtcggtgcttgcaaactaaatgaatttccaaaaccgcggaccggggaacgtaccgggtgtacggtttcccgctctcgcacttaaggaccaattccttggaatttcatccaaacataagacaagtacgaccacatgggtcgaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatggacggatgtgaggtgattcctagcgtagtttggtttgactactgcttgtgaaattgctgtgtgaaaaggggttcggtgtttgaaaaatctgtagctgatgggatcagctaggcccgggtggccgtttgaaaagttgttggcccgggtggccgtttgaaaagttgttggcccgggtggccgttgaaaaagctgttggccaggtgccaaccttgtttaaattctaaagactgatacattgcacatactccgaccggacgagacgcactgtctcatccgtgtcgtttgagaagcactcacttagttgtttc

SEQ ID NO: 16883 - DNA, 1501 bp, Oryza sativa
actcacgccatgaacataccatggcgagtttatttccagcaattatgagctcataaagtaattccaggccgcttggggagcctggcactcgccgtcgccgtcgccgtcactgtagctgtagccgtcgccattgccgtcgccgtcgccgtagccgtagctgccgacgtcactgtagccgccgacgccgccgtagttgaagacgttgacggtgtatatggggccggtgaagtggggcccagacggcggggccgtcgccgtctccatcgttgtcggctgcttgctgacactctgcttcttcttcttcagttagctgatgcaccaatggattacgcttctgacgccgacgaggagcagtgcggcaacggcgatcgtcgccaccatatacaacagcgattccacactcatcttgctgccgttggcctttgggttggtgttggagtcgacagatgcatgagtgtagatgccgccggcggcaatgatgagtgccaccgccggaggtggaagtggaggtggaggaggaggttgcagagccattgtgtgtagaaagtgaaagtctgtgtctcacattcgcatcgactattcatcatatagcctgatcgaggttgattccatggaatcattgggcttgttgtgaggtaatactagcattgtagtctgtcacgccccgaactagtcccgaccggaactagcccgtgacgctccaaattaacctgttaatcgataccagtcccaggaaacagtgctggtatcacagggagacagaatatcacagcaacagaggtctctttattatagagtagatgtacagtcatgttgggctgcggacagatcccgagctcacaactgcattacaaaaggaaagcggaagccaggacttggaccaatcaacacaggcgcgacttgggaactaggctgaaaccctaaaactcatcgtagccggcatgctcctggaagaactcctcatcagcaggatccgcttcatcttcttcagcaactgggggggattatttatatagagcaagggtgagtacgggagtactcagcaagccatgggaagtaagtgtttaatgcaggcttcaaggaaaggctggtgtttttgcaattaattttatttgaactcttttctgaaacaactaagtgagtgcttctcaaacgacacggatgagacagtgcgtctcgtccggtcggagtatgtgcaatgtatcagtctttagaatttaaacaaggttggcacctggccaacagctttttcaacggccacccgggccaacaacttttcaaacggccacccgggccaacaacttttcaaacggccacccgggcctagctgatcccatcagctacagatttttcaaacaccgaaccccttttcacacagcaatttcacaagcagtagtcaaaccaaactacgctaggaatcacctcacatccgtccatgaccgtgggcacggctgttcgaacagtttgttaacctctgcagagggggtacactttacccaca

SEQ ID NO: 16884 - DNA, 648 bp, Oryza sativa
gtcaaattattgtgacccgtgtgagatgcttttcatacttccatgatcaagatcgcacgcacactccacatacacacactatgctaaacttctacactggaagctagcatccctcatccattatttattttattcattatccacaaaataaatactccatgtcatttatgccttttcctccaaaaattctttcaaagaaaaaaacagagatagagagaggcatggctatgcaaaagaaggaaaaaaaaagtattgctcatacaagtatggagcattgataaaaaaaaagagaaaaaaatgaaaaaacaaatcttgctcatacaaagtatgggccatgattgaaaaaaaaagaaaagagatagccatgcactctcttaaatctccaaagagaaaaaattagaggaggaggtatatcaaaggagttgttatcttttattttcctttttccatccacaaaacttgctatacacatacacatacccatgcacatatcacacacatgcacattcttgatcagagagtatgacttggtatctccttgggtctggtattttggctttgcaatatatgtgatgcatgtatgccccgattgatccctaccgagccccacctatacaacctcttagaatagggacaattcggcaaaca

SEQ ID NO: 16885 - DNA, 1501 bp, Oryza sativa
cggcagcggcggcgacacggccacgacgtcgctgagccgcacgccgtcgggctccgggtgcgcgcggcacaccgggcacgtggagtgggcgcgcagccagaggtcgatgcagccgccgtggaagaagtgcctgcacgccggcagcacgcgcaccacgtcgccgtcggcgagctcctgcaggcacaccacgcactccaccaccaccgtcgtcgcccccttccccttgccgctgccgccgcccctcctcccgccgccgccgaccagcggcgacgccgccgccccgcgcgcccggtacgtgaacgtggggagcgcgtcgatgtcgtccgagctcagcccgagcagcgcggcgcgcggctcgccgccgccgccgccggcctgcagctggcgccactccgacatcaccgaccggccgtaccggatcgccatgtacaggatcacgccgacgaggacggcgatgatgatgtacagcagcgtgaagttggagctcgccgtccccggcacggccgagccgccatcgccaccaccggagctcggatcagacggcggcgaggacatggcggcgaccaagaacaccacccggtttcaaggacatggcaatggtaaacaaaagcaatatcgatcaatcaaaaccaaaccgaaccaaccattcgatcgatcgaggagaagagggtggttgtgcgagatcgatcgaggcatgcatgcttcgcgcatgatagggttttttcagttgggtcgctagctaagctaagctaagctgggcttggatgatctatcgagacatgatgagacgccacgccatggagtattagtatttgattggttagaaggattattatatttttttaggacatcgttttgtgataatttcgtgttggattgggttgctgggtagtggtattgtttaaataaatttcatctattagattatctggtcatgcttgaattcaaatcattcggtggtgattttgtgcattttgttagtcatggttgattggtgactttatcattgtgaaattgcgagttgcttgacatatgctggtgaatgcctggatagggatcaaatataaggctgcggtcaacttcgcaaccaacagatgcacgtatcattttgtaaaatatattttgggacaattaagacagtgacatcatcgagaactggaaatactaaaaacatttgcaattagaacatcctaggcactagaggagtaacgttgaaaataatcaaatatggacaatattccatataaaattttccagaaaagcataaatattctggcccactaccccaaccatgtctaggagcctaggataggacttaagataggatggcagcaacgaagcagagacagcaagattacgagtgcattagggcatccacaatgtacactgaaagtaaccttagacattaaatactgctacagtacaacgcatttagcattgtggagtcagaccacaagtccgatgcaaccaaagtacaccttaagcttaaggtgtagcaaca

SEQ ID NO: 16886 - DNA, 475 bp, Oryza sativa; identical to SEQ ID NO: 16713

SEQ ID NO: 16887 - DNA, 1501 bp, Oryza sativa
gattcccggtttcccgacgtgacgccctggttgccggcaagaactgcaaagaaagaaaagttgcatgtttgcagaaggatcggatgccatcgatcgatcaatccatcatcggaaactgatgaggtccaagaaaaggatccgagtacattgctgctttagtgcttttagtttgtctctgcacattctcaaaaaaaagatttttctttgcagtggttagtggttgggattatttattggtgttgtcttgttggcagggttgcttttgttcctttctttttcttttcttttttttttcttttgtcctctgatcatctaactctcactgtcaaccatccatgatatgggatgattggattcacgcgctttattgctggagatggcacagtacgtatctgcgcttctagtgaaatacagtagtataccatcacaatgaaaaggaagaattctagtgcaatctttttgtgttttgtttctcttgtatctttttttttgtcagttagcagcggctgcacattgtgaaactcttgttttgcttcccttgatgaatcctgctactgccagcgtgaggctgacaacggctggagatgagcagtacagcacggcacgatctgtgcagtgcagtgcagcagcaactccgggcttcagaaactggcatcactctgtgctagcttttctcgtctcatctggattggaattttctcttctctttaatcaaagtgttctccatttggttcaagacataacgatctctatgtataattcgatacatgttcgaagtgttgatgggctattcgcctattccgttcttcgttattttccttcactacttactctagtctgtgcgtgtatatgtatttcatttgtagtagttcagtcgatcatgggggatggattctaatagctcgagtggatgtccacccgtttattgcatgtcaattagatgattacgaaaaattttcaaaaaaattaacaagatagatcaatatgtaatatatcactccacaaacatgcaaattaaaattcaacttctacaagttgtaacaaaactaacaaatttaactgtaaatatacatatagtaatttgagttttatttgttatttttgttacaatctgtagaagttgaattttaacttgcatgtttgtggattgatacattagatattgatctatcttattcatatttttttaatttttttcataaccatttagatgacatgcaataaacgggtagacatccactcgagctgttaaaatagtttcccgtcgatcatgttctaatgtttttccttgtctaatactttgttggcacttacgtcggatcatcagttgggaattcttgaagataccaaaatgtacttgttcctactgactgagtaattaaggacgtccatcctacgatctacggccttgtttggcagttctgcttggtttgaaagtagctgatgaacatgccaagatcagactattccgatgatggagaagacgacgtcttcttcgacg

SEQ ID NO: 16888 - DNA, 491 bp, Oryza sativa; identical to SEQ ID NO: 16611

SEQ ID NO: 16889 - DNA, 1501 bp, Oryza sativa
agacagtgtcaactgaggtgacaccctcctcggcctaacgggcctccagagcggtgtagcggcgggcaagggagcggtaagcctcaaggagtaggtcgtgctgagtggcctgagcctccgaaagctcaaccatgcgagtcagcactggctgagactcgctgtacggacaagggtacctagcatctgcgtggccagaaggaaggcgtggaaactgccggaaggcagagcccccgagacggtggctgtagtcgtgggccaagcgacgtagcgcagtccaggagaggtcctggtacacgatctggagggtgggcctggccacagtgaagtggtgtgggcaaaggccagctccgtgtatacctccacgaggataaaggtacacagagagctcacagcgagggggaacacggtccacggagtaccccgtgtactcgggacacgagaagccaaggaagcgggcgaggtcacgaagctgagcgacgtggtgaccctcaccaaaaccgtgggaactgaagctggcgttcactgccatctacaattttgaaagagggagagaagatcagtaaccattttagcaacaaactattgaaaataaggaaaccaaaagaagccttagcttttcgcaagtagttttgaacttagtatccttagggtcgtcctaaacgttgggtttcgccctagggccaagcctgtgctctgataccatctcttgtcacgccccgaactagtcccgagcggaactagcccgtgacgctccaaattaacctgttaaccgataccagtcccaggaaacagtgctggtatcacaggaagacggaatatcacagcaacagaggtctctttattatagagtaggagtacagtcatgttgggctgcggacagatctcgagctcacaactgcattacaaaagggaagcggaagccaagacttggaccaaacatcacaggcgcgacttgggaactaggccgaaaccctaaaactcatcgtagccggtttgctcctggaagaactcctcgtcagcgggatccgcttcatcttcttcagcaactggggggggattatttatatagagcaagggtgagtacaggagtactcagcaagccatgggaaataagtgtttaatgcaagcttcaaagaaagaccgttgtttttgcgattgattttatttaaactcttttctgaaacaactaagggagtgcttctcaaacgacacggatgagacagtgcgtctcgtccggtcggagtatgtgcaatgattcaatcttttgaattgatcaagattggcacccggccaacagctttcaaacggccacccaggcctggctgatcccatcagccgcagattttccaaacatcaaacccattccacaacagcaaatttcacaaggcagtagtcaaacaaaaactacgctaggaatcacctcacatccgcccatgaccgtgggcacggctattcgaacagttttaataacctctgcagaggggggtacactttacccaca

SEQ ID NO: 16890 - DNA, 1501 bp, Oryza sativa
actgttcgaatagccgtgcccacggtcatgggcggatgtgaggtgattcctagcgtagtttttgtttgactactgccttgtgaaatttgctgttgtggaatgggtttgatgtttggaaaatctgcggctgatgggatcagccaggcctgggtggccgtttgaaagctgttggccgggtgccaatcttgatcaattcaaaagattgaatcattgcacatactccgaccggacgagacgcactgtctcatccgtgtcgtttgagaagcactcccttagttgtttcagaaaagagtttaaataaaatcaatcgcaaaaacaacggtctttctttgaagcttgcattaaacacttatttcccatggcttgctgagtactcctgtactcacccttgctctatataaataatccccccccagttgctgaagaagatgaagcggatcccgctgacgaggagttcttccaggagcaaaccggctacgatgagttttagggtttcggcctagttcccaagtcgcgcctgtgatgtttggtccaagtcttggcttccgcttcccttttgtaatgcagttgtgagctcgagatctgtccgcagcccaacatgactgtactcctactctataataaagagacctctgttgctgtgatattccgtcttcctgtgataccagcactgtttcctgggactggtatcggttaacaggttaatttggagcgtcacgggctagttccgctcgggactagttcggggcgtgacaagagatggtatcagagcacaggcttggccctagggcgaaacccaacgtttaggacgaccctaaggatactaagttcaaaactacttgcgaaaagctaaggcttcttttggtttccttattttcaatagtttgttgctaaaatggttactgatcttctctccctctttcaaaattgtagatggcagtgaacgccagcttcagttcccacggttttggtgagggtcaccacgtcgctcagcttcgtgacctcgcccgcttccttggcttctcgtgtcccgagtacacggggtactccgtggaccgtgttccccctcgctgtgagctctctgtgtacctttatcctcgtggaggtatacacggagctggcctttgcccacaccacttcactgtggccaggcccaccctccagatcgtgtaccaggacctctcctggactgcgctacgtcgcttggcccacgactacagccaccgtctcgggggctctgccttccggcagtttccacgccttccttctggccacgcagatgctaggtacccttgtccgtacagcgagtctcagccagtgctgactcgcatggttgagctttcggaggctcaggccactcagcacgacctactccttgaggcttaccgctcccttgcccgccgctacaccgctctggaggcccgttaggccgaggagggtgtcacctcagttgacactgtctcttgggactcaggctgcctctgccacgccagccacttgt

SEQ ID NO: 16891 - DNA, 1478 bp, Oryza sativa
tagcatgtgtagccccccagtagctagccggcgccgccctgactgctgccgtcgctcgccgtgtgctcgccgccgtcaccgcccgagctcggaagcgcctctcgtcgccggcctccctcgatgcgattcctcctaatccggcgcaaggggtggattcccgtagccgcgtagatgctctcaccgccgagaatcggcccctcgtgacctcgtcgccgtttcccccttttctctccaccggttgccgccgccgcaatccgccgccgtcgagcatcccccggcgaatccgagccattggctcgtctccccttgtcctgcgcaacatcccggtgtgctcgccttcgcctgtatcgccatggtttgctccgccgcttgccgctgtcgaccgccgtccgttccagccggcgtcgtcgtctacctcccgccggcccgcgtggcagccacgtaggcgccacgtcggcgccacctcagccgcgaccgggtcaagtagaccccggtccgccgcttccctccgcaccgcgtcctccgcgaaccgcgcgcatgcgccgcgcctccctccccaaaccctagcacgccccgcgtgcacctcgctcacggtgagccgagtcgtcgacaagcgggtcccacccgggaccacgcgggatggacccgacccactggctctctctctcccctccccgcccgagccgccccattctctcgggccgcgccctcaaatctcgagatgtatctaatggcacgcttagaggtcaataataaggctttattttcgccatttgctgagttgtcccgtttcgcgtgtagtttcggagcccgaagacccgcagtgcgaggatttcgaggatcaagctcaagatctcgagcgaggcaagccacctttgaacatcttgagcctatatttgaacttaattatattgcttgaaaaatattatgcattgataggatcgcacttaatctgcttgtcccgtctgcaaggcagattggcggacctacctaatttgttgcatttgacccttccattgtaattattataccatgttcccttgtatccacctagttgcgcctcggtaatcgtgcactcggcacgggtatcgacggtcgccttcaaacttaaaatctgagaaacttcttgtgtaaaacttgggttttacaaaagacttggaaaacccgacacctgggtcggtgcttgcgaactaaatgaatttccaaaatcgcggaccgaggaacgtaccgggtgtacggtttcccgctcttgcacttaaggaccgtttccttggaatttcatccgaacataagacaagtacgaccacatgggtggaatgggacacccctggctgagtaactagcttatcgggggagccatgatgccaagagacatgtggattcgccggggtggtgtcggggaggacctctgggcttcctggcacagtatggtctgggacctaatctggtgttggtctaggacccctctcgttggcata

SEQ ID NO: 16892 - DNA, 1501 bp, Oryza sativa
ggcgccgcctccgtcatcatcatcgctgcggcgtgttccacgccgtcctcgtccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcgttcgtcaagcgagccgctgcagccccgtcctcgtcttcgtccacggctccgcgtcgtcaagcctcgtgccggccgcgtctcgccttcgtcctaggatcgccgccgaagtcgtcccctcgccgttcgtctccgtagttcccggccgcctccgccgcgcccgttcgtcgttgtcgttccctcgcctcgtcgagtggtggtaaggtctcccctctcgctgccccgtccttgttcttccggtgtcgccccgtaccagttgtgcggtcgtcgaccccggtacccgtgtaccggtgtcggtagtcgttcacgcgtgcgggtggtgaccgtgtagtgtccgtgttagtgtgcccgctcggtagccgcgtggtttccacgtgtgcaggccgtgtgttgtttaatggagtccgtttgtcggccactcgcctcggttgacacacggggtctgcttccgtcgacccggggaccgcctctgtgtactcggtctaccgcggtcctttaggttgacatgtggggtccgcatgtcaacggcgcagccttcctgtcttttccaggctagcgcttacacatgttttatagttgcaaagcttaattataataatccgcaaatccccatataacagcattaaacttcggatgatcatatcttggtcatacgaactccgaatcgatccgttcaagtctcttaatgtttgttataacctaaagaaccctgtgctttgtttttatgtattgttattgcttctttataggcttgtagctttgcttgtgtgcttcgcgtagctttcatcgttccggaggttcccaaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttatgaccttattattgttgctattgttattattaccttgttcaccctaggaaaataaaaccccaactagtgggtactctatttatggttccactagtatgaacttaggtagatgcttcgctggataattaggcaacattaggtggttttataactttagactttgggaaatctcatatcatttggatactatggaatggttggcttatggtggaattggacatacccctctcttcctctttcaaagcccctaaaacctgtttttcggtggggtttgggtgcatgccagttgtgggaagtagcaccccggccactataaggattaa

SEQ ID NO: 16893 - DNA, 1501 bp, Oryza sativa
tgtaaggccttacagctttggggagataatgtttataatcctccaaggaggcatatatatttctcttatgcagttttgatcaatgcacttactttggaacctcaaccatatgctaagcatggaatctaataagaatataggaataattcctcatgttgccaccggataagatataatgagcagtgtttcatatgataagatataatgatctccaaatcaaccgagcagcaacaaaatctactaacagagcagtgtatcctatgataggattatcagtagctatacatgcatttgaacaagcaagcgctgagacatagtggagcgcaagctaggaacaaaagtcagaagtcagaacccatcggtcaccgaagaagtactggtctgcatgccctctgcaatcaataattgttcattacttttgttcctaaaaaaaacatagtgggataatggaatttaacatcccagcctttacaagctacagccaattattacattatatcaatccagaaaagaacgtagttcagctaaataggacaccaaacaaaaaacagaggaaactaagccaaaataaggagaacacatttattttaatctatttgtaaacctccatccataattggcaaataattgcataaccatcgacttcaacttgcggcatgcaacccttagaaactccccatcatcctcaccccttggtagctgtgcccaaaaccggagccagtgcgttgccctgaaaattacctgcatatatgaaatagatgatgatttattaaaaaccaaatcatttctactcagtgaagatcaacaaacggatgaagaaaccatcgtgccatttcagttttagtccccccttcctcaggttagtaccagcggctaatgctgacacctcgatcttgtagagtagtagtttacatctgccattctatccagtgacgatgcacgcgagcctaaaatgctcaagcataagaagattgccggccaaaaaataaaaacaaaaatctgatacaaaacctcaggctctgcttaggcggtcagctgcattgacacaaaacgtttccatcagataacatgaaaaaacgaaacctaaatgaaacggcagtaaatgaagatttggttagcatgcacgaaacttgagataaacattacaagtagcaacctctatccccccaccctctcaaagcgaagcaattattgtaatattaaaaaatatttagatgtgtaaaagcatgttcattcgggtaaacaggtactccctccgtccaaaaaaaaactcaatcctgggtttggacctggacgcatgtgtgtccaggttcaaaacccaggattgggttttttttgggacggagagagtatgtcgcaagtggatggacaggtagccaatatcatcctccagtatcccaataaacttcagttatggttcctccattgctgaaaatagataaagagaatatctactactccctccgtttcacaatgtaagactttttagcattgcccacat

SEQ ID NO: 16894 - DNA, 1501 bp, Oryza sativa
gacaattgtcatttggttcagttttgtcaatgccgggttttcgccagttttcctttaattaactgtgcagttgtaaggtttttgggtccggttttccttataaactggatcaactctctttttctatagtaaattgcaggagctccctgcctgtcccctcgaaaaaaaatatacgaagttttaggaataatgcacacatttattaagtttacgaactaaatttatacccacagttagtataccaaaaaataaattacaagatgccaactccgattattgtagttgttagggatcactagtttggagaacatgcatgtggttgccatggagcaggtcgaaatgacaaaatgtatggcacaaatggaagtatccaaatccagcacatatatagaggtaggtagtaggagagtgtaagagatggagatgtattagttcacgaagcgtgaaggtgaaccgtggacctaataatgtaattataattatgttagggttagtagactgaccataattaatccttagcataatttatggcgaccaaatcggttatcacggccttcagtgagctgccttgactgtagcagtgcagtgcagcctgcgaatgctttcacaagtcatccctgattgacaaccggccagaatgatatagcattcacgttttttttagacgatgcattcttcaatcctcaccctgatatgattgaccatcagattatcagaatgacgcactttgcttttgtttaaggagttgaaaagaaaagaaacgacacctgattgatcatcagaaagtctacaaaatgatgcatcttgttttagagattaaaaaaaaaacaagagaaagagatgaaaacgaacgcctggttgatcaacagactgatccatttcgtttatgagtaaaaagaaaccccccaaaaaaacatggttgatcatcggactgatgcattttgtttttgatggtgagaaggttgatcaacagactgatccatttcgtttatgagtaaaaagaaacccccccaaaaaaaacatggttgatcatcagactgatgcattttgtttttgatgatgagagaagtaaaaaagacagagtgaaaagaataaaaaacaaatgcgcatccggggaatcgaaccccggtcagtaccgtgggagggtactatgataccactacaccagatgcgctttctgtcaactgatcattttctaaactaattgttctcacttaactctaccctactctataaaacagcatcaggacaacaacctgcctggaattcctcagccagtaaccaccatacaaaatctggagcaaagcttcggctgtgtttagatccaaacttcagtccttttccatcacatcaacatgtcatacacacacaacttttcagtcacatcatctttaatttcaaccaaaatccaaactttcccctcaactaaacacagccttcagcaacaagctaagcagccaccagaattacacgagcagcagcagaagcaacaccaaattta

SEQ ID NO: 16895 - DNA, 385 bp, Oryza sativa
tgttccttaacaccgtccccaccttcatagcagcctctcccgcccgctaccgccaccgctcccgcccgttaccgccaccgctccctaccgccatccccaccgaagagaaaggccgagggagagagagagataagggagggagagggaggaaggaggaagaagggaaggagagggaggatgacatgtgggtcccacaagtcagttggtcccgcaatgctttatttgtgtgaatgacatgtaggtcccacatattcctttttattttttgttcttattctaatgccacgtaagcgtcacgtgggacaaagactcggtcaagaccgccacgtcggcgccatgtcctccaaaaccacacagggtcattttttgcatcggttttgatagt

SEQ ID NO: 16896 - DNA, 654 bp, Oryza sativa
attcctgcagccctttggattttcgagcacgatgtgtacgtttgtatgaagtgtgttttttaccacttgtgttttttatttttccaaacaccaaaacatttttgacgggtttgcccatgtgttcatcaaggaggagattgtaaaatcaaaggtgtttttgattattattctgtgatgaacaattgggcattggagatcattggttttgttatttggaatttattcacgaagtggttttggagatgattggattcacaggtgatcgtaggattctatcattttatgtgaccggtcaaaccgggctgtgtatgcctgtcagaccggcggtgatcgagcggtcggatcggccagcccacggtctgaccggccgacgctgtgtcggtttcggtttcgggttgtttatttggatatccgtgattatttcatgattatgacttctagatggatactatacgtatgtaatactgttgtttgctactaatgagtcaaattggatatagcttggtctcggaatatggtttctttatttatttcatgtgtaggtgactcgatgtctcgggagagtatttgcggtgatggaccgggagtcggcttgcggataagacgacgtccgtagtggtcagagatcatgcgggatacttaggctagagttga

SEQ ID NO: 16897 - DNA, 492 bp, Oryza sativa
tacccatgaattcagaaccccagagtccgcacatcctcaaatacaaagcacttccctagttagatgtaggttagacttgccgtgtcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcag

SEQ ID NO: 16898 - DNA, 479 bp, Oryza sativa
attcagaaccctagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatcttt

SEQ ID NO: 16899 - DNA, 1501 bp, Oryza sativa
gttcggggcacctcgtgttcagggcgccgacactcagtgcgtcgttgtagcagcgctgacgcttggcgatggcgccggtgttgaggattttgtggcgcgcgaccggcgaagacgccgctggtggctgcggcggcgaacacggggccattccggagcagtagcagctggaccaggcgccgcccaccgccatctccttcaccgatgctcccagcgtcgccggcgaagaggacctggtgctggccatggaggcggcctgatttcgttatcggtgttcaacagcttctacttcacctccattaatcctccatgatcgagtagcaagcttctggtgcagtggtgcttatgcagcttgcttgctggacgtgggcgacaacagcaggagaagaaatgctacttctttgtacagcttcgtgaattcagattgagattgtgaataaacttacgactgattattgcgttattttttttcatgtgaattgagtatggcaattcagaaaagtgtaatgctttaactgatgcttgaagtgtataagttaaacatttgggagttccaataaaagttaataacaaaataagcatccacacaaggatctttctagcatagtggttaagcttctgttaagtaattgctcgtggtgtgggttcgattccaggtgcagcatttatttttttggacaaatttgatagccaccagtgacatggatagccacgtatgcgtggtggggccagtgggggctagtgccacatatgcgtggtggggcagtgggactatggcgcgtgtagtggccactggtgggaccggggctagtgccacatatgcgcgatgggaccaacatatgcatatatgcggtgggaccagtggagacagtgtcacgtatgcgcagtgggaccaacaagtattaacaaatgaacggtgtgcatcatttgtgacgaaattttccattgttccttgacgctatttttaatttcgtcagagttttggaacctacccctgccacgactcacccatgacgaaataggaaatttcgtcatagatatgccctatttaatgacgaaattatacaacatcatgagaaaaacgtcatagatgggcgatttcctactagtgatcgctttgatctcttggatcgctctggtttggttgatatatttgcctacctgatatctcaattctatctctaattgcattgtgtttagagacgcatcggtttagttgggactgtctcggttaggtctaatctcctgtcttagccgatatatctctacaatcataatgttgttctaaatagatttgttatatccatcacattagacagatctattggctcatcgagtattagattatcatatacaatcttgtgctgcatcggttaggttcgacctattagattgttattgataatataagtcttgttaaaccaataggttcatgctaatgttttatcgggtgctagccgataagttatctggacgttgcatcggcttgtaaggattgcatata

SEQ ID NO: 16900 - DNA, 1501 bp, Oryza sativa
actttgcttaattctataattactagatttttctgggatttatttgagctaaggaagtgtttttaataaatggaattgcatttcatgaataatttaaattgaaaaaggttttttttttttggctttgggccgaaagccggcccaaaaccctccctctctctatctctctccctcctcggcccagtccggcccagtccgccgagccgccactcttctctctcagccgctgacaggtggggcccgtctgtcaggcctgtcttcctcctcgcgccgccgccgccgcccgaaaccctagcgcaagcgccgccgtctccttccaaatccggccgttcctttccgtttctggtgaaattgattgaggggaaacgatctccgggatctcctccaccttttcccctttggaaacatcggctaaatcggtttggaatgtgtttgattcgagttcgaatcggatcggtctctttccttcaaaccccgatctttccttctcgtcgccggcagccgtgggccttcaccgttgcctcttagcccctttataaggatccccggtgtctcctctacccgccgccaccctcgcctttgcctctcgtcgtccgtagcgccctagctccgtgtgccctagcgccgccgtcgccgccgtcgctccagccgtgcgccgccgccgttccagacgtcgccgtcgctcgggaagatcgccatcgtggtcgccgtcgcgtcgccgtcctcgtccaccgcttcaccgccgccgaagaccgtcggagcaccgtcgccgccgtcgacccgatcttctccgccaccttttcctcgacgccgccgccgtccgttggtcttccgccgacgttttggtcatcggtgagttcgccgcgccgtgatctacgtcttggtgccctccgtttgtgccgtagagccgccgttcgccggcgagcatacgcgcccgagccgcccgagtcgccgccggtgctgacgtcatcgctgacgttgtcgctgacgtcatcgggaccgtccgccgtgagccggtcgtggaccgatcgatctcggccgtccgttttggatagggttgatctcggccgttcgttcccatgaaccgttgccgtgcacccggtccaccgcgaaaccctagctgctgacgcaataatcctccttttccttttcaaaaataattcattattgcgtcataattcaattaaaatccatataagtgttttaatccgatttaatctttaaaaattcataactaattcatttgaactcagtttaatgtggttcaagttgcaaaaattatataaaataaagatctacatattaaaattgtccataaatagaattaaatttatttaattctttttaaatgggctttaattagatttaatcttgtaaaattcataataaattcttatgaagtcagaatgaggccgttcaagtctcataattcatctaaaattatgatctacatgtttgtttactttatatgtactgtttatttggtttttattagtctttt

SEQ ID NO: 16901 - DNA, 1501 bp, Oryza sativa
ttattattaatttttagaagtcccgtcaaacgatgcaactatactcctctacggcccgtcaaatttcggattttttaattaatctactattgggttcttatatttactcttatcaatattgcttatatttaattccaaatttaagttaattttaaattgtatttgtcgacgtttgatgtcacgactacggtatttgcatagtatggggatcgttggtaccaggatatatgcgagacttaggtaaaagagatggggacgaggatttttatataggttcgggcccctgaattgtcaggtaataaccctactcctgttggccgaagccggtcgttgctcttattcaccaaaatcgcaccagtacaatatttggggtagcctatataactgttgtcgacttggcggtctgaagtgctgactcgtagtcgacaacagagtagccttcctcctcgaatctgcatccggcgagatcaaagacatcgttatgtctctcctgatagtatccgtagacaccgtaggggactagctatgcttatctctgaagtcgatatccggcgtcttgtcttggcgcatgttggcttgtatgttgatcttgtgtcttgatctattgttctgtgtcccctctccttctaggggaccttgtatttatacccataggtgtccctttgtctaagtagaactagggaaaccaatatagatacaatccgagtagtccttgtcgttttcatgtagaactctattcatccttccttatacggaactcctcctatatccgaaggttttttccgtataagacatggtatgtggtgggccctgccaagatttagtcaactactattaggtatgtggtatcaataaccctgacagtattcctacttgaactcttcttttcttttctttcttctaatttcggtgttttttatttttttattcggaaatttaattaatcttgtattggattcctgtatggacttttttaattctgaatttaagatatttttaaattgtattccttctcgaactcttgtttttttttctttttctaatttcaaaatttattttatttttattccgagttttaattaatcatgtattgggttgctatatggactcctctttcaataatgcatatttttaattccgaatgttagctatttttatatttgtatttctatttggattcttcttttctttttctatgattaatgtgggaatttttagcctccacagcgaacgtggtgcctcctttcaaggctgttttaataatataatagatctcagtccactgccattagctgtcggatcaacctcgcgcatgtaaggggggctaacgagccgattcggcttagctcggctcgtgaaaactagtctatctatctattatatactagaaatccattaaacttcctacaaataatcctaaaccgccatatgacactcctacaaacgctcctaacttaccacatggtactttaataaatactagaaatctattaacttaata

SEQ ID NO: 16902 - DNA, 1501 bp, Oryza sativa
cattagaggttggtatagagatagtgacagcccacaagagcaccacagtcctcccagtccgggtacggagtagagcgcgttctggtagcagtgagcaagttagcgcctgaagttttgctataggattaaaccaagctttctatagacattgtttatcgctaggaaatcctctctatcatttgcctatctttgcttcgtgcccttggatgaacctagagaatagctgagcacacacgttcctcatggaaattgataccttggaatactcccgagtgaagtgttatatcggcatatccgtgcgcttgcagattttatctgtgaccgtaagaaataccaataagcatttatagtgccgttgccggggaacaattgctattctcctccgtaccttgttcatcctcatatctttgatttttcttcttcctctacccctgctatccgttgaaattacctaaaatacaactctcgaccctggagcaacctatcttcaaattgttagctcctacaggaaaattctatgaaccacctccttcattgaagccaatttttataaccgactacgaaattcgccccgaattaataagtatggttagggagaaatccttttttaggtttcgaccaagaaaatccctaccatcacctatgcatgtgtttggtttagggacaaggtgggatgggttggatccatccctgtttttgggaatgggatgatcccattttctgtttggttgaagggatggaacgaatcctattttttgtttggtttgaaggatatgatgggttggaatgatcctatgccttgtttggatggagggatgaaggtgggatgcctggagtgtacacattgtaaaataacatttagacatgaaaattacactatttgaaaattaaataccgttaatatcgctacatttttagtcagtatacatcaattcttgtatcaatccattcatagaaaataacacatggccatcatctactgtcaagaaattcacctaaaaaaataacacatttttgaactaattatactgctgttggttcaattgctactaactaattgacttcatccatacttactcataatactatgatagcgatcaagcgcttcggagatgagaattgacaaatatcagtctctctgatcaataccaattattggatagagaaatttacagaaggatagcagagtagcgaccggcaagagaagaggcatcaccagctccctgctcatgcgctcccaccgccgccttgcccctgtttgcaccgcagctcgcccttgctcatgcgctcccgccaccgtttcatccctgctcgcgccgccggctcgcccctgctcccgtcgccgcctcgcgcgctggccgccgattcgcccctgctcccgccgctaaccctagaacgtagtcgtgaggaggagctgaaaagagcgaagggaaaaaaaaagggatgcggtgaaacccgggatgggccatgagggttaccgcgcctcacacgcatgtggagg

SEQ ID NO: 16903 - DNA, 1501 bp, Oryza sativa
cgtcaacggggtcgacggtggtgacgaagacgtcgacgccggggagctcgtcggagtgccggtcagcgagggcggcgaggtccgggaagcgcttgatggggctcagtttggggagctggttgagcacccaggagaagccgaaccagacgtcgccggccatggacattgtccacagccacgcgccgtcgcggttcttgtgacgtatgcgccacgcgaattagaaggctacgatggcgatcagtcgcgccaggatcaagatcctgtaaggatgaaggacgatgcccttgaccttgtacgtccggaacagcggcggccggccgccgctggcccctgacacgtccgcttcgtcgacggccacccaaacgtcgccgccgacgtcgtcgttcacccgtttggccgcgggcgaccggcgctcgttctgcccgtcggctctggccgcggtatcgccgttggtggcgtccacgcggagagcagcgttattccggcgagtcacggccgccgccgaggaaatcgtggatgccgcggtggccgccatgcacgcaacacaccttcgttagctcctccttgtccgtggcgaactgttgcacgccgagccggcttttatatagcgcggctaacgacatgagtcatgtcgtctcggtcaaagtactactactctgctactccctttgtctcataaataaaatttttaaccatattttaggacaataaatctctatccagatttactatcgtagaatatatcacatcacttaaaaatctattatattatgagatggatagagtccactcttattataaaattataacccactaattactaaaacttaacatgcaaagatgccatatcatcatccactgaccattattacatttaagcatcatgcaaccatgctatgttatctataatttaataatttattaaattttagaaatttgaaattaagcatgttaaatcatcctacattattcacataatatttcaatatatatctccatcattttttttataatatcctactccctccgtcccaaaaacatcaaactctaaggatgaatgtgggcacatatgtgtccagattcatccctagagtttgattcttttggggacagaggagtatatagctatatagttcatcctcacttaattcttgttatttttcttttctcccattaagtcatatcacattaattgtgattttagtccttagatgattaatctatggttcaaattctctctcatcttttcttctcttattaacccatgtcatctcaatttttttagctcttacatgtatagtttaaattatcttccttcttttgttctctcataaagacatatcatcttattttttatatttgaataatcattttacatactatttgaatttaaatcacatgtaaatttatgttcgtgtaagcttacgttatttaaactatcataaacattatttttatctattgttatcatagtaaattcgtgcaacaacacgcggggttt

SEQ ID NO: 16904 - DNA, 1501 bp, Oryza sativa; identical to SEQ ID NO: 16903

SEQ ID NO: 16905 - DNA, 1501 bp, Oryza sativa
ttttcctgacatgcgaatggggttaggttgtctaataagcactctgatgctgtacgtcataagcactttaactctccaagtggttacatatcatgcatgcacaactgaaagatgaatgatatgcaagttaagtttttttataactgcacgcgcgtggagagacatagcaaaggagccattgcagcctccatttagagaaagttcctgaatgtcatttttcacttttgttccaggatgaaacgatgagaatcggaatgtcgttgtatctatctataggtttgtactaatatatataaaaagaagtagttatattatttgctacatccacctagctagtagaaaatacacataaattcacttttcattccacagtcattcgatcttcacatcaaatgactcaaattacccaaatgcgtttgtgcccataaaaaccaatcactatgccaaatcagcccatctgtgatggcctacctgtgacggaccaaaatgcactattacaaaacatcaaataggtgtcaccattataggtgccggaacagctaaaaccggtacttataatgcttttcccaccaaaaaagcgcatccacaggacaccattggctagaaccggcacctttgtgaagagataggtgtcggttctaaataaaaatcgacaacttctagattagtatcggttttttttggaagaaccgacacccatatttatattataggtaaccgacacctatttagagaacccggcggagccaactgagccaagctgactgacaccttttaaatacctggcttctctctctcctttggcattcagccttatcctcagcctctcttcccttatcctctcacccccttctctccgcatcctcccctctctcagctctctctctctctctcacgctccctctctctccaccacacagcggcggctcggcggtggaaggggatgcggcggcggcggctcggtggcgggaggggaggcggtggcggcggcacggcagcccgggaggtggcggtggaaagggatgcagtggcgacggctcggcggctgaaggggatgtggcggcggtgactcggtggcccgggaggtggcggcggcgccctcccctccaccagatctggcgggaggggaggtggcggcggaaggggatgcggcagcggtgggaggggaggaggcggcggtggtccgatagcccggaagatgttttgacttgtgattatttgttgatgtgatgatttgatgatgtgatgatttgtgatttgtcatttgtcatttgtcatttgtcatttgtcatttgtgggatcggcttgacggctcgatgcatcgagctgatttttttttttggctcatgtgcgcttcaaaggtgccggttttgaaaccggcacctttaatcttccattatctgtgccgcctccatggtgccggatgggaaaaccggcacctaagggggtttcctaactggcaccgacttgggattctgtagtagtagtgatgtctcatcat

SEQ ID NO: 16906 - DNA, 470 bp, Oryza sativa
cccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatcttt

SEQ ID NO: 16907 - DNA, 1501 bp, Oryza sativa
accgtacaagacattgtgttgcgcctttgcgatcgatacacctctccgtgggttgttgatcttgccggtgcagatcaaccttattcctgcaagcaaatcgaagaaacaagcaagaacatgataaaagcgatctaaattgcaaataggaatgaatacacacgataagttggggtttcaaatacaagcagacggacggtctagccgacacgcgcgctgcaaggaagtagcaatggctaaactttcatctaaacaaaacccaaaaaactctaaagtggtacctaactatttaaggaggtgggaggacgacctaacgggaccctagggtcgttctccacctggttggggcgcaccccacatgggccccacttgggccggggtcccagacgaagttacaagcccataggcccattataggtgacgcagcaccttctttttgtgatttcggccgactgggatggaatttggcgatgaagctggatccattggaaagatgactccgagagctttccatcaagtactcatggacccaaaatggagctcgcatgcatatttggcggccttttgaagtccacactgtagcaggtggccgaactggattgcagaacttggacggcttgatcttgatgtgaactacggttgtatctatagtagccatggtcacatcaatttctacatcattgctaggaatgaatatttctactaatgtcattaagaaataccaacaccagtttgaagttgaaaggacatggacaagaggtattggttaagcacgaagatggaatcctcttgatgagtggaacagcggtactgatggtttgcatggagatctcatggttgccaagaattgagaggaagaagagaacttcttttgataataggaagaagaaagatagacgaagaagaaaacgacattgaaggctagctacagtctgtcaggttgggtcgtgttggtgcctttagagctaaccttccggtccttttgaacgactcaaatcggctacagctaaagttgcagtcactataacaactactacaactgatcctaatccctgtgcagcccgtgtcaagagcgatccagaaagacgagacaggttacaagaacagggaccgaggaatgcatttggatggtgaattggtgagtgagctcccacaaaacctcttggcatccggattcctgtcgtcgtcgttcacccttaacccccgcttgttgtaacccgttggtcccgctttataagcataggccgtgtttagttccacccaaattcccaacttgccatcatatcacattgcatcgaaaactttcctactcacgtaaagtaccaactttttctccaaactaccaactttctcccaactttccaacttctccaccatctaaacacacccatagtgtaaaacagaccatcggtgatacatttcacactactacatctaacaacagatagcattatattttggtactcttctcttctcttgttcaatcaccaacacccttctatct

SEQ ID NO: 16908 - DNA, 988 bp, Oryza sativa
agtatagagtccatatagaaatacaattaggaaataactgaaattcagaattaaaaatacgaacattagaattagaagtagagtatagagtccatatagaaatacaattaggaaataactgaaattcagaattaaaaataaggaacattagaagtagagtataaagtccatataggaatttaaaactaactaaaatttgaaataaatataataaaattaaaattagagtttagagcccgtataaaaatacaatttacaaataactaaaatttgaaattaagaaaaacatgggaagaagaatttaaagtcaatataggaaattcgaaattaaaaattaaagaatattgaaatatgagtttagagttcacatagaaatacaattagaaataataaaaattcagaaataaaaataaataatgttggaagaagagtatagagtctatatagaaatacaatttatagaaaattcgaaattaaaaaaaaagaaatattaaaagacgagtctacagtccatataggaatatatataatttacaaataactaaaatttgatattaaaaataattaataactaacacgtatataaaatacaatatgaatattacacattagtagttttgtaaagttattgcaaaatttaaaattatgttgtcattttaatatatttgaataatataataagaacatatatgctattatatgatagaaaatataatgatactagccgcacaatctgcgcgggccaccatgctagttagagtaaagtatatggtcggtccttaaacttgagagctaatgtcacttaggtaaataaacttgaaaaattacatatttatgtccacgatcttggtttaatgtatcacaacaggtccaaatgacatttgactgtatctgaccgccaacgtggcactccacgtagacaccaaatttacatccaccccctccgcaacacaaaatagtggtaaactttcacttaggccattcaaca

SEQ ID NO: 16909 - DNA, 1501 bp, Oryza sativa
gagctccgtcaaacatatatacaaactttaaatttgacatggatctaagatttggagcaatgtttaaatttgtaggagacattgtagagaggaaattaaatctaaccgtccgctttgcaggatgagagagcgacagccaagatcacaaaagccaccaagcagccgagggccattgtgttatttttcttggaaatgattgccatcacaagatcaggctatagtgttttgttctcctgatgatttgataagctacttctatgaccttcactgttgccggtgttcatataggggtacaataacccaccataaatgacatatattaatgcaaacattatcttactcatatcccttgcatttatgctgaggaatttattagctgtttattttataagatttgatgttttgaaagccagcactgcagcaaggtcggtgttgctgccattgttcttgctcggaactggagaagaagcagaagtcacactgaacaaaacaataagcacaacagatatccacactggcaatttaagcgccatgtctgagctcttatgcattggtaagacaggaatcatctgcttgaggttaatttatatatttagctctccgttccattgtgcatgaaggcacctggttcttctgtctacatccaagaccttcactattgggtcaacaatgtaatttccacccaagaaaagtgaatattagatgtgctagcttgcctaaccatgcatgcatgttttattagcaagttgcttagctcctttcctttgactagctcattgtttacactcttcctagattatcttttcttttcttctgtttctgtatgatccttgttttgggctttctttgattttagaaaatgctggtactggctctgaatggaattggaacagccagtcaaattgttctcttcactcgagatcacttgcagcaccggacgactgacttgtgttgcctgagattgaagctgtccatggcgattaaagttgtggctactggcaggcaggtaaccttgacctttcttgctttcttataacttgcattctcttatttttactagttcatttcacttttatgactgcaaacttcataggcaaaacattgaacgctttgcaaatagggaacagagagaatgagcagagcagagatgacaaattacaaaaacacagaaagtgaggcaatagagattagcatattgatcagataataaataaagaaattcactaggaaattacaggcaaagagccatagactgctgttcaggtgtaatcccaccagcactgctgctcaaattaactattgtgagtcactctacaggaaaacacaaaatttgtacccacggaaatctgttcaacgagaaagctccacaggaaagaaaagctataaatttaagattgtgtggttttgacagtgaaatcctgtaaatgaattcttcactctactccatctatccatctatctatctatctatctatctatctatctatctatctatctatct

SEQ ID NO: 16910 - DNA, 437 bp, Oryza sativa
acaaagcacttccctagttagatgtaggttaaacttcccgttcgagaaactctaacttttacctgccctcaatttatgcacgagtaatgaatgcccctgggtggaagcgagaggggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaaacatttgttgctatctaaattccatttaaagtcgtaccttatcgcccagcatcatcttattctctatttgaattccctc

SEQ ID NO: 16911 - DNA, 1501 bp, Oryza sativa
actacactattaatacatggtcccacctgtcatacacacactgtgtcttggagtccgtgctacagctagctacaaatctgtagcccgctgcccttctctctccttatttatctccttaaaatatgtttgcagctagctaatagcaggctatagcttgctattgtacctgctcttagagagcaagacagtggagcagtgcccgatattttctctttgaattggtctactgatgtggagcgtttttgacatctttatccaaagcagcaacatgtggacatatgcagcttgagtagtttataccttactaaaaacatgtgtctcatcgaataaaaacttttggaacggagaaaatagtcctccctccgtttctaagtatttgacgctattgacttttttaaatatgtttgaatgttcatcttattcaagttcctatcatttgatttattgttaaatatacttatatgtatatatatagttttatatatttcacaaaagtttttaaataaaatgaatggttaaatatgtactaaaaattaagtcaacggtgtcaaatactccctccatctatttttgatagtcatatttcatcttggcatacagactaaggataagtaattctacttatcatctatttaagcatgctactagtcattcttcgtaaacaaacgattcattaatatttatatttctcgatgtccatatagccaatcacgtattaaatccgagaaagtcattaagatgataggttgttgaattgaaatatggctatcaaaaataatttttttagatttggaaatataactattaaaagtatatggagggattatttagtaaggtgagggagtattagtttggcgtgggatatgtacatgcacgtatcaaaagataaagaaaaatcccatgtatatctcacccacgaagcttcgaagcgacatatctcacctctgtcactagaccgtgaaaaaaaaaaaggagactcgcacgtaagccatcatgaaagggaaagtccgaatggtcaagtctcagacacgctcgctagttctagttcctgcgagcgctcgctcgttagctctttcgcatcgagaagcatctattgtttacgctgcaaattgttcttgtgttgcgtcaatacatgcgtaagccactacctcttgcatgtatggctacagacgccgaacgtgcccaactaacatgcatgcatgcagctaactaattgttaacttgcccgtactcaactaaccacataagctaattaattactcggtcaactaatcaccaaacacatggctgttactacaactgagctaatctcctagtacatgcatgcatgcatgcatgcaatgtatatgcagaactccactacgtgtatgacacacatacacgactggttaatgcagatattctaaaacatatgcgagtcattattagtgctaacagagagatcgagcgggccggcgtggcgagcatggagatcagcgcggcccagtcgcttgtgagtata

SEQ ID NO: 16912 - DNA, 1204 bp, Oryza sativa
gtgggaaccgtgtaagagaaagaatatttaggctctacattatgatttaaaggcaggggctgacccggccttggtcaaggcctatgctagcccattgcactttgggttaagattgaacttacatgatggaattttgtactacgtagtgagatttcaatccaaatcctagcattgacccgtggcctgggtctgcccctgtccaaaagtatgcatatgcacatgaaagcatcgaggtgatctcaattatatggaatatatatgcacgtacatgcatcactgcacatgcacatacctacgagtacatccttttaacatacaactggagagatgaaagcctgttgatacatccacaatctcagttaagtatccacacatgcataattatgaacatcagaatttagaccttgtgagtgaagtcatgcaccacatctaaggtttttctccattgtaatgattttctagtctggtttctagaatgaaatgccgttataactagcggcggcaatgcgagaaaatctaaaatttatcttgcgactagttaagctaatatgattgaaatgtactcgagctacaataattacaactagcggatattttcgtgtaattttttcgtagagcaagatttcaaaaagttgagttgtattttgagatacaactcttaggtccctcaaatatttggattgcaatcaaaatctataataatataatttgattttgattttgagattattctttgttggtcatatctctttttatgattgctcatacaaataaaattacgagtaaattttataaaactacagtactttgatcgaagtattataaaagtacagatttaaggcgtcgtattataaaactacatatttaacacaaaatttatcacaaaactatagatttaatactagagtatcacaaaactacatattttacagcttaaattcctaccactactgctatgttagagtgataaatgtgtagttttgtacttaacatgatgcaaaacatgaactgttgtgataattttattactaaatttatagtttggtgatcttccaccttaaatatgtagttctttgatgaattcggtcctaaatctgtagttttgtgatacacctttttaaatctatagttttataatagtttgtcaaagtatatgtagttttttgaaatttactcaaaaataccgaataaaatgttcttacca

SEQ ID NO: 16913 - DNA, 1247 bp, Oryza sativa
gttttttaaagggattaatggtaaggagaagatgaaatgaggtggagatgttagcccaaacactcacttgcacacacacagctctctctctctctctctctctttcactcgatgaaacacacacatacagaggaggcaatgacagaggaagaagatgaacagcacgcaatgaaacaaagagacgcaaggaaatttcttgtcactacacaccagtgaaccaccacacacttcactttctattctccacacattaatcacacactgattacatgcttaaatagcacacacgcgcagcagcacactagccacgttttttccacactaaccggccaccagtcacatgacttagccactaattaaccactaatcacgtctctatgcatgcaggccatatctccttgcatgcaaatgcactaacacacatgcaacacagctaactgatccacaatccatgccactactcaagctacttgacttggccactactcccagccgatatccacctatagcttcctacatgcaagcacttacatgcagatcatggattttcttgatcaagctaactcatgcacgcactaatcacaactcacacaataaacaacaagattaagtctaacaggagattgctgacatgtgggtcccgctggatgacttagcaagtcaactaccacctaagcaagtcaattgccacgtaggaataaaccacttccaaaatcgtccggggagttgatttgcaacggttttcagagttagggaagggttatactcggttttacggttgagggaagctattcatacacggccatgagttgagggacgaaaagtgtacttattcgtaataaaaatcggagggatttaaagctatacgtactcctgtgaatgcccagacatttaagccgtgtggtgaagaacggcctggttaagcatttgggcctagaatagagggcccatattggctcgcttatctatttcgttagttttcattttttagagcccaggagcggctcatcggccatcgccaacacatttgatcttctcttctcctgccccggcgaggcggcgaccgccgggattgaagcggcgagaactcgccatcttttccgacgagtcaaacctagtaagctcaatttccttcccctcccctcccttccccagccaccgcaaccttcttctccagagattgatttcgtttcaaattcccgacgcaaagaaagtgaccaaaaagatgagcgggaggcggcgcgcgg

SEQ ID NO: 16914 - DNA, 1439 bp, Oryza sativa
ttagatgccgaatttctattttttttccttaattgtatatctatatggatcccatactctacttctaatattccttatttttaattccgaatttctattatttcctaattttatttctatatggaccgtatactctatttctaatattccttatttttaattccgaatttcaattatttcctaattgtatttctatatggactctagtctcctcttctaatattccttatttttttaatttcgaatttcaacaatttctgaattgtatttctatatggactctagtctcctctaatattctttattttttaattccaaatttcagctatttctaaattgtatttctatatggactctgccttttctttttctctaattaatgtgagaatttctaggtcatgagagcgaacatggaggttcctttttttttccgaattttagttagttttaaattcctatatagactctatactctacttctaatattccttattttttaatttcgaatttctatttttttcttaattgtatttctatatggactctatactctacttctagtattccttatttttaattccgaatttctattatttcctaattgtatttctatctagactctttactctacttataatattccttatttttaattccgaatttcagttatttcctaattttatttctatatggactctggtctcttcttctaatattccttatttttaattccgaatttcagctatttctaaattgtgtttctatatggactctgtattttctttttctccgattaatgtgagaatttctaggccatgatagcgaacgtggaggctcttttttctattcctttaattatataatagattctacaatatcccaacaaaaattacaaattcaaatatgaaataatattttatcgaaggacaacatccctaccctttcatatgatgtgaatcaacataaaagtatgaaacaattcaataacgcatgttaccgcatcatacatagtttttcaaacatttacagctaattagatatagaattaattcaagcatgattagtccaagtcacgacatagaaaatttggtgcctttagttcaaggaaagatccaatcactctatgaattttttgaaatttgctcgagtaatcaagcaagcctaatagtccttatgtcccaaaataagaccaatacagaacatgaaaagactaaaatacccttactacatcaaatcctaatgcaattatgcctctatttttatctatccccaacatatttatcctctagttcaccaacttcgatgtaatgattactaaaattaaacttatttggaaacaaaccggatggcccaaaataaagttattatagaacagagggagtaatcttttacgtaagtcctctaaaatatgttctatgttccaatctttttttttgaga

SEQ ID NO: 16915 - DNA, 1501 bp, Oryza sativa
taaactttcaatttgtgttttttttacctttttcatttaggatttaaaaaggtggtgcactaatattaatattcaattggaaacaaaactatttccctcattgtttatatgttatccaaatagttatgaaaaattaaaaatatatattatttgtgctggatcacttgataaacatgtaaagttaaatttaacttatataaattaaaaaataattatgaatatatgttaactaattgtagtttaatttgttcattttgttgcatatcgtattttaatttatgtgcttgtgttgtaatatgttacatgttaaactatttttttctataattatttaatatgaaaaaacaggatatctcctcccatattaagggcaacagcaatgcttaaggtcttggtgaaaataatttaggtcccatcataccatatatccatgactataatattgaagacaagaatagatgttaagatgtgtctcacatctatgtaaacaaattatattttaaggtaggtcctaccataccataatctattttcatactctttagtgtattttatcttattattttatttcttaaggttgagccgtaagcttatggctagttttaacatttaatgtcttatggctagtgcccataatgtatatgactagtcataatatcttatgactcattcttatggtatattgtggatgtcaaaaggttaccgtggttgttagaattttattggatttcttaaaaaaatagactgattagtggatatgctttatatatgtaattaggatgccattttgctaaaaaatgagaaagaattgaaccttatgccaaaagaaaaaaaacttagtccccatattttttttctaatattttcgtagctactcctagatgtcgcatgttatacgctttaatcatctccgcgtacataactgatcgatgtcacctgatcattgtgcgcagccacacgttttttatttctacacagaaagcaactatatagtccacagaaaatacgaagaaagaagtggacgaaagaccagtccactgctatgatgctatcagcttgccgcttagcagccaccatgaactccttttcccagtataatactctcttcgtgcccaaataatatttgatgtcgttgattttttttaaatatatttaaccgtccgttttatttaaaaacttttacaaaatatataaaactatatgtaaaactatatatataaataaaaatataaataaaagtatatttaataatgaatcaactgattggaaaagaataataattacttaaatttttttaataaaataaacggttaaatatattttttaaaaaatgaacagcctcgtatatccgaagaagcagcaacgaacgaaatcgccgacacgtggatctgcacgctgaagctagccccctccagaaaccggcacgtctgcagccacgaacagagcatcaacacgcacacctcagcgaagagcagagcagcgtctccacgatctccggcga

SEQ ID NO: 16916 - DNA, 1501 bp, Oryza sativa
gttttcgaggcaaaagagacacaagggatttatacaggttcgggccgctaagaagcgtaataccctactcctgtgctatgctccttaagtgaaggattacaagatcctcttgttgaagtaaaatgtggtgttgatcattcggggctagagactgctctagagcatcaaaatggatcgtcccggatccctcccccttttactaggcctggatctcctttcatacctcaaggggttaccacatgggcccaaaaacctagctccggtaaagaagtgttttgcattaaatgcctgtcttatctcttgacttgggaagcaagcgcacgtcatcttgatgatggggcctgtcaaatcttgccgcctgacacgaggggcgcccatgtcagctgcttttaatgggtgaagacttccgggctcctattacaccgggaaacgggagcctagctttgaccagggcgggaggaccgactccggctgggataagaggatgagaacctctcaccatcattatttgataggacatgttaggctgcacgccgcctgacacacgagcagcgcacaggcgcactacccagtctcatcggtgattcgaccggtcacagaccggttgagtatactgcacggcacattaaatgcggcgtggcgcgaccgctcgggtcgccataaatgcgggtaagtggacacctataggcggacacctaacccaccgtacgtgatgacctagagagggggttgggggagcccgacccctagtcacgagagggggcggtcgccgcccgacctcgggcccgatcccccctcgggggagggccacgtggcgcctggggcagccttccccctctagtctcgaccagggagtggccgccgccctacctcgggcccgacccctcttgggggaaggccacgtggcattgggggggcagcctcctccgactagtctttgggagggagtggccgccaccccacctcgggcctcactccccttgggggagggccacgtggcattggggggcagcctcctccgactagtctttgggagggagtggccgccaccccacctcgggcctcactcccctcgggggagggccacgtggcattggggggcaacctcctccgactagtctttgggaaggagtggccgccaccccacctcaggcctcactcccctcgggggagggccacgtggcattggggggcagcctcctccgtccaatctctgggcctctaaacatgatacccccgggcccatatcaccgacagtaaacctctatgaacgcaactaacaaagtaaacaacgagttcacccaaagcattataacaaagtcgccaaagtgcactacactgcattactgaggaattttcccgagatgcctaaaacatgtgttacactcggcagtgtctgttcttttcagtagggttggtgaaatgggcaaattttgagaaatccatacataaataagatctgactagtgactactgtcagcaaatgcaagaagagcctttg

SEQ ID NO: 16917 - DNA, 1501 bp, Oryza sativa
tgcctcttaagtaagtatttatcgttttagttaatttgatgaatctgtatattaaattgtcagtttgtgtacctcggctgattcctggacgaggattttatgcacaaataagttcggaaattactagtgaattttcgggcgtgacagcgacgtagcctgcacgaatccacgccgcggcgtagcttacgcccgtcgtcgcctcccgaagtcgccgacgaaatctccgccgaaatcgccggacgagacgatgaggaaaaaggcaaaaagcaaaatgaatctctcacacactctctctctctagtctgattcagacaatctctctctccggtgcggatttcaaaatttgaatagtgtatgtgggtcccaccattaacacactctcacaaaaaaatctctctctgtcggcaacacaaagtgggtcccacaaaaatgtaaaaaaaaaaagaagcccatttagcccacgtatggaagcccgaacttacaataatcaaaagcccacatacaaaagaaaacaaaagtctagatagcacgaatctcaaacaaaatccaagggaccaaaaaacgaatgatacagcctaacaaaaacatgcgatagccatatagcctttccgataaaaaattggttaacattttttctttcccctaaatttgtgcaacttctgttgtatgttggttgatatgcagagatgagactatatcagcattattattataagttgttaactagttgtagtgatggatatgggcataaagaagcaagttatatgtggaggaatgtaggcagttggcatggccgcacatgcacgtatgatggaactgagagtgagttggtacgatggcaccacctctccacattatcattaatgtttcctattgtttgttttggttgtgtctcgacgagatgtataaatttggttggtacaatattacaaatattaatatatatatatatatatatatatatatatatatatatatatatatatatatatatatatatatatatataaagaaacacacatctgtcgtgcctgttattactagcgaaatatataaaacagagggagtactacatattttccctatcatgggtaaacagtacagtgaactcggcccatttaggcccacccacctgtatttggatcgagacccaaaccagcccacgaaaatttgggccgcaaaatacgggtgggccggcctatacacttttgtgatagtgaacatgcagctttcacttcaactggtttagctgcgacggccagggcacgtcaaaattaggcagtgtggggatcggatcgcacgcgccacggggagccggacgaaaacgagaagctcacagccaccgccgcgcgccaccagcttatactctctctctctctctctctctcgtcgacgcgccgatgcgccgagatggccccgatcatgagtggggcggcggcggcggcggggggcacgggcggcgcggtcccgctcatcaagaacgccacctccgcgtcccaga

SEQ ID NO: 16918 - DNA, 1501 bp, Oryza sativa
acccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagccccacaacatgtcaccatgtgcctcaataccaccacggtacctcggaaaggagttgtgacaataccccttgcacaacacaatccaccacagcgcacctttcctggatcataatcacccccttataaacaaggcatggactccccagcgacccccgtgggcttatctccgccacttctcagtctggtgctccgcaatgaatcatgctatacaaaaggtaaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataataatgagtcataagtaatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaaccttcgcaacgacggaaacgacaagctaacacgcaaaacgaagaaaaagactaataaaaaccaaataaacaatacataaaaagtaaacaaacatgtagatcataattttagatgaattatgagacttgaacggcctcattctgacttcatatgaatttattatgaattttacaagattaaatctaattaaagcccatttaaaaagaattaaataaatttaattcaatttatggataattttaatatgtagatctttattttatacaacttttgcaacttgaaccacattaaactgagttacaatgaattagttatgaattttcaaagattaaatcggattaaaacacttatatggattttaattgaattatgacgcaataatgaattatttttgaaaaggaaaagggaattattgcgtcatcaaaggcggtccgggtgcacgggacggtctaaggaaacgaacggccgagatcgattctatccaaaacgggcggccgagatcaacttgatctaccgcggttcacgggacaaggcgacgatgacatcagcgg

SEQ ID NO: 16919 - DNA, 1501 bp, Oryza sativa
ttttttcctcgcttctcacgcatggtgcggtccagctcggggtgtggagaatcttcaatacgcagaccctttttagaagatttcggcaatggaagtctgttaggacgagcagttctctccttcttatgacgccagtcacgcaggaattcgattgactcgccgtggcgtttgtatcctcctcgatcatctctatggaccgggatcttcgtgatatgctgggaagggtcgtcacccttggtctccttctgttgcttgccgccggatcctcccgggcgcttatcttcgacagtgtgtctatctcctgccgagcgcctgtctcatgttactcgcctgtcccccgttctccgcccgtctcgtgggacacgctctccgccgccccggtcgctggcgccacgctcgcctgcaaccctggatactccgtcttccctggccctctcaagatggttgcctgatgaaaaagtacaggatgatcaagaagcatcctaattccggtggctaaagaatcgacaatggatatatacctgcgatggagttaaacacctgaggcgccatattgcataatcgatgcacaggcatgaccagcaatatataggcttcatccaaattactcgtaactgccaaggatttggagtcctggccgatgacggtctagctttgtttttctttcaacgcacggccggagataagcttcaacatgggagtcctttcgtcgcatgactaaactctaccggacatgtatcgcatgagccgacacgacaccaagttaatttcgctcgctccacgatcaaaatttacttggtggggggcatgtgtttgatggtattttggcgattatatgtgtacacaagacttactcatgatggacaaagcaaacaagcagtttgtaagttggctagcttatcatttctacacaatgctcggccatgtatatacacgcaaataaatgcatgcacaggcagctgggaatatatatacttggattagtatatgtgcatgtataattaaccaataactagccgtgtgaagattggctggtgaggcaatcacgtgcatgcatgcatgtactacagtagacggtcgtatgtgtgtgcatgcctgggtgattaagcaacctatgcatatccgagtgattaatcatgggctcggcccatggccgaagacggtagctgcctacgcgccaagatttcagaagttaatatgcggaagagataaaaccagatgaattaagagataaccaacaaaccaattgattttatctctataacaaacttgatctagttagttacttcgcgcgagcgctggcgaggcgcttatcaccggactgtggcccagcagtagagaaacaaagcgaattacaaatcagatatttgacgctaggagaagctaagagataaaatcaaagaaggatatgaacaaatacaaattgatcgatcaagccttatctacaacgaacttgacgcggagcaaacggcgtgcggacgtggcgagcacagacctcaga

SEQ ID NO: 16920 - DNA, 1501 bp, Oryza sativa
aagaaatttgggcaaaatgtatgcatgggatggatatatgcatgcatgtaatttggacaaaatgtcagcagaatggaagagctatagctaggcagatgagatgagagtaaatgcgcctttgggcaagagggtggtacagttactgccatactggtgacacgtacgtacgtactccacggaacacagcaaaatggatggatgggtgcatggcataaatgcaccccacattacttcctgtccccccctccaaaaccgagtagaggctggaggccggcagctcttgcattctaccctacccttgcattgccattgccattgccattgccattgcattgcattggcagtagtagtggttgcacagggtctcaactgtagtgacaagccaactgtaaactggagtaaaagcagcagctatacaatgcacacaatgcatggatggatgcatgcagatgcaggcaggaaggaagggggtgaaagctagtatgtagctatcctacactaggcctggctaggaaagctgacatgactactggagtaactgtgccagctcggaatgacccaaacagagaccatgcacaagctgcagctaccgcacgttaccgctagctccccggccggctacatgcagatcgatcagcatgctgaatgatgaatgaatgcacatgcatgaatttgttgagcactgttcgagctcgaaatcgcagtataggggaatggaaggagacagcactacagcagaggcattctaccatcagctgagaaaaattatgagagctcccattttgctacggactactctctcaatcccttgttccaaaatatatgcatttctagctagcggccttctttggaacaaagaaattttgctagtttttttctctaataaattgaactaattcgtacgaaaattaatcctgtaggtcattagcatccaccatccggttaccagagcacatatgttaattttggggtattgttcgattgatattgcttggagttagatgttggagaaagttttaaattgtactaccttcaacagcccggctaccacccggtagtttgacttaaccgtaccccggtcttgactactactaggatctgattgaactgaactagtatagtgcagcaagcaccacgtactccaaatgaacgtaacattgtgagcaagttctagtgttgaacccaataaaattaaagatgaaaaacaataacactgctagaaattagaaaatcatcagagcctaataatgtcataccagatggcccaaatgtattgtggcccatagaagttcttacctggacagaagcaggccagcctaatgggccacttgcagaaatgacctggatatcaggcattcgtgccaacccaagctgggagcggatggcgtcgtcagtcctcgcattattcatttatgatcaacgcaatagagcaaacactggccctgttgacaagtcacaaattccacattagtttgacaacagttcatgcactccaaatagg

SEQ ID NO: 16921 - DNA, 491 bp, Oryza sativa; identical to SEQ ID NO: 16611

SEQ ID NO: 16922 - DNA, 1501 bp, Oryza sativa
atgccaaataaaacacaagtgttagtagaaaataaacagatttgataaaaaaaaagttagcccctaaacatttatttttttccaaaaacacctttttttaatttacatttaatttattatatatgttttctaaatagactaagtctacattatcttagatgatgaagaagactatagatatctgctgcttatagggatgaattaaatattatacggtataaatctatcaaatagattaaacaattatttaagcaacgcaatctactgtacaagcccgcgcgaatatgcggactaccttccttgttggtaataataataataacaattaaatcgatttctcttctcaatcgaattctaaacccatcgcagccagcaatgccatgtcttcgtcatcctcctcatccgcatcgctgtcagagtcggagagcgggaggccatcgcgcaacttcgcccatgcctcgttaagcttggcgcgacccctcgccctgcgctcgaagaagccggcgtcgaccaagaagcggccgctggactccatggcggccctgacctcgctctggtactcgaagaagcggtcgtccgcgaccttgcggaggatgttcgatctgcggatggagtccctgcagctcgccttgagttcctccgggaacccgtcgtcgttgtcgttgttggggttgctgctgatcttgaagccctcgatgtcgtccgggttggtgtagggctctcgcttctgcgcgaggatccacttcacctccgctagtggcagcggggccatcgccgaggtcgtcgtcgtcgtcttcgtcttcttctttttcgccggagctggagccggagccgccttgctgggcgagcgcgagcccgagccctcctcgtcgccgctggccatgggtggatctctcaacctgcgcctcgcgtgaagattttggaggatttgtttcgtcgaaaagaagaagaggagaagaaagatcgaccgagtttgaggcgggttcgtgttgttccagactcgcaatcggaatcggaatcatccaaggcgggggttcgaatcggatagttttaacttggattatgcactgccgaaaacagcaagcgacaagtggtagtaggccaaaacttgacacgaattcgacacgaattacgcaaggctgtgttctttcccatcacttcgctcatctccttcgttttcctcgtacaagcttttcaaattgctaaatggtacgggttttgcaaaaagtttatacacgaaagttgctttaaaaaatcatattaatacattttttaagtttttttatagataatacttaattaatcagctccgttttccgtgtggaagatatgtgttaatctattacttgtaatctttgataaattaaaggatacgtggtattatgaataaatacttttgtgcttctagttgaattgaagcctatggtcagttgaacagggtcctcttctagagctagcctgcttctttcaggttgggaactggaagattggtaggcgcata

SEQ ID NO: 16923 - DNA, 1501 bp, Oryza sativa; identical to SEQ ID NO: 16651

SEQ ID NO: 16924 - DNA, 1501 bp, Oryza sativa
cgttgcttgtcaagaattagtgaaaactcttaaggatgagttggttttggaaggtaaacagtttcatgtgaggtgttgtgcacacatcttcaatttgttggttcaagatggaatgagggtgattcatgtggcaatagataagatccgtgagatcctaaagtacattgagcattcaccctcacgcattcaagcgtttaattcaattgcttctagtaaaagtcttcctccaaaatctggtttcgctcttgatgtaccaacccattggaactcgaccttcaagatgattagagaaatattgtcttacaaagctgtcttcaatagctatacctctgaaaattgtgaagttctaccaactgaccaagaatggttgcaggctgaatcaagagtgaagtgcatcagcggtccctaaacttgtgcggatgtgtcatctaggtccctaaactctcaaaatgtatttttatgtccctaaacttgtcttaggtgtcatataggtccaaacgggcaccgacccgctccatccgctgacgtggcatgccacggtagcgcctacgtatcagtggggactcacatgtcagtcatatttataatatgatatgataacaatatttacagaaagaaccttacatgttttaaacttactctaatcaaatcctgtacgtgctaatggagcggagcccacctgtcataggcacagggagaaagcagcagcagccgcagagttcgccggccggcgttccttcaagacgatgccgttgacgaacggcgattcttcggccgacacaaccacaagaagaaatgctgaggacttccttgtgatcctgttgaaggtggtctcgtcgctagaggtggccggaatcgatgccagtggtgtcgcgagcggcggtggtcttcaatacgcctgtgcatgtagagtcccagcccgatttagtgcaaaaaaatgcatgcatgcgagtctagcaggtccctgagtgctcactggaacttgattgcggcatggcgaggtctgggtaacagcggtaatggaaaagacagcccggcggtggtggataacgtcggcttcacggcgacggctcgcttgagcggtggaatgcttagagaaggtgcatgggtggttagtgaggtccctaaagagttgcatgcacgattaattagtccgtggctcaccggggagagaggaattggcgatggcactcggcgaccggagttggagaagatgacggcgatctccctcgtctgtgcacgattcttaaaatttcttgagggcttttggccatgatggtgaggcgatgactttggcgcgatggcttggcttgagatggaccatgtcgaccggaacagcgacgacgtcatggcggcggcgcctggtgcgagttccggagctctcatgggcaaggtcgcgtttccgttgctgcagtggataaaacgagatggggtcaaaaggagatttgctcggcatgatgtgggaagtttggaatgggaaagatttggcgatagagacgac

SEQ ID NO: 16925 - DNA, 1501 bp, Oryza sativa
tttagacaatgctagtaacaacaccgttgcttgtcaagaattagtgaaaactcttaaggatgagttggttttggaaggtaaacagtttcatgtgaggtgttgtgcacacatcttcaatttgttggttcaagatggaatgagggtgattcatgtggcaatagataagatccgtgagatcctaaagtacattgagcattcaccctcacgcattcaagcgtttaattcaattgcttctagtaaaagtcttcctccaaaatctggtttcgctcttgatgtaccaacccattggaactcgaccttcaagatgattagagaaatattgtcttacaaagctgtcttcaatagctatacctctgaaaattgtgaagttctaccaactgaccaagaatggttgcaggctgaatcaagagtgaagtgcatcagcggtccctaaacttgtgcggatgtgtcatctaggtccctaaactctcaaaatgtatttttatgtccctaaacttgtcttaggtgtcatataggtccaaacgggcaccgacccgctccatccgctgacgtggcatgccacggtagcgcctacgtatcagtggggactcacatgtcagtcatatttataatatgatatgataacaatatttacagaaagaaccttacatgttttaaacttactctaatcaaatcctgtacgtgctaatggagcggagcccacctgtcataggcacagggagaaagcagcagcagccgcagagttcgccggccggcgttccttcaagacgatgccgttgacgaacggcgattcttcggccgacacaaccacaagaagaaatgctgaggacttccttgtgatcctgttgaaggtggtctcgtcgctagaggtggccggaatcgatgccagtggtgtcgcgagcggcggtggtcttcaatacgcctgtgcatgtagagtcccagcccgatttagtgcaaaaaaatgcatgcatgcgagtctagcaggtccctgagtgctcactggaacttgattgcggcatggcgaggtctgggtaacagcggtaatggaaaagacagcccggcggtggtggataacgtcggcttcacggcgacggctcgcttgagcggtggaatgcttagagaaggtgcatgggtggttagtgaggtccctaaagagttgcatgcacgattaattagtccgtggctcaccggggagagaggaattggcgatggcactcggcgaccggagttggagaagatgacggcgatctccctcgtctgtgcacgattcttaaaatttcttgagggcttttggccatgatggtgaggcgatgactttggcgcgatggcttggcttgagatggaccatgtcgaccggaacagcgacgacgtcatggcggcggcgcctggtgcgagttccggagctctcatgggcaaggtcgcgtttccgttgctgcagtggataaaacgagatggggtcaaaaggagatttgctcggcatgatgtgggaagtttggaatgg

SEQ ID NO: 16926 - DNA, 1501 bp, Oryza sativa
agaaagatatgtcaactctatatactatttgttcagtgaaactgatatgttgtgttgatcagtgttggcacacagggtcaggaatatataatagaataatgccttgagaaaaaaaatcaacaagataaatattcatgcctagaatatataatagaaggtgatgtacttctgaagaatctatatagaccaaatggtatagacactggaagggaagaatgtaatatagaccacatggcatagacactgcaagggtacaatgtaaactctacagccattactaacacaatttaccaattcatgttttgtacggaatacacaagtaatgtcctgaagtaaacaaatcaactacaatggtttaatgtttgcctatgaactactgcacgtctgcaccttactataagttcaattcttagtttttaaatcaccatatagatttttgtgctatattttctagatgatggaactacaaagacctaaaagtgcaaaacagagtaattaacaaaagaggaacattgtttgccaacactgtttcaagacatgccatcacaattcatctttcatgtgcaagcgaataaagatctatagtgtatcatttgcacaagtgctatatggatatcaaatttagcttcatatttcccccctgccacacaatatttgcatgatatatccctagattacctagtaatttagggcgcacatgcaaatgagttggtgataaaataagagagatctccaaaagagaattacaaatatccatgtctagggtatttaattgtgatttaaagggtgattttaataagtgcaagccatcaaacctagaataacatatcaaagagtccatacaaatagtataatatggtgtcgtgagtcacaagagagtaactgcacatgcaagtacaaaagcaccgaggtaggcaatggataaatcgaacagaacaggcaccatggcacatgatgaagaatgtgccagtgttgaatgcccttactcttttgtattgtagagactcaaaacaacagacaggtaacaaacctaacagaaattaaaaattgcttctaaaaattattgtagcaagatattactacctccgtccagaaaagtaccgaggtaggcaatggataaattggacaaatagaacaggcatgatggcacatgactaaagaatgtgccaatgctgaatgcccttactcttttgtattgtagaaactcgaaacaacatacaggtaacaaacctaacagaattttaaaactgcttctaaaaattcttgtagcaagatatcgttctacccgtcccagaaatgtagctgtttctaggtatgcacctggacacaggttgtagttactagagcatagttatctgaattgtatagattggcatactacaacattgcaatttggtctaagaattcagctcaatagttgtagctaaataatgtaatccagttcaataggtggtagcttaaaaaatgatggtccacaatgaataccaaacacagaaaccga

SEQ ID NO: 16927 - DNA, 1501 bp, Oryza sativa
atatgtaatattcatattgtatttgatatatgtgttagttattaattatttttaatatcaaattttagttatttgtaaattatattcctatatcgactctagacttgtcttcaatatttcttttttaattttttttttcatattttcattatctgtaaattgtagttctatatagactctaggctcttcttccaatattatttatttttaattctgaatttttattatttctaattgtatttctaggtggactgtaaaatcatctttcaatattcttaaattcttaaattcgaatttagttacttctaaattgtattcctatattgactttagacttttcttcccatgtttttttaatttagaattttagttatttgtaaattttatttttatacgaactctaaactctacttttaatattattatgtttattttgaattttagttagttttaaattcatatatagactctatactctacttctaatattccttatttttaattccgaatttctattatttcttaattatatttctatatgaactctatactctacgtacttctaatattccttatttttaattccgaatttctactatttcttaattgtatttctatatggactctatactctacttctaatattccttatttttaattccgaatttctattatttcttaattgtatttctatatggactatagtctcctcttccaatattcattattttaattccgaatttcaactatttctaaattttatttttatatggactctgtttttctttttctctaattaatatgagaatttctaggcagcgagagcgaacgtggaggctcctttttctattcctttaataagttaatagatttattcttaatctcgtcctttccttacacattgccactgccgctgctttcctagtggccgcatctgacagtgaggaggctagggatcgatgtcagatttgataaccctagcctccccactgttcaatgcccctctattctcctatccctctctactcgccaaccaccatccctcaactatccacccggttttgatttgccctaacacattatcattctcgattcttggaccaatatatagtgatagttgtcattggctttttctgtaccacatgcgtattgtgggtttcgaaacctaacagtatttgaagttttgaaaccggtagtgattatgattttttcaaaggagaaagaggaaaagaagaagaatactttatgactcgtgtgtttggtgtaagagggtacaaataccgcggctgatatatatattcaccactttatttggtggtgtagcattgtttatccgcgacttccgcgtagagtggaatatatataatttcatgcacgcacgcggacctgacctaactcctcgatcggtcgtagcttcgttctgtgacctcatcatatcaagtaagctaccttatgtgtactatttatacagtggttcattagccagtaggttacaagaaaa

SEQ ID NO: 16928 - DNA, 1501 bp, Oryza sativa
tacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacctccgtgggcttatctccgccacttctcagtctggtgctccgcaatgaatcatgttatacaaaaggtaaagccgttgcccacgctggcttgtggttggcacggttaatatttcacaacagtagctcgcgaaccggtccttaattgccatgagcacgattctcaaaaccatgtgctcacaacccaccattatcaagtttgagttggcaagtaattaattaaccaatcacgattgaccatcgtgaactatcattaagccatcattaaataatagtgagtcataagttatcccaatagtgtgctaatatttctaagcatggctaagcaatcatatctaatatctagctaaaccaatatataaagctcaactagtcaagttataataacccaaggtatcaagtaataaagtaatcaatgcaaacaggccataacaaaggaatagattcacaccacccagtgacattcgaaagtaaatgcacagttgaaataaatagagaatttaaatataggatcaacatgctcaaaggattgtgtttaggatctgtgtgacttgccttgcaataatcggtcttcaattaatcttctgaacactcccgacgcactcacgaaccttcgcaacgacggaaacgacaagctaacacgcaaaacgaagaaaaagactaataaaaaccaaataaacaatacatataaagtaaacaaacatgtagatcataattttagatgaattatgagacttgaacggcctcattctgacttcatatgaatttattatgaattttacaagattaaatctaattaaagcccatttaaaaagaattaaataaatttaattcaatttatggataattttaatatgtagatctttattttacacaacttttgtaacttgaactacattaaactgagttacaatgaattagttatgaatttttaaagattaaatcgggttaaaacacttatatggattttaattgaattatgacgcaataatgaattatttttgaaaagaaaaagggaattattgcgtcatcggctagggtttgcggtgaaccgggtgcacggcggcggctcacgggaacgaacggccgagatcgatcctatccaaaacggacggccgagatcgaacggtccacgaccgggccacgagagtcgatgacga

SEQ ID NO: 16929 - DNA, 1501 bp, Oryza sativa
gagggcaccacggatgaacgacatattgtcatcttggcacggcggagaggaaacatcacggatggacagcatcacatcaccgttggtgtagcggggagaaggcatcacagacggatagcatctcatcatgttggtgtagcgaaaatgggtgtcacagacggacggcatctatctcagcgtgacagagaggagacgtcacggatggacggcaccaatcttggcatgacgaagagagagtgcaccatggactgatggtatggctactccggggtgacgaagagaaggcctcactggcggctggaatcgatctcgacaaagacttgcgagtggtgccaacagattggttggcacggcgactccggcatgatggagagagtgcacctgttgataaaaaaacacacactgatctgagagatttactttactctagtgcaggttcaaagattaatttgctttcgggttcagggtgtgccagttgatttgatcttacaaccaacaaaaaaacaaagaaaacaaagttaaatctataaacgatagccgatcggacggattgccaatgacgtatcgtttaatattaagacgatgtatcatgcatcagatcggcagtgaagtatataacaaagaaataattagatctacttgatcggctaaagatatcaataatatacaatctatgcttcgaaatatgtttaaaccaagtgattgggatagatcggacagtacgccgagacagtataaatcacttatgattaaaagtactttagaacaaagattatatatattcatagcatagccgatattccttattttttaattcaaatttcagctatttctaaattgtacttttatatggactatgtttttctttttctccgattaatatgaaaatttttatatgccgagagcgaatgtggagactcatttttctattactctaataagttaatagatagatttgacggtctcacttacacggtacactgcatgcatgcagtacgtactgatctcccagttcctccttggtttgccctcatacatgcatacgcatatatatattaaccaaacatgcatgtgtatatagctgggcacacacatatttgcatgcctcatgcatcacacgtaagccaacaaactagctagtttcacatattaatacatgtggctgtcattttgcttgttttggccaacatccatattctctatttgaacaagatagcaaaatgccctcaaacaacgagtgctccggcgagatcaatgatgggcctgtttgcatcataatttggcgggaaaaagtacaccgaagttccctcaacttgtcatcgagttacaaaatcatcccccaaccgtaaaaccaagtatctagcatccctcaactatcaaaacaggccacaataggttcttcggtggttttgaccccggttttatcctacgtgggccccacatgtcaggctgccacatcagcttctctctccctctctttccccctcttctctcccttcct

SEQ ID NO: 16930 - DNA, 1468 bp, Oryza sativa
caggaaatcgtcgccgcagagaatcaacaatattcgctgcatacggaatcgatttgatatgagcctgttctggatcgggatcaatcagtgctccatcttccttcgtgcagagttgctgatcaagttctccgcccacgacatcggctggtatggctggtgcaaaagcatcagcagcccaggccgaacacgacgccgtgtccgagccgagcacagtgcaatgctacatactgcacggggactcgttcgagtacctatgcctttgtattactgtgttctaatcggagatgatcaacagagggtatttccctaatcacgtcacgtgcatatgcacacgcgtgcgagcatatgacgggtcatcatgctccacaagaccaacaaacaatcaagtctaagtttactgcatacatgtgtcttctgcagtgtgtagtagaccactaacaaggtaattagtagattagattaatctaattaatctactaatttcatatatatatccggcatatatctacacaggtacgcaatattttatataaatttatcgtacctatttttttagacttatacagcattgtcagatttataatttattatgtttacctagagcatgtttttatataatatctattgcgtgagtgtccccgatgttaaatcgactacggtctaacgctgggggcttgctctattctcttctgtatgaatcatgtttgtttacggtttacataatacctgatatttacatctgctcgttatatcctgataatactagaagatccatgcagtttttcgaatacatactcgatattatctgctatatgtcttgccttctagaaaatatttttcaggaacaattgagcactcgagtaggttgtggtcaagtacaccgcattatcgagaacgatctcgacgaatgcagagtcgtcgcgcccaacctgccaacgaagaccgacaacctatctcacagcaccggccatggctggactactcgagaaaaggttgttaacggataattcctcgcgaacgctgtcggcttgatcacccgacatgattgcgaacggacatccggatatgctacaagttgggtgtgtaagtcatgttggccacatgagatgcacatgtaataaaccaactatagcgcttccattgatgttcgagagatgattctactcactcgctggttctcgaaccagtacgtagcaaacttccattggtgttcgggagatgattctactcgctagctggttctcgaaccagtacgtagcaatctcctgcaccacaaacttccattggtgttcgggagatgattctactcgctcgctggttctcgaaccagtacgtagcaatctctcgcaccgcaaacttctattggtgttcaggagatgattctactcgctcgctggttctggaaccagtacgtagcaatctcccgcaccgcagcctccattggtgttcgagagatgattctactcgc

SEQ ID NO: 16931 - DNA, 1501 bp, Oryza sativa
ttcgggcgcctccgtgcaggccgtcgccggcgccggctggtcctcgccgtcgggccactttgtcttcggcttctacgccaccgacggcggcctcgccgtgggcgtctggctcgccaccgcgcccagcataacggtgacgtggacggcgagccgcaacgacacgccggccaccggcggcgcgctgcggctcacctacgacggccgcctgctctggaccggcgcgaacggccaggacaggaccgtcgccgcgccgccccagccggccgtcgcggcggccatgcgcgacgacggcaacttcgtgctgtacgccgcgaacgcgacggtggcgtggtcgacgttcgcggcgccgaccgacaccctgctcgccggccaggacctcgcccccggcgcacagctcttctcgagcgtctccgccacgagcagggccaccggcaagtaccggctgaccaaccagctcaacgacggcaacctcgtcatgtacccggcgggcaccatgaacgtcgccgccgccgcgtactgggacaccggcacgttccagataggcttccccctcaccttgcgcctcgatgccagcggcgtgctctacctcgtcggcaacaatggcagctacaccaagaacttgacgaaggccagtgcagctcaagccgtagagcaagctcactaccaccgcgtcacgcttgatcccgacggcgtcttgcgttcgtatcgccatggattgctgtcgagcggcgggtggaagaccgacgtcgagtggatcgggccgagcgatcggtgccatgtcaagggcgcctgcgggttcaacagctactgcgtgcttgatcgcgacgcgcagcccagctgcttgtgcccgccggggttcgatttgatcgacgccggcgacgccgcgggcgggtgcacggcgagctccggcgccggcgagtgcacggggggcagagagccgaccctggttcgtccatggcgaccatgcagaacgtgtcgtgggcggacacgccgtgcggggtgctggccgcgggcacgagcgccgccgactgccaggcggcgtgcatgtcagactgcttctgcgtcgccgcgctgctcgacaccaacgacggcacgtgcacgaagcagcagctcccacttcgatacggccgcgcgggcggcggctacacgatgttcgtcaagaccggtggagcggcgagcccggcgctcggcggcggcggcggcggcaaccaccaccaccaccgcctcaggcgagcgagcaccgtcgcgctggtctgcgtcgggctcctgacgttcgtcgcgctgtgcgccctcctcgcgtcggcgcggctgctctggctgaaccagaggatggtgcgacggcgcgtcgcgctcgccgacgccgaggccctggacgaggaggcgccgctccgctcgtacagctacgaggagctggagcacgcgacgtacagcttccgacaccccctcggccgcggcgcgttcggcacggtgttcaaggggacgctgcggcgcggcggagaga

SEQ ID NO: 16932 - DNA, 1501 bp, Oryza sativa
atggtggaaaataatgtaccggttcaaatgataagggattgcaagatgtttttctattttttttatttttttatgattttctctaatttattagaatgccacgtgatggcttatgagtgtttgtatggataacgcgtggccgctttatattaaaaagaagccatcatttaaaatcgattacatgttatataaaatatagtttaaagcacttacatgcatgaatgattattagctttatttcgattatttgaacatattaattcaaaaaataaaatctcgaactaagcggattgttttctctaagtaaaggcaccatatttttctatagaatagcataaactctgaggtagttctttttttccttataaattgtatatctaatttagcaatgtatgtttgcaaaaacaatgtatgatgatgcaacctgtcccgtgtttgttgaactatttcgtattttttgtggcatttctgatgacatgtatgtaaaagggcattagtgtttgtccctccagatatatttttatgtagtggcttcagcagttcagttattcatattttcttatgtacggaatatataatttagttatgcatgtttgtaaaacaatttatgatggtgcaatgtatgttgttaaattatttcatcgttgttattgtcattttttaatgattagttttacattcaagattattttataaaaaatgaatatatatatattattttatcttgaattgttttagataataaaaatcgattaaacatgatgtaaagtgcgcttaaatcacctcgtgtcatgttttcaatgttaaaaaaaattcaaagaaaacaagaaacatactccctctgtccaaaaaaatccaacttctggagtttgaattttgtcccacaaaaaccaacttctaccatgctatctatcctcggcacataaaacgagaagttttctcccttaaataccctttatctacccatcaacattactatgggctttttataggacaaagggtgtaccattctccacttaaataatgaacccgttattttaaacattagatctattccagaaaatcataaactgctgcatgacatgtcttatattaaaataaaatctgagaaatctgaggaaaaaacaaatcattggttttcactttgatcgttcgaaatttttttttaaaaaaaaaacaaactccccaccacccacccctcccgttgtatacacacacaaccttgtccaccctccaccccctaccatttttatgctatttatgtctctttggtccctccctccttatttttagctagcaaactaaaagaaacaatcaataaatgtgtgtaattttaagctacatgtatgatttctaatctaactattgctttatttgtaattaaaccaataatataacatccatataatctaagatcccataagaaataataaaagctatgaagttatagttgtttgaaatttgttataaacattatctccactattataaaaattaaaga

SEQ ID NO: 16933 - DNA, 450 bp, Oryza sativa
agagaagagagagaggaagagtgagagagaggggggaagaggggagagagagtgtgtatatatgacaggtgggctcactatgttttaaaaaatgaaaatgttgactggactgccatgcgaacgccacgcagaccaaaaccaccgcggattgagtcgagggggtaattcgtccgatttgtatagttgggggtgaagaatgtccggttttatggttcagggggtaattcggacgaccgcgatagttcccggggggaggggggtaattcgtactttttcctttcattaaaggaggggagacagaaaagtgttagtgaaaatattgatttacctctagtttattgcggaaatttagctaataaagatggcttaaagtgaaatttactctttattttcccaatttattgttcttgcatcgaaatcgagcgagaggataatttgttaacaatggta

SEQ ID NO: 16934 - DNA, 1501 bp, Oryza sativa
accgcaatccgccaccgtcaagcatcccccgtcgaatccgagccattggctcgtctcccctcgtcctgtgcaacatcccggtgtgctcgccttcgcctgaattgccatggttcgctccggccctcgccgccgtcgtccgccgtccgttccgaccggcgtcgtcgtctacctcccaccggcccgcgtggcagccacataggcgccacgtcggcgccacctcgggcgtgaccgggtcaagcagaccccggtccggcggtttcctcccggcccctcgcgcgcgcggtccaccgcgagccgtgaggctgcgagtgggccccccgcaccgcgtcctccgcgaaccgcacgcatgcgccgcgcctccctccccaaaccctagcacgccccgcgtgcacctcgctcacggtgagccgagtcgacgacaagcgggtcccacccgggaccacgcgggatggacccggcccaccggctctctctctcccctccccgcccgcgcgcgcgccttgggccgccttcttgggccggccggcccattaagctcggccgagccgcccctttctctcgggccgcgccctagccgcccgagggaagtgtaatttccctccctccttcttttctttttcaaaaaggatttaaataaatccttttcctttagaccaaaaatccaataatcttagaaattcaatatcttcccaaccgtaagtccgtttgactccgttcaacttccaaaattcctcaaatctcgagatctatctaatggcacgcttagaggtcaataatagggctttattttcgccgtttgctgagtcgtcccgtttcgcgtgtagtttcggagcccgaagacccgcagtgcgaggattttgaggatcaagctcaagatctcgagcgaggcaagccacctttgaacatcttgagcctatatttgaacttaattatgttgcttgaaaaatattatgcattgataggatcgcacttaatctgcttgtcccgtctgcaaggcagattagcggacctacctaatttgttgcatttgacccttccattgtaattgttataccatgttcccttgtacccacctagttgcgcctcggtaatcgtgcactctgcacgggtatcgacggtcgccttcaaacttaaaatctgagaaacatcttgggtaaaacttggattttacaaaagacttggaaaacccgacacctgggtcggtgcttgcgaactaaatgaatttccaaaatcgcggaccggggaacgtaccgggtgtacggtttcccgttcttgcacttaaggaccatttccttggaatttcatccgaacacatgacaagtacgaccacatgggtggaatgggacacccctggctgagtaactagcttatcgggggagccatgatgctaagagacatgtggattcgccggggtggtgtcggagaggacccctgggcttcctggcacagtatggtctgggacctaatctggtgttggtctgggacccctctcgttggcata

SEQ ID NO: 16935 - DNA, 675 bp, Oryza sativa
acatccgtgtccatgtgtaggccagggtggggtttgggacgcgagaaggctattacgcgatcagtcacgcgcgcccctcccggcgtgactggacacgtgtcgcgcgcgcagagggggtggcggatgcgccgcgcggagtgcgagttttccttttttttttgtttttttccgtgtttttcgtttctgttcggttagccttttcttctgtttttttcgtttctgttcagtttggtttttcttttttttttagtttctcttctgttttttcggtttttttaaagatgcacgaatacaaaatttgtattcgtatgtataccaagctagtttgtattcgtacgtatacaaagtttatatacgcatatgtagactttgtatacgcgtatataaagtttataaacccatatgcaaactttgtatatgtgatgtaatttcttgttttttaattttttttaatatgtatgtatataaagtttgtataatcgtatacaaagttcgtatacatcgtatacaaagtttatatacgtcctatataaactttgtatatgtgtattaaaaatatatttgtaaatatatatacacacacctatatacatatgtatatacgtgtgtatatgtagtatatacataagtatagtagatacataagagactagagggcagccgactgaccgcgca

SEQ ID NO: 16936 - DNA, 491 bp, Oryza sativa; identical to SEQ ID NO: 16523

SEQ ID NO: 16937 - DNA, 1501 bp, Oryza sativa
gggcaaatccccgcgtcgacgccgccgtatctcgctgtcgtctcgagctcatcgtcctcgccgccgcctccgcctcctccgccgccgccgcctctcccttcatcgcgatctccgatctcgatctctctctccgtcgcgccacccgccacgagaagccgcgcgcgcaacgctgccgccgccacgccacgccgccgccttcgccgccgcgcaacaccgccgccgcatgcaacgccacgccgccgccgctgttgccacgccgccgccgccgccgctgccgccacgccgccgcgccaagcgccggcccgatgctgccacaccgttgttaacgaacacgtgaacgagaacgaacacgtcaacgtacgttgccgtgagaacgtgaacgagaacgagaacgatcgaacgaacgagagcgagaacaagaacgatcgaacgaattaacgtgaacgagaacgacaacgaacgtgaacgagaacgaacgtgaatgagaacgagcgaacgaacgtgaacgtgaaatgcaatatatatatgttacttctcatttatcctaatacatattttttgtatcttgcagaaaagacatgttgtcggagtcgtccctcaagccggagtagaagagctagccctagaaggaattcgtgcaggcaagtgacgtaataatataaatgattgttatatttgtaatgcaattaagaatattagacttgtaattagacttagcatataagattgtgtagtgttctaattttatttgagttttaatataagattattttattgcaaattagacttagtatgtaattattgactacagaattggttcgactcctagcaattgactattgtagtcttaattagacttagcatatacgcacgaaacacttagcatacatgactattttagtcttagcatgtaatattatttgagttttaatataagattattttatttgtaattagacttagtatataattattgactacggaattggtgcgactcctagcaattgacaattttagtcttaattagacttagcatatacgacagttacacttagcatacatgactctttcagtcttagcatgtaatattatttgagttttaatataagattattttattgcaaattagacttagtatgtaattattgactacggaattggtgcgactcctagcagttgactattgtagtcttaattagacttagcatatacgcacgaaacacttagcatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 16938 - DNA, 1501 bp, Oryza sativa
ttcactccatacagtatctgcccaaggtacacacagatatctcctccatgcaccatcatcaaggatataatgtaaaatatatagactaactcctttatgaaatgtaatgaaatttgctcatatatattcagttgtgtaaactaaccagttcagctcagctcaaaaacttaacgatgaataacgacgtgactgcaatttactgataattcaatgtgcaaattatataatttcgcctgctacaaacttctattgaaaacctaattaattaaattatcgcattccaacaatgaccttataagtgatcgacttattagcagcattttatttttgtgaaagatccagttttaattaaattctaattatattcagtttttgaaaagagaaatttccatgttaattactccctccggacataattaagtacatgccggccgtttcagacaattaaattggcctgcgtttaatagaacggaattgctttgtcggaaagcacaagtaatattgatcggagagagtacatatgagaacatttgttgatgatcagtagtaattcataccgtacgttataaacacatacgtacataaatactgtagtatgatacgtataattatacgtatttggtattgtatatacgtacgtaccctcttgcgcgccctggagcgaagcgcggactcccggttcctcatcatccggatggtcctccggtcgtcgccgctgccgccgctctgctgccgcacctccatgtccacctcgtcgccgccgggggtactggcgccgccggcgatcccggcgagcgacaccggcgtggcgggcagcgcggcgccggcgaggcggacgccgccgccgtcgtcgtcgtccctcagggtggagatggagaagagggagctgcagccgctcatgatgctcagctgcgggctgtccggctccctcggccacgccaccgccgccgccgccgccatctggtagtactcctggtggtggtagttcgccatggccgcaccctgcacctgcaccttcttgcttgtagctgcaggatccttaattcgatcgccaacagctgcagttagtgctccttgcttttggttgttgttgctaagcttgtctctggctctctctctctctctctctctctggatgtctacatatataaataaatcagacttaattaagctagcttcatgagacagctagctcaacagctgctagcttttaagcctttaagtaccaacagtgtcattatgcgtgtaatatattttgctagcatgcatttaaatatgaagaagtaattaatcaaagtgcattcataccatgtcaaaagaacaagagaatagagcaagtaataaggtattgaccaaagcatacttgaaaaagtagtatattgctttaggttttgcttttcctgttgtactcaatgtggacaacatgaatgctcttcccttgagtactaattcttgcttcaaggacattttatgagataatagctattttatttgatgtaga

SEQ ID NO: 16939 - DNA, 1501 bp, Oryza sativa
tctttcctttacttcctgtgaacaactagcttaatttgcggttgattaatcgcatggccagtgtgaactggctgacccgccggaagaactaaacaagcagatcagagcaagtataatagtaggctataagccggctaaatgctgaggtggaggagaaaagagaggagagagagaagaagcgggctgtaaacttacagccgccttagacacaagaactaagaaactctgtaagagagacgagtgtgtcatatattaattgtaaagagctaactattactctctctatccataaaagttgcacatattacttttgacaccaagatcagaaaaaaattaaatcaccttaaatgttacaaaatcaaggagtgaatacaagcatgcaaccaataaacatttagatgactccttaggttctaataaaacatttaatttatctcttcatttaagtcttgaatgcataaagactacaaggagaaacaacttatttggaaaaactaaaatgtgtaatatgtgtaacttttgtggatttcttttagataatggaataaaacaactacaaataatcttatagccaacagatcggttatattattagcctctctctcagtatgctttacggacttgatgacaccacatggcgccccaccttaactagtcctgagccctgaatttaattgtcgcccccatgcatcatgcatcatcacatgagagtaactaatgatcctgattagtttatgaacagtaacatgtgaggagaaaagatgcatggccctcgcatccatccgatcggccactaattaaacaagcactggatcccccaactacgtacagctactgcacgctgcgcgacgatccaccggtgcagacaagtcaaacaaggtcgagctaatctagctaccggtgcatgcaccaggccggcatatgcagcttaactgcgaaaacttaattcggttgctctcggtcgggtttgactttccagtccccttctcctttccccctttgaaatactgtgtccctcctctgttttttttttttttactgatgaaataaaggatggcatgtgtcgcgtctctgatagctcccgttccataatgcatatggcgtatactgtgctcggggtgcatactgcatagtgcatatgcaatttctggcgaaccatagcatcacaaatttccgtgttccgtcggccaaaacaaatgccgtgtgcatacgtgcaggccaaaatgtgtaagttttatgttcgttcttttcttttctgattaacatacaaattctatgttgattatcacaaacacactctctacataaaaactatttaaaatacatttttaagtttataataactaaaactcgatcaatcatacgaagtactgtaccagttttctggcaaaccctatcatgggacacatgtacaatcacctcgatcaacggggggtgacagccagttttaaccgcgcgcgcgcggcgacgaggaacgagacgaggacatgttaaccgacca

SEQ ID NO: 16940 - DNA, 1174 bp, Oryza sativa
cgaaaattagaccgcgagagaaaaaattgtcctcccggaattaattttgagtggttaagtcaactcaacaggtgcaacgtaacgtacttacgtcttagatggagtttatttctccgggttaagcatgtcataaaggagagcgtgtagcagaaaatgtgaagtagaagaaaatgcatgtgagggtcccctttttatctgttcgaaatagaccgtccccgtgcaaaatatcagatcagacttgcatgggtgcatgcgtgagtaacatgtactccctccattccctaataacacaaccacttttttctcagatgtttcataatataagacatgcatataagtatacaattaactatgacatcttctctattaaatcctccactctcatgttatctagttctattggatgcatgaattatatttactatgatgatcgaaacttcaagatgataataattatttcttggtctttgggttaaggatggttgtgtcttatattttgtaatggaggaagtataatttacatcaacggttaaatatagaagtagtactagcaaacgacatggagtatttaaaaaaaatactccatccgtcccataatataagggattttgagtttttgcttacactgtttgaccactcgtcttatttaaaaaatttatgtaaatataaaaaacgaaaaattatgattaaagtattttggataataaagtaagtcaaaaaaataaataataattctaattttttttaataagatgattggtcaaacagtgcaataaaaactcaaagttcttatattataggacggagagagtatacagagagtgagagagaaaaggtgaaaggggaaagggaagaaaattacaagaacacttcgttggctcgtacttccgtgtgtagaaacacactcctaggcgccgtttcagatgtgagcaaaggccaaactatgcattccgagacaaagcgcttctgcacccaaccctaacgaaagagttgtgaccgcgcgcgacatctcgctgccttccgatcgatcgacagcaagcagccaatgcgaccgaccgaaaacccgggtcgcacggcgctcgctggtgtggattgtggattttgctagcgcgcgcgggatggaggcacacggcacggcctggcacgcttagactaacacgctcgcttggtcaga

SEQ ID NO: 16941 - DNA, 486 bp, Oryza sativa
cccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatcttt

SEQ ID NO: 16942 - DNA, 488 bp, Oryza sativa
ccatgcattcagaaccccttagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcag

SEQ ID NO: 16943 - DNA, 1501 bp, Oryza sativa
cttgccggtgacgacgttcacgccggcaggacgcggaacaagatcccaggtgcggttggcgaggagagcattgtactcttcttccatggcggcgcgccagagcggatcggcaaggcccgcccggtatgtcttgggcaccggagacagcggggcggcatgaagattaagccgatgaacaggcttgtggtgaccggacttggcgcgggttgtcatgacgtggtcgttgacaaccggtgagattcccaggccggacagtggagttggtgcgccggtagcacgaactgatcgaaggcggcgcgggacatgtggagctggcgggagatgcgggccgtccagtcgaggaaggccgggaggagccgggcaggtggaggctgatggagccggcccagctgaaggcggtccaggtgaagtcgacgccggcccaatcagtgcaggggtgggggaaggcggcccgagccggctgtctggggaggacggcccaccaggtgttgaggccggcctggtgggagaacagggtggcggccgctcaagcccatgcaccatgggcgagctggccgtctgtgttgtcggcgccacagctggtcgacgagtcgctccaattggtgcctgtgctggagcagtgaaatccttcaaaaaatcgagatcagtagcattggagacaccattagtgagctcagtaaatggaaacgagtgctcatcaaacacaacatgccgtgaaataataaccctgttggacaggggatcaaaacaccgatatcctttatggtagagggggtagcctaggaaaacgcacatggtggaacggggggcaagcttgtgcggtgtggtggcggagaggtttggataacacttgcaaccgaagacacgaaggtgcgaatatgagggatgggtaccatatagggcaaagtgaggggtgtggcgatcgagtgttttggtggggtgtcggttgatgaggtgtgtggcggtgtgaagcgcttcaacccagaaggatccggggagcttggcctgaaacagcatggagcgaacaatgttattgagggaacgaaggatgcgttcggctttaccattctgaggcgaggtgtgggggcaagacatccgaaggtgaacaccattggtgagaaagaaggtgcgagcggcggagttgtcaaactcacggccgttgtcgcactgaatgctgcggatgttagtggcaaactgagtcttaacataagcaaaaaagtgggacaaggtggtgaaagtgtcggatttaaaacgtaaagggaaagtccacacataatgtgagcaatcgtcaagaatgacaagatagtatttaaacccggaagcactaacgacaggagatgtccataaatcacaatgcaataactcaaagtttgtcgatgcccgagaagtagaactagcaaagggaaggcgaacatggcggccaagctggcaagcgtgacacactccggtgaggtcgccgcgtgtcatagggacgacggcagcgaggcggttgagggcgtcg

SEQ ID NO: 16944 - DNA, 1501 bp, Oryza sativa
aacataataacgacattgatagaaattaagaagggcatgcatcatcggaatcatttcgataataactaccccctccgtccctaaatatttgatgccattgacttttttaaacatgtttgaccgttcgtcttattaaaaactattaattcttttcttatcatttgattcattgttaaatatacttttatgtatacatatagttttacatatttcacaaaagtttttaataagacgaacggtcaaatatgtttaaaaaagtcaacggcgtcaaatatttagggacggagagagtatatggtacctcgcacgttgttacgagaaaattatgataaaaatcaaagatatgagttgtaaaagtttcttacttttttactatatgattttctttcatgtgcttatatattttatatcttgatcaattattcaaaggttgtaaatgattaggttgtatgggatgtcttttgtagagaggagatgtaatttgcacttttgatgaatgatccaaaagctaaaaataattaaggtgatgtggctccataagagagagaattaacattaactatacttagtggggatgaactttatagatacataggatccgtttgatatgtgttaccaagaaggtcaaattcttatagcctaatataccttttttagattttaggaaaatagttaattaagttcagaattgtatttcataactgaattcaaattaaaagaatactttgcaattccaactctttcaaactttgtttagggttagctctacaatgttctatgtcaggtttgtttccgccatatattttcccatatatatacgcccatctgagaaaacattcttcaacccatccgtgacaaagaaaccaaccaaaaccacaaaaaaaaaaaaacttgcgaaatgcccagtattgcacattttgctgtacaacaattcatcaaaatgctcactgcgtggcaagtccagtgtcagtgtcttagagcatccataatgttcatacaaaatgagtagtaagaagtcttcgtactactttacctttagagaaaatccatgaaatgccattgacaaacaccctaatccaagaaatgccatcgacgaacgcgacttccagcaaatgccatcgtacgagccattttgtcccaaaaatgccatcgccgtcactttcactctgttagacaccgttaattttgtcaaaatgaccaaattaccctcctcaacaaaggataaatccccttctcttccatcccatcgccggccactattcctcccctccacttcaatcgccagctcccgatgggcgacagcggcaaggcgacgctcccaggcggtggcacatcagttccaggcgtcgacgcgacgggcggcgaggaggtggcaggcggtggcgcggggctcccaggcggcggcgcggtggtcccaggcggcgcctgtggcagcggtcccaggcgtcgacgtgacgggcggcgaggaggtggaaggcagcggagcgtcggtcccaggcgg

SEQ ID NO: 16945 - DNA, 465 bp, Oryza sativa
tagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctt

SEQ ID NO: 16946 - DNA, 452 bp, Oryza sativa
atacaaagcacgttccctagttagatgtaggttaaacttcccgttcaaaaaactttaccttttacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcag

SEQ ID NO: 16947 - DNA, 1501 bp, Oryza sativa
cccaagttgcaagtttggagtctcttttttgtagcttgtggtacaccaagaagttctcctaagtctcctccacaaaaaaagggaaaaaaaggaactcataaaagataaattaccattgaaagagacccactttttgaaaacaaaaaaaaactcattaaaaaagaaacaaccatagcaagaggaagagaaacacagaggagtttacttttgcaaaatatatgcaactaacaaagtacatgggcctaccttgcaaaaaatgttctcggctagaagtctaatccaatataggccggcccatcttccaacacttgctttttcaatgttttcaactatttttccttttaagtttatagaaatacattattcttttttacaatcctagaggatatatctaatgaaatgacgtagagggttcggggcctagggacacgttagaaattttgcatataggccctttctgtccttctaatagacggttttcgagttaccgtctagatagagagcgggaaggacccaaataggattttaattttttttttacaggcgtacgtgattgtggcaaatgaagtcctatgggaaagacacagtttatcccactccctcgataattccatttaattccagcaaaaaccaggttctacacatatctgttcatgcaaacaatatgttaaactccaacccctccgcgctatgtcattggacctattcagtagagagattcataagccgctacagtagagtagcagaaattacactgcttgcagtgcagctatcaccgcagccggttgtagcatcctgctaacgaacaaacccattagagctgctctctcagaaggcggtttataaaaaagataacctcctaaagggtgggagaagtatattttcgtaaatttgtaaaagaaaaatatattactgtaatttttttaaaaaactctgtcttttatggacattgagccacaaaacaatacaattttgctatatatttgtcgataaattttctcctaaaaatttgacagatgtaatcacactataatcgtagtataattacatgctaacttgcatgtaattacactgtaatttacatacagcttacatataattcaatgtaactttcacataattttgaaccattatatttttttcaagatttgtacaagtgaagaaggaaaaaagtcactatgcgcacacagtgaaaggattcatccccacgacttccgtttcaccaaaatcatgttacggagagatatttgaaagttacatacaagtcacatgcaagttgcagtgtaattacttctcgattgtactataattacatctattgacaaatgtataggtgatcccaaacaaggaaaaagtacaccgaaggtccctcaacttgtcatcgggataaaaaacgtcctcgaaccgcaaaaccagatatgcggggtcccttaactatacaaaaccagtgacctgaggtcctttgagtggttttgacctcagttttagcctatgtggcgcg

SEQ ID NO: 16948 - DNA, 1281 bp, Oryza sativa
agcaacccagctatattcccaaactgacttgtgttttattgtactgagatactactggatggctgcgaagatgtatgcaaaatgttctgatgactaaaaacatcgagaaccatgatttagtcttgagacaatatcacgtcacgcagaatgggttcaagtgcgacaatcagcaagtgtcttgcattgtctcacattctgtgtaggggagttgatcaggcctgatttatttctattagcatcggaggttagttgatctaatggtcaaagacacgttgatctaatggctgagatgattctgatgacgtggctagctgagagatcttctttatagcatcattgcacttagtgggttccaattatataggaagaatggatttgtaatcaagttgttgtaatcaagttgtaattttatagttagcagttatttgtcctctaaattttatgataattggtttaatcttatttagagtaaaggtgggaacggattctattattaccttaaaaatattgttacttactataaaaaatgcatgtgcgttagaacggaaaaaaactaatgttatggtaatgatctatctatctattaacctattaacttaataaagtaatagaaaaaattagcctccacgttagctctccaagaactagaaattctcatattaattagagtataataaaaaaataaggagaactcatttaagacaaggactctttttttcctttttttaaaaaaatcatgttatatatgtgtagtgtccgatcgaatacctgcatagaacaaatcttttgcaaggaaaaaattacctgagctggatagactaatctctctatgtaagtaatacaacataatacaaagtattcctattttttatttttttggtggaatacaatttaagaaaagaaattaaattcggaatttaaaaataagaaatattgatagatgagattagagttcatatagaaatacaattaggaataataaaatttcagaattaaaaaaataggaatactggaagaagaatctagagtccatacagaattaaaaaataattaatattattaatttttagtttaaatttaaattatatatcatgacaaataaataattacatttttttactccatttagctataaatagtttaatttggagaagaaaaaactatttcaaattttagcaatttttaatgcagaaacagtttaaatcgattgagaataaataaaacgtaattaggcccatatttagaaggacggctcaaatatctctttttcacatcatggca

SEQ ID NO: 16949 - DNA, 1501 bp, Oryza sativa
aaaactgtactctctctgttccaatttacttgttatccaggcaaataccgtgcaaaccatgaagatgtgaaagattacatggttgcccttgtcagatacatcttaattatcttttcaaagtagatgagccaattatgaccgcatcaatatgtattgctgcattactgtaggtagggagggaataatatcgatcacctttaaaatttctttggatcgagaaaacgacaaataatttaatataaaattaaatcctagaacgacgacgatgagtaatatgaaacagaaggaagaacatgaataagcagtgcacattctagttgttcctgcctctgcttaaatccttccatggcctttctccatttgagttatgcatgtcccggcgacataggaggattgtgtcccccgtttgggccgcctgaaatgtactcatattaagtatggacttgaagagttggagtgatatcaattccaattaaatcatatgtacaaaagaaaataatattcactctggttaaaaatatgtgtccttttggttttcaagaaaggtaatgcattttttaatgtaaaatttagtatccttaagtacatcagttacctgagggagaggggaccgacctgagaggtgacgagcagcaagagctccactggatttgtaccgtcatctaggtttggagcctgcgacaacagcgaggttgagcgaagaacggatcactgatgaggggtgagctcgagagcctggcaacgtgccgttctcctcttgtcgctgcagccaccgccttccttgacgtctgttctgtcaccaccgccgtttcttcgatggcggcggcaacagagggcgcagcagcggccatcgacgatggtgacgaaggatgtagtggcggctgtaacaccctaggtaaccacgtacctagagtgccacaccaaaatacactcaaaacctaagtcccaaaattattagaaatttcggtaaaatctcccctaaaaaatacggacatccacgacaggcagttataagaaaaatcagtaccgatataatccacacaatacaaaccattctagctccacaaattccatgtgaaaacaggtagttataagaaaagtcaataccgatataatccacacaatccaaaccatcctagctccacaaattccacgtgaaaataaggaccagaactttaaatgacctttacaagttcaacgcaaaacttgtgctatgcataaacatagtctaaaactaaatttcaatagtgtgcaataataaagtgtagtccaagggtgctactcccgccccatgccgatcaatgtcattaggtacctaaaaaccaaattaaacacaagagtgagtaaagaatactcagcaagtacaatattgaactagtaaaacatacacatgattaatgcaataagaaaccaatatgaagggttggatttactttattttaaaccaaagaagtcaaaagatagtagttccctcctgagtaggtatgaatatcctcttagc

SEQ ID NO: 16950 - DNA, 1501 bp, Oryza sativa
attgtagaattaggggggcacatatatacaaaaaatgaaaatttttgtgcgaattgagaagttgtattaatcggcacaaaggattgtcaagacagtaaagtactagagtatcttagccgattacaaaaaatttctaaggtctattacacagaaagtcaccaagacaagtattgctggatagctgaaatagccctttgcctaatttgttctacttcttcaatggcttgagcatcttgagcatcagttccagaaataacctttagggacttggtcagatcaacaacattcttgagttttgctttctgctcttcgacagactttgggagatcggctatttttttatgttctatgtccagctcagcattgcattcttcaagttgtgccaagagctcgatcttgcgagcttcgagccggtcaatattggacctaatcggaccctcaaatagttgatcaagtttgaccttttcttcatgcacaagctgtcgattgacttggattgtggcttcaatctccttgcgcttccaacgttcggctagtcttagcttggtttttttgtaacgccccgatttttgttcgggactaaaaatcattaaataatgcattttctagaaattaaataaaagttaattcaatttaattaagtgaaataatgggagaattaaaattttcctttaaaaatcattggccgggaatattctgtaatattctttgtgccctaaaaaaactctctgaaatttcctgcgaattttcggagctcgagaaataatttgaatagcacaaagttcattttatcaattaaaataaaaagaaaacaaaataaaaaatccccttcctccttgggccgttttcggcccaagaatccttcccctcccgcgggccgcgcccctctccttcccccttcctcagtcggcctcccctctcttctcttaagccgtcggcccatttcaccttcccctcgcgtaaagtctaaataaccccctgactcccctccccctttcgccgacaggtgggcccgaagaccccacttgtcagctcttccttctaccttcggcctccagagccgaagccgccatgccgcgcatatgccgccccacgtcgcccacgattccagcctctcccgcctgcgccctcgcgcccaaaccacataaaatcgcccaaaccattcaacttgcaaaattcatctaaaattgagatttacatgtttgtttactttttatgtactgtttccttggtgtttattagagtttttcctcgttttgcgtgccaacatgtagtttccgtcgtttcggaagttcgcggtcgcgaggaaaagtgttcagaagatccaagtgaagaagcaacgcaagtcacacattccccttgagcgttttgatcctactttacaaatgttttaccgtttgcaaataaatatgcatgttttgctaattacatgggatgtgggtattacctatctgctcgcttgtgccatgtttacttgatatctgtcctttgtcaaccctgg

SEQ ID NO: 16951 - DNA, 1501 bp, Oryza sativa
cactctcccctcgcagcatccaccgtcccccatgcccgatggatgcccaaggaacacaatgagtgcaccagccacctctctctctctcaatcccccactccactcttccttatttcccaagccaaagcaccggaagcaacagcacactccccacactcgcgttccaagtccaagaaaacaaaccccacgcacagaatgcccagagctcggccatcttccccggctccggagacttagccgtcgtcgtcgtgcatccccggtgagtccctctctcttccctcctatggaacgtgacctacgcatcacgccgagctcacccgtaccccttttgccctaggaccaatctgtcgagcacgtggtgggcaccgtcctcgccgccggccacctgaaccgccgacgccgctccggccgccgttcctcaccaccgaagcaacaccaagatccggtgagtttctgtcggattcctcgcgcatgcaccctctgtggctcatccctaacacccccatactctcgaagttgcagttcgcgccttgagtcgacccggcgacgtcgatgccggagttttgccgccgttggccaacaaccaccgtctccgccactccctggacctcgctgcctctgtttctctgcttggtgagcaccctggtaccatatgagagcacatgcactaaccctttgcactaaccaagcctctgcatgcacatgcatgggcataccgagacacaccgccgctgtagctcatgttccatgggctacagaccaccattgccctcaccaccaccactggcggatgcgcaagaacgttctttacattttctcttttgtgctcgaaccgattcgatccgtcgattgccgccggtgaggcgtagaccgagctcagccatggctgctcctgatgtgagctagctgggaacttcatttcttgaatttgatcgactcgatctagggtccaatctgaaaactgccatgactcatattactatagcaggaccttgatggaaataaacaaaatcatagggactcttaataaagtttgctgtccaggtggcagaagaagtgcgggttgattcccccaacttccgagggcctctctgcaaatctcctttcactgtcctgtggacccggctggaattcaatttcgaaaattgatttctattttggtttaaagcagagaacgagcagaacttctaatatttgtagaaaattcattttaacttcaaaaattgtgaaaccacttctgttaaccttctaaaatcattctcagtaactttgtaaaaggaattttgttcatttctgtacaaaaatgttgcttaataaaacttagccctttttaaacctttttaattgtaaaatgcatatctctgtaaataaaaaagtgacaaaataaaaattccttcaccagaaaccacctaagaccagcacacactcactgcataagtttcatgcattttggtttttatgcatttttgtatttatcgtatacgcgtattttgtatagagg

SEQ ID NO: 16952 - DNA, 378 bp, Oryza sativa
ccgattcttccctgcttcgccgggttcagcgatattaaaacctccaaattccgcttgcaagattgtgttttcgaggagagaaatttttcggtagagctttggaaaattccacatgccacatattttgtccgtttgagtttattttttttatggttggttcttttgagttcctaaacgtgaaaaaaatattagaaaaataaaataaaaataaaaaagttgcacatctctctcctctgcactagttcggagagagaggagaggagaggaaaaattctacatgccacatattatgtccatttgagttcattttttctatggttgctttttgtgtgtccctaaatgtgaaaaaaaatatcaaacaaataaaagaaaaaaaaa

SEQ ID NO: 16953 - DNA, 1501 bp, Oryza sativa; identical to SEQ ID NO: 16835

SEQ ID NO: 16954 - DNA, 1501 bp, Oryza sativa
tcatcagttggtatcagagcatcggttgcctggtgaggattttagtttgcaattttatttcatttacccattgtctaccatatagccacaccattttttttccatcaccaaacattagttttgagccacgcaatttcattcagttttgctttattgagtttctgtccactgtcgagtcggagtgctggctttagtcctagtttcatcctggtttgagtttgcatctcggttgtgctaggttgaaggaaaaaaaaatagcagatcgatccattcatgatttggtttgttgcttgcgcaaggaattatagagatctgtttcctctaaattttgagtcggtttccatttagttggggaatatctgtattgttttcctcctgttgtgcgcaacacagaaactgagtgggtcccgtgttatctcgtgcatgcaaatgcaagtccggttttcttgcatttcagtttctttgtttcggtagttaatctccctaattaccttggtgtgtttccttttgtttagccatgcatgcaagttccatacatgcacgtgaactcctcttacagtaatagctagcagctgcttgtatttgtgcatgcgcgcacgcacttgccacttgttaaagaaaaaaaaaaggaaaaaaagaaaaaggtatcagaggtgcaaaaaaaaagaagaaaaaaaagagccgcaccaaaaaaatcagaaaagggaaaaaattaaaaaaataaaagagaagaaaaaaaatcagaaaaagaaagtgtgatattttttttgttggaatcttggagagagagttgcttgttatagctagttgtgttttgtccgagtatgatcatttgcttggttaagctaggattgagtctaggctagaccagtaattttgactagtactttggactattattcaattttcgtatttctgtttgatttttgctattccttgtgatatagtaaagcctaccaagatccacatactactaacctttacaggtccggttttgcaatcgctccactcatcaagcgtgtcattgtgccacgaaacagccatggtgattgacctgttttgcattctttgagaatattataagaatttggtatatgctttagtgttgagtgccttcaaaagctccacatatctatatattgttaggaactgacactttcttgtgagtttcttttgcttgctaacgatgtcaggtacaagttccgacgaaccaacactggagaatctagcgcataaactgaagggcatggaaaattggtatgaagagttgatgcgtaatagtaaatcatacaatgaaagcacagataaacatttaaaaaccttaagtgaaagcctggtgaaagtagtggatcaaattgagcaaatgaatcaatcacataaacaattaactgaaaatattcagaatatgaatattggacatgaaaatattgtgcgacacattggtttacttgaggctgcaggtgaagaaggtgcaggtgccactgctcatcgacaccaaaga

SEQ ID NO: 16955 - DNA, 491 bp, Oryza sativa; identical to SEQ ID NO: 16611

SEQ ID NO: 16956 - DNA, 1324 bp, Oryza sativa
aaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggcgaggcgagcgagcgcgcgcgtgtgtttcccctcttctctccaccacacatgcttcaagtgactaggagggcatcctcccttttaataaggtccccctctcctagaataagcaaggtggtactaaactccacatgcatgccatcccatgaggtgggcttttgtgattttccaaagaattaattttcgagtgggctaaggcccattcattaattccaacacttggcaatatgtatttttcataaaagaaaaaagaaggagaaaggacgtcattgtacaacagtgatcgtgtcatatgctagctgtgttcttcactttctgttactgcttttcaacgatgaaatggcatgcatcaatccatgcatgttgtacatatggcagaagtaacgaggaaataacgactaacaagaaacatactttaatttgccatttgatcatcatcatcatgtgtggccaattgggcgtcgttgtttgagttaatgggctgacaaacagatgtgtgagcatcaattccagtgggtccgaaattcgggaacatatcctatgcatacaagcttcctgtgcacacttcatgcataccaactagctagcaaatatcacagagaattctagaaaaaaatggacacatgcttccaatagtattagacatatctgcaaggtgttgtattcaaatttattatattttagccgtaataaaacggtgaaaaatttgacattttttagggtaaaaatatgtcagaattttgtctttttttgttacggctaaaatataatgaatttaaagataacgtttcacacgttggtgtatactattggaagtacgtgcctaattttttctagaattttatatgacatttgttagttggtgtgcacggaaagctaatgtgcataggatatgttctcccgaaattctgatacatctacaaatttgggcataatataatttcaccccctcgggcctgaaatacttttggcatgcttccaatgagcccacgtcactacaggatggatgagatttgaaggcatctcttgttggagccatttcttaaaaaatattaattaccaggcaaatttaattcattccttcaatattactgtcattagtaggtgtttttctcaaaacgcctcaaaatctactgctactgctacttgtgctaatctcgatgttaaatatacttttcactcaattttagg

SEQ ID NO: 16957 - DNA, 1501 bp, Oryza sativa
aaacataaagagtctcatgaaagaatcacatattcattaactaataattagttatctatttcaaggaacaatgtcgaataaatatgtaaacatattatgtgatacaatcatctctatgattgcctctagggtatatcaccaacagttaagaaaaattaatgcaaggtaatcttaaaatatcataaatttgttatctactcccagtaagtttgtaagggatagtgcttaatttgatgttattttttatgaccttcaactcagtggaacctcagactctgcttttgttaggagtttgtgacagacttctgcttcgttaggcgtttgttacagcctctgcaccgaatacctgctttgttaggcatttccactgagttcgaggttacaagtgtggaaatgcctcacagtatgatttgattttacaagtgacgtgtaaatctacgagtaacggagtactaaatagtggattcatgttaaaaccatgtgcgcatttaaaatgtggcaaatggttcatgccacaaaaatgccataaaccaatattataaattacatgtatttacaaacttcgtgagtgtctttttttttttcattgcaaggatgcgtatgaaccatcagcgtgaccttttaatgcatgcacgcttgacaaacaaataacttaaataaaatatgtaagcctgaaaatcttatcaaaactgtaagatcaaagtgtgttttgattcttattctgtgattattggttttgatatttggagattatcgtcgaagtggttttggagataatcaattttcaggtgatgatcggattcactgttattttatgtgtccggtacgaccgggcggaggttgctggtcagaccggcgctatgtgtgcggtcggaccggccggcccgctatctgaccggccgacgctgtgtcggttttggtttcgggttgtttctttagatatccgtgattgtttcagagttatggcttctagatggatactatacatatgtaatactgttgtttgttaacaatgagtcaagttggggatagcttgatctcggaatatagtttctttgtttgtttcatgcgtaggtgactcgatgcctcgggagagtatttgcggtgatggaccgggagtcggtttggtggtaagacgatgtccgtggtggtcagatatcatgagggatactaagactagagttgatgcacgtggttgatggagattccatatggcatacaatggaggtattgtgtgcgtatgggatgcagagtcgaatttggaaggagttcaaatttggtatgattggttatgtaaagtttgtttcttgtaccagagggtttcctaaggtgtttaggactcttagtatgagtttggttcgtggctttaggctgcctacgtcatgtataaatagagggggagcgtgaggctttccggtatcgcttttgtattgcttttgagagcaattgagttgctagtttagttagggtttcgagtttagtcgagatttttgtaaggagt

SEQ ID NO: 16958 - DNA, 1501 bp, Oryza sativa
caagttataagcatggattttgatgtttctcctctgataatttgcattgtttttgggaagtttgaatatttgctttgtgctgatgacttctaattactaatgatgtaattcataaattttatccatcagcatatgcttgcttggacggtttgttatttctttttatttggacatacgtagtttgcttgaaaattttgatgtggctaaaagagcatttggtttcttaggaagatgcctgatgctaatgtcttctcaagcttttggattgtaaggtgcttttcatgtttttaatccagtgctaatatccatgttttaaatccttttcatcaccattgtggatatattatttatttgtagcttcacgaaaaaagtgtggactccaggattaaattaaatcttaaaaagatatacgctattccaatttcagattatgccttttccatgatttgatatgtttccctttttccagtctaatagtggaaccctttccttgtgggaattccatgaaagatattggtctccagattttaagattggtagatcctttcgtggctgccacttcaactgcaggtgtgtgcatagtttagcaatatgaccactttagattaatattgtggtcaaggaaaatatagaggcgttttgacaaatgttagtgtttctggaatgttcacacttgctatctacttttttacttcaattaaggcaactatagacaatattctttttgaaattatatgtgatgaccatttcttacaagtgaaatggatgtaaatttgtgttttgtagatcacgtgaacttctgtggactcacggcaggagctgtatacacctcattggtgatcatgtaaatgctatttttagttgctggccatgagggatatatttgaagtattgttggtgaagatctgagttttttttcctgataagatattgtaggctgtggggtttaattcaataccataaatacaaatatcttgctttgagcttttcaagtgtttatcaagctatgacaaattatatgtttggtattgttagttgctttgcatttttttattgtttaaaggagtatgttaagttacattatagtacatatagttcttaaactttttagtatgttgtatattttgcctgacatatattacaggaaaatgcaagaaatttgaagtgtttttatatgattactatagttaatataggaaacgtgcattgcacgtgcacgattactagtgttagtataggtccccacatgttcaatgtgaaaactctgcgaaattttatagacccaactgcaattaatcaatgaaccgaggtcaatacgagtcatatcgtgctgatatcagcggtgttaacgggatagaaaacacgatcgaagatgattatgttcgtctgcctgatgaaattgtcattggttatgtaaacattgaagattcagtgaacgcactgattgaatatgtgaatatgtgtttccctcacttaatgatgagagatatacgacctccgc

SEQ ID NO: 16959 - DNA, 489 bp, Oryza sativa; identical to SEQ ID NO: 16613

SEQ ID NO: 16960 - DNA, 681 bp, Oryza sativa
taatgttttctaagcatggctaagcatttatatatataaagcatttagttgaaccaaaccaatatatagggttctagctaatcgaattataacccataggaaaatagagtcatcttcgaccattaattaattggaaaaggctcaccacccgatgagattcaaaaataatgcataagttgaaataaaacaatagctttaaacgggttcaacatgctcaaagggttgtttggaaactgtgtgacttgcttttgaaacaagcgtcttcaattcgtctttaggaacttctccaacgaacgaacgatcctccgaaacaacggaaaacaaaaaaaaacccccttcctttaaaaagggaaaaaaaaccccggcccaaaaaaaacgagaaaaaaactctaataaaaaccaaataaacagtacaattaaagttcataaataggtagagcttgaatttagatgaattatgagacttgaacgacctcattccgagttcgtatgaattaaatatgaattttacaaaatttaatttcaattaaacctattaaagaaaagactattccaaattgattaaacaatttacaaatgacttatagctgtgacaaaagattaaaacatcctccggaaatagattaggtcatatttggtagatgacatatattaaaaaggaataatatgccattgaaaaga

SEQ ID NO: 16961 - DNA, 1501 bp, Oryza sativa
tacccggctgtacagatctaactccaaaccaggagctaagcaaattattaccagttataacatcaatacttattgtgagaggtgtgggactaatcacgaaaaacattgctcaactcgcccataaccgcgggcacggctattcgaatagttttactctggccagaggtgtaccactgtacccacaagacacagcctcaacatcatgtctacgatgcgtcgcgatactagaaagtacccgaatagaggctgtgacaataccctctgcataacacaactcaccacagtgcatcattcctggatcataatcaccccctcaaaaaccagaggcatggactccccagcgacccccgtgggcttatctcggccacttctcagtctggtgctccgcaatgaatcatgctatacaaaaggtaaagccgttgcccacgctggcttgtggttggcacgattaatgtttcacaatagtagctcgcgaaccggtccttaattgtcatgagcacgactctcaaaaccatgtgctcacaacccaccattatcaagttttagttggcaagtaattaaccaatcactactgaccatcgtgagctaccattaaatataaccataaatgatagtgaaacattagttatcccaattgtgtgctaatgtttctaagcatggctaagcaatcatatctaatatctagctgaaccaatatataaagctcaactagtcaagttataatctcccaaggtaacaaggaataaagtaatcaagaacaaaagggccatatcaaagaataggttaattccacccaatggcattcgaaaataaatgcacagttgaaataaatagagaatttaaatataggatcaacatgttcaaaggattgtgtttaggatctgtgtgacttgccttgcaataatcggtcttcaattaatcttcttgaacacttccggcgcactcgcaaaccttcgcaacgacggaaacgacaagctaacacgcaaaacgaagaaaaagactaataaaaaccaaataaacaatacataaaaagtaaacaaacatgtagatcataattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatataacttttgcaacttgaaccacattaaactgagttcaaatgaattagttatgaatttttaaagattaaatcggattaaaacacttatattgattttaattgaattatgacgcaataatgaattaattttgaaaaggaaaagaaggattattgcgtcagcggctagggtttgcggtggaccgggtgcacggcagcggttcacggaaacgaacggccgagatcaactctatccaaaacggacggccgagatcgatcggtccacgaccggctcacgggagagggcgacga

SEQ ID NO: 16962 - DNA, 489 bp, Oryza sativa; identical to SEQ ID NO: 16613

SEQ ID NO: 16963 - DNA, 1501 bp, Oryza sativa
gaggatccttcgtccgctctctgcacccctcgtccaccagctagcaattagcatcgatcagtgacgcagtggaggtgaacatgcatgatccatccatattccagagacgattgcaactcgcgactcgtcggccggccactgatccatgctcagctcatctctcctagctatagctatagcctacttagctatagccagggaccatccatccgatccatgcttgcttgcatactcctcgatgcatcaagtcctgatcatccatgtgcatatatatgcaactctcgattcctggttttgtctttcggactccatccatatatcttcagactttgagtttggagccaatatatgcaatgtcagactgaattttgatgctacatatggttgttgggagtaacttatggaggtattcatttcattggattagtgtaagatatgacgcactgctagtagcctagtactattatagtaggctatacacggattgggtacgtagaccctatacacatccatgtagtagtagtcttatcatcagtggatgccatgttcttccttttatctgcaatgcagcttgcaaggctttacctacctaccatgcatcactgacctacgagagggttgcagtatttatatcgtggttaggtctaaattccttctgttctgtgctcacccggtcattgagttaggcggaggattattctcgattctttctaggatctccgtcgtcgattcgggccgttttgatttatagacaatgatagagtatctccgttttaaaatatatgatactgacgttttaactttggtcaaagtcaaattattttaagtttgactaatttttatagaaaaaaataataatatttttaacccaagacaaatatattatgaacatttattcaattatagatttaatgaaactatgctgatgctgtaaatattactaccttttatttaaagtagtttgattttaaccaaagttaaaacgtcctataacggaatatttattttagacatatcattcaaccattcatcttgttagaataatacttattttattattaaaaagtacttttgacgtgcaatctttttacgggtttacgaaaaaatatttttaaatgtactttaaatatgatttatatccttttttgcgtcaaaaaaattatatctttttatatttacgtcaaatttaaacatatagtcaaatattatatctaaaaattaaaagcgtcatatacatgtagtattagcagctagtgcacagtgacagttccttggatactctcttttgctttgaggtcgatcgatatattgatcatgattaaaaatcacaagcagagtgggggacagttagcgacgatttgcgagtcaacatgcgtaatattcattcttcgagcatatatttcgtcggtgacttcgagtcttcctaaaaaattcggcgactgaattgactggattaacttgatccacctttgtgaaacaattgcatcgtcatgtggcgtac

SEQ ID NO: 16964 - DNA, 1501 bp, Oryza sativa
ttataaatcacttagatcgaaatatatactaagaacaagattatatatgctcatagcatagccgatcacatagatttagcatgtatcggcaaatactgcaataccactctatattaagatattaaagcaaatagaatataccaaacaaagagcctaatatacttaaatacaacaagatcttaatatgaagggcagatttaacatgtcaacaaagcatataagataaatatggttaaatcaggtaagatcagctgaaaccccgatactaccctaatcggcaaccaagaagcaggctagagattgagattctaatcacgactcataagatcaaactcaactgatgtagctataagtatgaaaagaaggacaatatctagacaatcaagccattggaagtttcatagagtggtggatatcatatataatctaaatcaacatcggtatttaacctaatcggctgccttctagtagcagatgttagccgattgtaggttagatagcgatattgccagagattatgtaagatatatgataattcaacgaattacataaacaagattagagtatcataatgatgggatcactaatcccgagaacgcaagccgccataacaagttttacctcttgttgaagatcgaaaccgatgcagctcaacccgaaagcaagaactcgtcgaaacaaaacgaaagtaaaaagggtggcaatgcgccgagattgtattaaacgtgtgttagtttgattacatggggttcgggtctatttatacccgagaaatacaagatatgtccaaatcggacacgactcttatctctaacaaactctaagataccataagtccttgcggcaactttttgcccaaacatatctgtaagaaaatcacataaaatatcctaattaatagatataattgccttctcaggactttatccatgcgtggcaagcatcatgaagcacatcaacctaaaccgacaacgtatgctatgtcatattgtcgggttcggctcaatcggctaaccccgtccgacctgaactctgccaaccttagccgtagccgattcggacttcagctgatcctcactcgatttcttctcgatttcttcttcatctccgatccttggattactaaatttggtcgttaacagtgtcataccaactaggactaaggtttttttctttctttttcattgttcttttgctatttgcatattgcgcaaatcattacagatcgaatgaataaaataaacaacgaaatccatgtccatgaaaactaatttatagctacacttcttcacatctacaataacaaaatcatccatgttcttgaaaactaattcataggctacatttcttcacaactacaacaacaaaatcatccatgttcattacacttcttcacaactaaaacaacaaaatcatcttcttcacaattacatgcattcatcaaagaagaacaatgcattcatcagagaagaacaaacaaaaagagagcgccgaggggaga

SEQ ID NO: 16965 - DNA, 1360 bp, Oryza sativa
atgaaattttatctggcccctttttatattgagatttagcaaattaaaattagatcttctcttttaggcttttaaaatcatttctaataattccttttaaacaacaatttataagttaaggatttttaaacaagaaaagctcttaacaattatacttagatcattaatgatcaaataattactgaactgttctttgtattatttaagaattgagctctgaaaaatccgagaaaatttcagagagttgacttaaccatggagaatttaataaaaaattaaatccatccatgctttagatttaagaaaattttatttcccacattttacttcacttgaaaattaaagatcatttaatataaattctattaataatttattaaataatttataaaccctgaaacaaaaatcaggatgtgacaataaaccaaccacgattgaccatcgtgaaatatcattaaatatccatcattaagtaatagtggaacattagttatcccaattgtgtgctaatgtttctaagtatggctaagcaattatgtctaacatctagctgaaccaatatataaagctcaactagtcaaattataataacccaaggtgatcaagacatagggtaatcaatgcaaattggccataacaaatgaacaggttcacaccacccggtgacattcgaaaataaatgcgcagttgaaataaatagagaatttaaatataggataaacatgctcaaaggaattgtgtttgggatctgtgtgacttgccttgcaataatcggtcttcaattaatcttcttaatacttccgacgcacttgcgaaccttcgaagtgacggaaacgacaagctaacacgcaaaacgaggaaaaagactaataaaaaccaaataaaaaatacataaaaagtaaaaaaacatgtagatcatgattttagatgaattatgagacttgaacggcctcattctaacttcatatgaattaattatgaattttacaagatttaatctaattaaaacccatttaaaaagaattaaataaatttaattcaatttatgggtaattttaatatgtagatctttatacaacttttgcaaccggaaccacattaaaccgagttacgatgaattagttatgaatttttaaagattaaaccggattaaagcatttatatggattttaattgaattatgacgcaataaagaattatttttgaaaggaaaaagggatttattgcgtcatcaaagacggtccacggtagaccgggtgcacagaggcggtctacgaaaccaactgccgagatctaatctaagccaaacggacggccgagatcgatctggtccaccacgggtctagcgctgacaaggcgc

SEQ ID NO: 16966 - DNA, 1501 bp, Oryza sativa
tacccggctgtacagatctaactccaaaccaggagctaaacaaattattaccagttatagcatcaataattattgtgagaggtgtgagactaatcacgaaaaacattgttagacctgcccataaccgcgggcacggctattcgaatagttttactctgatcagaggtgtaccactgtacccacaagacacagccccacaacatgtcaccatgtgcctcagtaccaccacggtacctcggaaaggagctgtgacattaccccttgcataacacaacccaccacagtgcaccgttcccggatcatagtcacccccttataaacaaggcatggactccccagcgacccccgtgggcttatctccgccacttctcagtctggtgctccgcaatgaaccatgctatacaaaaggtaaagccgttgcccacgctggcttgtggttggcacgattaatgtttcacaacagtagctcgcgaactggtccttaattgtcatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatataaagctcaactagtcaagttataataacccaaggtatcaaggaataaagtaatcaatgcaaacaggccataacaaaggaattgattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctaacacgcaaaacgaagaaaaagactaataaaaaccaaataaacaatacatgaaaagtaaacaaatatgtagatcatgattttagatgaattatgagacttgaacggcctcattctgatttcatataaatttattatgaattttacaagattaaatctaattaaagcccatttaaaaagaattaaataaatttaattcaatttatggacaattttaatatgtagatctttattttatacaacttttgcaacttgaaccacattaaactgagttaagatgaattagttatgaatttttaaagattaaatcagattaaaacacttaaattgattttaattgaattatgacgcaataatgaattatttttgaaaaggaaaagaaggattattgcgtcagcggctagggtttcggtggaccgggcgcacgggcgacggttcacgggaacggacggccgagatcaaccctatccaaaacggacggctgagatcgatcggtccacgaccggctcacgggaaaagggacga

SEQ ID NO: 16967 - DNA, 1501 bp, Oryza sativa
gagccgccgctgccgcctgaaaccctagcgcgccgccgtcgccgtttccttccaaatccggccgctcctttccttctccggccgaattgattgaggggaaacaatctccgggatctcctctaccttttctcctttggaaacatcggctaaatcgttttggaagttcgtggaaatagagttcgattcggatcggcctctttccttcaagccgcgagctttccttctcgtcgccggccgccgtgggcctttgccgccgcctccttgcacctatataaggacccccgagctcccctctacccgtcgcctcctttgccttagcctgccgtcgcgtctagcgccgcctccgcgtagccctagttgccgccgtcgttgccgtcggttcagccgcgccgcgccgccgttgcagtcgccgtcgtcggtcgccgtcgccaccatcgggttcgccaagtcgtcgccgtccccgtccactgcttcgccgccgccgaagaccgtcggagtgccgtcgccgtcgtcgacccgaagagcttcgccgcttcctcctcgtcgccgccgccgtccgttggtcttccgccgccgttttggtcaccggtgagttcgccgcgtcgtcctctacgtgctggtgccctccgtttgtgccgaagtgccgccgttcgccggcgagcgtgcgccgcccgagctgtccgctccgccgagccgccgccgctgtcggtgacgtcatcgctggcgtcatcgtcccttttcccgtgagccggtcgtggaccgatcgatctcagccgtccgttttggatagggttgatctcggccgtccgttcccgtgaaccgtcgcccgtgcgcccggtccaccgaaaccctagccgctgacgcaataatccttcttttccttttcaaaaataattcattattgcgtcataattcaattaaaatcaatttaagtgttttaatctgatttaatctttaaaaattcataactaattcatcttaactcagtttaatgtggttcaagttgcaaaagttgtataaaataaagatctacatattaaaattgtccataaattgaattaaatttatttaattctttttaaatgggctttaattagatttaatcttgtaaaattcataataaatttatatgaaatcagaatgaggccgttcaagtctcataattcatctaaaatcatgatctacatatttgtttacttttcatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatcaattcctttgttatggcctgtttgcattgattactttattccttgataccttg

SEQ ID NO: 16968 - DNA, 1501 bp, Oryza sativa
cccggctgtacagatctaactccaaaccaggagctaagcaaattattaccaggtataacatccataattattgtgggaggtgtgggactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagtgacccccgtgggcttatctccgccacttctcagtctggtgctccgcaatgaatcatgttatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccgatcacgattaaccatcgtgaaccatcattaaaccatcattaaataataatgaatcatatgttatcccaatagtgtgctaatgtttctaagcatggctaagcaatcacatctaatatctagctgaaccaatatataaagctcaactagtcaagttataataacccaaggtatcaaggattaaagtaatcaatgcaaacaggccataacaaaggaatagattcacaccacccagtgacatttgaaaataaatgcacagttgaaataaatagagaatttaaatataggatcaacatgctcaaaggattgtgtttaggatctgtgtgacttgccttgcaataatcggtcttcaattaatcttcttgaatacttccgacgcactcgcgaaccttcgcaacgacggaaacgacaagctaacacgcaaaacgaagaaaaagactaataaaaatcaaataaacaatacataaaaagtaaacaaacatgtagatcatgattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatataatttttgcaacttgaaccacattaaactgagctaagatgaattagttatgaatttttaaagattaaatcggattaaaacacttatatggattttaattgaattatgacgcaataatgaattatttttgaaaaggaaaaggaggattattgcgtcagcggctagggtttgcggtggaccgggtgcacggcagcggttcacgggaacggacggccgagatcgatcctatccaaaacggacggccgagatcgaacggtccacgaccggctcacgggagatggggacga

SEQ ID NO: 16969 - DNA, 1501 bp, Oryza sativa
atggaagggacgaggtttacgaggccgccgaagccacggatgaggtggtccagtcgctccggcgtcacctcctccttgaaccgcgccagcacaatgtgcttcagcacgccactcctccctgccgccggggtctccgctgccatcgccctgtggcttcttgctgcagtctcgctagcttctctgcgcgctctccctcttccctctgttctcgactcgactcgatcttctgcttgccatggtttagaacttagaagtagaagcagtgggtggctacaacctagaaagtggttgggccgttggggttggtgtgtagtagtattgtgtatccccacaaaatgggcaccttggtaagagcaagtttatggtctagtcactgatacaaaattatcatattatctatagctaatatacggctccatcatttcgcttattcgtagaacactgttacacaaaccctttgtagccccggtttacaactcctttagtccactgctgcacaaaccctttgtagccctagtttacaacccctttagtcccgggtagcaaatcggagctacgaatccgggactaaagatatatatttttttttgttatttgcatgtgcctcctccttcctccttttttttttttgctttttctcttcctggcgcgctcctctactttttttcttttattcgtttttttctctctcatctgccatttttccttctattttatagaaaaattaaaaatacatcgatgaattcaaggctacaacccatgatctcatggttcagaacaaactctcctaaccaattcacccatatgacgctatttgatttgagttcattatttgctttctctatatagctgttcaaattttgtaaacacaaactcgttatgttaatgtaggaatcatatcttggtactatgattcggtagtaacattatcgcagaagtgcagtaacacgatacgttactgcgaaatgtataggtataggtcgttgctgcgaaatttataggttgttattgcactctttacagtaacatcatgataaaattgcagtaacagagaacatatagtagtaacggtactactacagtaccaccgcttgtgcatagctaaatttttaaatctcaatcttgtgcaaaatacaagtgcaaaaaagtacttctctttgtctattcaaagatacatagcagcaagcttagtacaagtaaacttttagaattctaatctttaaacaataatatctctcacatcgcatattatttttagaaccgttttcaccataatgattagatccgtcatgattattttataacgttgttactgtggaaagtagtcgtgttactgcacattgaccgtcgtgttactacgctgttccagcaagacaagaactaaaaaaaaaagtaaatctcaatctttagagagcaatatctctcacgttatatagtatttttttaatccgtccacaccatgatgttcgtaaaaaagtacttaataaaactagatacatca

SEQ ID NO: 16970 - DNA, 965 bp, Oryza sativa
ggcacagcggtttggatgagggaggctgaaggtagaggaagggtctgacaagcgggtcccacggccccacttgtcggcctgaggggaggaagaaggcgcgcaggaacgcaaagcagacttgggaagggaaggcgcgctgggccggcggcccgaggagagaaggaaggagggggaggaatttgggccgagcccgaaagggaggaaggggaagaaaggagaattaaatttgttttctttttatttaattggttaaatgatctttgtgactttaaaactatttctcgagctccgaaaattcacggaaaattccggagagtattttagggcacaaagaatattgcaaaatattcccggccaatgatttttaagggaaaattttaattctcccattatttcacttggataaattgatttaacttttatttaatttctagaaaatgcattatttaatgatttttaatcccgaacgaaaatcggggcgttacagggggcgtcgggcccgagggtgatgtgttcgccctcctctttgtctccccgagggggttgggccgcttccgcctcggccccgagggctggggcgccccgaccccttgtggattttgcgccgcgtgtatgggttaggtacggcgctcacctaaccgcatttattgcggtttggacgagcgcgttacgccgcatgtaacgcagtgcagcgcgctcgtttatccggtctgtgaccagtcacagaccggtcagatcatgggttaggtggcgacaggcggtctgacgcacgcctcgccccatcccgtcaggacgagagcctccaagcactcgtccctagccggagccggcgtgttagctcctggagatggcacgttggttccggtcagatatatgccaggcttcatcctaaccattacaggcaagatattgtatgaagaagggcgaacatgcagattgttaaactgacacgtggtggacaagaa

SEQ ID NO: 16971 - DNA, 328 bp, Oryza sativa
tcagaagatcggatttattgcaataatatggtgaaattaattcaatggcaattaagctaggaaaaaaaaaaccaagctaatcaatcaatcctgtgcatggtatggcagtcttctccaatacaaagatacaagatcatgcacagtatattcacaatgtaagtctgtgcatgcatgtatgtatatacagttttttgaaagcaaatacaagatcgacgacatgaccgggatacaggctgcagggtccgtgtagctaggaagatcatgcatctgtactgggtaatgttcagtacaaagacacctcaaggacctgtactgtactaaggtggta

SEQ ID NO: 16972 - DNA, 469 bp, Oryza sativa
agtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcaga

SEQ ID NO: 16973 - DNA, 1501 bp, Oryza sativa
taacataaattaaaaaagaaaaccagttagccaaacgaaattattagaaccaactgtttataaatatagttaaagttttatcatttgatattcttgaaaaaacagataagtacaacttaattatacctatttatttacatattttgatgtaaataaagaaaaaaaataagaatgtacttatgaactacaaataaaaggtgtgaaaccccagtacacgacaccagcaccagctgtagcgagggcttcgctcaactcgacttgactcaagcgacgccaccacccctctcccctcggacgcagctcctctaccttacgtcggagggattacgatagataagtacaactttattagatataatttatttactcatttcaatttaaataaactaaaaaaaaagagagaatatacttccgagctattactccagtaaaaccccagaagattagcctagcagagagcgtagcactcgcactgcacgccaccacaccaccgcagctcacctctcaagtctcaagtctcaagtcgactcgactcgagcggcgccgccacccctcgcctctgctcttctcctcttctcttttcctcctctttcgcttttgcttctccaaacccttgcctctctctctctctctctctctctttctctctctctctctctcctcctcctcctccgccggagaccacgggcctcaccctgctgctccgagctccccctccggcggcggcgaacatccacggtctggctctaggctgctgctcctcctggggtggggtggggtgtggcctcgtcggccggcgagcaggttcggaggagatagccaggaggcggccgggtggaatcgggctgaaggtatttgttcctctctccaagccctagcccttctcctccgcgccacctcgtgagccggcgcggtgtagattggagatataatggataaaaattccttcttggattgatttttattactgctccgtttaccccatccggtttcgtcccaatcccctttctgaggagcaacgacttcggtgcaagtttccttttttttttcttcctttcttttttttttttgggttggctaggggttcagcttaaccccctcattccacacgttacgttcgcctgtggctggtggactgcaacatgtagcctattagtattatgtataaccttttattgtgctactaaaaatcttcatttttacgattagccagttccaccaaatcacaagttttccttactgcctcatttgtatccttttgggaggtcctgaggttgtgtagcttaatgtttttatttatccacagttgtttctttaccctattcaagaagtataattgggaacttgtttgcttgcaccaatctaatattgttacctaatgcattatcgaacctagtaaattctgaatagccagacttggaaagtagcaaagtggggaatggaaattgcaaatgtattcgatggatgaacactgaatattcagtttctctttgcagtgtga

SEQ ID NO: 16974 - DNA, 1501 bp, Oryza sativa
  unsure (1)..(1501): unsure at all n locations
gttttgtcatatgaaagtgtagtaatatattgttcctgatgttcatgtcacaaccgtagcaagttttcttctgcgagcattgctcggatgatctgatctaatctaatatgacgatgtagcttagctaactacaaacatctctctgaagaacaattcaaaatccatatatacttgagcatcaagcttgtgattgccgatgatggattctaatatctcggatagacgtccacccgtttcttgcatgccacctaaatgattatgaaaaaattctaaaaaaattcacaagataggttaatatgtaatatatcacttcacaaacatgcaagttcaaattcgacttctacaagttataacaaaaataacaaatttgactgtgaatatacgtatactaattagagtttgatttgttatttttgttacaanttgtagaagtcgcattgaacttgcatgtttgtaaagtgatatattacatattaacctattatgtcaattttttgaaaatttttcgtaaccatttagatgacatgcaaaaaaaccgggtggacatccacccgagtgtttaaaatagtttcctgtgattgccatatgacactctcacacatattgcattgagatcagacgagcgcggaatgaggatcgccgaaccgttccaaaaaaaaaagaggatcgacgttttcccagccgaaaaatggggtcggagttttagtctccgaaccattggcggtatattttcattttgtccttttcatttttccatctctcttcgttaattttttttcccaatctctcgttccatcagcacatcatcaggatgaacgttttcctccgcgggaagcaatctggaccgctgaaatttgatcgaacggtcaggacatgcccaaattatattacacaggacccacattttacaccgagttaaagcccaggctcacgaattaggtccggtctagtacagctggagctatagccagccaaatagtttcaatttcaccttaaatgatagtagaactgaatgtagctctcacaaaatgaaaaaaaaaaagtagagctgagtttagcatgcttcataactttatttcagattcaacttctgtatctagatttaaaagttggagctgaaacaaatagacctttaatcaacccaacaccagcacaccgccaaccgttcacacgatctggaccgtagaagcttgatccaacggtccatggtccatggataatactgaattgcgagttcgtgacaaacgtgactagctagtgagaggtgctgagaatcgaagctggtgagtgtcacgactaacaagaataatatcatatccttcccagatatcggtgaattcgttcaagtggcgtacgcaaacctcaaggttagcattatgaaaacccatatgatactagccacgaggtaattgtctgagctaattagcacaaacagcacgtgcagatgtacttcgtagacttcatatacacgcctagttgaagttccaatatcctcgaaaaa

SEQ ID NO: 16975 - DNA, 1501 bp, Oryza sativa
ccattatctgatctatagctgatctgttgtccaaatcctattttgcagcaatagctaggcaaagtgtttgcatttggagggtgcccattgtttccaaattatttttgctgcagttgagtttatccttccgttgaattgtgctatataggttgacctcacactgtgttttccattgctcatccatcttgaagttatggtatcgtcggcaccttccgtgagggtgatgtcgttgctccatacttggtagaatacctcaaagtactccttgactagctaaactgtgaggttgtgtctgatattctctattcattggtcattagctagtccttcctgtactgaccttccttttcttttggcatgcttgtatagagttgtagccaattccttgagtagttgtccaccaattcagtttgattcctaaaagctcattttgcgtccatctcctattgacatcttgattgatcatgccatgagatgaagctgttggaaatgatatagtatactcacctaactggagtaaatcgggagctgtctgaattttgcccctgaatatctggaatgcaagttgctaaggagagaacagtagttgaaaagttgaaagagagaccagtgggtgagatcgagagttgcatactggcatgatgcaagccattgaatgttagttacatgcaccgatgcacaactactgttctcactgcaagcctataaatcgtccacttggaactacaacatcaaatcaaaccatatgacagcaatttgcaaggatatgttgccttcgctcctgaaaattctgttcttggattgagttctttgtgaagctgtagctagcattttctctcggtgaaatggatccacctgggcctggaggaccgggaggaggccctggcggttggggccctcctggaggtggccctgggggatggggccctcctggaggtggccctggaggatgggccccactacctcctgctggacctggctttctgggtggcccaggccctggccctggttactgggggcctggatttggaggtttcatggggtcctggtaagctgtgtacattacactgccctaaactttctggaagtttaacctcgcgttgcaattgcaaacaaagtttttaattcatctgcttaggaattcacattatcacatatgagttaaaaggtctacgttatgtgcaagttcaaccaatcgaagcacacaccaccgaaatttcacatatcaactcatcaaaagtttgaatctctgaaactctcttgtgcagtttttatgtcctctgctgctgctgcttgctccaggattgttgtgggccattgctggggcgtccaggcccgggtggcccatcgtcacccttctgataccaccctgaccttacccacctagtgaaataatgcgatgtgtttaccattacacatgggaccaaaatcgttacacatcctctgatgaagaacaagtacctgatagcagcttgcagagtcttatatatgctctttactt

SEQ ID NO: 16976 - DNA, 1501 bp, Oryza sativa
tccctcacacactcgaccttgccgctaagcctgccagtgggctggattttattgggcgaaatggattggatgttgatttggatggtggtggttggattcaaatgggctgatattaattttggattggagcgggttggcctgtgaagaattgcggtttgggctggagtggatgcgggttggcctgtgaagactatccatggattcagcccatgggttagcctccaaaacaaaccgaactatccccactccactccaaaccctacactccccgcacgcgcctgtgtgcggtgcgccgccgcgcactgccgccgccgccgccacaaccgcgcgccgtcaccgccgcgtgccgtcaccgccgttcgctgccaccgccgagcgccgtcaccgccgttcgccgccacagtcgccggactcactcaagaaggtgactcatctttcatgtttcttgaagtggcgttctctctctgcttggtcgagctccgctgatatatgttcttgctgtgggcagggaggtggcagatctgcggttgcgtgacctccatcttggatctcggtgagctagggggactgttcttggaagtggttcttgggagcatcctggtatggtaccttggctatttttgtgctttttctttgtttcgatttttagataatgtgggttggttcgattggagatgctgaagagtggtgggtttctgttgggtttaatgccgcagctggtgtcccatcttagttgtctcatgtgatacatactctgctggattgtagtatgtgtgccatcagacatcaggattagtcacaataattaggtcttaactcttgaaaggtaaagacttatgaagctattgccaaattagcagtaccaatgtctcatctaaccttgagaagtcatctagatctctggtatactgcaatgctactgaaaaagaaaaaaaaagatgttggagatttgaacaaattggaattacacaaattgattgctagcaatgttctgttattcgcaattaattctgtcagatggttgtttataatatatcagtgcaattgcaccctttcccaagtcccaacctctaagtcatgtttattaagcatgcagcttttttgctgcttaatggtgactgttgagcgcatctagaaaatccagcacttaaacttttaagctgttggtcaaaggataaaacattttgaatgtcagttcattcagttccatataactactaatctgttgatttaggtggctgtctttcactgtagtattaagtagctaactattttatgtgttgacatgacatgaggcctgtctttcttgttcaaagatgtgatttgatattcattatgttattagtggagtttcaaaaggtgaaaaaaaagtgcacaagaatatttatgcacggttctttgaaaagaaacatgtccagcccccaaatgctagatgcatgattacggtgtataacaggttgctgttgggtatgcttatcatttcactagtttttagcacaag

SEQ ID NO: 16977 - DNA, 1501 bp, Oryza sativa
tgcatacatacatatatatatatatatatatatatatatatatatatatatatatgatacacatataggactccatggtgcccgggctccaaggtataaaacacacaaattctctcaatttttttttaaaaaaaataaattgtgagtatatacctaggtatatgaatttgattcatacaaatacctaacaacaaaacaactcaaactcaactttatttcacaattcattattacatacctaacgaattatatgtttggatgttatatacctagaaccaaaatctagcaaaaaaaaaagttcaaactcagttcaaacttgtttgaacttgttagtaaagaagttaatgttcatatctaacatttaaaaaaaatttcatactcattcaaattgggtatatactcaatttgaatcttggagcccatattccatgtagcaccagttaatttacctatatatatatacacacacacacatttttgttgtaaaattcaaagtaataggtaccaagaattattcacaaatcagaaaaagtgaacacgtcaatcatacagcctaatggctcctgaacggcttgaatatggatttataattgcatgatgcaaattaattagtacttgtcaactccattggatatggcatgcgaacaatgaagcgcaatctaaaagccaagaggtatatatgagatagagataaaaagtgatgcacaaccccgtgtcagtagagctagaactaagtaaccattgattgagtaagcactctaagattggagcaatcaaaacattagtagtaatttggttgttgcaaaaactattgcatgcacgactaggagcgagcacaaatcaaacatcacggccaagtaaaaagccaaagcttattgtccacatatgatttgttagtattaggaaggaccatattaccctagacagatgaatcgtaactctatgatttctatcatcttacatcttgatcactcagtaagttctcccatgtatattttcttggctaccaactccatcttctttgattagcgtgaaaatataaaacacaaacataatatcactattttttttatagaaaaacaccgtcatgcaattcctatcataatatcgtcttctttcgcatatgccaatttagaaaaaaaaacaaaaaaaggcaaaacggatctactaccactactaccaaacaaataaaatgcagcactcctatacattaccacaatccaccccaacaccaagaaaaacccaagtgaattgtgcttgctacaaaatggttgggtgctctctagcagctacaaaacccccaaaccccaggccagcattgtgggccccacatgccaggaggacaggtggggcccaggtagccctttgctgcactactacccacaactgccgcttaatgctgctgcctcagcttaattatagccttcctcctcctcctttcctccctctcgaggcccaggtgttcgtccgtgtcctcttctccactccacacacgcacacg

SEQ ID NO: 16978 - DNA, 1500 bp, Oryza sativa
aggcggcgaattttcgcttgccaacgctccataggagtattgacctcatcaaccccagaccaaactttttttaccatatcaacaaatccatcacgttacaaccaaccaagttcaaacttaaaactatgttgagcgttactaaaagaggaagattttgtatttaggagcaaaggagtatggtctgaaatatctctattgagagcaacaaaagaggataaagggtatttttgctcccattccgttgacactaaaactctatccagtttctcataggttgggtgtgccagattatttgtccaagtaaaattcctaccagtcattcgtatctccctaaggcacaacccatcaataatagcattaaataagaagggccatctatcatcataattatcattatttattaattattattattattattattattattattattattattcaactttgagacaatagccgtcacgtgcagagtggcatggcatctccaggcacaagagaacatcgcatgacgcatcggcatcacatgcatgagcacatgacgtgtggtgtcacagaatctttgggttctcctgaaaataaaaataaaaagctcaatatttcgaaagctactctctgcatcataaatatgttttctttcttccaaaatataataagttttagttagataagacatatcatagtattacgaatctggacataataataggatgtgtattatccaaccatatccaaatttttagaactacgaatctaaacatcgtactaggatgtgttttatctaattatatccagattcatagtgttataaatttaggatgtgtcttatccaatcaatttttttttatattttgaaacgaagaagtaacaactatctactatatagattaatcatagaacaatttgtacgctggtgtccagtccgacgagatgagcatgagctttctgtacgtggcagaaaaaaatccatggctggctgacattgcaccgtgccggacggtggcggcggccgcgtcgccttctcccttcctggcgctgtcagcttgtggggtcgggatgtcatccagcgtagcggaatctactcgcccgcccgcggatcgctctcgcgctgccgaatctcaaaaggtgggagcgaaacctttttcttctgtcaccccagcttttccttacccccacacagccagcgcacctacggtacccgtatggcccacctgtcatacaccacctgacatatccccctcggcttcccaccgcctgcaatcgggccccaccacgctccgtccaatcccagtgacaggtgggccccggacagatcggtccacctgtccgtgacacgtgctcaacacgtgcgactcgcaggtagtagtagagctgaaaatacgcaacgcatccgcgcgacacctagcccttctcgatctctctctcgctgcagatccaaaccaacctcaccgtcgacgaggaagaaggcggcggcggcggcggaggcgaaggcggcgaaga

SEQ ID NO: 16979 - DNA, 1501 bp, Oryza sativa
agcatgtacggtgttctgtagactgcaagttccgatttctgaaatattttagctgcacatgaggtgaacgtactggtatattaaagccatatcttctgccttaccagcatgtagctagtatattactggcctgatatagttagatgtttgttaaaaattttgctgaaaaaataattcaatcactactgctaccacgtaatgggctactgctggcttatcactgccggtcgggcgtgagcaacaccgctggttcatttttaataaaaaaacaatcaattaatcgctactctctcgctctctccaaatatagctttgtagtcttaaattttggaatggacggagtactacacaatacacaataggcagagtaggtaacactacacaaatcattttcctaaacgccggccctgtttggttctaggagggccgtaactagcgccgcgtgaaaaaaactcgaggaccggcgccgggccggcgcccgcacgagaagatgcattatcctgtgcaggccatttaatccgactgcacgcgatgatgtcggtctatgtacactctagcccgaccatgccgcttttattccggcgttttctctcgtaaactttgaaaaattaaggggaaggttttcgacctcaaatctttgattttgatccatatataaggtgtaatgcttgatcttctccttcatttgcttctatttttgttagtttttatcggtgcaatgcgaagaaatttacagttttataaatggagagtgtaggcactttttgttttttatttattttttgagctaatatgtattgtttgtatcacatgtttttcaaagtattccgtagtccgattcctttttaggtttgcctccattaatttaatttgtcattggataaaggctaagaaaatttacaattttttggaaatggacagtttttattattgattacaaatgttgcatgcatgtttaaattctccgtagaactttaatttaatttttgtttagttccctctgtttatttcaaattttttcagtggaattcgacaaatatattaggtttgcaaatctagtaattctaagtaatatttaatttattaatttaattttattggaaccactagaccatgaatagcaatataatgtccgtttaagttgtatttttttcatatgttaaatatagtacaattcgactcatgaaatatgttcttttggtagatggaccagcaaaaagaattcatctggcgttcttgaagaaagcatccaattttgttgatcaggcaaatgcacatgctttgagggagaacaagagggacattttctgtccatgctttgattgcaggaacgaaaagatgatgcaagacccaaatgatatttgcacattgtagagcgtggatttatggattattacaagatatggacttttcacggggaagtcgcgggtcgtaacgaagaggctgatgatttttgctttgatgcggcaaaaaattttataatcgaagacatgtcacaggg

SEQ ID NO: 16980 - DNA, 1501 bp, Oryza sativa
caatccctctctccccggtgagccacggactaattaatcgtgcatgcaactctttagggacctcactaaccacccatgcaccttctctaagcattccaccgctcaagcgagccgtcgccgtgaagccgacgttatccaccaccgccgggctgtcttttccattgccgctattacccagacctcgccatgccgcaatcaagttccagtgagcacctagggacctgctagactcgtatgcatgcatctttttgcactaaatcgagctgggactctacatgcacaggcgtattgaagaccaccgccgctcgtgacaccactggcatcgattccggccacctccggcgacgagaccaccttcaacaggatcgcaaggaagtcctcagcatttcttcttgtggttgtgtcggccgaagaatcgccgttcgccaacggcatcgtcgtgaaggaacgccggccggcgaactctgcggctgctgctgtgttctccctgtgcctatgataggtgggctccgctccattagcacgtatagaatttgattagagtaagtttaaaacatgtaaggttctttctgtaaatattgttatcatatcatatatttataaatatgactgacatgtgagtccccactgacacgtaggcgctaccgtggcatgccacgtcagcggatggagtgggtcggtacccgtttggacctatatgacacctaagacaagtttagagacataaaaatacattttaagaatttagatacctagatgatacattcgcacaagcttagagaccactgaagcacttcactctaagtatagctaaaggaaaaacaagaccgacttccagaccgtccatgcatgctggcacatgcatgcgtacacgcggaactaactgtgactagattgttcactactcggcgacacgttcacgttaattaattactcccaactaccacggagaaaaggtcatccgtaccggatggaaacccacaaagagtgccggtttttccaaacgacaccatgaagaagacacatattagaacacttaaaggtggcggttttagaactggcatctttaagttatacaatttgcaaagacaaatttacccgagccgatgcatcaaagcaacccaaaaaatcatccaaaaatctaaaaaagactacacatcagcatcacacaatcaataattgatggatcacacaatcaacaactacacatgggagctcgccggaactgtcggatctggcggatgggagcctgtcgccgctgccgctgcctcccctcccaccggatctggcggaggggagggcgccgcccgccgttgccgcctctcctcccgccgccacccgtggggcgccgccgctgccgttgcctcccctcctgccagatctagcggaggggagggcgccacccgccgctgctaccaccgcctccctcccaccgctgcacgctgttgcatgctaccaccgcgtgctagcgaccgagacactgcggtagagaaggagagag

SEQ ID NO: 16981 - DNA, 1501 bp, Oryza sativa
caggcccgaccatcctaaacaaccatacccggctgtacagatctaatctccaaaccaggagctaagcaaattattaccagttataacatcaataattattgtgagaggtgtgagactaatcacgaaaaacattgctcaacccgcccataaccgcgggcacggctattcgaatagttttactctggccagaagtgtaccactgtacccacaagacacagccccacatcatgtcaccatgtgcctcagtaccaccacggtacctcggaaaggagctgtgacattacccctcgcataacacaacccaccacagtgcacctttcctggatcataatcaccccctcaaaaaccagaggcatggactccccagcgacccccgtgggcctatctccgccacttctcagtctggtgctctgcaatgaacaatgctatacgaaaggtaaagccgttgcccacgctggcttgtggttggcacgattaatgtttcccaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataataatgagtcataagttatcccaataatgtgctaatgtttctaagcatggctaagcaatcatatataatatctagctgaaccaatatataaagctcaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtgttcaattaatcttcttgaatacttccggcgcactcgcgaaccttcgcaacgacggaaacgacaaactaacacgcaaaacgaagaaaaagactaataaaaaccaaataaacagtacatataaagtaaacaaacatgtagatcataattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatacaacttttgcaacttgaaccacattaaactgagctaagatgaattagttatgaatttttaaagattaaatcggattaaaacacttatattgattttaattgaattaagacgcaataatgaattatttttgaaaaggaaaagaaggattattgcgtcagcggctagggtttgcggtggaccgggtgcacggcagcggttcacgggaacggacggccgagatcgaacggtccacgaccggctcacagagaacgacgacga

SEQ ID NO: 16982 - DNA, 1501 bp, Oryza sativa
gtccaaaaatatcataaatttgagccaaattttttacgtctaagacatgcatcgggattcatgcgcaatagtaagcattaggccatttccaacccaatgactaggatagtgttcatagtattaaataagttgccacctagaatgaaaaatgatgtggcaagtgaataaatgaggaaataaaaggaatctatatactccctccatcccataatataagggattttgagtttttgcttgcaacgtttgaccactcgtcttattcaaattttttaaaattattatttattttatttgtgacttactttattatctaccgtactttaagcacaacttttcgttttttatatttgtaaaaaaaatttgaataaaatgaatggtcaaatattacaagcaaaaactcaaaattccttatattgtgggacggagagagtattgcatgagacatggtttctacacaatatcgaagacatcatgtgagataagtagcattaaatttaagtatggaatagtggtgtttgcattggaagagtagtgtctagtactagtttcttgacgatgtggagtttatagaaactatgtctagtgtcttgggttgggaatgggcttatcccttctccccctccccacctccctccctcacttcctcactaagccaacggcaacaccattcccctgcaccaccttttttctagtctttgtcgccgtccgaccaccacctgctaacctcatatctcgttgccacccatcgccaactccacccactgctggcctaatctagaataaaatttactaggggtatgtcggtgatatgggcccgggggtatcatgtttagagggaggaggctgccccccaaggccacgtggccctcccccgaggggagtgaggcccaaggtggggtggcggccactccttcccaaagacggagtcaggcccgaggtgaggttggcggccactcctacatagactagtcagaggaggctgccccccaatgccacgtggccctcccccgaggggagtcaggcccgaggtggggtggcggccactcctacatagactagttggaggaggctgctccccaatgccacgtggccctcccccgaggggagtcgggcccgaggtggggtggcagccactcttacatagactagtcggaggaggctgccccctaatgccacgtggccctcccccgaggggagtcaggcccaaggtggggtggcggccactccctcccagagattggacggaggaggctgccccccaatgccacgtggccctcccccgagagggatcggacccgaggtagggcggcagccactccctggccgagactagagggagaaggctgccccaggcgccacgtggccctctcccgaggggggatcgggcccgaggtcggacggcgaccgccccctcccatgactaggggtcgggctcccccgaccccctctctaggtcaccacgtacggtgggttaggtgtccgcctccaggtgcccacctac

SEQ ID NO: 16983 - DNA, 1501 bp, Oryza sativa
taatatatatttatatgtaactattatatattatatgaatcaactattaacttggctatagatgatttgaagttagagcaggtacaatagcaggctataagccaactataaacatattttaaaaagataaaggaagagagaagagcagcaagttacatatctgtagccatctgtagcacggactgcaatacgtaatgtgcgtatgataggtgggactagatattaatagtataataagcaaatattgcatgaattgactattatattgtctataaatgatttggagttagtagtgggctatactattattaaacttgctatgagtagtccactgtactaatacttgctcttatacgcatagaataagaggcgcgccacgcgagtagtacgcgacgcgacgcggtggtggtggcgaggtggtgacgcgccgcgaggcgagacggggggaagaagtggtgggcgacgcgacgcgacgcgagttccggggcgcgcgcgagtaccggcaaaacctgtaaagaagcagaaggccgcgcgactgcaagagggtgcaagccacctgggtgtccggctagctggattcctgggcatgtggcccatgtggcctctctccccctctcgcttccaactggataaaacacctgaatttctcgcggttattccctccgtctcacaataataaaatcattttctcctcttgtttatttaaaataaatttatttttaagaattattttaaaacacaatccaaatacacactcataatacatgcgcacttattacatcggagttgatgaaaatagatgatactctctccggttccattttagttgacgttttggacaatgacacggtctacaaatacatatttgatcttatttttctattataatatatataataaataaatgcatgtttacttttattttattatagtactttaaaagacaaatctatatatgttgttctagttccttcaaactaaatatttttaaagttattgatggtcaaatttataaaagtttgacctcaaccttctccaaaacgtcaattaatatggaaccggaggaagtaaacaatatatggctgagtagtaagacccatcccacatgatattgtaaaagaatgcaacatttaatagaaatgcgggacatttataaattgggtacaatatgatcaattgtaatgcatgacttgccttgttctcacactgatgagaccacaacaacgtcttcgagaaaccgtagagcgacgaaacggccgagatctacgcgacaaacaaagcacacaagcaaaacatgctataagactactgaaacaggaaacaaaaccatttttaatggattctatgcatttttatgaatttactgagacttgaatggacttaaacggagttcggatgaattagatatgaattttagaagattaaatgtgtttttactataaaagaaaaggccttaacggattttattgcgcaataaaggtccatgctgacatcatcgagg

SEQ ID NO: 16984 - DNA, 1339 bp, Oryza sativa
gcaaaatctcattttcctagacccctaggtggtgcagaccgcctacccgctcgcaaaaatcgtgttagccctcacacaaaaatcttggttgtaggaaaaaaaggggtttttttggaaaaaaaaaaaaattttgggggggggtttaaaaaaaaaaaataaagggggtttgtggaaaaaaaaaagggggggttttttggggggcaaaaaaaaaaaagggttttggaaaaggaaaagggccctttaagggttttggtttcaaaacaatgacgggggtagaaacgatttaaaggagttggcagtggattgaggctgtgatcccacttgtacttcactcaacctagcatgagtggctgtctagtggccccatgtagatgtttcctatgagaagatgagaggtatggtgaagtttgggtgtaaattggactttaattccctctctctctttctttctctctttgaaaatataatttaggatcaaagagatgattcaccaaggttgtttgtaggtatttggacgacaaataggcccatatatagatgtttcctagaaggcttggagtggtagagtggcattttgggtggaaattcaatttaaacccttctctcaccttttgagaaataaaagaagatttaaatgagagaagagcagatgatgtgttggctatggttgtatgatgagtgggccccacaaggacttggtcccacatttaagagagatgtagaaggagagaactagaagctctaaattttccatgtgttggcactatcacactaaactatattactctctttctctcatacatttaatttagaattaggggggagacggcaaggtagacaaggatttgatggttcaaggtgccaagttccaaagtttacgtaatttatggctctcatttcatgtggttacatttcgaattagactaagccattgcaccagatgataaagtatgtttaacattctgaccttgagattttgctagaggagttatggtttaattttggtgaaggtgcaaactaggctaattggtatgctgtttccagatttttagctgtgttgaaagatttatttgggttatcaattgatgtgataaattcaaactaaaattgctggaagcttagggtgttgtttagtatttatgagaattttggtgggatttattgttgcttcatttatttttaggaattttctttagacaaagcatgcatatgcaacctatttaaaatcctcttcctatcttttggctgaaaccaagcaaactcctatccctctccacgcaggcccaaaggccagccgggtaaagtttatctcttttccgtcccctccctaaaacgaagc

SEQ ID NO: 16985 - DNA, 1501 bp, Oryza sativa
accaacttctcggatgcagtttcttcctcgcacccgctcgtcctggcatattatcttctgctcgtgccggtggaacatatatattagccggccaacagaaaaaatggcagagcatgaattaaaaagaatgacagaacatcaacttaaaaaaattagcagaacagccacctaatttttttctccgtatctgtttttgatggcagtacatgttctgtcggttgattactaacatactgtatgtcatctatacgtacttagataagtagtacatattctgcataaccgagtttctgctgggtatagtttctgctgtgtacgtacttagataagtagtacatattcaacttctcctcgtctaattaaatctcatcatcggtaagttctgctccttgatccaaaacttgaaaatcagcagaaactaccaaaggagcagaacatcggttagaaagggagcagaaagagatttgaattttgtacctgaaattatctctgtttctagaaacaagaaagcagaatatatatcttctgctcaaaaaacaaagtccgtttacttataggaagctttggcaagaagaaagaagaataccttctgttctttcaaaacaaactcgatctacttataaggaggcagaatatgttctgctctcaaaccaatatttttattattaatttcgtttgaaagtgagcactgtttggtgatatgttgtatataaacgggcagcacatgcaattgttgatgttatgctcttttcaaattgattttctgctcctaactaactgatgttctgttctttttggaattgattttctgctcctggccgacagaagatatatactagccggcaaatgaaaaaacaggctaaaaatatggtagaagctaatctgcataacataaatatgtatacgcatgcaacagaagctaatctccctgttcctataattatgaatatgtaacggaatagtttctgttccttcaaaaacaattcaatctactattagagcaaaaggcctgtggagattatggatatcccatatctacacggcgaggatatttggactggatataggataccgaatatatatagaatatcttatttgtatctcgggttcgtttcttaacttgtacatcaaggaaacaccttgagacttagtcggttacgactgtattttacctgtatctgcatattccgttagggatatagattatcttttttaacacggactccttcccatatataaggagggtccgggtgcctcttggggcataggttgattttctcccaatcatacaatcaataatacactcggcggatccatccccggacaggagtagggtattacttcttgaataagaaggcctgaacctgtataaatcctttgtctccaaacccatacacttttctagcttgatagccacccccttttactattgccgaaatctagtttcgacagttggcgcgccaggtaggggtagcgtcaagcttttcgccgatcagtgcaa

SEQ ID NO: 16986 - DNA, 1501 bp, Oryza sativa; identical to SEQ ID NO: 16985

SEQ ID NO: 16987 - DNA, 1501 bp, Oryza sativa
tacggagtactgcttactgtacactgcagtctctcctgccatgccttcccgtactctgttatccgctgatctggtaacctgacattcattcatgctagaatttcacggtaaggctgagtttagttccaaactttttcttcaaacttttaattttttcatcacatcaaaatttttctacacacataaatttacaacttttccgtcacatcgttccaatttcaaaccaaactttcaattttggcgtgaactaacacaccctaagggggtgtttaatccagggtataaatttttggcgtgtcacatcagatatatggacacacatttgaagtattaaacgtagactaataacataataaattatagattcagtatgtaaactgcgagacggatttattaagcctaattaatccgtcctatagcactacattgtcaaatcatgacgtaattaggcttaaaagattcgtctcgcaaattagtcgcaatctgtgcaattagttattttttagcttatatttaatatttcatacatgtgtttaaacattcgatttgacatggtgtaaggcctaactatgaaagcgtaaaaatggaagttacattggatacaactgttagctgatcagcggtagcaggaaaaatacgtacagtgtctgtggaattcgctaacaatactgcataactgcaacaaataatgtttgacaagaacaaggatttatttgattgggcttaagctcctgctttactttttctaaagacgcgaattaagtttgacaaggataaggttgtgttttgatcagattctagcttcactttttttctaaggctaaagtctaaaagaaaaaggggctagaccactagagtgatcgtaaaaaaataactagtgaggcggtgtggatgctccatagttctactccaaactccactttcaatagttatatttagaagtgaaagcccttctaaacatgccctaaatacactgagtaagagcacaactgcataaggcatgaggatgcaaaaggatgaccgacttggttgtcagcacaaggtgcatgctttcatcaaagaaaaatcttttgcatccccataaattcagttggtgatgtatttgcaaattggaattctctgtgcaacctcgcaagaatggacaacatcacaacagcacacaagtaacggcacatccttttgttgattcttgtccatgatcccaagtcatcactttccgaagtaaagatcacagcacgttggcgatggcgacatcctccaaaaaaaaaaaggaaaaaaagaaaagaaaaggtcaagattttactagcacgtagaaaaaggaaataaaaactgaaaaggaaaggaaaacgagaggaagggtctctgtccagtccagtccacttccggcccatttgctagtatacaagtctactaccacgccgtcgccggcggccggcctcattcggcaaccaaccatgtggcgcgcggccgcctcccacctcctccgccgccgcgccgcgca

SEQ ID NO: 16988 - DNA, 1501 bp, Oryza sativa
atttttggttgctggactatgtgcttttttgttgtaatatccagtacgtatgtacttgatttctttatgtatggtatatacttttataagttagtaacagtatgcatctttttaaattagtagagcagtatataccttttttatgttaatagcggtatgtacttttttaaattagtagaacagtatataccttttttaagttagtagcagtatatacctttttatattattaaaacagtatatacctattttaagttagtagcggtatgtacctttttatattattagaaaggtatataccttttatattttttaagttagtagcggtatatatctttttaaattattagaacactatatattttttaagtcaagagcagagtatatacttcttttaaagttagtatcagtatatactgttctttttcttttcttaaggtagtggcagtatatacttaattataagttagtaggcaggatatgcatttttaagtacatgctattttaaaattaggagtagtaagtatatatatatatatatatatatatatatatatatatatatatatatatatatatatatatatatatatatatatatatatataaacaagagatgcaaaagtatcggtacattctctaagatgcagaagacagcatgtattgagatgggaatatgaagaatagaaaatgtttgaatgtgccattctaatctagatataaacgaaaccatatgctgactataaaccagagcatacaatccaggcagtatatcccattcacttcatgtataccgattctgtctaaacagaatatccaatacgagaagcacaaagctctgttttcttttcggagcaatatactcgactttcataatacttcaaaacaaaataatgccactaaatcacagtttccaaacaaaggctttttcccatggcgcagaccctctacgtagcttgttgcagggttgaggtaagcatttgagtcattggagttaacatgttctgacggcggttggcaaccatctgcatgcaacaaagggcacccacaatggttatctataggctctctacaagagatacatgtcagcatattttcctacttggaagagattaaatgaagagagagagagtaaagctatctactaacctggagatagtctatagagaaaaacgaggcaatgcattagagagctatagatatccatgtagacataccattgaagtggtttactattaatctagtctattgctgagatgtaaatgttttatagatagcaccttactttaccattgcgggtgctctgagaggcttaatcaatgaactaacagaagaataaaatggaattgccatagaaagaatgcataaaaaaaaatccctaccgttttgtgcagcatcgggctagctgccacatcaatcttgcctcatcaatgccgtggatgaaagattgattaacgttgtgacctatgaatcaccgcatcgacctgctgatgagaggtcg

SEQ ID NO: 16989 - DNA, 1501 bp, Oryza sativa
atgcagctaacctctgatccatcttttcagctgcttggacgcgtccctcctgtaggctgtagctagctgctgctgctatcctactccaacctgctaccgctgctgctggcagctgctggcggtggtggcgttggtgcatgctgcatgcatccattgcatccatgcgccttttttttttttcatcccctttctttggacgcacacgccgcgcgcatcccccgccaaaggctacaaagcggcggaaacgcgaagagccgtgtggccgcgcatgcatgcggtatcatgcgcctcagcagcagcagcagaggcgcggccggatcttttgccggagctagcacacggcgcggtggcgccgtacgtacatatgcccagccgatcaggcggcggcgcgcgtcatgcatgcgcgcatccgaggtcaccatgtgtctgcttgcgtcgcgcgcgtgcgccgcctgctggtgatctgggtggtgtggcgtggcgtgtgcgcgcgcgggtgtgtagtggtggatggagatcgtgtggtccatctgatcgatctggccatgcacgcaccgaaccatggagagaaaggatcgtcacatcgtcatcgatcgttttttttttttgagacatactgtaggtggaggatacagtatgatatgctcacagacgacacagtactgtccttttgagttttgatggtggtcgttgacttgttgccgatactactatagcttgagccttgagggggtagccaactattgcgtactgcaaaatgaaaatgcgccacgcatcctagctactatactacactactgtaacccaatcttgttcatgtcttttatggcttctttgaaacacgagaatttacccctaaaaaaagaaacacgagaattttactacataaattgtactacttgaattagtagtaattcattttatcctgcaccctttgacttagagataaggtaacttttgtcagaatgaaactgaactgattgttatccaaattaacccttgaaaattgtttttttaagacggaggtagtaagaatgtttaagcaagatacattgcccttgatataacttgcgatgtgtactcacttgttggtgggagaaattggatccctgggttcacaaaattgatctaccttggaaaacgctcccaagtggtttttcggttttcatgaaatcattgaccaacagtgaaatttgtccaaatcttgcataaacttaaaatcagcttgaattttgttgaacttcgtaagttaactaatgagtggtctatgatctcgagtagcttgaaaataaagtgttttatactccgtacatgttttgtaaaccctagcgaatactcaccatccacgctgaaacttggaatccatatcttttaaaccttgaatgtctatgtcttcactcttttattaattagattattttgaatgtcactcttcgagagtgctagactctaataattggctgcagctcttttgagcaaaggccgggattctttcattcta

SEQ ID NO: 16990 - DNA, 1501 bp, Oryza sativa
aaaccttttataaactattaagaccacacaaacgataactcatctccttaagagacaatgataacttatcaccgtcagcacccacaggagtgatagatccgcccagtccaaggatgacgggagtggcggtctcggactgggcagatccgccgccagtgcccataggagtggaagatctacccagtccgaagacggtgggtgtgatagcggtggcctcggatggcgggagcaacctcgaactaagtggatccgccatgggatagcggtggcccattggagcggttgatccgcccaatgggagcggttgatccgcccaatccgaccggcagctggaacgacgatggcggtgccggctgtgacaacgacgacggccacggtgacgacttcaggtgcaacggtaatgatggtggctttggctgtggcgatgatggtggtggctccgatgacgttggtagcttcaggagctatggtttcgactgaattagttttttggaattttattttttttcactgaaattgttttcacagacagacaacatatgtgcccacgtacgaaaaccccatatttgcacgctgttgcgcgcgctgcatatatgaaaatgtgttgattttggaatacacctaaatgcagctggctgcgcatcacccacatatgaaaatggattttggtcatctgcgaaaatcgtttttaagtagtaccctacctttttagcgatttctgctccgtcctgctgctaccgcgtacatatacagtaccgcctgaatctggtggccgccgcacgttccattcgcgccgaccatgaattaacttgttctaacaccgcgccgtccttgctctgatcgaagctctgaacaccacccagccagccggtcggtcgacgaacctgggtaaataacagccacttgatccacacaagatggcactccacacagatacgtccaactaaaattccagcctcctccgtcttgcccattggctgattggcttcgcgctgcagtcctcacatagggcatgtttgtgcagcttctaagcagcttttcatccagattctgagaagctgtagttataaaatttaaaaaatgaactaaaagccaaaagcggagaaactcagcttttctagattatgataagctggctactaatcagctgcttctcagaatattaagctctctaaatatgccgatagagtactgtaccgtaatacagacatgcatttcaccgtacgtgcctgcagtagcagacatgcacatgtacagatgtactagcgcagttgcgctacctgcatgcgtatatacgaccgtgtgcatgcatatgcatggcccgggaatccacggcgtctcgtgaacgtgccgacgcgatttgatctgagctttgcccatgagtccgtgacatagctagctaatggagacaaagctagcgcgcgagcacatgcacgtcacgggccgcgctaacttacccccacgctatataagccgaccgtatatagccatcttagctacg

SEQ ID NO: 16991 - DNA, 1501 bp, Oryza sativa
gggaggcctcaccctccctctctatttataccacaaaaaccccctactcaaagtaggtgtagaactcctattcataataggactcaatcccataatttcctttttctccaaaactacagccgcacagaagtcggactcctcctgccgtcgctgctgctgcttgctgcctgagccgactcggcttgcctctgcatggatcaagcctgccatcactgaagctgcttgaccacgcaacaaagccaaagtcagtcaccaccatgcatacatacatgcatcacacatgcatgcacgtactgcatgtataccacacatatatgcacgctgcacaccagcacgcatacatatatgcacgctacagtacaccacagtactgtagcaccatacataagcctcttccaatttcttccaattccctttgcgaacaccgatgcttgcacgcacacctcgtgaagcccgttgcgaagatctctcccacacggtatccatccaccgtatgccatctcgtatccaacttcgtcacccggtatccttgacagtctggacctcaactccttcctgagtctagtcctgatctccaccgttgaccgaagttgacctccaagaattctaactctagtcaccttctcacatggtatcccgaccgcactagacctctgtttttctctgaacatagtcccggtcctcgccattgaccaaggctgacctcaagtcacctacacacaatcagacaaaacaaccgtttctgggcacagatatcacaacctgacccacattagtcacacgcactcacatcaacatccacacatcttttcaaaccaattcattgattaaattatttgcatagccaattgttcatcacaaatattaatcatgacaatgatttcacataacatacctcatccgttcctcaatacaatgactcatatgtatcgtcatccatcgcttcccggtcccacactctatcaacctccggtctttcttttaaaaccctcacacaagtacaccgaagctagtatgtcgtccccatgaagctagtttggttgcgcataagttttctatgccaccgcctatcgttgccattacatccaaaaagaagtcgtcatcctactattctaacaatgtgccaaccgcttctacccatggtcagcaatctcttagcaacccgacaacatggactattctacttgcataactatgtttagtcatgtgggacaagttaacgagtgtttgtgcaactccttgttggagacacaccattgttttactatgtcttatacaacaacccgtataacttttttagatgttctgattaaaaatcctagttttttacattattagaaatgaattaaatgcagatacacaaaatcaaataaattccatgctttcaataaatgcatttgttctatatatatatacaccatatatacatttatggaagcagatttattgaataagatattcagctggaagttattaaataaagatatctttaggctgcaca

SEQ ID NO: 16992 - DNA, 1501 bp, Oryza sativa
ctcgcactcccgcgtgcggccgtgcgtgccctcggtgtggacagcttaagccggtacatactccgatcgtagaagccgtcggcgacatgcatgcaaaaaatcacagattaattcgggattagcaaccggcaagattagtctaaatggaacaaacagatgcatgtatatgcttgctgtatagatgcatgtgtgattgttgattaagccacgcatgcatgtgactggatcaacacgtcttgcttgtgtttccaggccgcctgcgattggcttcccatatatcagacacgatccggcgtggctgcatggacggcttgcgcggagacgtgcattgcccacggcttgcgcggttggcggcaaggccgcctcgcctcgcttcgcggtcgcggcgatttgcagtacggccaaaacctgttgatctcgtcctggcagcgaactgctttttccaacgtgcggcggatggccagatcgtcgggacatgaaagcaagaaatacccgcgcatcaatctatgattagaaattaatcaaaccataaaaacaaattgaaacgacaaacccggcgatcggtggttgaagctatctccttaaagaaacgatctagcacccccatacctggggcgtcaactgtcgatttctatgattggcaatatattttatggggcgcgctagattaaggagagatagtgaaacagatgattgtcctggttcaggccctcaaggtgaggtaataccctacgtccagtgtggttgattctctgtatcggtggaaaaatggtcaaaaaagaaatcttggagatgatccgacctccctctcctctcgagaccgttgccccctcttatataggatgaggagggagggttacaaggaaagtatgtagttgattgaaactagatctccgtattctatctataaagatatgcatgatcctcgagaattatatcttatcccggaaatatctctttcttttatttacaagtacgtcgcatgggcctagggctcttggcccaccctatgccgtacggcccaaaggcctctccttgggtacccgggtacttgtattccacacatagctacataagcggtggcgctgccgatcctgatgcattgctttgctttgttcttctcacagcagcttgactgcgccaaagccccagctacaggcacacgagcggcagaacaaggcacgtaagcatcaaaattggctgctatttgagtcaattgtctggccatgcgaatcgtcttgctagttgccactgacctctcaacacatagcacataggagccattggtttaatctaatccagcatgatatatgccgtttatccccttgtgcatagtgctcacctcatctttcaccctgggtgaaatagccatggtagcagctcaaggcagtaccccactacacctggtccaaactgctatgttttggcaaggttagatggtgatatatgaaaagtgttgatagacccttgcccattgtgcaactatggtaatgaaaagggg

SEQ ID NO: 16993 - DNA, 1501 bp, Oryza sativa
gcagtggcccgggaggcgcacgacctcgccggtgagagggttcttgaggtagtggcggcggcgagggccgtgccccggccgcctgaagaggagccagccggcggcggtggagccggcgcagatcgtgtgccggttgaggcggctgaagcggcgtcgctcgccgccggggaagctctggagggtaccgtcgtggaagttgagccacgggagagccgggggcagcggaggcggcgccgtcgtcgccgcgtggcaccattggcggcagacggagccgaagcggacgcggtcggcgtgggagggcagacggaggaggaccacgccggctaggtccgtcgggaggtcgaaccagagcggctgccggcttgccggcggccgttggcgtggctttgcttagtccaacgcccatgacgcactagctacctgcccgtatgtatgtaggacgtcacgtccgcacatatatttgggagtttgagacagggtgcggtacgtgtgaataacggttcaaaatttcggactgacatttcgaatctatgttaagatttcggctgtttttttaattttttttcaagcttttatgaatttggcaaaaaaaagttcaaatttgatcaatttttgttaaaaaatttaaattatttcagaccgaacttgtcgaaattttgaaagtttggatcatatcggtacccgatagaaatagtgtaaatgattatttcgtacgaaaatttctatatatataagttgctttaaaatattaaataatttattttttaatttaaaataattaaaacttaattaatcatgcattagacataaacggttttttccttaacaaaactcccgtcgattcaggtttgaaatttcgggcactgttcacttgcatgaaactatgtagtccaggcaaactatgtagtccaaaatatatatatttatttattaacttgcgaattcagtaaagtttattctaatacggtgtaaatctgctcaattttaatttttaattacgaattttacgaattaaacactaattaacttaataccgagaattttatactcaagttagaacaacagggaacatggtgttgcacttgcacttacttcctgttctaccccttaagagcaagtttagtatagcccactactagctctaatttatatatagccaatctaatagccaattcatacaatagttgtttactatactattaatatatggtcccacctgtcatacacacattgcgtcttggagtctgcgttgcagctggctacagatctgtagcccgctgctcttctctctcatattttatctcaataaaatatatttacagcgggctaatagcctgctactgtatctgctctaatggcaaccacagtgtttatttagcaacttggtattaagtagtaagatggattccggtgtgaaacaataatagttattagcatgtttcacaatgtttaatacctgaagtgataagtaaagtggggtccacatggaatgcttccctcc

SEQ ID NO: 16994 - DNA, 1501 bp, Oryza sativa
tgaagttggaatatatgcttgaattagaaaggacaatctaaaatagatgaacaagaaaaaaaaattgcagtgataaaccatagtgttcagtgcagcatagaggatcaacatcatctatttgcctgcactgcaaccgcatagtgctagtcagaattcatgtttttctggagcatgtttgagtatcagagacttcagtcgtaagaaaaaatgtactcctagctcgaacttcagcccaaaaagaagtagcagaaaaatgcaaaaatactatgcatacgatgtttggttacgatatttgtagttcttgcagaaaatgtcctgaaaaaggtcctgtttgattgaaccagcaacgatgcaatctacaataagaaggtggtagatgttaaactcgaaacacaacatcaaaagtagaatccaaaataatcacgacatggtttcagatatatatatatatactagcaaatatgcccgtgcgttgcaacgggtgaaaaaacgtaatgataatatacgtttttcatgcataaccatgtcgataacaatcagaaaattagaactacgaaactttattttctagcgcgttttcttttgtgcttttttctgacatttttccctcacgtgtttttttaaaccgtttttattttctcgcgcattttttccttttttaatatactgtagaaacttctctttttatagttagattagattagattagagataaagaagatatataaatggactaaaaaacgacgaatataaatttgacttttttcctccgcgcttttttccgtccttttaattttttttctcgtgcatttcttttacgaagggtttttttcaccactttcacatagtgtcaaacctttctagatataataggattcgattttttttaccgcatcacgtataattcctttttctttagaaacagacaattttttcgcccttttttatcgcgtcaacggagtcggaatcgttttgattttttccctttttttggatcggacagatttttttttgcccggtttatttcgcccgatcgatttttttaccgcgtcacatataattccttttactttggatttttttcgccctttttttaccgcgtcgacggagtcggattcgttttgattttttttctccctttactttggaattttttcgccctgttttcaccacgtcgacggagtcggattcgttttgatttttcccctttttggctttttttggataggacagatttgtttttttttcgccccgtttttttatcggacttttatcttttttttcgcctggtttttttatttttttaccgcgtcacatataattcctttttctttatcggaaagttttttttcgcctttttttaccgcgtcgatggagtcagattcttttcagctttttccttttcttttattggacaaatttttttttcgcccatttttttttctcctgtttttttcggatcggactatttttttcttttttcgcccggtcgattttttta

SEQ ID NO: 16995 - DNA, 1501 bp, Oryza sativa
aaaaaaaccgggcggaaaaaaaacaaatatgtccgacaaaaaaaaaggaaaaaaaaggaaaaaataccgaaacgaatccgactacatcgacgcggtaaaaagagtttaaaaaaataaaaagaaaacggtcctattccaaagaaaaatgaattatatgtatcgtggagcaaaaaaaaaaaagaaaagtccgataaaaaaacctgggcggaaaaaaaccgggtggaaaaaaaacaaatctgtccgacaaaaaagaaagcaaaaaaaggaaaaaaatcgaaacgaatccgactacatcgacgcggtaaaaagagtttaaaaaaataaaaagaaaactgtcctattccaaagaaaaaggaattatatatatcgtggtaaaaaaatcgaccgggcgaaaaaagaaaaaaatagtccgatccgaaaaaaacaggagaaaaaaaaatgggcgaaaaaaaaatttgtccgataaaagaaaaggaaaaagctgaaaagaatctgactccatcgatgcggtaaaaaaaggcgaaaaaaaactttccgataaagaaaaaggaattatatgtgacacggtaaaaaaaataaaaaaaccaggcgaaaaaaaagataaaagtccgataaaaaaacggggcgaaaaaaaaacaaatcggtcctatccaaaaaaagccaaaaaggggaaaaatcaaaacgaatccgactccgtcgacgtggtgaaaacagggcgaaaaaattccaaagtaaagggagaaaaaaaatcaaaacgaatccgactccgtcgacgcggtaaaaaaagggcgaaaaaaatccaaagtaaaaggaattatatgtgacgcggtaaaaaaaatcgatcgggtgaaataaaccgggcaaaaaaaaatctgtccgatccaataaaagggaaaaaatcaaaacgattccgactccgttgacgcgataaaaaagggcgaaaaaattgtctgtttctaaagaaaaaggaattatacgtgatgcggtaaaaaaaatcgaatcctattatatctagaaaggtttgacactatgtgaaagtggtgaaaaaaacccttcgtaaaagaaatgtacgagaaaaaaaattaaaaagacggaaaaaagcgcggaggaaaaaagtcaaatttatattcgtcgttttttagtccatttatatatcttctttatctctaatctaatctaatctaactataaaatgtcacgagaaaataaaaacggtttaaaaaaacacgtgagggaaaaatgtcagaaaaaagcacaaaagaaaacgcgctagaaaataaagtttcgttgttctaattttctgattgttatcgacatggttatgcatgaaaaacgtatattatcattacgttttttcacccgttgcaacgcacgggcatatttgctagtatagttaaaaagatgtaaatagaattcgagtcatagttgggggaccaaggtggacttattcataacttgtccatcttacgtgtgtgacggaagagcccaattgcatatggct

SEQ ID NO: 16996 - DNA, 1501 bp, Oryza sativa
cccgtgcccggaccgaagtggcgctccggacgaggaagtgccctccgttgcgtgggcggcgcgacgagcgtcgcgccggcgctcgatatcgaggcgggcatccggccccccacgcacatcttcttgggtcggaggcgttgacgagggaatggcggacgaacgacgggtaacggccgccgctcgccgcgccctccgcctcgacgacatggagccggcggcggcagcgctagaggcctcgatggcggaggaccgcccgccggcgcctaggcgctgctgcgccgtcatgaccaagtcggccaagtcatccagccaacgtcgggctggagtctctggatcggggacgacgggcgggtgacgcaggagcgcgcctgcagcctggagcgcgccctggggcgtgccgccatcgccgtagacgaggcggcgacgcgccccatctcgccgtcctcccccgtcgcccgcgggcggcgaagtcgcggatcctccgacctccccgagcgcctccccccgcccaagatttcggcgagagggggacggtggggtgcgagcccgacggcgcgggttctgctccccgtcgtcaccgctagcgttcggagagaggctgtgcgccactgcccgttcggccattgggctgagcgggagaagcttggcgcacacgaaagaggacgagggcttagaaagacacgcgcacccctacctggcgcgccagatgacggagcgtggggctcctcaccgggagaccgcgcaggcccccctttgccggttcggccgggggcgctaagtgaggttcctcgccctccatctgaggaacgtcagcgagagaagaagtgcacaagacacgggcgacgtagacaggttcgggccgctgagaagcgtaacaccctactcctgtgttctggtggatctgtgtgtgaaggaataccgagagccggagagcgagagagagttcagactctagaacccccccttcctcccttttttcttttcttccctttttttcccccttttttttcctcctttttttttctctccctcctaggcctgggcctcctttttatctggtcaggggtcaccacaagggcctctagctgcctaagaagggaaacatgctttttacaatgagggctagtctacagccggaagtgacctctgacaagcagagcccacgcctcctgccccgctcgcccgcttttccggtggacgcccatttcaaccttcatttaatggccagcgacttccttgccatacttgcgctgaagcctggaatggatctgaccgggactgacataccaactccaggagttagcacaccggctccggctagggacgagagccaggaagctctcatcattccgacgggacggggcaaggcgtgtgacaggccgcctgttgccacctaacccgcgatctgaccggtctgtgaccggtcacacaccgcgaccggtcacggaccggataagcgcgcgctgcgccgcattaaatacggcgtggcgcgctcgtccaa

SEQ ID NO: 16997 - DNA, 1501 bp, Oryza sativa
cttaagaaaacatgttccttttaatcacgaagcaaaataatcagttttaatattccagtaaataagttggaaaaaacaatgcctaacatacataacgggttaaacagaaagcctcttacaacgcaatgtttgacaagctgaaaagcaccaataaaaccttccctgtgatatgtctattatataagatatccttttaaaagcaaaaagggaaaacatgttgtgtcataagtttgatagagaaaaaaaacagttatgatcgcacatttgtggtgtttcatggtgagcgaagcagctaaaaaggcttcaaaaaccttttttagctaaaaaaaagcttcaagaacctcccaaaaaaacaaaaaggcttcaaaaaccagtttacctcaaactgtgtagtcacaaccttcaaaaaaaaaaatcaaaattactcgccatggcccccaccccccacacggctaccgggccaggaaacacgaaagcgaaagggcgagaaaaaaaaaataaaaccaaaaaccacacacaactgaagcgagaatagagagcaaagcaaagcgaagcagcagctgcagctcactcctcccactcgagtagagcagccaactcctctctctctctctcgccgcagcgaggagggagacgacggcgaatcggagagggcgttagatcgaatcggagaggaggggaagcgcgcgcgcgcgctcgcgtcgcgggtggggggcgatggggtgcacggcgtcgaaggtggagcaggaggacacggtgcggcggtgcaaggagcggcggcggcacatgaaggaggcggtggcgtcgcggcagcagctggcgtcggcgcacgccgactacctccgctccctccgcctcaccgccgccgcgctctcccgcttcgcgcagggccacccgtcgctcgccgtgtcgcaccacaccgcgccggtgctcctcaccacggtcgcgcccgcgctggcgccgacgccgacgccgccgtcgacgtcatccacggggtcgtcctcgctcccgccaccgacgccgctgctccccaagcaccagcaggcgccgccggcgccaccgcccacgcagtcgcatcagccgcctcctcccgtggcggtgagggctccccgcggcgggccgcgtcgcctcaaggtgccgcacatcctgtccgactccagcgtcgccagcccggcgcggtcgtcgttccggaagccggtggtggggacgccgtcgtcgtcgtcggcgtgggactgggagaacttctacccgccgtcgccgccggactccgagttcttcgaccgccgcaaggccgacctcgaggaggccaaccgcctccgcgagctcgaggaggaggagaaggcccggggctacctccacccccaccacctcaaggaagaggacgaggtcgacgacgacgacgacgagagggaggaggagatgcattgcggcggatgggaggacgacgacgaccactacgcgtcgacgaccacctcggagaccagatcggaggagggggaaa

SEQ ID NO: 16998 - DNA, 1501 bp, Oryza sativa
gtagcccgctacctctctgcttagcctgcctcttttttacctagtccacaagtggtcaagtggagctgtagacccgggtatcgctaatacacgacctctactgtatgtacgtatgtatatggtacgtataaactttttatacacgtacacaaagtttatacatacgtatatacaaatatatcttttttatatgtatatttttttaatgtataaaaatatatcatacacaaagtttgtatacgtacacatacaaagtttgtacccatacatatacaaactttgtatatatatgtgtatatacaaaatataccaactttgtatacgtatatatacaaagtcttcttgcatagccgactgccatctttaaactccggccggaagagtgtccgtatgatgctcgaacggatcgaatctttctcgatcttccaaaattggttgaggttgtttgatacacttgatcaactcttttcgtttttatcaaaatgagtaaatccataaaactcggaataaaaacggtcacttttaaatgaagattaaatctggtaaattgtaacatcctgaaaattaactatttttctagtcttgcatcatgcatattcttatgttcttaatatccttctaaacctaggaaaatatgattagagagacctcctaaaactaacttatataaaatttctctttggtatttaatttcttttatgattttcatttaagatttatcttgaggtatttcttgatttggttttaatctaaaaaccttctttcgtctaaaactttctttatttaaatttagtttgaaaacccttcttacctattatgaattatggtccaagaaaccttcctatattgtgctagaacctaaaccaaagcaattccaattttattggaattaattgttaacctatcctttgatcttagacctatccttagttcttgatccaaatatctgaattcctccttttgatctagccgctcatttatttcctgtggcttgatttccttttcagcacaagaataatattattacaaatattgtgaataattgctcttgtgctaagaaaatagattatatccttgtcatccaaatttcttattagcctcaaacaattctttgaaacccatgccatatatttcggggctaaaaatcttgtttatcttcctccatttatttccctcccacattcccaacaatatataggttcaattttaggaatcatagtactcatgcaataatatatatatctctctcccatttgagtgcatcaatagattccaccatattccacttctaagaatattgcactcaaactagaaaatatctcttttagaaattatattcaaatataatttcctttctgtcacgcccagaaatttacgaaccagaatttctaagctggatgtgcattaaacccctgtccaggaccagccagggtacacaaacgacaattgttgacatacagtccacgtcttacaaaaaagtaaaagattacaaatgcagcgg

SEQ ID NO: 16999 - DNA, 1501 bp, Oryza sativa
tactactcctcgtcgtcgtcgtcgtcgtcgtccccggcgcggagcaagcgcgcgcaggcgcagctcgtcgtcgtcgtctccgccgccggcaagaagctaccctggccctcgccgcggcgtcgcgggagccatgtcgtcgccgttcctgggctcttcttcctcttccgcttcgtcgcccctctcttacctgaccccgcctaggcctcctcctcctcctcctccccttctcatggtacgtcacggattagctcgatggttgactgatcttgacgatgagctgatggtgttcgacgacgatcttggcgtgcaggggcagggatacgccgctgctgccaatggcggaattggcggcggcggcgtcgaggcggtgaacgcggcggcggcgccgaggcagggtggcaggcacgccgggcacccgccgctgccgaggccgccgccgaggcagtgcccgcggtgcggctcggcgaacaccaagttctgctactacaacaactacagccgcacgcagccgcggtacctctgcaaggcgtgccgccgccactggacggagggcggcacgctccgcgacgtccccgtcggcggcggccgcaagaacagcaagcgcgccgccggcggaggcaaggccggcgccacagcctcgacggcggcttctgcccatgtcgtcgcgccggcggcggcgccgccgacgtcgtcgtcgttccccgatctcctgaggcagatgctgatggcgccggctaccgccggtggcggaggcggctacagcatcgacctgaccgcgtggcagcaaatggcggcgttcgcggctccacctcaggccgccaccggcgatgtcggcggcgcggtcggagcggcgtcgacggcggcgccggacgcgaactgcggcggcggcggcgtgcagtactggaacgggtggctgcaagatgacatgcccggtctagatggttcatgttaagtaacccgtgcttgtattgatacgtatacgtatacggagctacggatatatataccgaatacgtatacgtatatatatgtgtgtgtatatgcatgtatagcctatgtatgcatacatgcatacacatgcgctatgaaagtatatacgtatgtcgtatgcgcatactaaattagcgtaacaagagcctatgactgtactagtgtagtttggattcaggttattaactcgtgggtatatgttgacctactgtagttaaatttgtgtatttgtgcgactctgcccatttctagtttgtacgtgcatctatgtgttatgctttttttttcccttttttaagtactactcccaccgttaaatattactccgtataaacttagttaaactttgttaactaagtttataaaagaatttaatgacatccaaaacactaaattagtttcattagatctaatattaaatatattttgataatgtgtttgttttgcgttgaaaatataactatattttttataaacttgattaaacttaaataattttaactagagaaaa

SEQ ID NO: 17000 - DNA, 1501 bp, Oryza sativa
ttcttgggctgttctgagctgcaacctaagttaaggtaaataagtcctctatttattttaaggattgcgatgaatcataattgtcaccgtgggtaccagcgctatgtcctgggactggtactgagatcatggtttcgtaggaagcggttcgcactgtttttcctacgacacgctcctgtcaggtaccgttgtacagcggtatcagattgggtgtgacagcacgatcacacaattttgtagcagaatgcatgatatgatgatctatacatgcttgattaaataaccggttcactcctaacacacaaatgggatgaagggaagaatgcatgcttctcccaaaatctcagtataaatacgttaaggaatgtagagtagctattgtatgtcacaattaccttatatgtaagattattaaataaggactaacccaagcagtcacgtgtgcggtcgggagtgagatattggggtagaacaaaattaaatggccatgtctatccttaattattgatttgatcatacttataacttagaacaaacataattgttgtgaaataatcaatatcttttagaaataattatccatacactcgcatgtattctattcctgatggatctatcacatttaacactagaaaatttatttaattctatagaagatatgatcaatgatgccatgtcagttaccatcttcatctggtcttatgtttgtgtaccacaattattaattatacttatttgtgttacaaagcacttaatttgaatatgaaatcaactacatgcacacattttacttgggctagaatggtgtcatgacacatatgtgggcgccaaaatttagttgggctgagaagcgctgacaggtcttgttacacttctagtagttctctaagtattgggctgcaagggatcggaacatcactgtaaatgcatgtatgcatgatcacacaattttgtagccgaatgcatgatcccatgatctaatcatgcatgcatgatcaccagcatcagtgacggcaacgcccatggatgtgcttgctgcctctgcaaattaagctctgctgcctcctaacatccaaatttagttgggccggaaaagtgataacacaagtgttgaaggctccctcttaacatcgaagcgttggttgattgatatgcagttctacacatgttaggctagaatgggattggttgcatcctgacctgatggccgatacactactcctaaagaagcagatcgttcttcttttgacctttatcgatagatattagcttagctagcatattatatctctccatataaatacgtaagtatataatcatagaaagctctacatgacaccaaaatagtgtaaattggttttaattaaacatgtgtctgccccgcaaaaaaaaattaaacatgtgtctgagtaatattgttttgaggtgaaatattagagtgaaacatattaggatacccatgtctgggttttgtagttggttattattggtatttgttaca

SEQ ID NO: 17001 - DNA, 1501 bp, Oryza sativa
gtggcagccggcaggcgagcgagtctctatcccctctccaccgactcctgtccatcgcagcatgccggcgtccccggattgagctccccaccgtgtcgaacctttcccctcctctccattcctaccgccacgcggagtcggccgacgctcagccgagcacggctgcgccggcgtcgcccgcggcagcctctcctcgtgtcgcccttccccaccacgccggtccatcctctccatccccaccttcgctggccatcctctctatccccaccgccgccggcctcctcttctccacaccgccgcgccggccttcccaatccaccgccaccccgtgaagctccccttccctccctcctttgcccggcgccgcccgattccttcccaaaatctttcttgagttttgggccaaaagccttccttacatttcaatcctatgccagttcgctacctccctccgtttggccttcttgtttccacccagccacgagtgaagcagttttcagccctaggctggtccgctacctccctcatttggcatgtttcgttcgacccatcaaatccggtcgaatctttcttaatcacccaaaattggttgttttacccaaaatcagagcgtaaaactcaggataaaaacaattggggaagatcgctgtcatcatcggcaaccattagattaaatccggcgaaataaagcccagaaaatcatggagaaaatgacgagggatgagtgggaatcgatttctttttgcaatcaaattgaagtaaaaacgcacgattaatatggcgccagcgtgacgccaaggttcaactcggtagacgtgccacgaataaatcggattaaaaaatcgtacaagaaaaaccaaaaacgcatgggataaaaacccggtgataaaaaaattgatgaaaaaaccaaaagcaccagggagatgcgtggtgaacagatcggatttaaaaaaccagacgaaaaaaccaatagcgcgtgcgtacggtaaaactatttcgcgtgaaaaaagtcaccgatgaaaaaaaaagggacttttctttgtctttttttactggcgagacctttttttacctgagtcggacaatttttttcacgacagaagttttttttatcggtttttgagtcggacttttttttccctttttttacctttttagtcggactttttttcctttttaccgattatggaaatttcttgttctttttaggtagagatagagattaaaaataaaacataaaattacaaccgattcaaacacggatgacgtatcaaagtatcagcaaaaacatcttcaatttttataatagtagatccatccaagaaaataaatttgcacgggaccgctccaatgcttctactttgaaggattcatgcatgcatacaggccgtacaataagaggaaatctactatatatatgccactaagatcaagtttgcaccggtgggacaacttgccatggacgagtagattctctcttacagtaaacaaccagtttttg

SEQ ID NO: 17002 - DNA, 526 bp, Oryza sativa
caactctacaagtatcgcaactgtttgactcaggccacatctccactactgagtcctcgccgacgtcgttgcttgcaccaaccaactaacctgcatgcatgcacatgcatctgcaactaactaatacatgcaagactaattcaccacataatcctgagactaatccaacctgcacgcacgcactacttggctgccaatctactataagcactctaacatattttgtgcttcacgggagattagctcgctatgccacaacgactaatgcatgcagctgacaactaaattagtctactcctacaactaaatgtgatgctatgcaacaaaataaatatgatcacctagtacaagattatttctaacaaggcccgacgaagcggcaagctcgcctcgcctgcaacctgcttgtctagcactctttgtggaaattatgggcgtgtttggttgtctggttcgcacttggcccgcatctgggatgcaacctcacctgtgtttggttgcttgcacgtttggttgggccaggtcg

SEQ ID NO: 17003 - DNA, 1457 bp, Oryza sativa
tatatattcccaatgcgcgccctcgtcttctccacaaacacttagaagtttttgcccgatcaatctctctcggcttctccttcgccgccactgcctagggcatccccgcgccgacgccgccgccgtatctcgccgtcgtctcgcgctcgtcgtcgtcgccgccgcctccgcctcctccgccaccgccgcatctctggggtgagagccgccgccgcctccctcgatctctctctccgatctcgatctctctctctccctctcggttgccgccggccgctgagtttcagacgctgacgcctacctcatcacgacacgacgccgcgccacgacgacgccgcgccacggcaccggcgccgcgccgccacgccgccgccacgcgccaccggcggcgcgccgccacgccgccgccgcgcaacgccgctgccgcgaaacgccgccaccgggcgtagcgccacgacggcatcgcgccgcgcgccgcacgccgccgccgcgccacgccgatgccacgcgcggcgccacgccgccgcgccacgcgccggcccgatgccgcgcgcggcgccccgccgccgctccgctgccgccactccgtcgtcccgctgccgccacaccgagaacgtgaacgagcgaacgaatgtgaacgagaacaaggtgaatgaacgtgaatgagaatgagcgaacgaacgtgaacaagccaacgaatgtgaatgagaacgagcgaaagaacgtgaacgataacgtgaacgagcgaacgaacgtgaatgaacgtgaacgtgaaatgcaattataggcaggtgaatgaacgtgaacgaacaaacgtaggtgaatgaaacgtgaccttaacgagaacgcgaacgtgaacgatatcgtgaacgaaacgtgaacgtcaaatgcaatatatgttacttcgcgtttatcctaatacatctttttgtatcttgcagaaaagacgttgtcggagtcgtccctcaagccggagtggtagagctagccctcgaaggaattcgcgcaggcaagagacgtaattatatatattattgttatatttgtaatgcaattaagattattagatttgtaattagacttagcttgtaatattgtgtgtggttctaatatactgacagctacacttagcatacatgactattttagtcttagcatataagattatttgagttttaatataagattattatatttgtaattagacttagtatataattattgactagctagagtcctataatatacgtcacctagacttagcatatatcactatttgagttttagtataagattattagatttgtaattagacttagcatgtaagattgtgtagggttctaatatacgacagttacacttagcatacatgactattttagtcttagcatataagattatttgagttttaatataagattgttaaaacataaatgtctcatgacttagcagatgtt

SEQ ID NO: 17004 - DNA, 612 bp, Oryza sativa
tctatagggtgtcgatctcactgtcgtgcatcttctctatgatcttttcagctctcacatctccggtaaaaatccatagcacatctctcagaaattttgcatatcacatcgagccaaatccttttatttttaagttcaaaaaaaatccttttatttttaccttttcactttgtgttctttgggttgcttgctttccttttcgtttacccctttcactcctttttctggcaaacaagtttgtcaaaactatagaataaaaaatgttgtcttcatcaactagtgccgtagtatatatgtaactttatttgtccaactcaactgcaccgttgaattagggatacctagctacctactcaatcgttaataactatcattaagaaacagataaataaccatcatgcaagtgattaattaacaggttataatataactactaaaacctcaccaactcttcacagagaaatgttctaaaaaatagattcactaattaagtaaagtaagcaacacacgtgcatgctttgcacataagaatgtaccctacaatatctgaactcattagcagcacatacaccattgtatatatacacaaactagtgagctaatattattgta

SEQ ID NO: 17005 - DNA, 1501 bp, Oryza sativa
tttacccggtttaaaaataaaaaccatgctaactcccttggtctgaattttttaaaaaagaactcatgccttgcctaaaagtaaaaagaagaggatgcccaattaatcaacgatttcaacaaaaaaattatatttaattgaccgagaggatcttgcattttggtatagtacgaagctaacatctgtagtatcatttcttgttttaacatatagtaaaggccgtatttctttaaaaaatacttatcatccattcccacacacagcactaaagatgtatactagagtcaaaatggttaaatctagtaagaaatgattgtccggttttatgtactctagtcaagtcaaggggaaaaaaaaaggggagtgtttattttgccttgcctaataagcaattgcaacaataagacaaccgagaaaataggtacacgactcatccattttgcatggtgaatgcgagctacaaatagatagacactatgacctagttcatttcttgtaaagataaagattttaccttagtttttattatcacgctttttaaactattaaacgacttgttttgagtgaaaactttttatattaaagttgcttcaaaatattaaatgtatccatttttcaagtttgtaataattaaaacttaattaatcatatgctaatagctttttttttgcatgcccatatttaatctgaatctttataagattcgaacacaatctatgtttacaatgaatatggaaaggtacctgttcaaattcgtttggactaaactccatattatataacatccccaactatgctgtttttttaaaaagagggaatacctttttaccaatattttttctttttattatttaaataatcatgtccagattcgttaaactattgtgtctcatttttaactaggttgagttttttcttttacaaaaggagtacccttttacgaaccatatatatattttttctgtctcccttaatagagccttttattatctaaaggttatatccatgtacaacccatctcattatgaataaacataaatatgtatacacccttttgcagctcagtataacctgctattaataccaaagttgccaaacggaaatacttattctgcgaaattctttactaaaccacacctatcaaagatgttgtaacagtggcgctcaacttaacgaaaaaacagctgtcgacaaagccacagcgccacagacagcgaccgaaaacgagagagaaaagatcacggacccatggaccgcgtccacggaatgatcgacagggcagcggcaaccaagggcggcacgttgccccgcgcggctagaccgctagtagactagtcccacgactccccatccctcctccctctctcgaccactcccgtggactcctctctcctccccttccctcccctcccccgcgcgcggtggtggttcgccggagcgcagcagcagcagcagcaaaaggccgcgagggccgccgtcgggatccccgccgccgccaaga

SEQ ID NO: 17006 - DNA, 1501 bp, Oryza sativa
ccggttgtacagatctaactccaaaccaggagctaaacaaattattaccagttatagcatcaataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctttgcacaacacaactcaccacagtgcaccattcctggatcataatcacccccttataaaacaaggcatggactccccagcgacccccgtgggcttatctccgccacttctcagtctggtgctccgcaatgaaccatgctgtacaaaaggtaaagccgttgcccacgctggcttgtggttggcacggttaatgtttcacaacagtagctcgcgaaccggtccttaattgccatgagcacgaccttcaaaaccatgtgctcacaacccaccattaatcatattttaattaccaattaattatcataacacgattaaccatcgtgagctaccattaaatataaccataaataataatgtagtatatatgattcatcccattagtgagctaatgtttctaagcattgctaagcaattatatctaacatctagttgaaccaatatatataaagctcaactagtcaaattataatatcccaaggtatcaaggaatagagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatttcttgaatacttccagcgcactcacgaaccttcgcaacgacgaaaacgacaagctaacacgcaaaacaaagaaaaagactaataaaaaccaaataaatagtacatataaagtaaacaaacatgtagatcataattttagatgaattatgagacttgaacggcctcattctgacttcatatgaattaaatatgaattttacaagatttaatctaattaaagcccatttaaaaagaattaaataaatttaattctatttatggataattttaatatgtagatctttattttatacaactttagagacttgaaccaactaaacccgagctaagatgaattagttatgaatttttaaagattaaatcggattaaaacacttatatggattttaattgaattatgacgcaataaagaattatttttgaaaaggaaaagaggattattgcgtcagcggctagggtttgcggtggaccgggtgcacagcggcggtctacggaacggacggccgagatctaccctatccaaaacgaacggccgagatcgatcggtccacggccggaccacgagagacgacgacga

SEQ ID NO: 17007 - DNA, 1501 bp, Oryza sativa
gttggactcatatgggatggtatctatccatttgacatgagaaataagatgattctactttttaagagaagacccatatgctagcgagagaaaaagttgggttgattttgtccgttagttttttatggaatatgtcaacccagatcttaggaatatcccctatcagtaaccatcccattccatttgttcttaaaccaaacaccatgaaaaataggttcaacccaatctgatctataccaacccttcaaccaaacatatgcttagtagctactccatccttttcaaattgatcatcatataatagaattcaaaatttttcaaattgataatcatataaccgcatggacacgtatttcatcaaaatacaattaatgtagcatgagaaaatgtgtgcatactaaggtgtagtatttggcatagtgttttaaacgatacatgcattgtgtgaaaatgtgtgcatggtatcttaattgatgtgatttaaattattcttggttttggtgcataaacatatcccctccattccaaattgatctacatatttcataggtacaccaagaccaagaaaagttaataactctctcatactatatttactctagcaacaaactcgatgcatacaccatccccactattttctagccaatagtaaatcaagatattacatgtgggttataaatacttgtgtgcatggatgcatgcatcaatgttcatttactccaatgcacaaataacaaatagacttaatgaatgaatataaatatgtagattatttagaaataacctaaaaaaaactatacgtagatcaatttggaacggagagagtatatgatatgatcaatttaggaaggagtgagtatattttgacactgagaggatagtttttcttttaagtagatgaatagaaattcggcatctatatccacagccaaaagttacatggataaaaaaattcaggccccaaaactaagaagcaacagaatatagcaaagaaaagacgagaagactaagcttcgatctttagctgcctcacgaaccctgtcgcgctaaaaaaccgcccgcttcacgtaccctgctgcgccaaaaaaccgcaccgtcttgatcttgatacacaactctcatccatatttcattcgtcactatgtccctaaaatcggccgaatccccatcgattcagatctgacaatttccagtccctagtgtcttcgctcaccgacgctatccagtggagacagagaagaagcccctccaatatagttttgcactgaaagacctacttgggatacttctccaggctactagtttttacattttgtttatgaacgtttgactaatatatcataacatctcaatcgatcatgaaaacaagatatcaattctacatgttacaccctttatttctctgaactacacgccgcaccttgcaaaatttagaaatacacctaagcctattaagtcaaataggtggcaaagtgaccacccacctttctttctttcttta

SEQ ID NO: 17008 - DNA, 1501 bp, Oryza sativa
taaaacagccttgaaagaaggtaccacgttcgctgtggggactagaaattcccacattaatcggagaaaaagaaaaggagagtccaagtagaaatacaatctaaaaataaataaaattcggaattaaaaataagcaatattaaaagaagagtccatataaaaacccaatatgtgattattcaaaatttggaataaaaataaaataaaatccgaattagaaaagaaaagaagagtccaagtaggaatacaatttagaaataacggaaattcggaatcgaatacgagataaattaaaattctgaattaaaaataaaataaattctgaattagaaaagagaaaaagagagttaaagcaggaatacaatttagatataactgaaattcggaattaaaaataattaatatatgaagaagagtgcttatataactgaatacgagaataattaaaattcaaattaaaaaataaaataaattctaaaaatagaaaaataattataagagttcttgtaggaatacactttataaataaaaaaaatatcagaataaaaaaattgaaattttcaaaaaattaatcaacctagaagtcaacggtgacaaataacaataaagaaagaagagacaagtaataggcccgtaaaatagtaagatggtgaacagttgatgagacatttacaaattataaacaaaactgcaaatagaacccccaagaacgattaagaggtggaacgacagacatgacgttaagcagtatagtcacaacggttggcgggacttatataaagtaaaaaaaaataaaacacaataacaatcatgttttttttagaatctcaatgataatagataggggagataacgggtataccatataggagtataatggtgtggagccggcggcggttggcgggacttctagaaattaaaaaatgaatccttaaaattcaaaataaaaaataaaataaatttcaaaaatagaaaaataattctaagagttcaagtaggaatacactttacaaataagaaaatatcggaacgaaaaatatggaattttcaaaaaaaaagtccatctagaactcaaacatgacaggtaaccataaagaagagagaaacattaggcccgtaaaggagtaagttggtggcacttgatgcgacatctaaaaactataaacaaaagcacaaatagaatctcaatgatgattaagagaagggacgatagacaagccgttaagcaacatggtcacgacgggtggcaggacttctaaaaagtaaaaagtaaatcacattgacaatctgatagtctatgcataactttttttttttgtagggaagggtatttttcacccggtctctatatctaatcggatatatgtagtcttttaaattaggaacttaataccttaaacaatccaatttgaaatttgctcctacagagatttaaactcaggaccttgagatgctactcatgtcactccaatcactatactacatgcgttttcacaatcac

SEQ ID NO: 17009 - DNA, 1501 bp, Oryza sativa
tgttattgtgttttatttttttttactttatataagtcccgccaaccgttgtgactatactgcttaacgtcatgtctgtcgttccacctcttaatcgttcttgggggttctatttgcagttttgtttataatttgtaaatgtctcatcaactgttcaccatcttactattttacgggcctattacttgtctcttctttctttattgttatttgtcaccgttgacttctaggttgattaattttttgaaaatttcaatttttttattctgatattttttttatttataaagtgtattcctacaagaactcttataattatttttctatttttagaatttattttattttttaatttgaattttaattattctcgtattcagttatataagcactcttcttcatatattaattatttttaattccgaatttcagttatatctaaattgtattcctgctttaactctctttttctcttttctaattcagaatttattttatttttaattcagaattttaatttatctcgtattcgattccgaatttccgttatttctaaattgtattcctacttggactcttcttttcttttctaattcggattttattttatttttattccaaattttgaataatcacatattgggtttttatatggactcttcttttaatattgcttatttttaattccgaattttatttatttttagattgtatttctacttggactctccttttctttttctccgattaatgtgggaatttctagtccccacagcgaacgtggtaccttctttcaaggctgttttaataatataatttttaaaatctcaatgataataaaaatatatgagtatagtaaagccgacagtggttgggcagatttctagaaagtaaaagatgaaccccaacgatagttatgttcaattttcaaaatcccaataacaataaatgtgggagacaacagacggatcgtggagaattacagtattgatgtttgacaacactcctaaaaattataataagggaacttgacgagacaatggactctaaaaactagaaggtctattttttaaaggtttaaaggaagataaataaatccgtgatagattgggtaaacagataaaggggtgataaaagagtaagaggtaacgactggtgtgacttttaaataaaaactataaaaatttaaggatgataaggttcgatcttttaaaattataagacaacataatggctatttaacaaattttaagtaatatcaaatatagaaaaatagataattttatatggatgctagccgcgcaattgcgcaggtcacccagctagttaatagcaaagaacagtttgtgcatctctcccgatcgggcccaacgtgtcccggcccatgaatcccatgatcgaggagcctagccccccaacccggaattcccggccatgccgaagcccaaggcaaagaggcccacgccgccacgggctcaccgcagatccacccccacgggcg

SEQ ID NO: 17010 - DNA, 1501 bp, Oryza sativa
gcactgccactgtgcggcgacccgcacaggctttattcgctgagtgcaaggtattttctctagtggccctagattttattatgagatcatattgttggtgcttctaattttatcaaaatttgataatatagacatattttcagtgccgtattttgataggctagaaaccaaacatattttaatcaatacttcgatattatagtaatggtgctgtgtacgtttcccttgtacccttaaaaaaagcatcagtcaatttttcttttaaggaaaatagctttcgacaaggaccttggagtacctccaactcacaagctatttggatgaggacatgcttaacaaatatcttcttgtgtttgatggccaaaaaccatctcttaggcattgattaatcaagagtgacggtaagtcctttagacaaactgtgagagaaaatatcaagttttacattaaaaatatattaaatacaacaaatttctctttataaaatattaaaacataaatttaccattgacctacaatttgaaaacctaataggagctagtaactatctttacaccatgacctatatatttttcaatatttaagttggacgcatgaaaataatttgtgaatagtatgtcttaaagaagtactttgtgatggcattatgcccgtattggttttataaatatgttacaataaaaactagcaactaaagttctgtttaaatgtgttaatatccaacaatgaaatgtattcggccggccctagcattttgttattgcactccgaactgcagagtagagatacgcataattatatatactcgctggcttcttagttgcaaccaaaatatttattgaaattcttctttctagactcttctcgcaactatcgcaagagaggatattttctcacaaaaaaaaaaggttattgcacgtaaatttaagcgacaactatgtggcataatcctgtgccttttatttggagcatgcgcgaaaatttctgaaagaataaaacaaaacaaaaaaaagggccccgagccaaccttgaaagctacaaccgtatgagaaaactaaagaaatgcaaataattctcttgtctacaaagaaaaggaaaaaagaaaaagggaaagagcaaagcaaataaatcgtctcatcatcacgagtcgcctgcgaaacaacagcgaaaagaaaagcaaagcttggagagagcttcacttcacgtcttcaccttcctctgctcccggagagcctctccctctcctctcctctcgcctcggcctcctctctctctctctctctctctctctctctctctctctctctctctctctcatcaccgcctccccacgccaacccgcgcgacgcacgcggcataccaagaaaccgcgcggcgcgcgcttcccgggggggcgcctgccttcgatggaggtcgcggccgcggaggacgcgctggaggagagcggcgtggcggtgtacctccccaggcttctcgccggcgtcatctccggcgctctcac

SEQ ID NO: 17011 - DNA, 1501 bp, Oryza sativa
ctggtcccacctatcatacacacattatgtcttagagtcagtgctgcagctagctacagatttatagcctgatgctcttctctttctttctttatctctttaaaatatgtttacatctgacttataacttgctattgtacctgctctgggagaggggccggctgaggacaagccggcaaaggatatctcccaatatgtgaccacgtggtcaaaaccactctcatctcatcgccacataagttaaaaccacctcgatcttatacataaggtagctagagatcgtcccacaatttcttattctttatttcattattgagtgactcattggttgtttgttttatggaaaataatagcaaaatactcatagtctgttatgataaaatgtacatactcatgtgtgtgtgtatatatatatatattgttcacttgatttaaataaatattagattattacatagtattagaatatatcaagaactaacttgtaaggtggtggattggtggtagatatcagttaaatgcctatatgttccaacgggaattaataaagactttaaaacctcaaacactaaaataaaattatccccattgtaaaccatctataatatttttcaccattttgtatctcactttaaaataaattttccttgtttgatggcttctggttaaggaagggataaaagcctacctatctcactattcgggggaccaacatggtaatgatggtgggtagtgacatattcagatataaatatagatatagatatatataatgcatttctattactaaaagtttcaagcatatttttctgtcataataatatatctaatcgtcgagttagagtgtttccttgctcatctatatctatacctattataaaaattcaatgtgtttttgcatgaaaatttgatacatcatctatgttagaatcggttttaattaaatatgtttccgtatcagaatgtttgttttatctgtattttggtttttttccccttggcataaaaggggtgaaaaaaacgtccgtaaaaaaagaaaaaaaaagagcgaaaaaggtcccaaaagaaaagtccgattccctgcgaaaaaagtcgttcgtaaaaaaaataaaagaaagcaaaaataagatctgattctatgcaacgaaaaaaagaaaaaaaagaaaaatacgtaaaaaaaagcgaaaaaaaggccgtgaaaaaaattatatccaaaaggataaaaaaggctaaaaaaacaagaaaaataataagaaaggcaaaaaaatatgcctttcaaaaaagaacaaaacatttccatcataatctttacctattatataaattaaagataatttcatactcatcgtattttcggccgttgtcctttcattttaacgaaccgtcctattccgatttatatatgtttttagcgttgtgataatattcacgttttgctttttatctccacatccaatatgtttctgcacatatgggcctaaaattgtaaaagggtccaaaa

SEQ ID NO: 17012 - DNA, 1501 bp, Oryza sativa
ggaagttgcggtgtgagagattgctacgtactggttcgaggaccagcgagcgagtagaattatctctcgaacaccaatggaagttgcggtgcgagaaattgctacgtactggttcgaggaccagcgagcgagtagaattatctctcgaacaccaatggaagtttcggtgcgagagattactacgtactggttcgagaaccagcgagtgagtagaattatctctcgaacaccaatggaagttgcggtgcgagagattgctacgtactggttcgagaactagcgaacgtgtagagttatctctcggacaccaatggaggttgcggtgcgagagattgctacgtactggttcgggaaccagcgagcgagtagaattatctctcgacaccaatggaagttgcggtgcgagagattgctacgtactggttcgggaaccagcgagcgagtagaattatctctcgaacaccaatggaggcgctagagttggtttattacatgtgtatctcatgtggccagcatgactcacatacccaacttgtagcatatccggatgtccgttcgcaatcatgtcgggtgatcaagccgacggcattcgcgaggaattatccattaacaaccttttctcgagtagtccagccatggccggtgctatgagataggttgtcggtcttcgttggtaggttgggcgcgacgactctgcatttgtcgagattattctcgataatacagtgtactcgaccacaacctactcgagtgctcaattgttcctgaaaaatattttctagaaggcaaaatatatagcagataatatcgagtatgtactcaaaaaactgcatggatcttctagtattatcaggatataactagcagatgtaaatatcaggtattatgtaaaccgtaaacaagcatgatttatacagaagaaaacagagggagcccctagtgttagactgtagtcggcctaacatcagaaacactcgcgcaatagatgttgtataaaaaacatgctctaggtaaacataataaatcatagatctgacaatgctgtatgatctgaataggtacgataaattgcatataaaatattgcgtacctttgtaaatacatgccggatgtatctacgaaattagtagatcaatttaagaaaccaatctaccaattaccttgttgcgtacttgttcgatatcatgcgatctgacatcttttggtatgtcgcggagcttgaggcttggatgatctcgatagaccaagttgtcgatgacgatgatggttccgatctagtcagaagatatacttggataggttggatctccccacagccgaagtcgccgagtagcttgtacttggagagtccatatctcaaacccatctcatcgaaaccttgaagcaccaaaatccccctacctggcgcgccaactgtcgacattcgatatctcgactacggtatttgcatggcatggggatcgtcggtgctaggatatacgcgagactgaggtaaaagaga

SEQ ID NO: 17013 - DNA, 1119 bp, Oryza sativa
tctctgcctgcagctgtgcagcctgcctggttgcatgcatgcatccggcccctgactatattattacgtccgcatacttggcatgctgcgctggctgcgctgagctgagctgagccattcggccggcatgatgcagcagcagcagaaggcagagcaggagagaagcccatctagcagcagacgtggggatggatggatggatggatggatggacgcagctggcagctgtgtggctagcttgatctgatcacggagcctggccgtgcagcgcagtgcagtgtgcgtgcccgggcggctgctgctgcgagtgactgagctgagctagccagctaattccgccgggacggacggagacggcgcgggaccatgcggcgtgcgtgcgtacgcgttggaccgcgtggtgtgcgcgcgtgctgcgtccgtcgatggatgcaaaccatggctgactccaccgccggtatcgttggttagttgcagttcagcagctgggcgctttttacatggcacacatgcgcacgcgtgccctgcgacgacgctacacgggccgtgtaacacggcacccacgcacgcacgcacgcagcaggccagggcacggcctcgtcgggcccgggcgtcagctagcggttgggtgggctgaaatccagcgcgtccacgcatatggatttcatatgggcttcggtgttagcgggttggttttccccccggaggccgtgaagtgtgttgactgacttgaacttgagaggggaaaatgtacaccgaaggtccctcaacttgtcattgggataaaaaacgtcctcaaaccgcaaaaccatatacgcgaggccccttaactatacaaaaccgatcacccgatgtccttaggtggtttcgaccccggttttgtcctacgtgactgctgagtcagtgcgggactcacgtgggccccacctgtcagcctgtccaggtcagccactctctcttctctcccatttctctctctctctctctcacttctctcctcttgggcaagccagggcaggtggggaggaggtcgccggggcgcagcggcgggagcacaaggcgacgcggcggcgggctgaggcggctcgtcggcggcggcagaggaggaggaggcaacaa

SEQ ID NO: 17014 - DNA, 1501 bp, Oryza sativa
ttgacgggacttctaggaaataaaaaaatgaattccaacgatagttatgttcaatttttagaaccacaatgacaataaagagtaggcggcgtacgggccgtagaggagcatagtagcatcgtttgacaaaacttctaaaaattataaaaaatgaaacccaacaagacaataaactctaaaaactataaggttcaatttttaaaagttcggaacttctaaaaagtaaataaaaaacaatgataatcatgttcgattttaaaatctcaatgacaataaagaaaggaggcagcgggcgagccgtagagaagtacaatggcaaagccgctgacggtttggcgggacttatagaaagtaaaaatgaacccaaacgataattatgttcgatttttaaaatctcaatgacaataaagagaagagatagtggacggaccatagaggagtataatggcaacgtttgacgggacgcctagaaattataaaaacgaaacccaacttgacaaaaaaaaactctaaaaactataagatccaatttttaaaggttctaaggagaatgaatagaaatagtggtagatcgaacaggcaaataaagaaggagatgatataaggggtagcaactggtgtgacttttaaaaaactatataattagaaacacggggatgataaggtttggtctttcaaactcttaagacaatgagatagctatttaataaatgttaagtaaaaccatactaaaactatatgattttatttaggtgctagccacgcaattgcgcgggccacccagctagttttattaaaatagcttggaaatgaagcaccacgttcgctgtggggctagaaattcccacattatttggggaaaaagaaaaagaaaaggagagtccaagtagaagtacaatttcaaaatagctgaaattcggaattaaaaataatcaatattgaatgaagtttccatataataacccaatacgagattaatcaaaattcgaaataaaataaaataaaattcaaaattagaaaaggaaaggagagtccaagtaggaatacaattgaaaaatagttgaaattcggaattaaaaataagaaatattaaaagaaaagtcaatataagaacccaatacgagattaattaaaattcagaataaaaataaaaataaatctgaatttagcaaaagaaaataaagaagagttcaagtaggaatacaatttaaaattagttaaattcggaattaaaaataagcaatattgaaaaaagatccatataagaactcaatacgagattaattaaaatttcgaataaaaaatatagtaatatccaaaattagaaaaattaaaagagagttcaagtaggaatataattttgaaacaactgaaattgaaaataaaaaataaaaacattaaaagaacacaatacggttgtcaatgtttgatgccgcgattccggtatttacatagtatggggatcgttggtactaggttatacgcgaggctgaggtaaaag

SEQ ID NO: 17015 - DNA, 1501 bp, Oryza sativa
ttgtattggattcttatatggactcttatttcaatattccttatttttaattctgaatttcagttatttttaaattgtattcctactcgaactcctatttttcctttttctaatttcgattttttttatttttattccgaattttaattaatcacgtattgagttcctatatggactcctctttcaatattgcatatttttagttccaaatttcagctatttttgattgtatttctatttggactcttcttttctttttctccgattaatgtgggaatttctagcctccacagcaaacgtggttatgtatttttggcttgctaatttttggcttggttatgtatttattggcatgacaatactgatacaattcggaaacggcagagtttgattaggattgttttgcctttcaatgtttctaaaagtggtgtgaacacacgtattcccaaaatattgtccgtttccaatatgattatgtttttctttttttttttgtttttgaccgattgtacatttcgtttccagtagattaggttttcctttttttgtttgtttgtttcttttttttaagacagattgtccgattccgtttccagtagtatgattaggttttccttttttttttgtttttaacgattgtccgattcgagtttcttaatatgccttttttctttctttcttcagtttttaatttttaactaatcctaatctagttctatttttcctttttcttattttttgattaatgtgagaatttttaggccatgagagcgaacgtggagactcctttttctattactttaaagatataatagatagattaggtcctccggtattagagatagttggtttaccgacatgacaaattgacctgatccactcgtattaattagaagtttatctggcaaaaataaagtggacctcacatatcatcctcactctcctcccctattctctccctcatccatccccttgtccctcaggcctcagggcgaggagagccgccgccattaacgtgatgtgaagccgtcgtcattgccgacacgatgtggaggcgttgctaccgccagactcctccctccaccgctttaccccctctcatgcaggccatcaaaaaaacatgtcgtggcgtggatggatgagggaggagtccaagagtgctgacggcgaagcggcttaaggcaaaaagagtcaccgaccgggtcaccatctctgttccctcttctttacccttttctcccgtctcctctttttctctcttgctttgatccaattttataagttggagggtgaatattttcggtattgcggtttagagatatgatttaagctcgatgaaaacatgaggaacgtttggtggacttaacccggagataaactctaggattacattgtaatgggcttttgatgggccgttccggcccacgaaggatagcagatggtggtggactggactggactggacctggatgggtgcgtggaatttctcttctcggcgaga

SEQ ID NO: 17016 - DNA, 1501 bp, Oryza sativa
aattaatcaggtttacttaaaaaaagattccttaatcaagtgattagttaatcctaattgaactcggaaagctgtcgctacgcttccaagtgatggtagtagtactgtagttctttggctcctgaagggacaagaacagatgatgctgagtcacacatggtctaaaagtaaagaattggcaagttcttttcattcccttttgtgctgtttgattgatgaaacatggaagccaagtcaccttgatcacttggcctttttttgtttggactcttggttctcctataggtcatgtactcatgtgtttgcttatctgataagaacctgtcaattaatacattggcctttttatcacagctactctgtgttatcagagtactgtactaattgaggagaaaatgtcaggctcttttcattgaagggaagagactaaagagaaactcaacaggagcaagagacttggactcttctcaataatttgatattttatatacaaattaacctgtctagaattatttgactagagcattattgccgaaaaagataacaatgtcaacgccaagcacttgtcaaagcctttttcctgtccctgatttgcagccagatatgacacataattccctggaggcaaatagagagagccacatgaacatctggctcagtttgctgccaagttcttggcaacccttggcagcacaaaggaggacatgaataaaaaggaaaaaaaatctggaaataaaataagttcagttaatttgggtctccctctgaccttttctttttggggtaaaaactcctttttccttttcttttttatttgcaagaaagctctggctctctgtcatacatctaaagaggaaaaacatactagtatacaattttactttgttgtcttgtttccatataaagctaccaacctcttctttcctttggtggcactggatatgcaagaaataaaaatcatctatctatataagtaattctacatttcagctcaataatatctccctccatcccaaaataaattaacctgtgacccattctaggtcgagttattttgggacggagcgagtatgccagtaacctattataaacctcacaaaggtatgaaatggcaggtagccaagttgaatcgcgtgcatctccatgacctcaaagctgtcaaatatctcatcacatcccatcaaagctaagtcacgcaaattaccaccattcagctcagcggcagtgacggttgccgctagaaatcaagggggaaaaaaaccaatgacgattcatcattcatgtgattttctaccaaaatagttggaagggaaaaggaaaatccggacaattgggagttgggacacctgggacctcctagcaattctggcggctgtagcgcccaattcagatactccatctctttttgatggcagcatctcaactatcaacatcacaacacatctgattggatttgttgctagaagcaatagatctgatagacaatagaaaataagaatta

SEQ ID NO: 17017 - DNA, 1501 bp, Oryza sativa
ggttgaaacaacggtactatactactacaaaccagcaacgcgttgctatctgcacagcactccaaatgttcgcgaaaacttgacttgttttcgtttgagaaagttaaagagtcgaaacttttcatcctgacaagttgagagagtagtacgtgacaacaaaaatcaaagggagatgcatgtagctaacccgttttctgcctgctgcattgttgttaagcacaacaacaaagcttaagcctgtaaaagcattgcaaaaggcaggcgacgcgtcgattaattaggtgttgaaatctggaacgttcttggccatacaggcgctgcgtggccgtgatatagagcagcttgccgggtaaaaagattattctcttatcagttaacaacttttttaccacctttcatgcatcatgcatcattcaggtcagattagatgtgctcattggaaacggacagggatgatcgaaccatccatccatgggcgatccatggtgattcagaaaagtaaaactgcctttgtttcttgtgtagcacagggatgcaaacgtacaaaacgaccgtcacaagggtcatctctagctggaatcacatctcttagcttgttttatggatttgcgtcaggtgcacgcttcaatcctgggccacggcatgcatttcgatcacctcgtccttcgtggcgacatacctttcgattttggggaaaacaatggtcgaaattcccggacaatggaaagcgagcaagcagcatctctctttgttcttttcttaagcaaagattgtttttttccccttaatttttatttcgggtgaaagagtttatgcttttctgaaaaagaaagtgttgttttacaagttggaagggatccacattctctatcataatggcagcactaccattacaagcactgacgtgtggaacaataggagtatatgacccacatacctgtcacggtaatggtagtgatattatgttatccggttgtaagaaatcaggctgctccaaaaatactcaatgaagttggtgtactgctctagtcttccactgagtaagtagagcaattaactgtgcaccagtaatcaaatctttgcatttactcgcacatttagtaatgcaaatctcagcacaatgaattactggtactagcatccaagtcaagttcatggaaccgaatctgagagtacattaaacaccaaagatatatcatatcatatcaaatattcaaatcaaacggctagaatgcaaaacatacacgcacgcatgtcacgcgtttgagccagtcgaggaccaccggtgggcccagctgtcagcgaacgtgggagttggcacaggagagcgcgtcatcgagccgagccgatcgatcagtgggtgagggtgagagtggccggccttggccttctataaaacgtggcacctctcgctcctcctcgcatcatcgctcgcagtcgcagcacaaaaacatttctctcgcgagtcgcgagttgcaccgatcgaattaagggtcgaaga

SEQ ID NO: 17018 - DNA, 1501 bp, Oryza sativa
tctgtgtatgccatgcggtttgaacttctctcgctagctactctctccgtaaaaaaaataaaaaaaaaactaggattggatgtgacatatcctagtgcaacgaattcaagacatatttctgtccagatttattgtactagaatgtctagattcgttttattaaaatatatcacatctagtcatagatttgttttcgtgtgataaagagagtacagctgcgggcggtttcgacttccaaccagctgcacgtacccttctttgctgtagcctgtaagcacatcgcatcgactagtcaggacattgaagagaggattacttctaagggcctccttataatgtagtactctcctagggatacaaaggttcaaagacaggatatatttcgacaaaataccttggattctagaaggactataatgaggaggaagactctccattcataaatgatcatcatataatttttttcaacgttatatagaaatggtaagcatatttgatagtactttttatacctggcttttcgtttctctgtgtattattaaatggtcttttgcatgcatagttcaatgtactattcaactaattgtaatttgaggtgcatgcatgtatacatgcaagcaatatatcattggtgcaaatttcccttgttgcatgcataggatatgaaaaaacggtgttgcaggttaatcgatgtaaatttaagtggcatgtgggagtgcattggcataggtgcacaaatcatatatgctgatcatttgtgaatgaagggaatagcaagtgggtaataaggatggaacacaaaatcatgtactctttccatcccaaaatgtagcaacatatgactgaatgaaacacatcttagttgtacgaatctggacagaaagatatgtcctatccaattttaagttgttatattttacaatgaagggagttgttgttttagttattactaggaatggatgggtgaataagagagtgggagtgagaaaggagagtgttttaatatttgttgattgcttgttatttggtagtagtgttactactggatcatactactatccaccttactacctaccctcacaatagtagtatccaccttactacctaccctcacaatagtgaaccaggtaatatgactccttgctacctactttttagcatagtgtggatgccctaacaaatttccataacatttcgacttcttgaaatcacacggttagtttgtcaaaaaaataaaataaaatcacagagttactgcactaatttagtaccctttatttcgaacatcaaatgtgttcactaaggaaatacctgcaaaatttgttggagccttaaaaaaagtctatgaaaactatcaactatagataaataaaactttcctcttgatatcaaaatgttatccggagacgaaaaggttttatcaatgaattttgctctaaaaaaatcacagaagccttaaaagtttctctctctctctctctctctctctctctctctctct

SEQ ID NO: 17019 - DNA, 1501 bp, Oryza sativa
aatatgacattctcacttacagagaaatcaatttctggtaatacattggctaagcagcatttcgttgaacaccttttgggcaaaaaagagcattagtgatcctgcaatctgtaataaccctcgacactcacagtgatgattcttgacaaatgaatgggttgcaacgtaaagagaacgaaccaattaaccatgcgtcccttctccggcagaagttctgccggagggatcgtgctcggatggtaccgggggcatggagcgctggaggcgggcacaggtgtcacctctcccatggagcgggcgaggcggctgggaagcagattggcgaacctcgcccttggcaccgacctgggcgaggggcgagtgagggatcggcggcggcgttgatctgggcaaggacgaacaaccccgtcgcaccttgcacttcattctctccctcaacgcctggtagtgtcaccgcgcgcagccgtcgttggagtgaggtcttcaacatctcccatctgtcggctgttgtggcgtcgatgcagggtcagcgtccggtccccaatcggcggggtgtcgggcgacgagcggtggcgacgagcgtgtgaccttgagaggcggaggcgtgcgatggcgatctgcagtggatggatggaagcgggggtgcggccgacggcgagacgcggcggatggatggaggcggtgccgggggggggagtgttggggcgatagggcgggagggaccgggagagcaggcggcagaggaggaatggatcggtggtgcgaccggcggcgagacgcggcggatggatggaggcagtgccggcggggaggagtgcgataggaggagcggcgatgtcgacccgcgacgacggcggcgtcgattcgggcgagcaggagtggcggtcggtgaaggcgtggtgggggcgcggcgaaggatgaggggagcggcgtcgacggttggatagcgagcgcgatccggcctgtgggggagaaaagtgtgattcgcggaggggaggagtgcgtgcgatgggatcctcagcaccgtccgatctgccaatcccacggttaataagtcgcgtgtctgctagggttggagtgactgtcaccactacagaattttaaaaagtagtagagatacaccatgcatgcatatgatatcctgcaaattatatccaaaacatatgttttattaattcaaccgtagtaattttaagttattgttttttattttttacaaaattaagatatggttaacattgtggttctataaaaccttatgaccaaaatacccatgattatacgaacatgcctaacctcctatgtagggatggtaattgtgcccgtttgcccgtttatccgtgggtaaaaaccctattagggttggttttgttcgctattttatacccatgggttttttattgggtcaaaggctatgtccgatgggtaaatgggcataggtattgtcagggttacggatagggtataccctctacccttagatatacgttgtatactgata

SEQ ID NO: 17020 - DNA, 1501 bp, Oryza sativa
ggcgacggcggcggcgatgcagcgcccccaggcgacggcgcggcggcgctcgcgggcggcggcgcggggatccccggcggcggcagcgaggcggcgctcccgggcggcggcgcgcggcactcaggcgcggcggcccccggcggcggcgcggcggccctcggcggcggcgcggcggccctcagcggcggcgcggggctcccaggcggcggcacgtcggctccaggcgacggcgtgacagcccccggtgacggcgcgggtcaccgcggcgggtccaagcggcggcgcgcgaccctcaggcggcggcccgcggctccaggcgacggcgcggcggcccctagcgacggcgcggggctcccagtcggcggtgcggcggccctcgactgcgatgtggtgctcccaggtggcggcacggcggctccaggtggcggcgcgtcggtggcaggctctcaggcgacgggaggcgaggaggtggcaagtggcggcacagggggtggtgcgggggctgcatgcgccggtacggtggtcactagcagcggcataatagtcccagcaggtggcacatccctctcaggtggttccattttccttcttttgtttggtttcatttgaagaatttgtactgcatgatgtgaatgagatattgtggtggaattatagatggattggagcacagtgaaggagagcatgaacatgaggggatggattcatcttggattccggatgggtatgtctttcatcttatgccctatgagtaatatacttttattagggagtcagagcagttacatttttcacatttttcttctcacacatcgacgatgtgttcatcaacagaatggacacatcttctacttatttacttgacgtgagaataatgggtaagacatgtaggcctgaatttccgggtggtttttctttcaaatggcctattgatgcagacgtaacaaacttcaaagattttctgggtgatatttgtgaaaaatatccatggggtttaaatgaaactgtatgtttgcattatattcatgctagtagcaaagaactcattccaatatgcaaagatcaggacttgacagcaatgttggagtgctttcatcatactaaaaggggtaaagtggtaatcactctgggaaaccaaattaatttgtcccaagctattgtaccttgcactccatcactttcagtcccctctcaggcattttttactcaggaaggcagcactagtcaggcatccaaaagtgatgcatacctagaaaatccattccgcactatgagcatgtaggtgtagatgatgagaaacaatactcagttggtattgatgactcttcatcggagagtgatgactcttcatctgagagtgatgactctattgctgaaactgataatgtgcctgaggtagaagggggagatgatctgagtatcactgatagtgatgatgaagagtggattgcacgagatgctcaggcagatccagtaatcccacaagttgcatatgacaaag

SEQ ID NO: 17021 - DNA, 1501 bp, Oryza sativa
ggatggctcgtggaatgtaggggaaaaagggcggcaatggaggaaaggaaggagaaaaattaaagaagaggtggtcagtcagaggacgaggacgatgatgatgatgatgatgcattggttgtcggaaaagtgggggataataccctggaatatccgcttgcacggccaatgccatgcaatgcagtaatcaaaccagccaattagtaaaccgtaagcaaaagcacatatgtttttgattaattgtgttcttggacaaaagccctgaggtgactggaatgggatcactgagccagagagagagagagccagttgacccagcacttggccgagtatgtatttttactcgggaagtgcatttgttcatcaggaaatattccctcgtttttatatgttacttaaaaaatttttggaaacctttaatttcttcaatcgttatgtgagatatcactgtgtaaacttatatatcaaattcaacttacaaatacatataaacaagaaaaaaggataaaaataacaaatttggttgtaaatagttttgaataacatacacaaaacagtaggatggttactcgagagagaaaaaaaaaactctattagctagctagcaccttcagctagcattaattggacattatctaatgagatatatacttatttttcgcactgctactacacctacatgcatcctctaacatacacatgaatagagatcggcctatagtaaatccctaaaatactaaaatcctagtaaaaacatactcatgtgtgcacctaatattcataggtggcagagttatatccctaataaataaaagcatatatatcaacgactccacctattcatttttccatcttacgtaccactggtccttttgcaagtatattatgtgctctctctatcctaaaatataagcattttaaaataatatcaagtcaaatatttataactttgactatgaataaaaataaaaaaaaatcaatcatgtaaaattgatgctactagatttatcattaaataaactattataatatataattctttttatttaaaatatcttactcatataaatattgttggtcaaaatagcatctgaaagaatatatcaaagttcaaaaatgtttatattaaacattttgggacagagggagtagcaggtttggaatacaagagtactaagggtttgtttagttcacgaaaagaaaatttttggtgttacatcggacgtttaaccggatgtcggaaggagttttcggacacgaatgaaaaaactaatttcataacttgcctggaaaccgcgagatgaatttattgagcctaattaatccgtcataagcatatgtgggttactgtagcacttatcgctaatcctgaacaaattaggcttaaaagattcatcttgcgatttccatgtaaactgtgcaattagttcttctttttatctatatttaatgcttcatgtatatgtacaaagatttgatgtggtgtttttggaaaaaaaaa

SEQ ID NO: 17022 - DNA, 1501 bp, Oryza sativa
gatcaagtttgttatagagataaaatcaattggtttgttggttatctcttaattcatctggttttatctcttccgcatattaacttctgaaatcttggcgcgtaggcagctaccgtcttcggccatgggccgagcctatgattaatcactcggatatgcataggttgcttaatcacccaggcatgcacacacatacgaccgtctactgtagtacatgcatgcatgcacgtgattgcctcaccagccaatcttcacacggctagttattggttaattatacatgcacatatactaatccaagtatatatattcccagctgcctgtgcatgcatgtatttgcgtgtatatacatggccgagcattgcgtagaaatgataagctagccaacttacaaactgcttgtttgctttgtccatcatgagtaagtcttgtgtacacatataatagccaaaataccatcaaataggtggacggcagggctacgtctctcctcccatcggcgggcgcgagcgggagacggcgctgacgggggcacggcgggagcttggtggagtggatctggcggtgtggccctctccgtcgagctgccgctgctgtggtccttggtggcgcggaatggcgacaacagcgaggttaagttgccgccgccaccaccatatccctttcctccctaggccgctgccaccaccatctttcttctcctcgcttggctgtcgccgccgccatcttccttctcctcgcttagccgccaccgccaccccgtcgagctcaccagatccagcctcgggttcgccggatctagcaagctgcaccgcttaggggatgacgcagctggtcggggcggcggcctcgccggcgaccgtcgccacttcgcacgggatgtgggggcatcgcatggggctacggcctctcccaacgcgccgctccaccctcgctgcaagttatgacgaagaacgggtaacttagtttggctccgcggacttcggttgggaacgccacgcacatatatgggaaggaatatctgacgtggatggttggggcagaatgccacctcagtgcactgtgaatgcccttaatagatggggtggggagagacaaagggctcccgagcctgacgcgtagtcttttcgggagaagctacaaacttcaaaaaggaaaaaaacactatgagtcccattggttaccctaacaaaccaaagcaaaagctgaaatttatttttgtcaaacttgattttgaagttgattgtaagatattttcaacgtagtttatttttcagtattggtttttaagtcacaaacatatatataaaaaccttacctataaattaattattatttattaataaattgttttggcttattaagaaatactatacgtacaacagaatgagaacttctttttttacttataaatgttactacggctacacttaatctaagcctcacatcaataccatagtgcctgtgaacctcgaatattaacgattcattcgtacaaaaa

SEQ ID NO: 17023 - DNA, 1501 bp, Oryza sativa
tcgcaacgccgtgaagcagcggatccaccagctcccctcccccccgcctccgtcgtcagctgccctcctccccgtctccgccgccggctccctcctcgatgagacgccgcctcagtgagccgtcggctcccctcggccgcgacgatgatgaccttcgcggcgctgtgaagcggcggatctaccggctcccctcctccccgcctccaccgccggctgccctcctcgatgacgacgacgaccgcgacgccacctccgcgagccgtcggctcgcctcggccgcgacgacgacgacgacgttcgcggcaccatgaagcggcggatccaccggctcccctcctccctgcctccgccgccggttcccctcctcgccgtcggctccatctccgccaccggctccctcctcgcccccagcttcctccctctcgacgacgacggtgccaacgacgctaagacgaccacgacgtgacaacggcgccaccagcttcatcctcaacgacgacgaccacgacgcgacgacgatgacgatgcgacgacggcagcaacccctgtggggacggcagcagatggaggaggagagccgtcgtcagctagagggagagaccgacggcggtggtggggcgtcttttttttattcgctgaaatttgctttgcaggcgagtgaatctgccacctgcgaagatgccgtccgcctgcaaaaattgattttcgcaggcggacctcagatccgcctgcgaaaattatctattttcacagtcgtttgcttataggcggaacaccggtccgcctgaaaagacggatttggcccgcctgcaaaaaccttttttctagaagtgaaatacacacacgggggctagttatcgaatattatctctcaacatatttttctatcatctattaacttattaaaggaacagaaaaatgagccttcacattcgctctcacggcctagaaattaccatattaatcggagaaaaagaaaaacatagtccatatagaaatacaatttaaaaatagttaaaattcggaattaaaaaataaggaatagtggaagaggagactagagtccatatagaaataaaattaagaaataacagaaattcggaattaaaaataaggaatattagaagtagagtatagagtccatgtagaaatacaattaagaaataatagaaaatcagaattaaaaataaggaatatgagaagtagagtatagagtccatataggaatttaaaactaattaaaattcagaataaacataataaaattaaaagtagagtttagagttagtataaaatacaatttacaaataactaaaattcgaaattgaaaaaaatgggaagaagagtataaagtcaatataggaatacaatttagaagtaactgaaattcaagattaaaaattgaatattgtaagatgaatttagagtctacatagaaatacaattagaaataataaaaattcattattaaaaataaataatattagaagaagagcctaga

SEQ ID NO: 17024 - DNA, 1501 bp, Oryza sativa
tggcatttcccttacaagacaccaaaatccagcgtgtatacaatctctaactgtaccatataacttggttgaaccgttgaaatgtatgaaatcgtatgttttacatcatatctgtataattgaacttcagcgagaaacagttaggaaaaacatttttattttttttgaactttcgaaggtaatttaagaaaattcactttgttttttaataaaacaaaacctttttgacatggttgcagtacatctgccacaccgggaaggcagggaccatggcgagaccaaaattttgaatataaggtaccaactaaacggtatgttttacaatgttattagaatagtattttaaggtggagaagcaccaataaagttgtggtatgcggatgtgcttgaagtgaagtggtggtggctagggttcaaactctatcaatatacattacacaaacatagttgtgttttaaatagaaactaggaaggtagcccacgcattcgcgcgggcatgcaccgtacactatgtttgaaaacttataaaggtgaaattttaattggaacttatgaaagatcattttttatttggattatttgagcacatttagaaaaaaattggaatattttctctaattaaaggcactcgattttttatgcagcggctcaaactattcttgtttacgtagtgaacgtttaatttagctatacatgtttcaaaacatgtcatggtgcgtccctgtgttgttgaattatttcttttccttttggcaaattaaatatgaaaattttgttctgataatattgatttaatttagctatgcatgtttgtagaatttttcataatgatatataatgtcttttcataatttttacaagctaaattatagtcaacgggtgtattaaattctaatttgtgattaattgtaatttgtgattttaatcataaataacataatgatataaatagaacgtataatttggtccgacagaaaaagaacttccttaaaacagaaacggagaggaggtatgtatgtgcgtattgtttgcacgcacgctacttgcatgggaagaggggacgtctctttgttagaatgagaaaaatcaatctaatccaatggcttggagtagtgggcctattaattttagagaaatcaaaggctagttgttatttttctcagattttctataatttattggaacgtcacgtggtgtcataggagcatttatatgagcatcatatggtggcttaggagcattatagaaattttcatggacttttactactcccttcgtcccacaatataagggattttgagtttttgcttacaacgtttgaccactcgtcttatttatttttttttgcaaatataaaaaacgaaaagttgtggcttaaagtactgtggataataaagtaagtcacaaataaaataaataataattttaaaaaaattgaataatacgagtggtcaaacgttacaagaaaaaactcataatcccttatattatgggacggatg

SEQ ID NO: 17025 - DNA, 1501 bp, Oryza sativa
acgcacggtgacactcgtccctccccctctccctttccctctcctcattgcctcaatgcccgtccctccctctcggtgatgacgccttctccaccctcaagatccggcgacgtcgacggcgacgacgatgtcgtcagcctccgcgggtggatctgtcggtggtggcggctaccgcttgcggatctggcagcgacagctccctccgtcgcctctcttcttcctctggcgacggtggtggcgtcggcggtggtcgtggatgaatccggcagtagtggcgacggccgaggggatccgacgacgccccgtggtcggattcggtggcgacgacggcgttggtggcttctcggtgatgtttttatttttcttccctttttttttctcaatcgcttgttgtccgattgaattttgtatgaattttttttttgctttttttttgccttattatgatgcaaccggatttgattttttttcaccttttttttttttttgccctttttcacggacggacgacggaaacaccttttaatttttagacgatggaaacaccttttaattttttaaatagtagagatgtagttgacagagttgccaggcctataaaaacacgattccaactggcccaacggtcttccctagccaactggcccacggcccacggcccactagcagcacatctgatgctcatctttgtaacctaggtcacatagccaacttgacagttgacactcgggcccgcgagcccccgactcgcccgccgccggccgccaggccgatgtccgacgacgctccagcctcctgcgctcctcacctcctgttcgtgcttgcttgacgtcgacgctggcctggcctcgctcggtcctgaccgagcctcgaggagacgtcgccgccgaccgccggggctgacctctcctccgattgcccgacgcccgctccagcgctcctactccatctccggcctccgactcccagccacaggggcgcaggcggctgatccccaggctgctatccgcggcggcggcggcgcgtgcggcacaactcgccatttcgaagggagtagccgctctttgatgagcgggcgaatgggtacaggtatgaacccgtacactgtaaccgtctcactgagaggagggagcgcatcgtctgccgtcgtaactataacggcacggtcatgccgttggcaaatcctgatcgttccttttctttggacgattaggatttagaaggatccaaataccaggcctgcaagttcattcaagcccactaaccaatcggctggtgcggcaatataggcgccgcaaccttctgacgcgagagaagtcccgatgcttttttttatcgatttcactttccccatcttcatctctcacctctgtctctctctccacgcatctctcaatcactgcaaagcaggagcgccgattcagtggcttcaaccataaatttttgctgccaataacagcaataagctccctgatattacccaggtttgcttcccatcatt

SEQ ID NO: 17026 - DNA, 1501 bp, Oryza sativa
atataagtaattttgacattttacttgcactgtttgactattcgtcttattaaaaaaaatagaattattatttattttatttgtgatttactttattattcaaagtacttgaagtataacttttattttttatattgtataaattttttaaaataaaataagtggtcaaacgtttaaaaatagggaatattttttatattaggggatgaaggaagtataactttaccgttatattctgttcttgtctttaatagcagtggacgacgaccacacatgatacacgatacccttctctcctttcatttcatcttgcctcttcgacagggcgacactcatgaatcatcatccgaacgatctaagagcaagtataatagtgaactataagcttactatacttaggtgaagaaaagaggtagtggaaaattaagtatgttggctcttatgcaagagctagcttatcacaagctccaagacaaatccattaaatgcataagtaagagatagagagaggagaagaaaattgcagccaaccttatagccaatctattatatatgttggctttaaaataaaataatagtagaaagtggactctattattatccttcctctaatcacccatccattcgccatcattgcttcccaataccccatattggtctccattcattccattatctaagaaaaaatattattggtctccatccccgggtgggccccacacacaccccgtgccacgtcggcctcacacccctcaggttaaaccaaaaccaaaaccaaaaccacaggacggcaacccagccacagccactgacaggcggggccaacccggttcagggccccacccgtcatccacatgggtctcctcccttcctctgcctggtggggcccgtttgaccgtttgacaggtggcgcgattttcgttaattaattcccctccgtttctcacggcctcatggccagatggacacgaccaccagtccaccacctcctcctctacttcttcttctcacgtctctctctctgaatccagatttttttttgttggttccatcctctctcctgcttcagatcagggtggccatctcgcttgaatctgcaggtgcgtgcggaatttcgatttttgtttttacttttattttgtgcacatccttttcttgagaggagaggtggcggcatggtggcttcttgggtcggatttggatttggagtcggaattgaggaattcagtgagaatatgtagctcggatcatctttcatcctactggtcactggtttgttgatttgggttgtggaatgattaagccgggagtgatttgctgttgctttgcggtttctctgaatttgttgacggctacagtgttcaggcaatcatggagatcgatctgcttgcttgcaccgagcaaatgatccaatttttaacattgagaattgttcgtttccattctgccagggtgagctgaggaggatccactgaggtggcggcggtcgagatggggctgg

SEQ ID NO: 17027 - DNA, 1501 bp, Oryza sativa
tgaacgagaagccgtatgcgaacgcgatgttcccgaacgcctggaagctccgccaaaccttctgcatcgaggtgacgccggcgccggcgccgacgaagacgcccgtgatggtgcccctgattcccccgttcgctgcaaactcgatctcaaacatgtcaagcacttcaaaaaaaccacaacgaaacaacgagcccctcgctcctcactcacctacgatctgcgcgacgccgagggcgatgccgatggcggagtaggacagcgacatggcggaggcgagcgtggagagccaccacatcttgtggaggttggggatctgcgagaacacgacctgcagcgcgccgtacaccaccatgtacggccggctcgagccgccgcacgcctccctctggtcgtgccctctcacgtggaagcaccccgccctcttgatcgccctgctcgccgccgttcgccgcgtcgcgcgcgcgcgcgcgcacgcacaagaagcgaagaaagaaagcgtaaagattcacggcgagatgtggcgcgcggcgccggcggcggagagagatcagagaaagggttttggtttactgtacagcatgctgatggaggaggcgatggtgatgccgacgcagacgccgaagaagttggcgaactgcagcacgccgcagagcctcaccttggtcccgccgaggttggcgcggacggcgtccatgtaggtgcggttgcgctggccggtgtacgggtcgccggtgcggtagcactcgacgaggagcacggagcagcagtagatgacggcgccgaacagcagcatcaccgcggggccggccacccaccccagctgcgcgacgccccacgccagcgacagcacgccggacccgatcaccgccgtgatgatgtgcgcgctcgccgtccacatggtgcccgtccgccgcggctccccgtcgccgtcgacacccgccgccttcgatggcaccatgtggccgccgcgctcgacggcggccaggtcgtcggcgagcgacatcgctggagatcgaggaaatgggaagccaaggaaagctagaaccggatgcgaaatgggattatgggagtacgaggcacaggtcaggtggattcaaggctgggaatttaaagagtttgagatttgaaagctgaaagtgatttggtactaggtggacgcatttaatgaaggagtaaaagcctatcgtatgtggcaatgtatagcaataccttgccatacttggatgcagcaagtttgacattattgtatatcactatagctcaacgtgtacagccatattgctaaagttggctaacgtaattatgaggtgtactagagcactaagtgtggctgagaaaaataacacatgttttaacataatgtagtgattttttttttggttatgagataaaacttgtctagtgtcaacgtagaatagattctgtacatatactatacaccactgtatagctcaatatgtacagccatatattgctatagttggctaagtacgtaattatt

SEQ ID NO: 17028 - DNA, 1242 bp, Oryza sativa
gaacaaattaataattcagtacggtgctgtatgaatttttatttaataatggatacttcatactgcatgcaagataacagagttctccacatagtacatatatagtcctcatcgatttgtgattccagcattgtcttaatatgcacgtacggtatatggccgaggcgccccatttccagtcgcagttctggaccaaataacaaataacaacaggtatgaactagttaattcactctaacttgatagtatatattaatgatcgcaaacgaagaacacatctgatttaacatgcatatccatcgacaaacagccattttatatatcacatgcgaaataatataattaagcggcccagcttgctgaattaattccaagcggaaaaaaatcgatcgacaaaccgatcgatcgattggtacgtgaaaatgcatgcctagctacatgcatgcatggatgagagtgagagagagagagagagagcgctgatcgagcaaagtagcgtcttggcaagcagtacaccagcacaccaccgatcgatctcttgatcacctgcaaaatgttcagaatagtagctagttagtgtcagagtaacggttcaactgaacaattgaacatgtatgaatgcgtgcatccactggtgcatgcagcagtctagctagtgagcataataatgtagtatgtatactactaccactagacatatacaggatgcagctgcatgctaatctgccgcattatcgagtccaccactacatggacaattggacatgggttaattagctttcaccatatattgatgaagtaattgaactagcacaccggtgctgtcagctgatggtcgatcgagattaagtaagggttaatttggttggcggcagcggtcgatgtcgtggggtcgtgcatgcagttatcacatccatccattgatcctaagtgcgccccaagtcacgtatcagcgccgcctgcggtctccctcctagtacacagatactcctcctctgtaaacaaaaaaaaataaaaaaaaatcgacttcttgcagggcggtcggttacttgacggcgttggctggctggctggctggctgccaccacctactcctagactcgtgttgtagtgtgtgtatatatacgtgccactgccccgtcgagcgagctcggaaagctgaaagctagctgagactgagtgccagtatcaagcagaaggaagctaatttaagagaagatcagagtgaaccatcgtcatcaa

SEQ ID NO: 17029 - DNA, 1501 bp, Oryza sativa
accatgtctcatgcaagacatggtttccttctctttcctcatttattcacttgccatatcatttttcatcctatgtggcagcttatttaatgttatggacatcatcctagtcattgggttgggaatgaccttagagcagttataatagcagactattagccagctacaaacatattttaataagataaaagatgagagagaagaacagcgggctacagatctgtagccagctacaacacggactccaagatacaatgtgtgtatgacagtgggaccatatactaatagtatagtaagcaactattgtatgaattagctattagattagctatagataaattgaagttagtagttagctatactattaaccttgctcttatgactttacatgagcaaaggtacattgcttgtatcgttgtgcgctaccattacataataataaacctctaccatgttttgtgctgtattgtttcgctacgaggttcagatttagggtgagttggagagataggggattgagaaaattagaaagatacgtaaaacgagatgagtcattagcgcatgattaattgagtataaactattttaaatttcaaaaattgattaatatgattttttaaagcaactttcctatagaaattttttgcaaaaaacacaccgtttagtagtttgggaagcgtgcatgtggaaaacgaggtgttttctcaccttatctcacacaaacgaacgcagccttaaatgtgagttttggaagaatttatttgaaaataaaaaattaaaaaaagccatgagccactaggaccctgacatttcatgttcctgctacgtcaaatagctgctcgatcagtagcgaacctctccttttcggtgctttttaactaacggcgtggcttgagctgaatgaagaaagaaaaaaaaagacggagtaggactagtaattgacaccatcattgacgacggcgcggctgacaatctctgggaaaagggcacaccgcacatgtcgtttcagaattcagttagacagagcctgccgcctgcagttattgcgcaccttttccttttttttaagacctttttttacgatagagtggacttttctttttcgagcaatttctatgagcctactacttcgcggctaaccaacacaaccctggttgcttatagatggtacttcatacgtcctaaaatataataacttttattttttattatatctgtttcataatataagattttttaaattgctcacacacacatatatatatatgacactcatatggggcaccatgatatctaatgcataaaatcacttaaatttttcataatttttaaattgtgagtatatacctagttataataattcgattcatacctatacctatcaacaaaacaactcaaaattaactttatttcacaatccatgattgcatacctaactaattatatgtatggatgctatatacctagaatcaaaatctaaaaaaaacaagttcaaatttgt

SEQ ID NO: 17030 - DNA, 1501 bp, Oryza sativa
ccgcctcctccgccgccgccgcatctctggggtgagagccgccgccgcctctcccttcatcgatctccaatctcgatctctctctccgtcgcgccgcccgccacgagacgccgcgccacgacgacgccgcgccacgccgacgccgcgccacgctgccgccggcacgccacgccgccgccttcgccgccgctcgcgcaacgccgccgccgccacgccatgccgccgccttcgccgccgcgcaacgccgccgccgcatgcaacgccacgccgccgccgccgtcgccacgccgccgccacgccgccgcgccaagcgccggcccaatgccgccacaccgccgttaacgaacacgtgaacgagaacgaacacgtcaacgtacgtcgagaacgtgaacgagaacgagaacgatcgaacgaacgagagcgagaacgagaacgatcgaacgaattaacgtgaacgagaacgacaacgaacgtgaacgagaatgaacgtgaatgagaacgagcgaacgaatgtgaacgtgaaatgcaatatatatatatgttacttcgcatttatcctaatacatattttttgtatcttgcagaaaagacatgttgtcggagtcgtccctcaagccggagtggaagagctagccgtagaaggaattcgtgcaggcaagtgacataataatataaatgattgttatatttgtaatgcaattaagaatattagacttgtaattagacttagcatataagattgtgtagtgttctaatattatttgagttttaatataagattattttattgcaaattagacttagtatgtaattattgactacggaattggtgcgactcctagcaattgactattgtagtcttaattagacttagcatatacgcacgaaacacttagcatacatgactattttagtcttagcatgtaatattatttgagttttaatataagattattttatttgtaattagacttagtatataattattaactacggaattggtgcgactcctagcaattgacaattttagtcttaattagacttagcatatacgacagttacacttagcatacatgactctttcagtcttagcatgtaatattatttgagttttaatataagattactttatttgtaattagaattagtatgtaattattgactacggaattggtgcgactcctagcaattgactattgtagtcttaattagacttaacatatacgcacaaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatatt

SEQ ID NO: 17031 - DNA, 1501 bp, Oryza sativa
gtgcatctagttggcctggcacccgtttcggtcggtttgactccctcatgtgaaaggttggtggacgtggcttcttcttcttcaggatgttttccacccccaaccaacaatgtccacctatggctgccgttgccagcggctacctttcctatgtgcctcctctcttatcctcttttaaccctagatccgtttgcctccccgatgacatctccacataccttcttcatttgccaactcctttcctcttcgttttttctattacggtcgtggaactatggtcaatgcatttctcgtgccattggcccctagaaagtccgcttcactcttccctttcatccttttttgtgtaaactttgtgccaatactggcatgcctccatggttggagtccctagagccattgtttttaccgttgcttcaaccaatttagctctgccccattgtctaggagtgtgtccaatcactttagccttgtcccctcctttggatctgctcaatttagcatgctccatgtttaatagcttgggtctccatgttggttgaggtctagggctctaggctcttccggtggttgtggtgactagcgagttgtgcctttcttctatcagtgtgatctccatttatatccttttgtccagatccgtgttcttctacatctttcttcaatagccctccctcctttttgtctagctccctgctagtttacatcctccttcaacaactcttcctcttgtggggctccttttcccaaaagggcgttggagtttatcacgcttcttgtttgtctacatcttccttcaacagctcttcctcctttttttgtctagtttcctgttcgtctacatcctacttcaatagcccttcctcctttggggcttccttccccgaaaagacgttggagtgtattgaactagatgacaatttgatgaagtttgatcgaagataattggatgtgggaggcctagagaagtaacatttaatggagtgtggacccacaagtgcatcggtgggcattgatctaagcaataacatgataaagtgggattcttgatggcttggtgttggtggcgttaggcaatcacaaccttcgatcaccgggatatcgagctagcttccgagtagcagaaagccctccggtaatattcaatacacgcacatcatatccttgtgagcacctttaaaaggctggacccgacatatcttgagattgacgaagtcgatacggacacattattgttgatgggtacatcgcataacactaaaatgcgagcactcatgtcaagtttaggacttaacctagatgaacaggttctgtagcaagaaacctaaccagttgagttatgctcactttgcttttactatgtctctttgtcctttgggaaggttgtggtgactcccttcttcttttttttttatttctatgtattccttcactttattctttaggactcgtgcgcttgcacagccgaagtaggtcataaggatgtatggtttaaaaataa

SEQ ID NO: 17032 - DNA, 1501 bp, Oryza sativa
ccgtactcgaagagaggtggatagaaaataccgtatcccgaaccgccaggaattaagtcgatcgatcggcttgttagaagcaacagcgacatccacaatgccagtatatgtatcgtgcatacaagtagctagctagcttgattgcagatgctgatcgagatgcagatacatatccacaaatagctaccgcatctttcttaattactgtcattctaactctatcgataatgatcgatcgagctagatctcaactaaattggcaagaaattaagaggaagaataaaccggccatgctttctacatacgtgatccttatgtatcgcctactatatagcgctaatggactagtatttttttagtttatttaagagaattttaagtcatatgcatgcatcttaattgaagctggcttgtaggtagatttgaggcaaatccccggccgatcaaaacgcacaactaactacctttaattgactagtgactagctagtgtttccctgccatacatttcgcaatcatctgtctatgtatctctgaattaaactgtacctttggtcatcaatcatcatatgcatgtgtcgtcgtttcagactttcttcagtaattaaccggccggcttaattgccccatggaatatattggccacgaattgcatgcaggtgacaaaagtgcatctgcaagtcaatcaaaagcaacgagacgacttgaaaagtgcagagctgaaggcgaaagagcaaaagtccaatgcatctcatccaatctcatcctctaatcgaatcgagacacacaagttgtagcgctgttgatgtactgcttcgatcttgcacggaacacacactgctggctatgtacgcctttttctttcaatcattcaatttatctcatattcctcaacgcgcatgcatatttgtcccatttcgatcgaccattcgagcatgtgtcgtgcttacctcaaattgtctttcctcgataaactcctttcaagcagctgcatgattgatgcatttatatatattgcatccaccaaattcttgcaattatatatattcgcaagatatgttactacagcataaggaatatgcgtgtacatatatcctcaccaatcatatcttcagttatacattaccatttttctttcgggaaatgaagggatatatatgcatggttctcctgagaagatgcaaacaaccacagataatgcatgtacacatcttatccaattccaaacgaaagaaattataataaacttgcatgtgcatgcataacctgagcctaactatgttgggaacaagtagttgtcgatcaatatacaggaacgtgtcgtttgagaatattggcatatgcaacttgcatgcatctctctgcccatgccatatgaaagtctcctttggaactcaccagttcagttcgagccatgaattgtcaaaatggcatgcacttgaatcaagcaagatcgatcgaattgaagcacgaggtgaacgacgagcttagctttcggtttg

SEQ ID NO: 17033 - DNA, 1501 bp, Oryza sativa
catggaatatattggccacgaattgcatgcaggtgacaaaagtgcatctgcaagtcaatcaaaagcaacgagacgacttgaaaagtgcagagctgaaggcgaaagagcaaaagtccaatgcatctcatccaatctcatcctctaatcgaatcgagacacacaagttgtagcgctgttgatgtactgcttcgatcttgcacggaacacacactgctggctatgtacgcctttttctttcaatcattcaatttatctcatattcctcaacgcgcatgcatatttgtcccatttcgatcgaccattcgagcatgtgtcgtgcttacctcaaattgtctttcctcgataaactcctttcaagcagctgcatgattgatgcatttatatatattgcatccaccaaattcttgcaattatatatattcgcaagatatgttactacagcataaggaatatgcgtgtacatatatcctcaccaatcatatcttcagttatacattaccatttttctttcgggaaatgaagggatatatatgcatggttctcctgagaagatgcaaacaaccacagataatgcatgtacacatcttatccaattccaaacgaaagaaattataataaacttgcatgtgcatgcataacctgagcctaactatgttgggaacaagtagttgtcgatcaatatacaggaacgtgtcgtttgagaatattggcatatgcaacttgcatgcatctctctgcccatgccatatgaaagtctcctttggaactcaccagttcagttcgagccatgaattgtcaaaatggcatgcacttgaatcaagcaagatcgatcgaattgaagcacgaggtgaacgacgagcttagctttcggtttggttagcttccatcaacccagtgttgttgaaggtgacacttaaaaaattcagatacacacttagaatttacatacattaatatcgaccacgtcggtaaattaaacaaacatgattgaggctgtatatttttgtgtgcctactatatttgcttcaattgacttcgatcgcttcaattgacttggatcgagagagatgcaggtttactgattacggtcgtacaaactcagatatcttggatagcgattgatggaagccaacacgtagtgtatgaacggaattgatggtttttgagcgaaacgtatcgctcctaacaagtcataagttgatcatatcttgcttagccatgaggttggcaacttgccatgatgcatgcaacacgaaccaaaactagattgtgccactagcctctgctgacgacaattgtgcaggtaagtacagtaccctgatatggttgtgttggtcttggactcttggtagtagtagagatgagagtatctcaggtcttttcatccactgtttagtctcacactgtttacagcgagaaaatcttgccccaaaaaacagtcatgccttcattctcttttcaccggacaagggaaattaagatcaaattcctgctcaaacat

SEQ ID NO: 17034 - DNA, 1501 bp, Oryza sativa
  unsure (1)..(1501): unsure at all n locations
tgacacaatctcttttaagctttaaatatttataactggaaagagtgtatttttgccaagagatacgaactagacactcttttatgttgatagcgctagacgtctaatgtgcacgtccaaattaaaaaaagaagcctgtctccacaaacttaatttaatttaattccagagaagattagaggccacaaatgatatatggtgctaccttcaacttaaaatatactagcaagttttttttttcaaatatatactacgtagttagatgttgccatattttaagacggatggaatagtggtgtgtagtttcaaaattgaaatcgagatcagagcgagtatatgcaacattttgtttttatttgactctgaatatgaaagtatgcatatgtaaaaggaagagtaaatttcataaaactacatactatattaccaaattattgtaaatctacaggtgtaaggtggcgtatcataagattacatatttaacattttatttataaacaaatatagttttaacactaattctctagcaccaatgttatgtttgagttataaacatgtaatagttgtgattaaattgcagctgaacttgtagttttgtgacaactttgcgattttcatcattaagtctgcagtgctataataaattaggttaggtattaacttcctatagctatataatacatcacgttgaatctgtagttttatgatagtttggtgcaagtaaatctgtttattcttaggttaaaatctctcctataaatgcttcgtccatctcgaataaacaaaacaaattcgaaatgtgacacattgaagtactacagtgaatctcgacatgtgttttagggttgtttattttaagacggcgaaagaatttttaaaaaaaaaattttaaaaaaaaaaggggaaaaaggggaaaaaattttttaaattttttaaaaagggaaaattnttttttgggtnttccgttncaatatgcactagggttgtaaacatatattatggattcgactcgatcatcgtatagtttttgtaaaaaatattccgtaaagaaaaggaaaaggttttaaatagaagcgtgtggtaggtgatggtgaggaagaagaggagaggagacacgcttgaaacggcggaggccggcccggaatgttctggaaaaccaccttttctttctcgcaggagtagtatttttgagggtttggtttcaaccaaaaaaagtccaaatctgaaaacaagagagagatcacagcagccgccgccatcgccatctctcggacggaaaccctagacgagcgaccatggccaccatgccaagcacttgcgcctcctcctcctccctcttcctcctcctccgcgtacgtacaccctttccttcccttcctctacctaaacccctactaaaccatggattggattcattgattttgctgctgtttccagagggacaggaggagcagcaggagtgccagcctccccggacccgcccgccgtttgggggttgtgc

SEQ ID NO: 17035 - DNA, 1501 bp, Oryza sativa; identical to SEQ ID NO: 17017

SEQ ID NO: 17036 - DNA, 1501 bp, Oryza sativa
agagaattttgaattcaaggagaagctacatctgcccaaaaactctcacaaacatgccattaacatcatgaaaaatctactccaaaatcctctatacaatttccatttgatatcagaaatctattaacttattaaaagaatagaaaaaggagcctccacgttcactctcacggcttagaaattctcatattaatcgaagaaaaagaaaaacagagtccatatagaaatacaatttagaaatagttcaaattcgaaattaaaaaaataagaatattggaagaggagactagagtccatatagaaatataaattataaataaccaaaattctgaattaaaaaaataatattataagaagagtatagagtccatatagaaatacaattaagaaataacaaaaattcagaattaaaaataaggaatattagaagtagattatagagtccatatagaaatacaattaagaaataacataaatccagaattaaaaataaaaaatattagaagtagagtatagagtccatataggaatttaaaactaactaaaactcggaataaacataataaaattaaaagaatagtttacaaataactaaaaattgatattaaaataattaataactaatactatataaaatacaatatgaatattatacattagtagtttcgtaaagttagtataaaatttaaaattatattgtcattttaatatatttgaataatacattgagaaaacatatatgctattatatgagagaaaatataatgatgctagccgcgcaatctacgcgggccaccatgctagtttcaaaatagaaaataatatgtaatcttatgcttcaaagtgctctatagaatattcttctctaataggttggaatcctataaaactcctatctttctcatacaaaccgaaacgggcataattttttacttgctccgatctaaaatgttgttgcaaattagcctccaaaaaacatgttatacatttcggtaagggaccacctatacatttatcgacaaattttctactaaaaatttgacagatgtaattatagtacaatcgtagtgtaattacactgtaaattgtatgtaattacactgtaactacagtgtaacttgtatgtaagtttcatgtaattttgaatcgttagatctattacaagatttgttctggtgaggaagaaaaaaatcatagcacacacatatgtgaaaggatttgttcccacgacctctattttactgaaataacatgttaccgagagattcttgaaagttacatataatttacattatagttacagtgtaattatatacaagttacagtgtaattacactacgattgtactgtaattacatctgacaaatattagggggagaaatttgatgacaaatatctagcaaaatcgtttcggtaaattcggcttcttcttttccacctttgatgatctcccagttaattgggtctcttttatggacctggaaaaagtacttgtctactt

SEQ ID NO: 17037 - DNA, 1501 bp, Oryza sativa
tctattcttttcttaattgtatttctatatggactctatactctacttctaatattccttatttttaattccgaatttcagttatttcctaattgtatttctatatggactatatactctacttctaatattccttatttttaattccgaattttagttatttcctaattatatttctatatggactctatactctacttctaatattccttatttttaattccgaatttcagttatttcctaattgtatttttatatggactctaatctcctattctaatattccttattttttaattctgaatttcaactatttctaaattttatttctatatggactctagtcccctattctaatattccttattttttaattccgaatttcagctatttctaaattgtatttctatatggactctactttttctttttctccgattaatgtgagaatttctaggtcatgagagcgaacgtggaggctcctttttctattcctttaataatataactagctgggtggcccgcgtaattgtgcggctaacaccatacaaaattatctatttttaatataattttacttataatttattcaatacatatctcattgtcttaagattttgaaagaccaaaccatatcatccccatgtttctaattttataacttttataaaagtcacatcagttgctatcccttacttttttttcaccctttctttgtttgcttgctcgatctaccacggcttctattcattctccttctaacctttaaattttggatcttatagtttttttgagtttattgtctcattggtttcatttttttttatttttagaagtcccattaaaagctgccattatacttctctacggcccatccgctgcttcctctctttattgtcattgggattttaaaatcaaacataattatcgtatgagttcaattttttactttctaaagtcccaccaaaccgtcagtggctttgtcactttactcctctacggctcgcccacttcctcccactctttattatatttgagattttaaaatcgaacgtgattatcattgaggtttatttttttaattttttagaaatcccacaaccgtcgtgaccgtgctgcttaacggcctgtccgtcgtcactccttttaattgtcattgggattctatttggggttttgttaatagtttttagatgtccctaactgtcaccactctactcctttacaaccctgttgcttctcagatatttattatcatttatcatcgttgtgttctagatgattttttttttgaaatttccatatttttcgttccgatagattttattataaattatattcctagttgttttattctattttcagaatttattttattaattattcggaattttaattaatctcgttatgtgtttgtcgacgtctgatgtcgcggttctggtatttgcatgatatgaggatcgtcggtgctagggtatacgcgagactgaggtaaaagaga

SEQ ID NO: 17038 - DNA, 1501 bp, Oryza sativa
ttgttgaatgaaccaaataaaacagctgagtaattattttttccatttcatcatgtgcacatcacattcgacatgtgtaagggcatatgcttcatttttgttttactgatttgaacttagggttcgagcccatcctccattctcaacctggatttgccactcatcaagcctcaaggaaattggtggaggttggccaacgtttaccttctactgcagaagcttggtcatcgactgcgtgccttggtgctgtcttgccatagctgcggctgcttgccttgatctgttcacttcttagtttgctaatttcaaacgcgaaattggttattagtggttccgttctaatagctaaatattagagattgatttcaccgagtctacagcttgccatattcatctattatattattaaaacagctttgaaaggaggcaccacattcgttgtgggggctaaaaatttccagtctatgtaggaatacaataaaaaaaatggctgaaattcggaattagaaataagcaatattgaaagaagagtccatataagaacctaatacgagattaatcaaaattcggaataaaaataaaataaaatccgaaattagaaaaaaaaaaagaagaggtccaagtaggaatacaatttaaaaataactgaaatttggaattaaaaataaggaatattgaaagaagagtccatacaagaatccaatacgagattaattaaaattcagaataaaaaataaaaaaagaaaaaagaaaagaaaataatagttcaagtaggaatacaatttaaaattaattggaattcggaattaaatataagcaatattgatatgagagtagatataagaacctaatagtagattaattaaaattcagaataaaaataaaataaaatctgaaattaggcaaattaaaaagagagtgaaagtaggaaaataattttgaaacaactgaaattgaaaataaaaaataaaatatcaaaagaacacaatacgaaaaataaaataaatactgaaattagaaaaataaaaataagatttcaactaggaatacaatttaaaaataattaaaattggtgataaaaaataaagacaactgaaaaataaagaccatctaaaacacatgacgagattaattaagtaacaggcctatacaggagcagagtggtggctgttgatgggacatctgataacttgacgattaaaaggaaaaacaacgggcaggtcgtgaagcaatcggtcaaggcggttggcgggactttgacttttagaaagtaaaaaaataaaccttggtgataatcatatttaatttttaaaatctcaattacaataaaaacgagaggcagcgggcctgtataggagtacaatggcagagccattgatggttggtgggtcttatagaaagtaaaaaatgaattccaatgatagttatgatcgatttttacaatcccagtggcaataaagagtatgcggcggacgggtcgtagaagagtatagtggtaatg

SEQ ID NO: 17039 - DNA, 1501 bp, Oryza sativa
aatagttgaaattcggaattaaaaaataaggaatattagaagtagagtatagagtccatatagaaatacaattaagaaaagaaaataaaaattcgtaattaaaaaataagaaatattagaagtagagtatagagtccatataggaatttaaaactaagtaaaattcagaataaacataataaaataaaaggtagtgtttagagtccgtataaaaatacaatttacaaataactaaaatttgaaattaaaaaaacatgggaagaagagtttaaagtcaatataggaatacaatttagaagtaactgaaatttgaaattaaaaattaaagaatattgaaagatgagtttagagtccacatagaaatacaattagaaataataaaaaatcagaattaaaaaaagaaatattaaaagacaagtctagagtccatatagaaatatatataatttacaaataactaaaatttgatattaaaaataattaataactaacacgtatataaaatacaatatgaatattacacattagtagttttgtaaagttattgtaaaatttaaaattatgttgtcattgtaatatattttaataatataatgagaaaatatatatgctattatatgagagaaaatataatgatgctagccgcgcaatctgcgcgggccatcatgctagttatacttaaatgatgctcatattccttattatgtttaggtcactctttttcatatatcggaatagaatggacaaagaaaggtgatgtggtattctctgttatttgctttttcaatcaaacttgcatacaatgataccaactttggctgttacttgcattaatctaaactaccatttgactgcaaatctgcattctctctctctctctcttcgttcatagcacaaacggttgcatacacctttctgagtctgctgctagatcgcatatgctgctcctaccacaggctcgccattcgccatggcgacaacaaaagcatcacttgcccttctgatctcgtctgttgtcgtaaccaggtcaccagcacgatctgcatcaagtgcgcgaggattagattagcatctggatctactggtttatcccagcataagcatctcaagtgttacatgctttacactacatccattccatgacgcctgtaaagcatacttgggtgcccacaattgttctgtcaggctcagctgctcgaagtctgaaggaatcttgcacatttctgcagaaagcttaccctgtgaagagagcacaggcaacataaccagctcaaattccaccatgacaagttaacagtaaggtacaattcgggattcatataagtcgtaacaaaattccaccaattcaccatgccaagttaacggcaaggtacaattcaggaaccataagtcataacagaagctactctgaattactcagcaagcgaaaaatcgaacactgatggggcacgtctccacactatcaaggttcaggacaatgctcctgatttccaagaacaga

SEQ ID NO: 17040 - DNA, 1501 bp, Oryza sativa
gcaatcctctttttttttttcagatttccccggagccaagccggtgagcgacgcggtggccaagtccggcacgacgccgctctccccggcgatcgccttcatcctggagaaggtcgcgcctttcgttcccaaggaggagcccaagcccgagccggaggcggaggcggcggcggagaccacctcccgggaagtcgccgtggaggaggagaagaaggaggaggaggcggcccccgccgagcccgccgccgccgccgcggaggcggcggcgccgtcgacggaggtggtggaggagaagaaggaggaggagaagccagcggaggcggcggcgccggcggctgagccggagaagcagtagtgatcactccagaagcaagcaaagctaagctagcttagctaagcttagctgatggtaattaaaatcaagattaaggttaatgtgatcacactactctctctcagtctctgcacaaaaagtaagtaaaaatcaagatacacacacttggcatgcaagaacatttgttattgaattctttcaccctttgatcctttcatctctctcctatatatatatatggtcgcctcatcggttgtaaattaatttatgtggggtttcttgttttttgggggtgattaaacatgtgtaattatattcatatgtttgttggtcatgatcataaggagcttgtgtatattatccatatctttttttttcttttgtttacaaattttcggcttgaggtgtgatgaagatagacatatatatgcaccctctccaattgtaatacaaattaatggctgtggatatatgttcatatggtacagtttgttgttgttgatccattggttaccttggggggagaaaatctttgcttacatgtcgtgatcaacttaatttgattgcgtatacatactacgtaaacaaaaatatggataggtgggaaggacatgtctggcctttgcaattaattgttccatgagtgataccatgtatgatatgcatcttctcgtacatactagtacgtacttcatctgacgtttggagcaatattcaatcaaatttgtagaattttgaccatcaaatctaatgatattatgatgccaaggcaaatctaactcaaacatttggaaaattattgatagtcaaagctttaaaagtgtaactaaatcttatcctaaatgtttaattcggatctatagaatcttatcctaaattcggggtaaaggcattatctagaaaattgccacacatatagattgttgttctgccggccaataaattaatttgaccatggtatatgtataaaatctagtaacaaaagtgtatttctcaaatatcaatattacacatatatatcccatatttatgtatcaaacgtttatacataaataaagtccaccaatattcttttaggaaaacatcaacgcgtcatatagaaaaaaaaatcaaagcttgaacattggacttcaaagctactggacctaagtaatgacatcaccttga

SEQ ID NO: 17041 - DNA, 1501 bp, Oryza sativa
acaggtgggtcccacctgtcaggttcgtcttcctcgcgccgtcgccgccgcccgaaaccctagcgcaagccgccgccgtctccttccaaattcggccgcgcctttccttctccggccgaattgattgagggcaattgatccttgagatctcctcttccttttctcttttggaaacatcggctaattttctttggaaaccggtggatttgagttggattcggattcatctctctcctctaaccccgacctttccttctcgtcgccggcagccgtgggccttcactgccgcctccttgcccctttaaaaggacccccggtgtctccgctacccgccgcctctctcgccttcgcccgccgtcgtgtgtagcgccctagcctcgtgagcttttgcgccgccgtcgccgccgttcgtccagccgtgcgccgccgtcgctacggtcgtcgtcgtcactcgggaaggccaccgtcgggatcgccaagtcgtcgccgtccccgtccgccgcttcgccgtcgccgaagatcgccggagcaccgtcgccgccgtcgacccgatctccgccgccgcttcttcctcgtcgccgtcgccgtccgttgttcctccgccgcttctttggtcaccggtaagttcgccgcgccgcgctctacgtcctggtgccctccgttctcgttgtcgcgccgtcgttcgccggcgagcttgcgctcccgagccgccgccggtgctgacgtcatcgttgccgttccccgtgagccggtcgtggacccgtttgatctcggccgtccgttttggatagggttgatctcggccgtccgttcccgtgaaccgtcgtcgtgcacccggtccaccgcaaaccctagccgctgacgcaataatcctcttttccttttcaaaaataattcattattgcgtcataattcaattaaaatccatataagtgttttaatccgatttaatctttaaaaattcataactaattcatttgaactcagtttaatgtggttcaagttgcaaaaattatataaaataaagatctacatattaaaattgtccataaattgaattaaatttatttaattctttttaaatgggctttaattagatttaattttgtaaaattcataataaattcatttgaagtcagaatgaggccgttcaagtctcataattcatctaaaattatgatctacatgtttgtttactttttatgtattatttctttggtttttattagtctttttcttcgttttgcgtgatagttagtcgtttccgtcgttgcgaaggttcgcgagtgcgccggaagtattcaagaagattaattgaagaccgattattgcaaggcaagtcacacagatcctaaacacaatcctttgagcatgttgatcctatgtttaaattctctatttatttcaactgtgcatttattttcgaatgtcattgggtggaattaacctattctttgttatggcccttttgttcttgattactttattccttgataccttg

SEQ ID NO: 17042 - DNA, 1501 bp, Oryza sativa
taagtataatcaggagaaatttaaaattgtaaagtttgattctcatgaataatgttaggcagatttttacttgttttaattagttctcaaattcaaaatcaacttaaaattaggtcaaccacacaggcaaggtaactcaacatagcatggctacaataatgataggccatcgaactaaatatgctattcttcttatgtgcaagacttttatgagttaaaaaaaactaaatattcacacacatgcacacaaaaaaaaatacctttactcatagcatatctataatttcttattttcgataaatatctgataataagaaactcgtatatttggggtcatgtttaagtgttgcatctctgcaaggaagatatcagttaaattaaagagagatttttatatatgttcgaacccttcttagagtaataagtatacatcttgtcagtcgggttatcggttttattaataccaaaagagtatggttacaaggatatatatggacctagtcaaggtttatatgctagtcttgttggggattccaacgagtttttattgatcagtgggtgcaccggctcgatggatcttgaggcttgatctctgactcaacgacatatcgacttgcggtggcatatgattgttgtgtcttggcttgcagagtatagatagttggataccagatacccatatggcctgcatatcgactaagatagaaggtaggccggatccatatgatatgagatggaataacatctgtttgccatattgccttgtatcctaaaatagcgtacagagaatcccaaccgaacaatgctatggatagataaggtaaccgaaggcgtgttcggctaggtttcctaacttgtaacactaccccctaacatatataagacatgcagggatcccctcgagggcaacagagaataagaaacaccaaatcgacacaatatcaatacatcaggcataatacaatccatcaaaataggagtaggatattacctcacatcgagagcctaaagctatataaacccatgtcttctgcatccatccacttttagatcttgtgcgtagcccctaaattagtattgatacaaaacttcggtatgtacattatatatactatatagttagaacccagctaactctaaaccttaacacatatacctgccacatcatcacttactataaattattacctaaagctcatataagcatggcatatcatccaacttataacgttttagaactcaagcatgtcaaatcatcatcttccatatagttttcacaatatttcaaaatatatctgtcgacgtttgagatcacgactacggtatttgcatgatatggagatcgttggtactaaggtatatgtgagattgaggtaaaaaagatagagacaaggatttttatacaggttcgagccccttcataggaaggtaacaaccctactcctgttggccgaagccggtgttgctctttattcgtctgaatcacataagtacaacaatt

SEQ ID NO: 17043 - DNA, 1501 bp, Oryza sativa
gtctcaaggatagtgtaaggggttgtttactctactactactattttcaaccatactattttttgacaaaattgtaaaaaaaaataatatctacgtttaatttgtggctaaatcttggtaaatacataagaaatcataccaaaattttggcaatattaccatcttgccaaaatctaaagtagcatatcgtcctctaaacatctgattgcttactattttgtctccgtcattgtccaggcttgattgttgcaagagtccagttccctgatagaccattacagacattatatgtgatcaaacgaaaaacaaaaactggatgagttcattactaactttgatagaaagaaaaaggaagaagtggtcaaaatagaagttaccaatctgccattcttggcatgcaatagcaacagggtttataaaaagcgatgaaaaccggtttgtatttcgtaaaatccggatttcccgaaccgaattgaaaacaccaaccacttgtttttttatcaagttcagaaatatttcaaactaagttttaattttttggcaagatttttcctggttttattggtatttttttcgattcatcaatggtttccgtaaaatccgaagataccgctcgtgagctgtttttatccggtatcagagttgtgaatattgaatatcagtactatgcatgcatttccccgctaacaatggccatgttcatacatggtacatccagctaattaatccaagattaaagagcggtttttatctgatatcagagttgtgaacactgaataatagtactatgcatgcatttccccgctaacaatggccatgttcatacatggtacatccagctaattaatccaacagcaaaaatattgcagatttcaacagcagctggaattagtatatcctgtatatccaaatatccaaatgttccaccctgtatagagcacaacatatggcaaaaccaaaatgcagaggaaaaatttgggaaacggcatgcatcgaggcctatatttattggctctcccctctgttcaccaagttaccccgctcagttggaggctctcacccccacattgcaaatgatttcattgaggtaaacgggaagcaaaagaggcggcaaaaattaatcgagttcatcctttcttggctcgtttcttcctcgtcccatctttttttctttcttgcgtgagtttaattcgctttgtttctccccaaaacctccatttgatttggaaccattttctgcaacaccatggattgcttcgatccaaatggcatcccagataccgattttctttgtttggaatgctggaattttctgcagattcctgcaagatttgaattgtttggtgtaaaattctgccatgccatggatgtgctaattaacttggacatggtttgattattatccccagggtctccaattgaggcgggcggtggcaggtcaaggtggcgattgacaaggcgggaggggatccatcggttggccggccggtcgtcgacgcca

SEQ ID NO: 17044 - DNA, 949 bp, Oryza sativa
cgtcgtcgtcgcgagcctccgccgcccccgctgccagcctatgcacagtcaacctccatgcccgcatcgggataggattggtatgggagaagaaaggagaggaaggaggaggaacgagagactgacatgtgggacccgatgttaaattggagaatgtgaatagagagactgttggagtaaaatgcaaacttggctctccaattctttagatggctggccaaatgctcatttggagagcttaaaaatagccaatctgttggagatgttctaactgacaactgacagcaagtcaacaactcctccaaccaaagattctgggatattctctatggcccctattcttttctccaacaaaagttggaaaaaattttggatactcgtggcacgcttttcaaattgttaacgatgcgtttcatgcgaaaactttatatatgaaagttactttaaaatatcatattattttattttttaagtttgtaataattaaaacttaatttatcatatgttaatatcacctcattttgcgtaaaaaatttaatgaggattgaggagaaaagaaccatatgtaccaaaaccaagatgaatttgggcacatcgatgtgatgggcctgtttacctttggattgggaatgagatgagcaaatccggcctggcccatattcccttgtgggctcgtgcaatgttgggcccttacggcctgcctatgcgggcaaaaaaacctatccttcctctaccacatctagtaatttccactgacatgtggggtccacacgacggcctgttcccacgagcccacctgtcaggggcggtagtttccacaccaagagacattaccgcgttcagtgcgcaaagcactgccactttgcacactgacaggatgggcccactagcagccacacccaccaatttcctcctcccttcttcctccttcctccttccgctcttcttc

SEQ ID NO: 17045 - DNA, 987 bp, Oryza sativa
tactcgcataatgagtatcagtatggtctttattttacatgaaagcataatgaattttcatacagaaatgccattaatttgtagattaattataccaacgatatctcaaaaaatattatattatacttccttcggtttttaatgtttaaagctgttgatttttaggcgcacgtttcaccatatgtctttttaaaaacttacataattatcatttatttgtttaatttgttttatcatcatgtgtactttaaatatgacttatacttttatattttttacatattgattgtaaaaacaaatcttgaatagaacaaattatcaaacatatattaaaaagttaacggcatcaaacgttaaaaacctatagagtatctttacgagtaaatagttaaattaagaagtcgaacaccttattttctttttcaaccgaactcatcttcaaattaataaaggttgacatatctcaaattgaaatatttttctttaattttagctagttgtcttttgaacttttgtacattagcaatgcaattaatgctaatattcgtctgctactacaatttaaggtgactgtctccactaagcacaccatctagtctacttataatgcatgtgtttgacctaatgcaaggatcgatgggatgcatgtagagccaaatatgaccaattaattaagaacgttttcgttgagcctatatttgtaccttctattcttaattattagcagatgtagtatagacaacatgcatgcatctatatatgtagctgataataagacatgcatatggttcaaactgttgggttttggtaacatcaactattagttgactaatgttttactacggtaaccgtgacgtacgaacagtacatgcatgcttaatgggtaagcttcaaattaaataaacttaactgtgggtctcgcaaaccaccttcattagtttgatgtggttgtgaattttctatctatcagggttcaaaccctgcaga

SEQ ID NO: 17046 - DNA, 422 bp, Oryza sativa
  unsure (1)..(422): unsure at all n locations
aaatgcttagtcgcgacgacagcaantaatccatgacactttgttggagnctaacgnnnccngggntgnanttnaagggaannnttgngatacaaaaanangnnnnaangtgatttttttgttannagnnannnnnnaaggaaaaaaagttttttttttattaaagnannaaaaaaganagccccaaaagcnnaaaanccaaannnnggnnnnnnnnggnnnnnnnnnnnnnggggngnnnnnnagngnaagaggaggggaaaaaagggannnaaaaaaagaaaaggnnnnnnggnggannaaaaaaanggnagnggaaaggaaaaaanngnaaaagaaaaaaggaaggngaaggggnaaaaaaaaagggaaagaggnggnaaaagggaaaaaaaaaaaaaaaaaaaagagaaaaaaaaaga

SEQ ID NO: 17047 - DNA, 1501 bp, Oryza sativa
ttgcacagtttgcttccctcatgtcaaattatatttgccttcgattttttttctcttttttcaacagatttttatttattatgaaatcttatcttataatgaattagtttttaattcgaaaattaaaaataattaaattatgtacacaaaaatcaatataaatatatgtttacctaggccctagaataagtctactttccttccctctctcaaatcatacagatttttatttattatgaaatcttatcttctaatgaattagtttttaattcgaaaattaaaaataattagattatgtacacaaaaatcaatataaatatatgtttacctaggccctagaataagtctactttccttccctctctcaaatcatatttgcgtgtatttttttttctctcaaccactagcacggaccatgcacatccgatggatgaaaaatcaaaagttcagcacctctttcttcaacagacttttagtgattctgaaatcttataattatattatataaaaaaatcagtataaacacgtgaaccaaccgatatttttttaaaacatgaaaattgaatatgtgcatggtgtgaaacttcacaccatgcatcctttccttctatctcggtctttgttagcgcgttttttaaactttctatatacaagttgatataaaatactagatattttttcttaatttttgtaataataaaactcaattaatcatacgctaagaggttttctacaaaagaaaaaggaacggcatggtacggctggcactgttcaggttttgtaggttagagcatagctgtatactgttgcattgtgattataaatcaatgcaatgttattgcaattatcaattatgaaaaaagattataaaagtgccataaaaatgtagtttaaaataattaatgaactcccaaaatattcattatttacttatacgtaaaggtgcattgctcggacgtccgtttctccaatgctacaatcattgggaccatgtgttagggacattattcacatcctacacgcgtagagcggattaattgtccaagcacaaatatgcacttgtgataactatgaaggtgcttcgataaatcattgaggttaaatttcattcacctaaccattaccagtgcaatgatatcacagtttgtcacacaagggttgagagagagtgtgtgtttttatccatcgtgattatcattagcctaatgaataatttatctatcttgaaacattactatatacatgttaactctagactttatagcatttaactgttcctttacccataacgaagcacgtgcatttttctagcataacaataacatgattaaaatagccttcacccgttgcaacgcacgggtatttttttccagtacactaagaaaatcggatcgcgcgtactaagcggacgaacaaacgaaaaacaatgtgatgtttggaaatttatcatttttttaaagtagttaagataagataacatatagatggaatatgaagttac

SEQ ID NO: 17048 - DNA, 1501 bp, Oryza sativa
aagcagctgatacaaattgataaccaatacaaaacatatatagagatgaatttaagccaaaggagtttaatacctttactaggacaaataggatcttgtcctattagacaaacaacagctgaaaccaaatagtagtaggtccaactcacatgcctacaggcagatggctagggtcacaacctagttctcgatcagccttctgatcatgtgctaattaagtacagaatcatgccagtagagtttcctcttctcacgcttttatgtctaaaaagaggggaaaataacaatggtgagtactagagtactcataagcccccactataatatgattaatgcacatagggttgacgaaaggtcaaggttctttttggacgaagccggtttttataaatattttcacaaagttataacctagcccttttaaataaacactacattatgttctcttgtttaaccatttactgatggttgtggccacctctccaagtctcacttggaacagtttacctccaggcacatttatccatatttctgtcactggatcataccgtcatcctatgtggttctatcattcattatccattcccatccatgccccaacccccaagttaaattaaaagttgtaagtctagtcaagaatagtacaagtcccggtcctccttccatgctgattacagtgaaatataattcttgcattgtaattgcatgatatttgttgcacttggaaatacttttaacttacctttcataaatatttgtattcttaatatattgctcgagtgtattgtattagtatattaggaatagagaattaaataggtactttaattcatgaccttttgttgccagattaagctcttggtcacacttttgtagtataattggattagaaattaaattggtatttaatttctctaaatttgtgttatctttttccaaattctttgttttaagttctctaattaaattataatgtctcttggtggatttcgtgattcaattatgcatagttttgtttaaaagtgagtttccacacaacttagcaaagatcacaacatgatgcaaaagttttaaaaagttcagaattttactgatttttcttcactagattttcacagtgttacaaactatttaggtggtatacaagaaataggggatatccttgggagatgaaaatactttccccgatatagcaagtaaaacagacgattacgcttttcttaaatttgatatatactctagcagtaactgtcggaattgtagtataagccttagcccatatgaaaaataattcctaaaaaatgataaaagacccaatctcaagtgaagggatgcatgtaaacctttagtatcatcttactacttctaggatagagaaacctcctttaaaggatgagtgctcttttagctacttgagcaatgaggggtggagagaaccagggaaacacatccgtgtgctcactagtggatatattttcgcacaaggattcattgtaccagt

SEQ ID NO: 17049 - DNA, 1501 bp, Oryza sativa
ccccgtgctcccacacagggtccctactatctgacatctccaccctgtatcaaatgcatgagaaattatcactgctaattataaacatacctcccattatgcaataatacgacgtaattatatgtacactggtaagcatgcatccaaattcttccatactatgacgtatttaatttaacctatatgtacatagaccaaagcaatcaaatatacttcacatgcatggttttagccaagcacgggcaaccaaatgccgaaataaactcatattcccaatgtatttcacatgcatattggtaaaaatatgttctattgacctaaatcccaaaatatgtccatgcatatcacagtaaaaaataccataccacggttcaagccacggtaaccacggtagggtggacggttaccacggttttcacacgattaccgcacatacgtatatcgtctcatagattacgaagccgacggtaaccgtacaaaaccgcacggttaccgctcctaaccgcgcgaaaaccttcaaaacggagggattacctcttgcccgtcgacccaggcggttaccgtctcgtaccgcgcggttaccgccgcttaccgcgcgggaaccggcctcgccggcgcggaggcggcggatctggcgcgggcgcacgccgtcgccccttcggtcctgagcgcaactacgcgagagaggggaaaaacggtaggattcgccagagaaacgaagcagaggcttccaaagatattttcctcccattgtgggccttattgggcctcgtgaacagtgcatacttggcccattccatttaatcttttttcttttttataattcacaataggttttgcgctcaaatttgaatttacctgcatctttttgatgaaattgtttcaccataacaacatacaaaacaagcttttacatccatgattttttttgatttttttcgattatttttcaaatttttgaatttgagcaaaatttgcccaaaccctaccgccggttttcgttaccgaccccccacggtaagcccggtaaccgcggttgccgcgcggttaccggcgagaaagtgaaccctgtgtgcacacaagccatcaagttttcaacgggacgaagaaaacggtcggaagatgtaaaagtaaattaaatatattcaaatcatttccgttatttttttttctcgaatgcaaaatcattccaaatcatgacgatagagtcagaaatgataatggttttaccggaggccggagcatcagaaaatactatagacaaaatcattgaagtagagcctcaaaaacagcaagcaagtcttagttatatttatattgtaaaatactagtaacttgtcttagttatatttatattgtaaaatactagtaacttggtcatttgatgttatagatgttggtgtatttatcttatctgttatccataaacttggttagattgtcaaaacgctttcttcctctcgcgtcgccctcccaaggggtggctcgggaggcaacgagc

SEQ ID NO: 17050 - DNA, 1501 bp, Oryza sativa
cctctcctctacccactccaccacgccgccgagtcatcgcatagagccgccgcgccgccactttcggagccgccgcgccgtcgccccggagccgccgcgccgtgcgtcgccgccttgcgccgccgtcgccgtcgtcgccgccaccgccgccgccggtgagccgtctttccccctcccccccttcacctcgcgcccaccgccgtcgccgcccgcggaggcaaagaaccgagagagaaagagagaaaccgagggagggagaagccgaggaagagagaaaggagccgggagggagaaaagaaaaggaaaagagagaaaaagagaaaaagaaaagggaaaagagaaaagaaaagaaaaaggaaagggagaaaaaggaaaaggaaataaataggaaattagagggagtttgaggaagtttagaaaatttaaaataattagaatttaattatagattaattatagtcgtagaattgcaaaatttaatataaattatggattattcttggtaatttctataagaaatcaattcgcggtagtaaattagatgtaattaataactagacaaatagatgaattattatagattatttttgggtaatccctataagtaatcgattcacggtagaaattcggatttaattactagggattttagccgtgtattatatttaatcatttagtcataaactaaattaaatcgtataatatttctagaatttcgtccgatatttagctcatgatagaaatttctaacctattatatggatataatgctcgggaagattaaattaaaacttatgacaacgaaataattatacccgcaaaatagcttaaatcgaaattgggttgccgtagttcgcagatagtaaagttaataaaaaggaataaacccggggtcccacttgtcagttggtacaaggctgtggatatgtcttggattaaaaataaatcgtttatgaacagtagcttttcgcaatttctcggattaattcaaatttgaatctttacactagcataacttattcattttaactcggatttgagtgaaacttgaacctaaattcatctaaattcataagctttccaatgatatataattcactatttaaaaaaatatatttataattataaattaattaataccaaatgattagataatagttaacctaaatagtgtgccaatgaataaaaatggatattgtacagtagcataattatctttaacatgtcttgtcactgtagcaactaaataaattagttataatcaatccttcaaattaatgggtgtataggaaaatattagtgccatttactagtctatgtccaaatataactaaatccatgacttataaattgtttacataaagtttagcctcatattttgtaactaaaatatcaacacacatagatgaatctttaacttgtttaggagagtaatcacaaagctagttgtatttggaccacttaaaaatttgtcgatacaatgtcatgtgaagtagaatat

SEQ ID NO: 17051 - DNA, 1070 bp, Oryza sativa
aaaaatagaagaagttcatttgtggttcttcatttttttcaaagcattataacaattatagtatttgaatatgtttaattcaaagcaaacttaaaagaaggtagtttcattcttttttaattaaataatttttaaatgatgtttgtattattaaaattagcaattaagctctgaaaattccaataaaattttaacgagtgtaactaatcatggagaatttaaaaaaattaaatttaaccatgtcattttatttctcacacttgctttacttgtaaatttatttaattatacacatacctacttaaaaataccaaatatttcagcgaatttgtattttaattaattgcatatttttctgatctgtacgcttcccgttgcaacgcacaggcacttttgctaaaccaaacaacactgggccgaagaaaaatagaagaagttcatttttggttcttcattttttcaaagcattataacaattatagttattgaatatgtttaattcgaagcaaacctaaaaggaagtagtttctttcttttttaattaaataattgttaaatgatgtttgtattattaaaattagcaattaagctttgaaaattccaataaaattttaaagagtgtaactaatcatggagaatttaaaaaaaataaatttaaccatgtcattttatttttcacacttgctttacttgtaaatttatttaattatacacatacatacttaaaaataccaaatatttcagcgaatttatattttaattacttgcttatttttctgatctgtatgcttcccgttgcaacgcacaggcacttttgctaaaccaaacaacacttttggtcaatatacacactccgtaatcacccggtgcaacgcacatgcacttttgctagtataactaaatgaatgtaggcaagaagacgccacatgcacatacgtatggtatttatcaagattctatggtatttatcaagattcacgaacacaactgtttacacccaaatttggcacgtaggttcaaattaagcaaaattaccaagatttgggaaaatcgccgatttcctccacagg

SEQ ID NO: 17052 - DNA, 1501 bp, Oryza sativa
agtatatttcgttaatgaaatttagtatatattgttaataaaatttttatatacgtcttcttagtaattaaagagctttacaaaacaaacttccataaaaaacccctaaaacaaacttcgataaaaatttttatatacgtcttcttagtaattaaagagctttacaaaacaaacttccataaaaaacctctaaaacaaacttcgataaaaaaacccctcgaagataaaaaaagaccctcaaaattaatttgaggttaaaaattaggctaaaaataaacttgataaaaaaaccacccctcgaagataaaaaaagaccctcaaaattaatttgaggttaaaaattaggctaaaaataaacttgataaaaaaaaccttaaaattacttttaaaatgatttatattcatgatttatattctagtacggagaggattctagtacggagagggtgggtgcatacatgcacattccaatgtaaccaaagaatgagaacaaatgattaaaataataataaaacagcgtacacgaaaaagagaaaaaaaaggacgaagagattttagtgagacgtacgcgcaaaattctcagtcgaatccggccgtaaactctccataggaaaagggtcgacaataggtaatcacccaaaccaagtggttaacgaactaatcaggttggcattgcaacgtcatcgatgatgaaatcaaacgccgccttttagtattttatagtaggagggtcagcctcttctttggaaaaaaaactgtgatactacgaggaagcaatcgtccgttggcatcgctcgcgtggttagttgtcaggtcgctccgcttcattctgctgtgcattttggcgagtgcctagacagatccgtgatgaacagtatatgaaattttccacactttggcctggtttagttcctaaatttttcttcaaactttcaactttttcatcacatcaaaactttcctacacacaaacttccaacatttccgtcacattgtttcaatttcaatcaaacttttaattttagcgtgaaataaacacaccctttgattacggtttagtcagaacatttgcgaattgcaatgcgcgcgggtgaaacacctttatcagacgcgatcgggaattcaggatcgggaacagctgcgtgccgtgcagaataatacttcgtattacagaaagtttagaatccgtattacgcgagagcagagtcgatgcagtgtgttttgagtaggggtgtgaacgcagctgaacagcaagcagagttggcagattcgaattcttgtcccgtaaatttttccttgccttatcctacacccaggcctagatgcttgctttttataatcctctagtggcaacacagcctcacctataaatgctgtgactgatgataagtccagtgcattccatcacagacagttcgcagaatcgcagcagcttagcttaattacttttttcaccaactcaactttcagttaatttccggttaatcctcgattcctcatca

SEQ ID NO: 17053 - DNA, 506 bp, Oryza sativa
ctcgtggacgatccgcactagctcccatgtattgaaatgtggcacattagctttgatcccatctactaattggctctattgatttgcgtgcacacatgacgcacgtacacgtacccatgcatgcatgcatgcatcctaattaatagttagttaatgcatgcatcatcctagctaattagtaattagttatatgtatgcatgcatatagccgaacttaattagttactactaggatgttaatgattcagctatatgtgatgtatgtgtatgcccgccgatgcgatgcatggtcgcgcatccgacgatccgctccggccgcctcctaactccaccgatttcctttcctccaacccaccggccgtcttcttttgtttgtttggttagcttaattagtccctcaacctcaagagacgcggaattaatccctctcaagttacttcttgacaggtaaatatgtattaatgttctctaatcatccttaatctctatctagctattattatagg

SEQ ID NO: 17054 - DNA, 1501 bp, Oryza sativa
tatatatattcccggtgcgccctcgtcttcttcaccaacacttaaaagttttcggccgatcgatctctctcggcctctctcctccgccgccactgcctagggcaaatccccgcgccgacgccgccgtatctcgccgtcgtctcgagctcgtcgtcctcgccgccgcctccgcctcctccgctgccgccgcatctctggggtgagagccgccgcatctcccttcatgcatctcgatctctccgatctcgatctctctccgtcgccttcgacgccgtcgccttcgacgccaccgccttcgacgccgcgcaacgccgccgccgcatgccaacgccacgccgccgccgccgtcgccacgccgccgccgccacgccacgccacgccaccgccgccacgccacgccgccgccgccacggccccacaacgccacgctgccgccgccgtcgccacgccgccgcgccaaccgccgccccgatgccgccacaccgccgttaacgaacgagaacgagaacgatcgaacgaacgagagcgagaacgaacccgtcaacgtacgttgccgcgacaacgtgaacgagaacgagaacgatcgaacgaacgtgaacgagctagggaacgtgaacgagcgaacgaacgaggacgaacgttaacgtgaaatgcaatatatatatatatatacatgtatatatatatatatatatatatatatatatatatgttacttcgcatttatcctaatacatttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattatttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgttt

SEQ ID NO: 17055 - DNA, 1501 bp, Oryza sativa
tgcatttcttttacgaagggtttttttcaccactttcacatagtgtcaaacctttctagatataataggattcgattttttttaccgcatcacgtataattcctttttctttagaaacagacaattttttcgcccttttttatcgcgtcaacggagtcggaatcgttttgattttttcccctttttttggatcggacagatttttttttgcccggtttatttcgcccgatcgattttttttaccgcgtcacatataattccttttactttggatttttttcgccctttttttaccgcgtcgacggagtcggattcgttttgatttttttttctccctttactttggaattttttcgccctgttttcaccacgtcgacggagtcggattcgttttgatttttcccctttttggctttttttggataggacagatttgtttttttttcgccccgtttttttatcggacttttatcttttttttcgcctggtttttttatttttttttaccgcgtcacatataattcctttttctttatcggaaagttttttttcgcctttttttaccgcgtcgatggagtcagatttttttcagctttttccttttcttttatcggacaaatttttttttcgcccatttttttttctcctgtttttttcggatcggactatttttttctttttttcgcccggtcgattttttaccacgatatatataattcctttttctttggaataggacagttttctttttatttttttaaactctttttaccgcgtcgatgtagtcggattcgtttcgatttttttcctttttttgctttcttttttgtcggacagatttgttttttttccacccggtttttttccgcccaggtttttttatcggacttttctttttttttttgctccacgatacatataattcatttttctttggaataggacagttttctttttatttttttaaactctttttaccgcgtcgatgtagtcggattcgtttcggtatttttttcccttttttcctttttttttgtcggacatatttgttttttttccgcccggttttttttcgccaggtttttttatcggacttttctttttttttcgctcggttttttctcccgttttttgacggacgacagaagcacctagagaagtgtttttttcttttctccaatccaatacagatcggatctcttccagggaaatcagattttttttctccagggaatcggactctttttttttcgctttttttattcattaaacggtttgtctctcggactttttttttccctttttaagggatcgggtgtttttttgccagggacgggtgtttttttcgcccggttttttttttcactttttttttggatcggattttttttttcgtccggtttttttatcggacaaacttggttttttctgcccggttttttttcacccggtttttttgatggacgatggaagcacctcttattttttaagtagtagtaga

SEQ ID NO: 17056 - DNA, 1501 bp, Oryza sativa
ttatggtagagacacggaagtactccggcatgaatctaataggagatcccagggatacaaatctgactgtaatctaacaagatttatggcgatataattatagcaaaaccgaaaaaaaaacggagaggaaaaaaggaaaaaagggcaaaaaaaaaagaagaagaaaaaagcaaagcaaaagaacatgggtcgataactagtggccaactagatcagcgcgtgggcatgatcaaaattcaaaagcaatgtgtacatgtaaataaactaggaaattttgaataagatttccagccaacctagtgtgtggaatgcatatggtcatattttccgtatgggccgggggagtcttctattttggatcaatgcgtgcagaattgcgaacgaatatattccggatgaaactatgcatgttgcgccgatgaaatgccaaaaaccagggcagctacatctgcatccatgcagcagcagccaaaaaccaaatttagtgaacaattcaacaagacaataccactgcctctgcatgcatggaggatggatcagcacctctatccttctatctcttccccaaacaaatttagcaaaactttgaacaagacaataccactgcctctgcatgaatggaggatggagcagcacctctctcctctcctaaattacttatctgatttacgatccgacttaaccactgtattcattgaaattgaatctttaaattaaaatattacatgattatatttatcacaaaaatataaatgattatatccaaaattgaaatatttatgatacataaaatatctagttataattgttgaaacatcataaatatatgttaaaatataaaagatagcctgtgcaacatttaacaataaactaagtaacgaaacgtcggaaaaatatccaaataatactgtgcatgggcacattataagaaaaacttcatttgcaaaaacaaaaaaaaagaatatgcaatatagtcgaatttcagttagaatcacgagagatctttcgaaaaagcttaattaccatgaatacaatgatacagccggcttaattatatatcagctacatcatttagactaaaaaagtcatttgaagtgtgttaagtggagcttctcttagctagctacttgcactcctatactaccatgaagacagaagagagggaaatctcgatgggagagagaggagatgggtagaaattagtgggtggtgtgttagttagctgagagcgggggtatgtctgattttttttttcttgacgagattgggcgcatgacagtgagcattttccatcatatattcctcacagaatagacacccagtcacagctcatagtatttgcatccccacaggtcacggcattatcatttaagaaaatggcaagtgccattggccttcctagctctctgccggctataaaacggtgccttgggggagcatgcaataccacagcaaatcactccactcctccactcatacaccaccacactgcacacacacc

SEQ ID NO: 17057 - DNA, 510 bp, Oryza sativa
aaattatcagtgagcccattgatactcaaaccgagaaaattatcagtgaccccattgaagcgcaaagtgagaaaattatcagtgagcccattgatgctcaaaccgagaaaattatcagtgagcccattgaagcgcaaagtgagaaaattatcagtgagcccattgatactcaaaccgagaaaattatcagtgaccccattgatactcaaagtgagaaaattatcagtgagcccattgatactcaaaccgaggaaattatcagtgaccccattgatactcaaagtgagatgttggataattttcaagatgacactggaagggaaatgcacaccagggaggtcctttcccatgttatttttgaaacccatgctggtgagacaaacattaccattggtaagagtgaggagatttcacagtttgtcactgtaaaaacatgccaagattgttctgatgcaaattcacctgtttatgaaactgcaggtttgtcaagtgaaatgcatgacatctctt

SEQ ID NO: 17058 - DNA, 746 bp, Oryza sativa
ttttctttttctctgattaatgtgagaatttctaggtcatgagagcgaacgtggaggctccttttttttctgaattttagttagttttaaattcctataaggactctatactctacttctaatatttcttattttttaattccgaaatttctattttttttcttaattatatttctatatggactctatactctacttctaatattccttatttttaattcaaaatttctattatttcctaattgtatttctatatggactctatactctacttctaatattccttatttttagttccgaatttctattatttcctaattgtatttctatatggactctatactcttcttataatattccttattttttaattccgaatttcaactatttctaaagtgtatttctatatggactctagtctcctcttctaatattccttattttttaatttttaattccagattttagctatttctaaattgtatttctatatggactctgttttttctttttctctgattaatgtgagaatttctaagccatgaaagcgaacgtgaaggctcctttttctattcctttaattatataatagatagattagctgtaaggttagctacaatttttttttcctctctctatttctcacttatacatttaatgcatttgtcttggagattatgttaaactagctcttgcatgagagccaacccctttgactttgttctacctctctcctctacataaga

SEQ ID NO: 17059 - DNA, 1501 bp, Oryza sativa
cgtggtcttttttttaacatagaaaaaatgcctgtgcgttgtgatgggtaattaaaattataacaaatataaaaatattatatgattaaggtttagttttacatgatatgagctctttaagaaaatatatttataatgaaataaaaaagttcagctaaagtgacctaaagtgaacttgttccatacggagagtacacatggtccatgaggcggcccaatagtgtgggtggcctgggaatagaatcggggaggaacaacttaaacaacctaaagtgaacttattccgtgtgggcggcctgggaatggcgttcggcctgacgcgggagaagccagagccgtccgatctgatagacggtcatcccgacctatataaaagttcaacagcccaaaccctaaccctaaaatcatttcccctcccccctctctctcaaaacaatgtggcggcagcctgacataccgacatccctacgacggcggtggcggttcagcagcgatggcgacaccctccccttccggcgtcggcgttttcttggtgttcttgaatctgatcttgtattcttgtagtagtgttttctttagaatttaggtccaaatttgatgcagtctctcattttttttttcttttctttttttatttttttgccatcggagagggattaaagcgggatcgatcgcacgtgtgatggaatttctataacccacaagccatacaaatttttttaattaggtatacatagatattgaatcggactttccttttttttcatttttttcgcccttttttcgttactacggatgtcagaaacgtctttaatttttttaccgcatcacatataattagattcgatttttttcgctgatttctttttcacgctttttttcacggatggacaacagaaacactttttaatttttaagtagtagagatagagatagagaaagagaaacggaaaacttttttcgcaactttttttttggaatcgcacagaaaaaaattttacgcttgttttttaccgcgtcgatggaatcggattcgattttttttaccacgccatgtcacatataataggattcgattttctttggtatcggacatatacttttttctttttggccctttttttttaccgtgtcgacagagtcggatttgtttaattttttttccttttttcgcccttttttaccgtgtagaccgagtcagattagtttcttttttttcctttatttcgcccctacttttttttggatcggactttttttttctttttttccggtttttcccttctttcgcccttttatcggactttggtttttttcgtccgcggatttttttttgttttgtcctttttttattggacatagtttttttttcgcccgatttttttcgcacggtttttttctcccacggtttttttacggacgatggaagcacctcgtattttttaagtagtagagatattgtttagttaagatgaaatttactgtgtgagttcgcttggat

SEQ ID NO: 17060 - DNA, 1501 bp, Oryza sativa
ctcgaccccaatctatggggatatctgctcttcttcgcgagctcggacatttttttcctcaaagccaatgcttcagctgttgtatgatccgcaacaaacgtgtcccagtcagcctgcgatatatgtccataatccgtaaacggtgggagattcttctgaacataatcccgatttagatcggacttccaatgtcgccatcgatctcccatctttttaagtgcgtaatctctccccctgacctctgatccaggagggaacacaaaatacttctgcaactcattccagagaagtgtcttgatgttgtcgtccactgtttcccagaacttgacattaatgggacaacgcgtcctgactagagtgccacaggcgttgctgaacttggaccgcactatcggtggttcgacgggcttcccatcctgatcgagagcaatcacgttgtaagattccttgggtaatttattcttgcttctctcaccacgtctttttttcccactcccgtctgcacttgtagatgtctccgtacgttcaggtgcagacgtagcggtgtccatctcaacttcttgctctgtcctgttcctcccggctttacgtttcgagcggcgtcggactaccatctgcacacaataggtaactctatacaccattaggttcatgtcacatcatagttagggaataatacatggctaacgattttcagcacttacggcctgttcgataggtatgtagtccggatcatcatcgcggggggcgacttgtgttatttccattggaaacgggtcacttggtgtgcgccacgtttcttcactagaagcgtctggctgcttattgctaccggaattttaaggagcgttaccttcttgaggcgctattggtgcgttcgatggaaccttttcgttcgacatcttccaacttgacgtaaaaaaatttgacataagtcccaattttacgtaagtcccaatttaacgcaatttcacataagtctcaatttgacataagtcccaatttaacataagtcccaattatacataaatctcaatttaacataagtcccaattatacataaatctcaatttaacataggtcacaatttaacttattttcacataagtcccaataacttaatttcacataagtcccaatttaacataggtcccaatttagcatcagtcacaattaaacataaatctccatttgacataggtgccaatttaacaaaagtcccaattatacataaatctcagtttaacgaaaatcacaattatacataaatcctaatataacataagtctcaatttaaacataagtcacaatttaacataggtgccaatttaacaaaagtcccaattatacataaatctcaatttaacaaaagtcccaattatacataaatcccaatataacataagtctcaatttaaacataagtcacaatttaacataggtgccaatttaacaaaagtcccaattatacataaatctcaatttaacaaaagtcccaatta

SEQ ID NO: 17061 - DNA, 1392 bp, Oryza sativa
  unsure (1)..(1392): unsure at all n locations
gtgggtttgaatgcnattccactnaacaacaaaatataaaaatacaaatatgacaaaaccacttatttttagaagttttaaaaaatgacaaaaatacaaaattgacactggtctgaacagaaactatgctcatttctgatgatgaatgtaatgccacaaaattataaacaaaatcaatcaggactcacggagggagtcgctatcacgctatgcctgccttgatgactgttgtagccgcgctgacctgtgccaaagaggcattgattttggcgctgagcaaaaaaaaaagcaaatattttggcacacaacagacatgtaggagtatgagtttagctcttcctcagaaggtaatgagacctactaaaggggctagagctacacatcgttcaaatctatctattatattattaaaggaatagaaaaaggagactccacgttcgctctcatggtctagaaattctcacattaatcggagaaaaagaaaagacagagtacatatagaaatacaatttaaaaatagctaaaattcggaattaaagaataaggaatattggacgaggagactagagtccatatagaaatacaattaggaaataactgaaattccgaattataaaaaaggaatattagaagtagagtatagagttcatatagaaatacaattaggaaataactgaaattcagaattaaaaaaaaaagaatattagaagtagagtatagagtacatatagaaatacaattaggaaaaaactgaaattcgaaattaaaaataaggaatattagaagtagagtatagagtacatatagaaatacaaataggaaataatataaatttagaattaaaaaataaggaatattagaagtaaagtatagaatccatatagaaatacaatttagaaaaaaaatagaaattcggaattaaaaaataaggaatattagaagtagagtatagagtccatataggaatttaaaactaactaaaatttgaaataaacataataaaattaaaagtagagtttagagtatgtataaaaatacaatttacaaataagtaaaatttgaaattaagaaaaacatgggaagaagaatttaaggtcaatatagaaatacaaatatagaaatacaatttagaagtaactgaaattcgaaattaaaattaaaaaatattgaaagatgagtttagagtccacatagaaatacaattataaataataaaaattcataaataaaaataaataatattggaagaagagcatagagtctatatagaaatacaatttacagaaaatttggaattaaaaaaaagaaatattaaaagacgagtctagagtccatgtaggaatatatataatttacaaataactaaaatttgatattaaaaataattaataa

SEQ ID NO: 17062 - DNA, 452 bp, Oryza sativa
agtccaaataaatgagtttgttttcaagtttctgaatttcatcaaaaaaaaaatatttttctttgtgccttttgattttttttttaaaaaaatgttttcggcatttcaaaagaaaaataatattttcggaaaaaaattcttggcaaaaaaaaggaaaaggttttggcagaaaaaaagggaagggtttcggtttaaaaagaaagggagagtttcgttttttaaaaaaaaatttgggccaaaaatagtatttttttaaaaaatatttatattgcttcagtatttttgatttcagtttagtgccttttctttctttttgtttccagttttaatgccagcatctcgtttctgatcggagtcagttttgttccttctatcttttctttagatggccgattctccctgtactcaccatggtgaaggcatggaaggatttgttgcggagcttgcaaata

SEQ ID NO: 17063 - DNA, 453 bp, Oryza sativa
aattcctgcagcccaattttgttacgctgcgagtacgtattgaacgagcgagtacgtatgtaacgctgtgacttgttatagctaatagcttattcatataatagttacctgtaagcatatagagaagagaagcaaattttgttacgctgcgagtacgtatggaacgagcgagtacgtatgcaacgctacgacttgttagagcagggccaatagtgttgataggtactaacttcaatttatacatagccaatctaatagctcattcatataataggtatatgtacgctcatcctgaataaatgatatcagattatttgactggccattgagggaccgcggggtacacatacgtaaaacaatgttacacggattatattacatgagccggatgagaggagcaactgctgatcaaggagtgtatcatatgtgatataaaactcgagaacctgaagc

SEQ ID NO: 17064 - DNA, 1501 bp, Oryza sativa
ctcacccgcgcgtcgccggggcggtcgccgaagcacatgtacaccaggaggcagaacatcgcgtactggaacggctccatcacggtcaccggcgcaccgccctcgccgcggacgtgggagatgagcacgtcgagcacccagcgccgcgcgtcggagaacgcgcggaggcgggccgggttgagcacgccggaggagatgcatcgccggagggccctccacgtggggccatacggcgccgagctcacgttccggccgccgctggagagcagcgcggacgccgggccgccgccgccgcgggggcgcgacgcgaacgccgccccgcgctgcaccagcgcgcggtgcgccgcgccgcgcgccgccacgaagatcgtcggccgcgacggccccagcggcgcgaacgtgaacaccggcccgtgctccgccgcgatccgccgcagcgtcggctcgacgtcgaagtccctccgcgcgaggaacagcagcgggcccagcacaggcaccgtcctcggccccggcggcagcggcgccgcctccgccgccgccgccttggggctcgccgccgaggcgcgggcgcgcagcagcagcgagcacgcgaggcagagcagcgaggtgagggagtagaagagccaatcctccatggctaaacctctcggatttttttcccattcccactgctcacagtggagggatatttatacgggagggaaaaaaagttttattcctttttttattgggaaaataatttgtttatccattttgttcctggctagaatgtttggatgctggtaggaagtgggtggctgggatatttttgggggtgaataatttcacggggatttttttttttttggtgtgtagctagtggccggtagtgagtgttggagtcatgaacacgtaggtaaggttggattatgtggctgttaattttttaaccggataatttacttttattataactttaattacctgggtattagtcacctgccaagaaagtcaccagattggtgaaagaaaaaaaaaggcaataagtgatcagatgacacaataataagtactgagcatttttgttcaaaaataataagtaatgctctaaaatagaacaagaaaaatcaaattcgattaatgccgcaacatcacataagtatgcccggagaaaaacagaagaggggttctctgtttttttttctgttgctggttagttaaaaattgaaccgatataatgtaaaagaaaatagaaagagtgcatagcttcttagttaaatcgtttcacgtaaatctggtaggccataaaaacggcttatagaactcacgaaataagttattggtaaattttttagctatctaaaaactacgaatgctgaaaaataaactacgacaaaataccttaaatcaattctaaattaagttttaaaatttgtgaacaatgagccaaaaagaattccatggtgctgataataagaacgtgaaggatggaatagctgttgtcttcgtaaatatcaccgta

SEQ ID NO: 17065 - DNA, 731 bp, Oryza sativa
atgcttatatttataaattaacttttgaattgtaaaatttaattttggaattggttttataggttttcattgtagtttatttaaaaacttttgaatcgctaaagatatatttcctgcattccaaattgatttacatatttcataagtacatcaagaccaagaaaaaataataactctctcctactatatttactctagcaacaaactcgatgtatgcaccatactcattatttcctagcaaatagcaaataaatatattgcatgtgggttataaatacttgtgtgcatagatacatgcatcaatgtctatttactccaatgcacagataacgaatagacttaatgtatgcaccatccccattatttcctagccaatagcaaataaagatattgcatatgggttataaatacttgtgtgcatggatgcatgcatcaatgtccatttactccaagcacagataacgaatagacttaatgaatgaacacaaatatgtatatcgtttaggaataaccttaaaaatatatatgtagatcaatttgaaatggagggagtagtatacagtataaaatttctactcataagttatttaaaaactgttgataagcgattcacataagtataaacaaaagcttaacaataaggtcgtagtcaaacaacctaagctgtcataattatatttctggtttagcaactctgtgtagattaactccctccgtatatgatgtgacca

SEQ ID NO: 17066 - DNA, 490 bp, Oryza sativa
actcgtattccagtagtacaactcatctcaagtctcgactcgatggagatatgcatgcgtatatgcatatggaactttattagaactacgaatgcatgcatgcacgcatacacgtgtcgcgccacctaagcaaacgcttggttgtgcatggctggcacagctagcgctagctgctgccgtgacacgtgtggctgcctcccttcttcacatgtgtacatgcgcccagggtggccatccatccatatgcatgcctcacagtttgtgccatccacaaactgtgtcgatatgcatgcatgcgccgcaacaacaatgaagcggtaatttcacaccaaaataagtacatttcgatctacttctagctactttcttcatcttaaaatgtagctgcctaatactagatgtgatattacctaatactatgaatctgaaaatgtcacatctaatactagatagctatattttaggacggaggtagtagcagtataagagt

SEQ ID NO: 17067 - DNA, 1130 bp, Oryza sativa
gtacatgttatgcaattaaacgagaaacctcattagcacataattgattaagtattatttattataaattttaaaatagatttatttgtttttaaaagaacttctatatagaaacttttttaaaaaaaatgcaccatttaacaacttaaaaggtgtgctaatggaaaacaagaaagttaaagtttggagttaagaaaaaaaaaagggggcctagtctcctctattctcaaaaccaaatatttcaacaatgcttccttttggaaagctccttttaatgtttcccagtcaactctctggtcttccatttctaaaatccgaaaataccttttcacttcatgtattgggcaaatttctaaaggttaggtttctatttagaatcaaccctagtgttctatttgagaaattattcatgatccttaaatccgactaatattcctaatcatttaccttcgatggcttgtggggtcaaaacaaaaattatgactttgataaaatttctcaagtctttgctaaggaggctacaaattctatatcccatgtaagagtaattcatcaggatacagaagataagctttgttggattcacacttcttctgctgagtgtaatactaaaagtgcttacaaagaagttttcaagtctttccattataatcatcatcctattccttccttagttatcaatcttattaaatctgcttggaaaaataagacaatttctcctatagttaaaattcttctttggacacttttcagaaacgctttacctactgctgttactcttcattctagaatcaaggacattgaacctacttgttccacatgcggtcaacaacaaaacgaaactcatatctttttgcactgttgctttagtagactagtttggtttatctttgattttcaacataaaacggatgctcttagcttgatgacatctatgtatgatattattcttacctcctagctactatgtccacagataatgcccttcaaaaaattgctattatgctttggcaaatttgaaaagctatgaatgatcataattttaaagcaaaaaattgggagccttttcaggtttgtaatgcaaccatctccatggtgcaaagttataatagtgttcatcaaacacaaca

SEQ ID NO: 17068 - DNA, 1501 bp, Oryza sativa
gatggattacaagcacatggaggcacgcggcacgccggtgcgctgtcgccgtgcgggtcactgtgcatgcaggaggcagtaccgatgtggtgcactgtgcagattggttttcgtataccaatctgatgcatgcaaggaggattagattaacatgcatctacacgcatgcatgttgcatgcatacaactgatatatgcatatatccttatagtactgacactaaccagatttattttcgtgattaattgtcttgcatgtacggccggagctgcatgccgtgggctgttgaagattgtttctggactctagccacgcgcattgcaccggagccgagcgcctcggctatggtccacatcgactcccccgggagttcccttgtgtaaaacggagcggcagctgcatatccggaccagctatacctttacatcggataaacgagataaacgagatgagtatctgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagcccctctaggggcatgatgagacaacctgatcgtcagatctatactacacccggcggattcaaatccccaaacaggagtagggtattacctctcattgagagggcctgaacctgtctaaatcctttgtctccgcatccatccacttttaggtctcgtgcgctacccccttttattattgccgaaatcatgtttcgacagttggcgcgccaggtaggggtaaacgccgagtttcctgacaacgagtgcgatggaatcaactttatgagtcgccggcttcgtcttcgctttgggagctccttgattcctcgccgccgacgacttcaacaagacgaatcgtcgctgctattctctgcctgatcttgtttgcatcagcacgacggcaacgacggggcaacgacagttcgacggatttgatggtcgtcctcgtccaccaccacgcctactggtccaatctacccaacgaggatgccatggtgttgcaagatggatctacaaacacgaagcatgccaaaaccgatctaatcggatgcataagagacggctgcagccacgccgatgccttcctgccgtcctgcgtcgtgctgatggacaccaacgccgcccgcgactgcgacctccgcctcctccgctccgtctcggagtcagtcgaagagatcaatctcggcgagttttttccttttaatctccgacttcgccgggttttttccttttcaacttattgttgtttattagattgatctctaaatgtcagattaatctctcttggtattttctgctgtttgcatgtaacgccgcggc

SEQ ID NO: 17069 - DNA, 1366 bp, Oryza sativa
ctttaatgccaaaaaaaaccttaccaaattttagcattaccaaaatttcagtatagttgccaaaattttggcaggattttttatatagctaccaaaatttgacagcaaactaaatgtagccacttttttagcaactttactaaaatttggtaaggttgaaaatggcatcaaagtaaacaggccctacatcttttgtgcccctatttggttggatgcaaaatttgtagattgagacaacacaaaaattcctttattgctactacaactaaagttttaaatatgcaacctcctaaatagaaattgtgcggtctaaaatcatataaacatttcctaatacatttaatttctccttttacttgaatgcagagcgtatgagttcagtttgtatttataagcaccatgtatctgcacaatatatgagatgcatacgtataagatttataatgaatatgtgtacacatggatgtatgccagtctgtatatgtatgtacgtaagtacgtacgtacgtacgtatgtatgtatgcaacctataaccaaatagtttgtgaataatttactatagtttcagttctgatttctactgtgcatgtatacctagcttcgtgacaactaatctacgtatagtttgatcgaaactaaattatcccactcctcaacagatttagtctaactaacaataaatcaatgatgcatatggatatgacttgataaataaatgacaagaaaacgatcgaaatatcatttaagatccataatagaacaacaatcaacatatttataggtcctagccagaatcgtggctcaatcaataccgctctcagccagtgtgatcaagtcatagcgtgattaatactatagctaaatacccaagatgttacaattagagatcttaagggtggaggatttaaaaaagtaataatttaatagagaagatgtcctagttaattgtatgcaaacatgcatgccttatattatggaacacctaaaaaaatagttgtgttttatattatagaatggagggagtatataacaatgatcttgttcactttgatgccattttcaaccttaccaaattttggtaaagttaccaaaaaaagtggctacatttagtttgctaccaaattttggtaactatataagaaattttatcaaaattttggcaaattttgacaactatgccaaaatttggtaaggttttttttggcatcaaagtgaacaagtctaatgttttactaatttttaagtatagagagagatcgcttacatatcaggtacaactgcaaactgcataaagcataaagcataaagtcagttgatcaggtctgtttcctacggccattttctaatgtcatataaactgattca

SEQ ID NO: 17070 - DNA, 1501 bp, Oryza sativa
ttattaaaacagccttgaaagaaggcaccacgttcgctgtggaggttaaaaatttccacgttaattggaaaaaaaaaagagaaatatatgtgtcgttggattgtatttgtgtagattttgatggtccagatcaaccagcaaaatacgtgagtccaaaagaaaaacatatagagagattgactaggaatcggacacgcatgtatttggactaatttgactaggagtcggacatgcatgtatttgcatgcatgcgtatggccttttgagcctgtaaatctttagtgagatttgcaattggaatcggatattcatatggcgtggaagtaattagagtcatgcacgttcatccacgaaagaacaagcaaatattatgttaattattaagcgctcaaaggtagattaaaatctattccaatagattatggtaggactaaattacaatgctacaattttatctataaaacagaagataagagttatacactaaatctaattatacatgcatgtataataaaatatttatgcacttaaattgtactatattcgctctaaagaaattatcacgttatctctatctatatagtccttaaaaaacaagaggtgtttccgtcgtccgtaaatctgaccgagaaaaaaaacgggcgaaaaaaaatccgattctgtgtaaaaaagggcaaaaaaaaaataaaagaatcagtcctattataaaaaaaggaattggacgaaaaaaaatcaggcgtctgattccaaataaaaaaggcgaaaaaaataaaaaaaagaatcgttccgattaaaaaaaggaaccgggcaaaaaaaaaaccggggaaaaatcgggtgaaaaaaccgggcaaaaaaatgaatcgaattctgtggacgcggtaaaaaagggacgaaaaaataaaaaacaaatctgtctgattccaaaataaagaaattatatgtgacgcggaaaaaaatcgaatcctatcatattatatgtgacacgatactatatatctctatcttctctatctctatatctacttacttacaaaattgaaagcgtttcctctacttacttacaaaattgaaagcgtttcctctacttacaaaattgaaagcgtttccgttgtccgtaacaagtaataacgaaaaaaaggcgaaaaaacattaaaacaaaaaaaataatccgattcaatttacttccgtcgtccttgaaaattttatcttatcttaatcttaatctaaatctttccgaggggaccgagcggcgccttccgtccccacccgcacgatgaaacgcttgccaaagcaaaaaaaggaaaaaccaaaattgagcaaagggataaactagattgaagttcctaaaattaaaagaggataaacaatattaaaactcccctaactcgaaaagagggaataaaatagattgaaatttcccgacaaaattcccaaaattcgaagaaccctaatttcaggttagaaccctaagagttaaaatccaaatcaattaacctaaagg

SEQ ID NO: 17071 - DNA, 1501 bp, Oryza sativa
gtgcttccgttgtcctgcttttgcaccttgcttcacactgcctcaaccaaaaacgctaatccttttttttctttcttgcgtagaactttggatttatttagtgcaaacttgtgtttttatcaccactttcaatttctgctttctcgttttcttgcacgcttctcaaatcactaaatgatttgttttctagaaaaatttactttagaaaatcatattaatctattttaaaagtttatttttgctaatgcttaatttatcatgcgctaatagattactccgaatacaaccatagtacatggattagtgctagacgcttttagacgcttttatgaagagaagagctatgaaacggtatattgtcaggacggtacaagttatgcacgacattaaaccgtccaacccagcatcgctataaaccacccatctctcctcccgcatgggtcccacgagccccacggattaactctttgcgcatgcagtactagtacagtcgtactccgtactatactactgtctgccatatactaatgcatgcactagtagtataggaagaggagtacatgcactaccagtcaattattgtcgctgtctaacggtctaatactactcctgccttgatgatgccatatgcatcaaatcgaagttaaagttgccaatgccaatgagcaagagaaaatgacttgattctctattgctatatgtgatcctatgtgacctgatgatgaatggtcctgtttcaagggtaaaatagcgtgagtatatgagtcgtatctaggtatcatgtctggtacctacatgtatcacgactgatatctgggtatcatgtatggtaagtatcagacttggtaactacatgtatcacgaccggtacctaggtatcatgtctagtctagtacatatataagtatcagatctggtacctacatgtatcatgtctggtacctacatgtatcacgactgatacctgggtataatgtacggtacttataagtatcagacttggtaactaaatgtatcacgaccggtacctgggtatcatgtctagtacatatataagtatcagatctggtacctacatgtatcgtgtctggtacctacatgtatcacgactgatacctaggtataatgtatggtacttataagtatcagacttggtaactatatgtatcacgaccggtacctaggtatcatgtctagtgcatataagtatcgggtctacctacaggtatcaacctaatacatatatgtatcatgcttagtaccacaaattctagagctatcaggtatcataagtgataccttagtatcagactgggtatatgttaaaactgagacccacgtataccagctgatatgtgcttggtttgctacccacatgtattatgataggtactttacgatactttcgaggtactattatagatagtcatattttgacatgtaaaaaatagtatcataatataagatactgaggtaccagcccaaccactgagtatagcta

SEQ ID NO: 17072 - DNA, 1501 bp, Oryza sativa
tacatgctgttgttattatagctatactcagtggttgggctggtacctcagtatcttatattatgatactattttttacatgtcaaaatatgactatctataatagtacctcgaaagtatcgtaaagtacctatcataatacatgtgggtagcaaaccaagcacatatcagctggtatacgtgggtctcagttttaacatatacccagtctgatactaaggtatcacttatgatacctgatagctctagaatttgtggtactaagcatgatacatatatgtattaggttgatacctgtaggtagacccgatacttatatgcactagacatgatacctaggtaccggtcgtgatacatatagttaccaagtctgatacttataagtaccatacattatacctaggtatcagtcgtgatacatgtaggtaccagacacgatacatgtaggtaccagatctgatacttatatatgtactagacatgatacccaggtaccggtcgtgatacatttagttaccaagtctgatacttataagtaccgtacattatacccaggtatcagtcgtgatacatgtaggtaccagacatgatacatgtaggtaccagatctgatacttatatatgtactagactagacatgatacctaggtaccggtcgtgatacatgtagttaccaagtctgatacttaccatacatgatacccagatatcagtcgtgatacatgtaggtaccagacatgatacctagatacgactcatatactcacgctattttacccttgaaacaggaccattcatcatcaggtcacataggatcacatatagcaatagagaatcaagtcattttctcttgctcattggcattggcaactttaacttcgatttgatgcatatggcatcatcaaggcaggagtagtattagaccgttagacagcgacaataattgactggtagtgcatgtactcctcttcctatactactagtgcatgcattagtatatggcagacagtagtatagtacggagtacgactgtactagtactgcatgcgcaaagagttaatccgtggggctcgtgggacccatgcgggaggagagatgggtggtttatagcgatgctgggttggacggtttaatgtcgtgcataacttgtaccgtcctgacaatataccgtttcatagctcttctcttcataaaagcgtctaaaagcgtctagcactaatccatgtactatggttgtattcggagtaatctattagcgcatgataaattaagcattagcaaaaataaacttttaaaatagattaatatgattttctaaagtaaatttttctagaaaacaaatcatttagtgatttgagaagcgtgcaagaaaacgagaaagcagaaattgaaagtggtgataaaaacacaagtttgcactaaataaatccaaagttctacgcaagaaagaaaaaaaaggattagcgtttttggttgaggcagtgtgaagcaaggtgcaaaa

SEQ ID NO: 17073 - DNA, 1501 bp, Oryza sativa
ttaatgaatatgaacgtgggaaatgctagaatgacttacattgtgaaacggaggaagtactagagaacgtctgctagggtttggtgctggtgaaagatgtaataggggaagaggaggaaaggtgaaatcattgaaggatattaaagtgggatttgcggagctactagagcacccgcaatggtaaagtaaggtgctatctataaaacatgtacatctcagcaatagactagattaatagtaaaccacttcaatggtatgtctacatgggtatctatagctctctaatccattgcctcgtttttctctatagattatctccaggttaatagatagctttgctctctctcttcatttaatctctttcaagtaggaaaatatgctgacatgtatctctggtagagagcctatggataaccattgtgggtgccattattgtataattaaagtaggatattaaatcatatggatatggtgggagagaactagccatcaattatacagtgtcaagaaagaaaggaaatgctaatttgcccgaaggatgaaccagcagaaggaaagttgatgattaatgttcaacaaatgcatatgcataaagaaaaaaagggaaaaaaaagaaaaggaatgcatggaagaaggaaaagaaacttcaggaaatgcatgctcagaaaaaaggaagaaggaagatgatgattagtgttcaacaaatgcatgcaaaaagaacaaaggaaaaaagaaaaggaatgaatgcatggaagaaaaggaataaaaaaaacttcaggaaatgcatgctcagaaaaacaaaaaaaaaaaaagtaaattaaggggcattccgagaatcgaactcgggacctctcgcacccaaagcgagaatcataccactagaccaaatgcccttcgacgaaattaaaatcccttttaattctaataaccattattatctcaatttgtcgtgaagaaaaaaaaaacgagccttggtcccgccatgtgagagtctctgagctctaatgccaaacttgcacgaactgcagcttccgtccaaaaccatctcctcctcctcctcgcctcactctttccttctctgtgcttctcctcaagcaaatgaaaggagagaaactgccaatgcaaaaggctgcagcagaaaaagaaagaaaaaaaggcgagcaagaccagaaagaaagatcaaagcaaaccatcgctcgcgacgtcactccatctcgaccaaactgctcattcaatgctgctgcttttcgctcaatcagatgatgattcgatcacatttactcctactcgagatcaagatcttggtggtactactcatcgattaattaacttgtactcatcgagaccctgatactgatcaatcaatcaaacaatcagtcagtggttagtgctcgtcgtcagagatagcaaaaaggcgcaggcaagaacgaggagaggacggacaggcgccatcagaaaaggaaagaaacgtgagagagagagacacagatcgcggcggcga

SEQ ID NO: 17074 - DNA, 1501 bp, Oryza sativa
tcgttccattttttattttcgtccgctctgaaacaatcaaggaccagattagttttgagactgcaagatccaaattagtttgctccaacatataatttgaatctttctgcttggtagcaacactctcaacttcccagcagttcatagctctagagtctatacatagtaattggatatttcattacattagcataaataacaacagagagaatcctgcaatcattagtataaataacaacataggggacatggcaatatgacattctcacttacagagaaatcaatttctggtaatacattggctaagcagcatttcgttgaacaccttttgggcaaaaaagagcattagtgatcctgtaatctgtaataaccctcggcactcacaatgatgattcttgacaaatgaatggattgcaacgtaaagagaacgaaccaattaaccatgcgtcccttctccggcagaagttctgccggagggatcgtgctcggatggtatccgggggcatggagcgctggaggcgggcacaggtgtcacctctcccatggagcgggcgaggcggctgggaagcagattggcgaacctcgcccttggcaccgacctgggcgaggggcgagtgagggatcggcggcggcgttgatctgggcaaggacgaacaaccccgtcgcacctcgcactgcattctctccctcaacgcctggtagtgtcaccgcgcgcagccgtcgttggagtgaggtcttcaacatctcccatctgtcggctgttgtggcgtcgatgcagggtcagcgtccggtccccaatcggcggggtgtcgggcgacgagcggcggcgatgagcgtgcgaccttgagaggcggaggcgtgcgatggcgatctgcagtggatggatggaagcgggggtgcggccggcggcgagacgcggcggatggatggaggcggtgccgggggggggggggggtgttggggcgatggggcgggagggaccgggagagcaggcggcggaggaggaatggatcggtggtgcgaccggcggcgagacgcggcggatggatggaggcagtgccggcggggaggagcgcgataggaggagcggcgatgtcgacccgcgacggcggcggcgtcgattcgggcgagcaggagtggcggtcggtgaaggcgtggtgggggcgcggcgaaggatgaggggagcggcgtcgacggttggatagcgagcgcgtgcgatgggatcctcagcaccgtccgatctgccaatcccacggttaataagtcgcgtgtctgtcagggttggagtcaccgtcaccactacagaattttaaaacagtagagatataaatccaagcgaattctcacagtgaatttcatcgtaactaaaccatataacaataataagattaaaatagttatcacccattgcaacgcacgggcttttctatagtttgtataaaatttttaaataaagcgaatggtcaaacatgtgttcaaaagtcaatggcgtcgtcaatta

SEQ ID NO: 17075 - DNA, 1266 bp, Oryza sativa
tgtttttcatgatcaaaacttttttaagttcgatcaatttataaaaaaattaacatctaacacaccaaattagttttattaaatgtagcattaaatatatgttggtaatatttttgttttggtaaaaaatggtactatactttggaccctccccgcgcgtggccctcctcagtcctcccgatccccactcgcgcgcgcggccctcctcctccctctcgtgtcgcgcacccttcctcttctctccttccaaccgaccccctctccccctccgtttttctctccctccttcctttctttttttctccctcagccccaatccctctccctccttcccccctccgtttttctctccctcatcctgatccctctccctccttccttcctttttttcgtttttttctctctcagccccgatccctctccctccttccccttttttttcgtttttttctcctcccggtgccctcctcttctacttttttttctttttcttctttttttctcgccctcccatctatcatttttcctctcgttcttttctcttttttttgaaaaattaaaaataaattgatatttttcctcttgttcttttctttttttagaaaaattaaaaataaattggtgaaatcaagacttgaactcatgatcttatagttcgtggcaagttctcctatccagttcaccatatgatgttatgtgagtaaaaaacattgtttgtatgttttgcatgtgtgttcaaattgtgtgagaacaaatcatttatattactgcaagaattataccttgttactataattcaacaataatattatcatagaagggtagtaacatgatacgttactgcaaaattaataggttgttactgcacttttggcagtaacaacatgacaaaaattgaagtaacagagaatatgcatactaacagtggcactacagtagtaatttttttgtagagttaaaatattttaaatctcaatctttagaaagtaggaacgtatacgtcatgtcttatttttctaacccatttgtatcatggcgttcgtaaattagaaccatcataactattttttaacgtcgttactgcagaaagcagtcgtgttactatagattggctgttgcgttactacgatgttccagtaagacgaggactaaaaagaggtacatctcgatctttagagagcaatatctctcatatcatatcttgtttttctaatccgtttgcaccacgacgttcataaaaaacgcttaacgaaactagatccatca

SEQ ID NO: 17076 - DNA, 1501 bp, Oryza sativa
aaatacaaactactaattgcaactcatgattttcttaagaaaaaatccaagtctattccgacagtgaattttactctagctaaaccgtataataacaataaaattaaaatagtatttacccgttgcaacgtacggacattttttagtaaaaaaataaaattccactctctttgtgattagttggaatatttgggttgctgagtcagatttaaaaacacctgttatgttacatgaaatgtatttttaaatatgtcctaaacttgaaaagatgcatacaacttttgatcaaacagtaatccacagacaaccaacatcccggtccagggcttaatatgattaatagaatactcgtatcaacaagttgcaatttcttttccggaagccaatctctaaagaactccgaggttaagtgtgcttggcctgaagcaatttagggatgggtgaccaacccggaagtgcatgcacacgagtgaggacaaagtgtgcagaaaagatttgtgttggtctgtgagggcaccaggactgggtgcacacgagggagcaatttagggactgtgagggcaccgaccgagaagtcccgggtgcacacgtctatgacctacgaaagctactagatgtaagtgagtccggcccctgagagggcagtatatgacctacgaaagcctgtgagggcaccgggaagtcccgggtgcacacgagggagcaatttagggatgggtgaccgaccgggaagtcctgggtgcacacgtctatgacctacgaaagctaccagatgtaagtgagccgaccgggaagtcccgggtgcacacgtctatgacctacgaaagctaccatgtctatgacctacgaaagcacacgagggagcaatttagggatgggtgacagaccgggaagtcccgggtgcacacgtctatgacctacgaaagctaccagatgtacgagggagcaatttagggatgggtgaccgaccgggaagtcccgggtgcacacgtctatgacctacgaaagctaccagatgtaagtgagcccggcctgagaggacagtgtatgacctacgaaagctaccagatgtaagtgagcccggcctgggagaggcgggccgttacaaagtggtatcagaaaaggtctatgacctacgaaagctaccagatgtaagtgagcccggcctgtgagaggcgggccgttacaaagtggtatcaggtcgttacaaagtggtatcagaaaagacttgtgttggtctggtctatgatctacgaaagctaccagatgtaagtgagctcagcctgggagaggcggaccgttgtaggtgggctccacatgtcagtgactgtttgctcctgcgacgacgaatctgtgccgaccttgtttcaccgcctccgcctccgattcgacctccgcggccgccatgaaattggagcttccgggaggaggaaatctcgagaagtagagagagaagaccacagcgtgggcgagcgcgtcggcgtcattgattccggcgaca

SEQ ID NO: 17077 - DNA, 1501 bp, Oryza sativa
tacaatccgattacaccgttatgttcgtaacaattaatctttacaataagatctcagatgattatattttgatgaaaaatcacaaattacttttatgatatgtctaaattacttttagatttcactaagttacttcttaaacatataaaaataaattcagtaaaatctaaaagtaatttacatatattatagaagtaacttagaacaaaacggaggcaactttggcatgttatttgaagtaaatccattgtagagataaaaacataactctatctgaaattaaattaatcagcacaaattatggaattaactaaaaacaataataaaagtaatcacctcaaagcattatgaatgtataggaagtatttgaatcaaatctaaaagtaacttatatatatgacaatttgttcaataaagaaaggcattaattaaagttactttctttataacttcttttttaacacttacttatataatatatatatatatatatatatatatatatatatatatatatgtaaattacttttaggttttattgaatttactttaatatgtctaagaagtaatttagtgaaatctaaaaataatttagatatattataaaagtaatttattatttttcatcaaaatataatcatgtgagatcttcttataaagatttagttgttacaaatacaacagtgtaatcggatcgtagatcggatgagtagtttaagagaaaattatatttgaagtataggtggaaggtgtctcttgtattagacaaaccagctagaactagctgtgtaattacatccgtttcatatataaggaatttatcctttacccctatcgttggccttttagaccttctccggcttgcatagttgcatgcgactagagcatacgaaccccctttttttagaaacgcatacgaaccttttgagcaaaaggttccaactgtcataatccgacaaacgaaattaccataagaatgagtaggatttgtccacatataatcgccaagtacatacaataagacagaaaatcgatgagcagctatacaaaaaggttaagtctactctcgactaaataagagttaagactccaaatgcttgctgcgtaattgtcaactcgtaaccaaatgggagttaggatgaaaaaaaaaaaacaaccctactcattcttagctatcgtaagctggatcagaacgggagctcaccggacatgctaatatagccgatatgctctcttgtccaaagcacctgcaaaactcatctgcttaccaactcatttcttagttggacttgtgtcaccaaactttggtagtgccaacaatgtgttcaatcgagtgaaaccatccaaggacctctcatctccgcttacgtttgagtcactaccatcatcgacgtcgtcaggagtaacccttttactattgggccgggtaatacctgatagggcaggcatccttggactatatccaggttgccctgataaaccaccggtaacttcatacttg

SEQ ID NO: 17078 - DNA, 1190 bp, Oryza sativa
cccctaatatattatggcaacatgccctcctattttcagcattttcttaattaatattggaaaacatactttgtaataaattatttaaacaactatatcatctaaatagctattttttatccgtgcatgggacgagattatttacaataaaatttagaattcaatacctacattaaatatattttaaaagtaaaataaatgtatttctttgggtcatataatgctagagactacctattggtcactcgatatatattaagaaaaatcacatagatttttaaaccatatgagtggcaacattttgcttatattagtaaatacaacacccgacacattttctaataggtctaaaattatatctatattttaaaaatagataactaaagactacgacccgttggaatatgcctcagaaaaaaatttccgtcccttgtcctgctgtacatatacctcctttgatcctctcgccttattatttttaactaacaacctaatatttaaaaaacatagctaaatgacttataatttctaaaattatatttgatttttaatttgttttaattattgttttatttacagttaattaaataattcaatatccattatagttgtattttactatatagaaattaaaatactcctatgcagggcaactgaatgaaattgaaaaattataacagaatgaaaacatgtattatttcatattaaacaatctacgcaataaaaaccaaaaccaattaaagacctttagagcacacttaagtcaccatatgtcacattttaaaattataaaatatttcatttaaatcgatggacccattattttcaaccattagatttaatttacgaaaaatcttacgctgccacgcgtcatgtcctgaaaatcataaataatcttaaaaattttgagaaaaaattaaacctatcatcattggttttaagttacattatttggagaagttataaaaataaatcgcatctacctcctcgcccccttcacatgcgcgcagaccactgccaatcccatccctatttttgggtaggagtaaactaaaagagaaataatcaatatgttaaaacaaccatagtttttaagctacatgtctgatttctaatataattattgctctatttataattaaactaggaatttaagatccgtatccttatattttcctatatacaaaata

SEQ ID NO: 17079 - DNA, 163 bp, Oryza sativa
cgccgtcgccacgccgccgccgtcgccacgccgccgtcgccacgccgtcgccacgccgccgccgtcgccacgcgtcgccacgccgccgccgtctccacgtcgtcgccacgccgccgcgccaaccgccgccccgatgccgccacaccgccgttaacgaacgaga

SEQ ID NO: 17080 - DNA, 1501 bp, Oryza sativa
agtaccaccttgcttattctaggagagggggacctccttaaaagggacgatgccctcctaaccacttgaagcatgtgtggtggagagaagagggggaacacatgcgcgcgctcgcctcgccttgcctcgcctggcagggcagggccggcggcacgcgtgcacgacgtacgcgttgaatggtccgcaaaattgactcctcacccttgcgcagatgtagcctccttatgctgttttgtattgctgcaggaaaattcggatttgttctgttgttggaaacattccgaaaaatccggtgcgtgaaaacagcgtggagtccggataagttacgcgcgacttatccggttcggttacgcggagtggagatcatgcgggcgccctgatcaagcgacctatctttatataaactgagccaccggcttcacgcaacacacgtgaaatcaatctagggtttgcctccctactctgtactgcgccgtcgctcatagactactccatcccgctcgccggcgtgcaccggcgatcgggagagcaggtctccggaacctttgccttcgacgtgctgcaccgggagaaggcggcaataaggtttttgggaagcgcttcacgcgactgcttcctattcgtccgcgacggctcgttttcctctccgcacgtgtgcttcgcgccttcgtcgacgctcgcaaccgcgagtagttcctgccgagcaaccggtctttccgccacctcggtacgtgttcgacatgttgcgcatatttgatctattcatgttttactgcttagtttacatgtgtagatctaatgatgcgttaatgttagtatacatctgtaattacatgatttatttatggaatatattaaatcattatatgcctatgttctcaacactagctgcacatgctcctccctattgccctcctcgccccttctttcttcttatgcttgggcatgcaatttttatccgctattaggtatgcattgttccacatatatttgactagaagtgcatctcctctcctgtactagtttgtgcaggatagaaaaatgtagcgcacatttggttctctaccttaccaatttataggtagtaccaacatctagacaaattttggcactatcaatcttttggtaggacaatgttaactaatattttcgaaaatagttcaaatcgtttggtaggataatgttagctaaatttttatagctcaactagttagctaaacattatttttggaaataggcctttgaatccaagtgagaaagtttcaccataaagaatctaactagttgagctatgctcattacgcataagctaatattcccaacagtaaaaataaaatcataagaatcaagggtttgagatttattttgtactcgtaggaaagacgaaagagaaagagaaaaagaaaaaggaaaatatgaaagaaaaaaacattagaggaaaatggaaaaggaggaaaaggaaaaggaaaagggaaaagagaaaacaagaagaaacaagaaa

SEQ ID NO: 17081 - DNA, 353 bp, Oryza sativa
tccacttgaattatttgataattacatctatattaagaaacacactattttcggcctaatatttcctttacatagttggattaaatagcatttaactgtggtcaggacagtgctataaatattcctggtattgatttcgctattttaagatttggatggatatagagtttttaatccacacatgccttttttttaacaagtatccccttttttgcatttctgttgtaccttttattttctgtactactttgtggatgttactctgatatgcaggtatgtgaacaaatgtactagatgccatgccttttacatgattgcattttgtattagtgacgaacatttctcctttttct

SEQ ID NO: 17082 - DNA, 1501 bp, Oryza sativa
tgtagtgccgtctccgcgttcacccgtgcgccgccgtcgccgccgcaagtccagccgtgcgacgccgccgctctggtcatcgtcgtcgctcgggaaggccgccatcgtgatcgccaagccgtcgccgtcctcgtccacccctccgtttccgccgaagatcgccggagcaccgctgtcgtcgtcaacccgatcgtcgccgccgtttcaacctcgtaatcgttgccatccggttgtcgttcgccgtcgtttgggtcaccggtgagttcgccgtgtcgcccgctacccgtagatgctctccgtttgcgccgccgcaccgtcgttcgctggcgagcatgcgcgcccgagccgccgccggtggtgacgtcaccactgacgtcatcgtcgccgtttcccgtagaccggcagtagatcaagtcgatctcggccgtccattttggatagggttgttcttggccgtccgttccgtagaccgcctctgtgcaaccggttcaccgtgaacccgagccgctgacgcaataatcctcttttccttttcaaaaataattcattattgcgtcataattcaattaaaatctatataaaggatttaatccgatttaatctttgaaaattcataactaattctctgtaactcagtttaatgtggttcaagttgcaaaagttgtataaaataaagatccatatattaaaattatccataaattgaattaaatttatttaattttttttaaatgggctttaattagattaaatcttgtaaaattcgtatttaattcataggaaatcggaatgagaccgttcaagtctctaaattcatctaaaatcatgatctacatgtttgtttacttttatgtactgtttatttggagtttctctgtgttttcctcattttgcgtgttagcttgtcgtttccgtcgttgcaaaggttcgcgtgtgcgccggaagtattcaagaagattaattgaagaccgattattgcaaggcaagtcacacagatgcttataatagatgcttagccatgcttagaaacaatagctcactaatgggataaatcatgtttcactatcacttatggatatttaatggaagctcacgatggtcaatcgtgattggttaattaattacttgccaattaaaacttgataatggtgggttgtgagcacatggttttgatggtcgtgctcatgacaattaaggaccggttcacgagtttcggttgtgaaacattaaccgtgccaaccacaagccagcatgggcaacggctttatcttttatatagcatggttcattgcggagcaccagactgagaagtggcggagataagcccacgggggtcgctggggagtccatgccttgttttataagggggtgattatgatctaggaatggtgcactgctttgagttgtgttgtgcgaagggtactgtcgcgatttccaccaccactgcagtgccgtggtggtacttcagggcatggtaacatgtgtggaatcgtgtcttgtg

SEQ ID NO: 17083 - DNA, 1501 bp, Oryza sativa
agcaaatatgcaagtgcacaaggataccaaagaatggcataatatatggctcatttgcaaaagcagcatttagcaaacatttgggaattataaaacagtagagtaattaatcatcaattttaatcaacactgaacagcacacccatgctgctcaggcccaaccatcctgaacaaccatacccggctgcacagatctatctccaaaccaggaatgtaccattccaaaccaggagctaatcaaattattaccagttatagcatcatttattatggtgagaagtgtgagactaatcacgaaagacattgttagacccgcccataaccgcgggcacggctattcgaatagttttactctggccagaggtgtaccactgtacccacaagacacgattccacacatgttaccatgccctgaagtaccaccacggcactgcagtggtggtggaaatcgcgacagtacccttcgcacaacacaactcaaagcagtgcaccattcctagatcataatcacccccttataaaacaaggcatggactccccagcgacccccgtgggcttatctccgccacttctcagtctggtgctccgcaatgaaccatgctatataaaagataaagccgttgcccatgctggcttgtggttggcacggttaatgtttcacaaccgaaactcgtgaaccggtccttaattgtcatgagcacgaccatcaaaaccatgtgctcacaacccaccattatcaagttttaattggcaagtaattaattaaccaatcacgattgaccatcgtgagcttccattaaatatccataagtgatagtgaaacatgatttatcccattagtgagctattgtttctaagcatggctaagcatctattataagcatctgtgtgacttgccttgcaataatcggtcttcaattaatcttcttgaatacttccggcgcacacgcgaacctttgcaacgacggaaacgacaagctaacacgcaaaatgaggaaaacacagagaaactccaaataaacagtacataaaagtaaacaaacatgtagatcatgattttagatgaatttagagacttgaacggtctcattccgatttcctatgaattaaatacgaattttacaagatttaatctaattaaagcccatttaaaaaaaattaaataaatttaattcaatttatggataattttaatatatggatctttattttatacaacttttgcaacttgaaccacattaaactgagttacagagaattagttatgaattttcaaagattaaatcggattaaatcctttatatagattttaattgaattatgacgcaataatgaattatttttgaaaaggaaaagaggattattgcgtcagcggctcgggttcacggtgaaccggttgcacagaggcggtctacggaacggacggccaagaacaaccctatccaaaatggacggccgagatcgacttgatctactgccggtctacgggaaacggcgacga

SEQ ID NO: 17084 - DNA, 1501 bp, Oryza sativa
gtataggattattcaaaggctcacacggtcgccgcctgactttgacgtctttgccagtgggtaatagtggaggatgtcctcatcacgcactcacacaactatacttacccctatttcttagaagcagatgcacatgtatctcaatatacgtctacaagtactcaaaatacagatgttaggaataaatccatgaagtagctccacttatctcccacgaaattcctacaagtaaatttcacagaattacatgtaggtagtctgaccaaactatcacaagacactagagatttaagatggtgtatcccaaaactagcagtcttatcttttcgattatgcttatgcttatcaaccaaaatttaaatttttaaccttaaatttgaaattgattttgaagtttttttccattgaagtttatttttcagcattttcttttagatggctaagaacacacatataatagttttactcacaaattattttccgtttgtaaatatgccgttggcttattctttatataaaccaaacaacggggacctagattttacaccaaatttatcatacataaaactatatatttaaggtgcaacatcacaaaactatatatttaaaaattaatttatcacaaaactatataatccagagcttaaataatacctagcactattaaacattatagtcatgattaaattgacgttaaatatgtagttttatgataacttgattactaaatctatggttttatatttaattttaaacatatagttttatgataaatttagtgttaaatctacattttttttcatacaccatcttatgtaattttgtgatagtttgttcaatgaatctatagtacattattttgtaaaatttactcaattcctaccgaaagagcacctacgtaactgtgcgacactaagattttgaacccttagttagcaagtggcatgcacctacaacttcaccgtcacactaaatatgctaccctactaatttgatttcgatcaaaagcttgaataaggaagctagtgtctactaattgcccaaaatccttgcatgcatgtgtagcgtgtgaaatactaattattgccgaatcatcaacacgcgggaagagataaatgttctgtcggtgaagaggggataaaaagcacgtgtcatgtatattcttcgatatatctctgtcatgacgaggatggtaattgcatttggcagctaggtactgcatatctatatgtgtacatgttgagcagctttctccaagagagagaaattaacatcatgcaagagatatatagatgcaactagctagaggtctccctcctgtcatgaaaactagtaattgctagctagcttaattgtggtgtggcaaatgagggatcacacaaacatgttcacatcaactattgattaatcaattactaaggcgatcaatagtaatcactgtgcatgctaaagagaaaggcagttggaaatagtattattattaggcaaaatttgctacagg

SEQ ID NO: 17085 - DNA, 1501 bp, Oryza sativa
ctccaacacggggtgacaactttcggattccgtacctattttcaaaaacagaatctgtcggtcagaattttttggaaacgaaaacggatttagaaatattttcttggaaacgaaatcgaaaatcgaaaatgataagggcagtttccgtcggaactcgaatcggtcagaaacttttcggaaattttctcggaatttccagaaatcacaaaataccatgtattctattttttaaagcactgaatagttaataccatagtgtttggttgctatttttttaaaaaaaatatttgttatgcaaatctaatattacataagaatatttttttcctgcattgggatttatcaacagcattactaatttattccgtagattatgttttgtgacgtaccgttgatacttaacaattagacttatatgattgtgttttatgatgaattgttgaccgttaagacttgagaattgggtttatcagtttgaggggtttttttattccgataaattttcgttaccgtattcgcgccggctcgttttcgctccgttttcagtttcgataatattcgattccattttcgtatccggggtttccgattccgatttcgattctgaaaaaaaattaaaacgaaaatgacaaagatgatttccgtccgtttccgtacgaaaatgataagggcagtttctagtactatttaacatttaacactaatgacagtaattagaaaatattttaaagatttcttttttactaacagattgaaaatttttttaagttagatttaaaaacttttgatttaaggttcaaattttaaagtcaaaatttgaaaacattcaactcagatttgaaaactttcaactcgagatttaaaaactttcaactcagattcgaaaactttcaactcgagattcgaaaaatttcaagtccatatttgaaaattctgaaaactttcaactcagattcgaaaactttcaactcgagattcgaaaactttcaagtccagatttaaaaattttgaaaactttcaagttgagatttgaaaatcttcatatccaaatttgaaaaaaaaaagttaagattcaaaaattttcaagtcatgatttaaaacttgcaaaaaaggaaaaaaaaaggaaaaaacacacaaaaaggggaaaaacacgtgggaaaaaggaaaaaaaagaaaaaaaaatgaggggatgcgacatggtgggggccgcgcgcgccagatacggactggcacgcgcacgccaattaggaattctgccaacgctgaccaggctgggacaaccttttcttctccgaaacccaaatgcaacattacctttggccaaatttatttattttaagggttaattggatccattgtaattttactagtttcgaaaaaaatatcatttgaagcatctaggcccccggtgttaattttggtaattaatgacaagcactaattgtggactaaccgttgtctttgagctatacattttaagttaggtccacgtcatatgtgc

SEQ ID NO: 17086 - DNA, 1501 bp, Oryza sativa
cgcctcctccgctgccgccgcatctctggggtgagagccgccgccgccagatctcccttcatgcatctcgatctctccgatctcgatctctctccgtcgcgccgcccgccacgagacgccgcgccacgacgacgacgcgccacgccgccgccttcgacgccgcgcaacgccgccgccgcatgccaacgccacgccgccgccgccgtcaccacgccgccgccgacttcgccacgccgccgccgccacgccacgccacgccaccgccgccacgccacgccgctgccgccacggccccacaacgccacgccgccgccgccgtcaccacgccgccgcgccaaccgccgccccgatgccgccacaccgccgttaacgaacgagaacgagaacgatcgaacgaacgagagcgagaacgaacacgtcaacatacgttgccgcgacaacgtgaacgagaacgagaacgatcgaacgaacgagagcgagaacgagaacgatcgaacgaagacaagcgagaacgagggaacgaacgtgaatgagaacaagcgaacgaacgtgaatgagaacgagcgaacgaacgtgaacgagctagggaacgtgaacgagcgaacgaacgaggacgaacgttaacgtgaaatgcaatatatatatatatatatatatatatatatatatatgtatatatatgtatatatatgtatatatatgtatatatgttacttcgcatttatcctaatacatttttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagatttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtt

SEQ ID NO: 17087 - DNA, 1364 bp, Oryza sativa
attttaatgtataacgccattgaccttttgaccaatgtttgaccattcgtcttattcaaattttttgtgtaaatataaaaatatttatgttatgcttaaagaacatttgatgataaatcaagtcacaataaaataaatgataattacataaattttttaaataagacgaaatgtcaaacgtttatcaaaaagttaacgacgtcaaacattaaaatatggaggggataatatttaacaccatgtgataaatagttgagacaaaatatactttatacgattattactcaagtaaatcagtgcagagaccgccagactggtaaaaagtggtgacagtaatagattaatagtacttctagaagaaaccgcgatacttaaatatgagatctgagcaattagggtgtgtttggttgcccatattcccctagcctggctcatttctcgcatccaggctgagtttgacctggctaagagtatacatatgcagttgtttggttggttgcattggtctagccaggctagcatgagattttgtttggttacttgtataagagatacggtttgaaagggattttgtttggttggttgcatggatgtgagtgttctttacctcttcatttagttgggtgaggttacctctacaatatatataacaaataataagagtattttgatttatccaattgaatattcacttacatatgcgaatgatactgcaaaatcactctattatctacataaaataagtcggccaacttttcacaccgaatcagtggtacgaaaaataagaaaaaggttatctattatattattaaaggaatagaaaaatgagcctccacgttcgctctcatggcctagaaattctcacattaatcggagaaaaagaaaaagcagagtccatgtagaaatacaatttagaaaatagctgaaatttggaattaaaaaaaataagaaatattagaagaggagactagagtccatatagaaatacaatttagaaatagttgaaattcggaattaaaaaataaggaatattagaagaggagactagagtccatatagaaatacaatttagaaatagttaaaattcggaattaaaaaataaggaatattagaagagaagactagagtccatatagaaaaacaattaggaaataactgaaattcggaattaaaaaaataagaaatattagaagtagagtatagagatacaatttacaaaaaattcggaattaaaaaaaagaattattaaaagacgagtctagagtaggaatatatataatttacaaataactaaaactcgatattaaaaataattaataactaacacgtatataaaataccatatgaatattacacatttgtag

SEQ ID NO: 17088 - DNA, 1501 bp, Oryza sativa
tttttattttttttcgcccttttttactgcgttgacggagttggattcgtttttcttttcctttttttcgccccttttttgatcggacggatttaatttttcttttccttttttcgcctggtttcttcgcacgatttgttttaagccggttttttcgccctctttttggatcggacaatttgtttattttctttttttcgccctttttttggccggtttttttgacggacgacgaaagcacctattatttttttaagtactagaaaaaatgcccgtgcattgcaacgggtgaagtctattttaatcttattattgttatatggttcagttaagatgaaatttactgttggagttcatttatctctactattataaaaattaaaaatctgtgcatgagttgatttttaagtttattcgtttttggaaatacagatccatgtttgagtcggtttttaagttcgttcgcttttagaaatatagaagaaatcgtataagaaatctctttaaaaaaactcgcctgctaacttgagacgattggattcctaattgcagctcatgattttttttaaaaaatatatatccaaacaagttccctcaatagatttctcgttaactaaaatatatgggagtagctatacaacactcgacagttttttagatgaaaaactttcaaatgtaactagtatgtaactatagtgtaattacattgtaactattatgtaactataatataattaatatgtaactcggatgtaactcccacaaaagtgcaaaggagtaactggttaatggagcaagtgtgtatgttgcaggttttgggttcgatccccatggcgcgcttgataaatttttcctatcctcctgcaccgttagcacgaacagggcttgcaaattttttccatctctgcacgcaccgccagcgctgaaaactgtcaacagttaattagcaaacccaaaaatatataacaataataagattaagatagcttttaacacacggatattttttctagtgtatatatatatatatatatatatatatatatatatatatatatatatagaggacactcatatggggcaccatggtgcccgggcaccatggtatctaatgcacaaaattactcaaatttttcaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatagtaaatttcaatcatggtgcccgggcaccatggagcaccaaacaaatttactatatatatatatatatatatatatatatatatatatatatat

SEQ ID NO: 17089 - DNA, 1501 bp, Oryza sativa
aaatttccaaacatcacattgtttttcgtttgttcgtccgcttagtacgcgcgatccgattttcttagtgtactggaaaaaaatacccgtgcgttgcaacgggtgaaggctattttaatcatgttattgttatgctagaaaaatgcacgtgcttcgttatgggtaaaggaacagttaaatgctataaagtctagagttaacatgtatatagtaatgtttcaagatagataaattattcattaggctaatgataatcacgatggataaaaacacacactctctctcaacccttgtgtgacaaactgtgatatcattgcactggtaatggttaggtgaatgaaatttaacctcaatgatttatcgaagcaccttcatagttatcacaagtgcatatttgtgcttggacaattaatccgctctacgcgtgtaggatgtgaataatgtccctaacacatggtcccaatgattgtagcattggagaaacggacgtccgagcaatgcacctttacgtataagtaaataatgaatattttgggagttcattaattattttaaactacatttttatggcacttttataatcttttttcataattgataattgcaataacattgcattgatttataatcacaatgcaacagtatacagctatgctctaacctacaaaacctgaacagtgccagccgtaccatgccgttcctttttcttttgtagaaaacctcttagcgtatgattaattgagttttattattacaaaaattaagaaaaaatatctagtattttatatcaacttgtatatagaaagtttaaaaaacgcgctaacaaagaccgagatagaaggaaaggatgcatggtgtgaagtttcacaccatgcacatattcaattttcatgttttaaaaaaatatcggttggttcacgtgtttatactgatttttttatataatataattataagatttcagaatcactaaaagtctgttgaagaaagaggtgctgaacttttgatttttcatccatcggatgtgcatggtccgtgctagtggttgagagaaaaaaaaatacacgcaaatatgatttgagagagggaaggaaagtagacttattctagggcctaggtaaacatatatttatattgatttttgtgtacataatctaattatttttaattttcgaattaaaaactaattcattagaagataagatttcataataaataaaaatctgtatgatttgagagagggaaggaaagtagacttattctagggcctaggtaaacatatatttatattgatttttgtgtacataatttaattatttttaattttcgaattaaaaactaattcattataagataagatttcataataaataaaaatctgttgaaaaaagagaaaaaaaatcgaaggcaaatataatttgacatgagggaagcaaactgtgcaagtaataatagatgtacaaatgagagaaaaatgggagtcgaacccgtgtggccgaaa

SEQ ID NO: 17090 - DNA, 1061 bp, Oryza sativa
ctaatttaaagtattaaatatagactaattacacagatagaggctaatttatgagataaatctattaatcctaattaatctataattaacacatatttaatttaatatttattttagcactgcattgtcaaataagttagttagacatggttaacttattatacatattagctcaagtagtataagctaataaataataagttagctataccattaaatttgctcttaaagataatcaggcaggctgacaaaccggccaatgtcacctgccacgtgccgctcagattcatttcgactctgaaaagtttttcttttggcagtaaaaccgataatactcttttctttttaactctgaaaatgttcaggatctactgaaaagaaggcatgtacggagcacatacatacgtacgtggagtggagaagtacgtcagagaaaacagggtgcgggaaactcttttaaatacttgggtgaacgtacatccgtttcttgcatgtcatttaaatagttatgaaaaattttaaaaaaaattgacatgataggttaatatataatatatcacttcacaaatatgtaagttcaaattcgacttctaaaaattataacaaaaataacaagacttctaaaaattataacaaaaataacaaatttgactgtgaatatacgtatactagttagagtttgatttgttatttttgttacaacttgtagaagtcgaatttgaacttgcatgtttgtgaagagatatattacatattaacctatcttgtgaatttttttagaattttttcataattatttaggtgacatgtaagaaacgggtgaacgtccacccgagagattagattagaatccatcctcaacagggggcagatcgagcacagtgccaccgaccactccagcatatgcaaccactcgtggttttcacctcaaaaccatgggtcgtctctcttcttggtgcgtgcgtgctcccccaccttgctggcttcgcatcatccgatgatcgcattctctcgcctataaatccagaccccctcctcttcaatctcatctcatctcatct

SEQ ID NO: 17091 - DNA, 1501 bp, Oryza sativa
ggaagaagagaaaggagccgggagggagagaagaaagggaaaaagagagagaggagagaaagaaaagaaaagggaaaagagaggagagagagaaaaagaaaagaaaaagagaggaaagaaaaaaaaaaggaaaaaggagaaaaaggaaaaggaaataaataagaaattaggaggatttaggaaataaaaatggtcggggttaatcatagattatttttgaaaattcctcgagcgtaatagtatttcggtcgaaattccgagttaataataagaatatgtgtcttgatcagattagattaaaattggtagtaatttagatataattaataactaaacaattagatgaattcttatagattattatagattatttttggtaatctctataagtcattggttcacggtagaaattcagatttaattactaggaatcttagccgtgtattatatcgtttagtcatagactaaattaaattgtataatatttctaggatttcgtccgatatttagctcgtaatagaaatttctaacctattatatggatataatgctcgggaagagtaaattaaaaacttatgacaacaaaataattatacccgcaaaatagtttaaatcgaaattgggtttgccgtagttcgcagatagtaaagttaatgaaaagaaaatcaaaaccttgactccacctgtcggtcactgtagcttgtggataaggttgtattataaataaatgaattagggacagtaccatttcgcaattattagaattaattcaaatttgaatctttacgctagcataacttattcatttcagctccgatttgagtgaaacttgaacctaaattcatctaatttcataagctttccaatgatatataattcactattggataaaatatatttataaaaattaaataattaatatcaagatgatgcataatagtcaacttaaaaatatgctaataaataaaattagtattgtacagcagaataattatctttaatatgttctgtcactgtagcaaccacataaattaagtataattgatgtttgaagttaatggatatataggaaaatattagtgccatttattaatctatgtccaaatataattaaaacccacgacttattagttatttaaatagagttagccttataattattaggtaagtaaaatatagatacacatagatcggtcctaagcttgtttatggcaaataataacagagctagtgtgattaaatcacctatatgaaattaatcaacgacatatcccatataatagcatatagtgggagaggtgagcaacccttagttaaccaagcagtaaatagaaactattcaaataaatgattcaatatattaagatattgtgcacacatatattgtacatcccattatagatatatggtatcgtattaatttgcttgttgcatatattaatttagagggagtatgtgacgaacatgaatattagataaatactagttatacatcttgtcc

SEQ ID NO: 17092 - DNA, 1501 bp, Oryza sativa
agatttttacaagcggccaagatcattcttactatacggacggctgttccacctgtagggcctatgaaaattgacgattttcgcagacggtccgcctgggaagattattttcctaggtggattgtaccatgatgcgccacctgggaaaaaaagggagagcacacctgtgataagaaggagccgccaccttgggaaatatgcgccaacttttgatttttcccgccaaatttttaataatatttttttatcaataatgttgcaattaattaattaactaatgcatacacaatattaggaactaacaaacatttaataccgacaaaaatacatatattgcattagtgaaaagtatcgtgaatatgttacaacattttttacattgtcactgtggttttcactaacatgaactcattgtgggcctgatcgattgagtgacctctctatatatatatactcctagggaaatggttctatactcctagggagtacgtactcctgctctcatccaccgttcatcaaaagcagtaccgatcctggatgttagcggatgctattgttgaaacccgttttgattttcggtaaaaacaattcccgtaatactttaattatcccatgtttatcggatcatgaaaactgaccgcatatatcaaatgagtcccagccattcgtctttcaccggcgcgacgacgacggcaaaatctaggtgggcatctccatcgtcggtggctggtttgctgatcgccaccacgagcggcgtacccctcgtcgactctccacgacgtgcaggttcgtttgtttttaacgcgtttgttttcattcggaatttcggatgatcacccgatcgcttgttctgattccgtgccgtctcaggatcatggtcggggcaacgagacatcaggcgctggtgacatcctggcactgcttgtagcagaggcaacgggagttcaccccgatcgcagatcagagcagcccatccaagcggtggagaaattataagtagtgagggcaactccccacaattgtctcgatgatggtaagaacaagactttccagtccgatatttcatttcatattcatcaatggcggcgacgacaacacggcatcgatcgatttgcgaagcctatgcatcacggcatcatggtggcggcgacggcaccgccgcagcaatcgaaggagcagagaggcggctgcaccacagtgcgccgctacgactcctcgctaccgatgtggaagaagaatgatgaagctcctaattaactagttctttgctccatacagatgcatgacaaatacaccattgatggtggccaacaccgggcagtattcgcatagttgcatcgattagctgatgtagatgcagaaaatgtggatttggcagtatgaaaattctgtccaaagcagcttgtgcaggtcaagaattgggtgtactgtacattcatttttcttctttttcagaatggctaaatatgtatgaatccatatactgcctgcattattgcaa

SEQ ID NO: 17093 - DNA, 956 bp, Oryza sativa
tatacccctgggtctttagtcccggttcgtaagaacactcccggttgttcttaccaaccgggactaaagatattttcccgctatttctaaattctttttaaacctggttagggttaagaaccgggactactgataaacgcactgaattaaaattatttaaagtcgaaaaattaatgacaattacttcgaaaaattattgttgtctgtagtaaattaagtggataaaacgtaataagcaaatatatgatttaaaattaataaaaattctaataatcatatataattagcatatgaatgatattaaattgttaaaaaaagtaattaacatatgttcataccacatgcatgatttaatattaagaaaaattctaataatcatatataattagcatatgatgatattaaattgttgaaaattctaattaacatatgtaaataccacatgcatgatttaaaattaataaaaattctaataatcatatataattagcatatgatgatattaaattgttgaaaattctaattaacatatgtaaataccgcatgcatgatttaaaattaataaaaattataataatcatatataattagcatatgatgatatcaaattgttgaaaattctaattaacatatgtaaataccacatgcatgatttaaaattaataaaaattctaataatcatatatatttagcatatgatcatattagattgttgaaaattctaattaacatatgtaaataccacatgcatgatttaatattaataaaaattctaataatcatatataattagcatatcatgataataaattgttgaaaattctaattaacatatgtaaataccatgcgcatgatttaaaacttttaaaaattataataatcatatataactagcatatggatgatttcaatttgataaaaattctaataatcatacataattaacatatgccata

SEQ ID NO: 17094 - DNA, 1270 bp, Oryza sativa
aatgggatgtacaatatatgtgttctacaacgtataaggttttggtcgcctactgtacatgagcttatttagaaagtgtactacccaatgctccaagtgattcctgaatatattgtagtttaatatacattagctagtttctatgagtgatattgtatatgtgatgcgacaagtttaagcactggttctattgggttactaataagtggtaatcaatttaggcatatataagctattctatatggtattgcgtcgattaatttacttagtgattcctccacatctagctctattattattctcctaaacaggttaaagattcatctatgtgtgtttatattttagttgcataatcataaggctacacttgatttaaataacctataagccatggatttaattatatggccatcgaatattaaataagtactagtattttcctatacatccattcatttgatacatcacataaaattagtttgtgtggttgttatagtggcaagacatgttagagacaaatattattacatctagtctactgtacaatactaattttatttattaacatatttttaagttgactattatgcatcatcttgatattaattatttaatatttataaatatattttatcaaatagtgaattatatatcattggaaagcttatgaatttagatgaatttaggttcaagtttcactcaaatcggagctaaatatcgaacgaaatcctagaaatattatatgatttaatttagtctatgactaaatgattaaatataatacacggctaaaatccctagtaattaaatccgaatttctaccgtgaatcgattacttatagggtttacccaaaaataatctataataatctataagaattcatctatttgtttagttattaattacgtctaaattactaccgcgaattgatttcttgtagaaattaccaagaataatccataatttatattaaattttgcaattctacgactataattaatctataattaaattctaattattttaaattttctaaacttccctaatctccctctaatttcctatttatttccttttcctttttctccctttcctttttcttttcttttctcttttcccttttctttttctctttttctctcttttccttttcttttcttctctccctcccggctccttcctctcttcctcggcttctccctccctcggtttctctctttctctctcggctctttgcctccccgggcggcgacggcggtgggcgcgagg

SEQ ID NO: 17095 - DNA, 372 bp, Oryza sativa
caccaccaggaatcaattaacctgtgcaaggggttagtcaaactcaaacagcttgggcgggtcatgatgagatcatgcatccttggtccatggaaatttggccatgcatgcatgtgcaggcttgtaatattctagacacatgcatgcagggatggtcaatgtttttgatagcatatgcagccgaaatgccgaaattaatactatatactctagctagccgagatgggtttttttatgtgctagtattagtagatccacacaaaatatgcatgtaaatcctaaccagatgctcggctaaccacgcagaaagaaaaaaaaaaaaggtagtaactatattaaaaacatgatcctatgtctgcttgttagccgcaa

SEQ ID NO: 17096 - DNA, 1501 bp, Oryza sativa
ctggtttttgttgtatgaagggaacttctccaaatttggaaaatgagtacagtattatatgcaacaatgtgattgcataatgattttggatataggcatatagccaagcacagttacgcttaatttagttattgatcgtaaataaaatggaatcacgtgtccacaaaagatagaagggcctatcggttgactataagctagttatgtactaaaacagctgttggagaccaaaacttttatatatctatccttataacttaaaaattagtattgaaaaataaactatgttgaacatatattaacgttaagaatatgtgccgttgtgtcattggtgacttaacatcatgtttattttagattattggtgtggatttctacctattatatgaataaattaaatattttaagaaataaacataattttagataagaggtgtaaataatgagctaccttttcttctaggaaatatattaattaatttttcgaagcgtagagcaaataaaaggaaaaggcatccttttgaaacccttttcaccatcattatgctcgtgtgtctaaggctaacatcaagcagcatacgcaaacttaaaatatcaatcaaatatgaacatattccctcatactttattgatgtataaccacacataacccttgtcaccacgggtttattgacacaaaatactatccacacgaaattattcccccctcccactcccatttcctcgcaaagaaaagatgcaaatattccaatcctcttcatccgtaaccttcacccttcagcacagattcgtggaggtaataataataataataataataataataataataataataataataataataataataataataataataacccatcataaattaggtgtagttttgattttttctggtaacgtttgaccattcatcttatttaaaaaatagtgtaaatataaaaatggataagttatacttaaaatacttttgataataaaacaaatcacagataaaataaataataatttcataaccttttaaataagatgaatggtaattatagacaaaaactcaaaactattgatattgttttgggatagagtgagtaataaagaaccgtgcaggataactaccggggtatcgccaacaattttaccacctgacgacgaaacatgggcaacggacggactccccggaaattggtacggccacgcaataaatcgcacacgcccgtttgatttcttcttcccccacgcgcgtccgtgctttgcctgcgttctgcctacacacagccgcccttgccgaccgccaccgccgcaaccgcaaccaccttccttttctccaccctcttccttcctcttcccgcggcttcgcctcgcctcgcttcgcttcgcttcgcttcggagtccagcctcctcctccgctgacctcctcgcggtcttctcgtctccgcgtggagcaactgcctcccgcggcggcgcgcgcgggtgggtggagactggagagtcc

SEQ ID NO: 17097 - DNA, 179 bp, Oryza sativa
gaagtgtcattcggacggcaaccataccaatctccgccataaaagaaaaaagtcagtttttttttttttgggggggggaaaaaaaaaaaaggggggaaaaaggaaaaggggggttaaacaattgttggggtattcccccccccccccccttttaagatataaaaggaggaccatgccca

SEQ ID NO: 17098 - DNA, 906 bp, Oryza sativa
tttttatttttcccatagcttttgcttcacacgttgtttgcaatgtgactgtcaacatacctgtctgttaatgtcaacactaacatgatctggaatttttgacagaccattagaccaagggtgacatggacgtgtgaaaatgtcaggcaagcaagcaaggctagctgtggactatactattgttaatccacgctggaagcttcacccgaatacggcatgtggaaagggatatggttaggtgtgttaagttcacgtcaaaattgaaagtttggttaaaattagaacaatgtgatggaaaaattaaaaatttgtgtgagtagaaaaattttgatgcttgaaaagttgaaagtttgaagaaaaagttggaaactgaaccatgccttacttacactcttctattgacctaaatatcttgtccatactgtaaatgattttatccatgtattattatatttgtgaattctcttatattttagacgtagatagtagttgtagaaaaaatgcttaagagtttgcacgtactgctaatttatgggtcaatctgggtacgccgtacgcttgcttcttcacgttaagaattgcagcattgttcctggagaaggaaaatggcgaaaggccgaaagttgcatcgcatgtgttacatgcatgcatgttttgttgaccaaagcttccgtccaagaacgtgatctcagttttcgtttccatttcaagcgaagaggccggggccctctgtcactgtgtcacatgcatgattttttttttcgaggaacatgcatgatttgttgaccatgcattaggcctaattaatcatgctgccagaggaccagtggtggtggttgcattgcatgtatgtagctcaaaaactcgccaattaaaccaaaccaaattgctgaacttgttttcaga

SEQ ID NO: 17099 - DNA, 1501 bp, Oryza sativa
atatgacgaaataaaagccgtgtaatagatggtaaaaaaatcgatgtatcctatccgactcaagcatccatcaatttagtgtttttttctgacagttttttcagagcgatttgttttttaatagacggtgtttttttcttgcgcggttttttcaaatcattttttagaaatggcgcattttttcttacagtttttttcttgcatgttttttttaaaaaaattaccgacgatggaaataatatttctcgcatgttttttttatggaaaatggaaaaccattttagcatttttttgcgcttttttctcacgcatttttttgaaccgtttttatttttctcgtgcattttctctttttaaatagttagattagattagagatagagaagagatatacactgattagaaatcggaatttgtttcgccctttccatttttttctcgcgtgcattttttattttgtacgaaccagctttttattttttcacgaaccatttttttagccactttcttagggaatcggacaaacttttttagatgttttttcagatttttttcgtctttataggaatcagactttatttttccctttttaaaggaatcggatctagcctttatttttcaccacttttttttgccttttataggaattggatctactgcttttttcgccacttagtggaaacaaaattttattgttgttgttttctttttttccctttttttccttttttgcagtttttctttttttttatgcacctttatgccctcgttctctcccttttattattttttcaaaaaaacgacctcaagtatcttattgcaagattatagggactcaaatgtaaatataaaaattacagggactcaaatagaaaagtacaaacccaaaaattaaaatcatataaaaatggaatgctctcgaccggtaggttccgtttttgcaaacagatcttcaatccggcacatcaatttttttcaccaagatgtatgggatatcacggtatagattgaaaccgagaggagtgtgcctgagatctcgactcaaaccgagaccgagaggtgtggtgtgttttattttccgtttttaaggggggatcggatataaagtcggactttttctttcgtttctgagagggagtcggacttttttttatttttttcgctatttattttgttttgacgggagtcgaactttcttttatttttttcactatttattttgttttgacggacgaaggaaacatctcctattttttattttttatatataaatagtctaatttaatatatatggttggaaagacaatctaagtgcttcccaattttctaccatataattcaccaacacagtcctacgtctttcatacttcattcctcaaatctaacgactgaaaatcatccatcgcatcgcatccaacgacagaacacgcacgcgggatcactggcagaaaaatcacgtacgcgatcgtcgcacgccttccttcgcacatcgctccacagc

SEQ ID NO: 17100 - DNA, 1403 bp, Oryza sativa
taaaagattggtaattttccattcgtcacaagatggacgaaggccacctttgcagctcccccgaatcccaatcgctcttagaatcggataaaaaaaataaaattcaaccactctttacccccaaaaatcaaccacaatcatcacaaaatcataaaataatcatccaagaacaacaacatacatcacatcacatccaagaacacctgccgccagatccgcctgccgttgacgccaccaccgccgcgggagggaaaagagaggcggcggatggagccgccgccgccgcggatcgaggaccaagaaagagagagtgagagtgagagagtgagaggactagaggagagcgagagagagtgggagggggactggataaggatgttgcctcggcttggctcagcacggttttttttgttgtttttttataagaaccgacactatattataggtaccggtttcttaaaaaccaacatatagtatagttgtcgctcaaaatccacatgctataaattgatggttcattaacaagcatgaaactagaggtatacaatttagagctaattaaaatccagaattaaaaaataagaaaaattaaaggtagagattagagtccatatagaaatacaatttataaataaataaattttaaaattttaaaaaatatattgaaaaaagagtctagaatccatatagaattataacttatacataactaaaattctgaattaaaaaataaagaatattgaaaaataagtttagagttcacataaaaatataattagaaataacaaaaatccagaattaaaagtaagaaatactaaaataataacatcacatagtcatggtcaccactgtcgcggaagggaaacggacggccagacgcagctgcggtcgtcaatcgaccatcgattggtctgaggttgcttgctgattcacaggtcgatcgtgttgctaagccacctcgtagatctgcctatatcttcagagtccatattgactcgcaccgtgtaaagttggaaatcaaaccggctttgtcttttttatctcctttttttgaaattattcttgaataataatttattatgagctactacatttctctctatcatttaagactttttctagcgagcaaaagtagtgtgaaaataacttcggttaaaaacaaatatttttagtttattttgctagtatcattaaaaaataatttgctatgaatctcaacgagatttgatacgataaaaaatttagtttttacacttttctacctttacatctcgaaaaaaaaaaagcctttacaggaatactcactgctgattttctagataaactttgtgcgtttcaggagaggcctgcgaagctacactggctcttctgcccaaccgtaggcgccgcggattcccgcgaaa

SEQ ID NO: 17101 - DNA, 1501 bp, Oryza sativa
gcaagataaaaaaaaattgccaactaaacaggccgttatagcttctcccaaaatttgcccggcccgtgacaaagtcctcacgtgccatgtaacattgtcacacacgtaacgaccctaaaatttgagaaagtatacacacatacgtatgtacatatatatatcggatttggttttaatcatcatttggtgtgacaagcttccacgtctcctgaagtctcgtcactttctagtctcttctcccttcatttatagctagcgtccgtcctcgaaatcgaatatatatattgctatagacaaaatctattagtttcccgcttacatttagcaggtttggataatagtatgttttgatcgctacgtaattatattagtaataccccgtgggttaatgctgaaatatagtaatggtagtaggtgtgtataagatggagcttgtgttgttagatgacgtaacttactttaattattttgcacaatgtgcaaacttcgatcagttggccaaaagattagaaataattgaaattaaatgatgtggtttatgaaaaatttaattggaccttaatttggttggttatcatagaccatatagaaaattaaaattatctgcctagagattcgtgagaggaaaaatggaaaggaaatagccagtttgtgtcataaattaaccatctaagaataaaaaaacaattaaccatctaagaattaaaaacaattaacgtggtatgtcttgtttttggtgcatgaaaagagaaactaaagcatatttattattattattagggaaaaggcatatatattatgatctctgctggttgcagaaataatttagacatttatttttcctagaaaaaacacgaatattagaaaatgatctaatatcaaataaatataatgggtgagacttcaaacccagaccggctagcccgttaccttgtggagttagccggaagatcccgggacatttctctctatttttcctagcagataaacgcaatgtatataattagatcgatcgatcgatcccttgtgaggagtgggcctgtgcgtgcagctaagctcaagctaagctagccaccagcagcagcagcagcagcctctgacaaatcccacaagcgtgatagctcagctgatcatcgatatgatatagctagctcagctcagctcatcaggcgagcatcttttgggccagatggcgacgccgtcgtcgtcctcgacagagaccatttcaatctaattctatcccctcacccccaaatcatcccaaaatcttaattatctaactaattaacaaacccccgtgctagctagccccctctcccctctatataagcccctccattgcttcgcctcccaagaagaagaagagatcatatttagctatatctctagctagctgcgtctcgtcttctccaagctattgttacttagctagctttagctaggagagtaaaagatcgagtgatcattagtgagtttgattagttgattttgttggggttga

SEQ ID NO: 17102 - DNA, 1501 bp, Oryza sativa
aagtacggggcgtcgccaccaccaccgctgatggcgcgggaggaggcgcagtggctgctggcagaggcggcggagcggcggctgttggtggaggcggcgtggcggcgacggcggatggtcacggcagaggccgggagcggccgcggtgcaacgaccagcgacgacgaggacgacggtgaccacgagcggtagcgcgacgacgacgaccacgagcggcggcggcgcaccgacggtgacgacgacgggagtggcggcggtgcgacgacggcgacgacgaggacagcgacgatcgcgagcggcagtggcggcgggaggagcggtggctgcgcgaccacggcgacgacgacgggatttcttcgattttatttttctcggtttcttttatttccgtgcgggtggtataatttgtccgcacgggataatcgattatctcatgcggtcaacttaacacaaccgcaaccgcctggatgcgaaaatattgattttcgcagacacctgggtgcagacgggcaggacctctgtacgaaaaaatgcattttgaccacacggagaaatcgattctgtagtagtgtgacattcaggaggaacggatttatggaaatagcactactagctttgctggcatttcggaaacaaagaaatgctcttatctttcagcagattcagcctaatgttaacagatggtttgactgcttcagaaatgggattatcttgcttcaggatgaatgagcaactatacaatatagtgctgttacaatttctgaaattgttctgttttcctcttcctttttcttttgtacttaatgttttctttctttaatccgtaatatttaactactgggccttaccagtaatgttcccttcaaaaaagatcatacttcaaacaaagtgaaaaattatatttattagcaaccttttgaattaggactagttgtttagtagtcaatagaaagctcaaagtacgaatctactactaattacatgattccttatttttgatccaaatcacaataacttggaatttatgaagtaatgtatctggtatatgtacgataaatttttgaaaattaataacatcaataataacctgagggagtagtatttacctaatgtatagtttctatacgtgggaccaaatataataaatttatctattatcttctcttttttgtatttattgatttgcctgccgatttgtgtcatatacacttttttggggaaagtgtcatatacactattttgatcctagtacaattttacttgtttcttttttcagtacaatcttacttgtttcttttcttggtgtactcggtgtcttggtaaaacatagtttatatttttcagacctcactaattctcttgtaaaattgtctcgtgccatgtcatttggagtttttttactacctctcgttcttaaatctaatgatggctctttggccagcctccatatccatggtacgattggtcagccattctgaaacagggcaagcaaatcacaagg

SEQ ID NO: 17103 - DNA, 1501 bp, Oryza sativa; identical to SEQ ID NO: 16985

SEQ ID NO: 17104 - DNA, 313 bp, Oryza sativa
ctgccgggctgagcgctcttcgataggaacagtgctatgtatgcatgtacgtatgcatacgtatagatagaatattattcctcacagcaaccaaaaagtcatcgtcgtcatggatcaatccaaatttataatttcaccgtacgtacgtacgtttatatcagtcgatgagacgaacgacctagctagcagccagcccttagccgccgccggatacgtacagtaattaacttttgctacgatcgatatagtatacgtacagtaattaattaagtatgcacatttacaaaaataataataataataaccacacaga

SEQ ID NO: 17105 - DNA, 1501 bp, Oryza sativa
gcggactcatgctgtggatggtgggtggagcgggagagattggggactcatgaagaggatttttttttgtgagtatgacatatgggtaccatactgattcagccaccatgtcacctaaaaatggaagcaatactgtcttagaactcaaaatgatctgattttgtaaggcaaggaaggcgttatatctttcttttttttttcttttagggatgattttgtaactcggcagtaaactgaggaacctgaggtgaacttttttccttctcccttcgggcatgatactaggccgtgatgggctgggagcctgggacgtttttactgccaaagtggacctattgggccactatcctatgatagtgggatgaaaaattggactggatttaggccgtgttcttttctaacagagatgcatgctttctattaccaagcttttctaattgctgagcgatatgttccgtgcaaaaattttctatattgaagttactctaaaatattaaataaatttaatttttaagtttataataattaaaacttaattaatcatacactaataactttcttatcatgtatggccttatttaatctttatcttcattagtacgaataggtttttacaactttgtgacatgcctttactactatgttatgggttcctagcgcttgtacgtttttcatagaaaaaatagatataatattttaggggtgactataaaaacttatcaaaatttctaatgccaaatctcgataacagtaaatcaaacatcaactacacctgcgggtaggtcttaaatatcagcaatagctattatagacacggtactacagagaacgacattattctcccgctattaaggatttggggtttagatttcattgattggtttgtttacttgaaacaaggtgcatgaaaaatcatgctattacattctacaatgatatggctcctcaacacatgtaagcataaagttgatccaaccatttagaaaacatcctcttacatacaagcgttatcataactctaacgtcctcttacatacaagcgttatcataactcttccataaatagttagtcccatcacatctaacaaataaaaccattttttaagtacataacaaaatatcaccagcaagtaactttagaactggatttttcacattttggtccttttgaaaaacttatttcgcaaatagacctctgaaaaaacttattccagaaatggtcctttttgggacgccagagtggttggcgccgtccctcttttgaaaaacttatttcacaaatagacctctgaaaaaacttattctagaaatggtcctttttgggacgccagagtggttggcgccgtcccccttttgaaaaacttatttcacaaatagacctctgaaaaaacttattccacaaatggtcctttttgggacgccagagtggctggcgccgtcctcctgccaccgtggcactcgcgaaccgacgtggcaggaagagggcgccagccatgctggc

SEQ ID NO: 17106 - DNA, 1501 bp, Oryza sativa
gggattttgtaattccaaacctttttcagaggtgagctggcctgttgaacacacagagccctgtaaaaagatttcacagaaaaggtcccatgttttgtcagagtccaactaagtttatctttagccccttcctgaaagtccaactccccaaatttcgatttgatcttgttacagtcatgtagcttatccccatataaggatcttctgaatttgatcacctcccagcctttctcttttatcttggctaaggtaatgtgtttagaaaaagtgatattatacaaggcagggtactggatgttcaggggtctgccccctaaccaactgtcttcccaaaacaaaatagatttcccatctccaagtttcttagtacacaaagagtagaacttatcttttatttccatcagcccctgccaaaaatgtgagtcaccaggtttgttttttttaattgacattggtttctttcttaagtatttgttttttaaaatatcttgccaccaaccctcctcattttcgagtttccagatccatttcccaagtagggctttgttcataaggtctaaatctaggactttggagtccacatagaaatacaattagaaataataaaaaatcagaattaaaaaaaagaaatattaaaatacaattctagagtccatataggaatatatataatttacaaataactaaaattggatattaaaaaaattaataactaacacgtatataaaatacaatatgaatattacacattagtagtttcgtaatttaaaattatgttgttattgtaatatattttaataatataatgtgaaaacatatatgctattatatgagagaaaatataatgatgctagccgcgcaatctgcgcaggccaacatgctagttatattattaaaggaatagaaaaaggagcatccacgttcgctctcatggcttagaaattctcacattaatcgaagaaaaagaaaaaacagagtctatataaaaatacaatttaaaaatagctgaaattcggaattaaaaaataaggaatattagaagaagagactagaatccatatagaaatacaatttagaaatagttgaaattcggaattaaaaacataagaaatattagaagaggagactagagtccatatagaaatacaattaggaaataactgaaattcggaattaaaaataaggaatattagaagtagagtacagagtccatatagaaatacaattaggaaataactgaaattcggaattaaaaataaggaatattagaagtagagtacagagtccatatagaaatacaattaggaaataatagaaattgggaattaaaaataaggaatattagaagtagagtatagagtccatataggaatttaaaactaaacgttcgctctcattgtcaaggttacggataaggtataccctctacccttggatatacgatgtataccagtatggtataccagcgtgtatacggatgttccctgtacacgttaacgaa

SEQ ID NO: 17107 - DNA, 1501 bp, Oryza sativa
attctaaactctacttttacttttaattttattatgtttattccgaattttagttagttttaaatttctatatggactctatactctacttctaatattccttatttttaattccgaatctctattatttcctaattgtatttctatatggactttatactctacttctaatattccctatttttaattccgaatttctattatttcctaattgtatttctatatggactctatactctacttctaatattccttatttttaattccgaatttcagttatttcctaattgtatttctatatggactatatactctacttctaatattctttatttttaattccgaatttcaactatttcctaattgtatttctatatggactctagtcttctcttctaatattccttattttttaattccgaatttcagctgtttctaaattgtactccctccgtcctataatataagggattttgaatttttgcttgtaacatttgacgactcgtcttattcaaaattttttgaaattattatttattttatttgtgacttactttattatctacagtactttaagcataacttttcattttttatatttgcaaaaaaaaatttgaataagacagtggtcaaacgttacaagtaaaaacccaaaatctcttatattgtgggacggagggagtatttctatatggactctgttttttctttttctccgattaatgtgagaatttctaggccatgagagcgaaagtagaggctcatttttctattcctttaacaatataatagattttttgaaaaaagatttaaacactgtgctgactgcaggacctaaaaatataatagagcttttacagtgtactggtctactggagtattgtattgtatataactatggtagtggtagcactttggagtagttgagatgttaaaaggcagaattgaagacgatttacgaatcacagctatagttgttaaaaaaaaaggggactatatatagtaggcaactgaggataaatatgaaccaaattaacttctttatttttttttaaaaaaaagggctcatcgtgtatttatgtgcaagtgaaaacggattttcctcactctgctctatcaatactacgagccaaaatttttaccctcttttacagaaatatatatacacacacatacaagtttcccttaccgcacggttaagtgtcgacgggtttaccattggggtgaagtaacgataagagattagtaacataaccaagtttttaaaattttaaatttttggtaaattttgttcgattgtttcactgtttgtgcagtaaccatgtgggattgtgggcctgaacagtaagagcatgcagccagtcgttgagtcatcactgtaataccgttacacacattccaggcttccagcacgatacttttcgacttcgtgtaggctaggctacttggaattttttttggcgcgaacagaatatatatataacagaataaaacatctttt

SEQ ID NO: 17108 - DNA, 1501 bp, Oryza sativa
gcttggcggttgattgtttttttgtcttttgcttctactaggacatgttctagcattgtgtccttgaattttgtgacagacgctgcaccttttgctatggtctttcggctgcttgctctcagcttgtttcgacaccggttgttctttgtctttcttcctcccctttgttattgtaaccgctcccctttgttattgaaaccgctaattatttgtagtaactcatatgcaatatcttagacagccgacagttatttcatacgcgatacatacaccaatgagcagtaaaaaaatacttgcagtaaccagtcagcagtaacatggagattcctagggaaaaagctctcttgaacaagttcacatgtaataaatcagacagtaaaatagtacaggaaatgtagtaacaaaacagttaaaatgtagtaacaaaatggtgattcctaaggcaaatgctctcttgaactagctcacatgttgtaaatcggacagtaaaatagtacaggaaaggcagtaacaaaacaattgaaatgcagtaacaagagctagcagtaacatggtgattgctagggcaaatgctctctcgaacaagctcacatgcagtaaatcagacggtaaaataatacaggaaatgcagtaacggaacagttgaaatgcagtaacaaaatctttctcttaagacaaagctcacatgcagtaaaccagacagtaacagggaggtatatagacagtaacgacacagtaaccacagatttctcctgacaaagctagcatgcagtaaaccagacagtaatatagtgatctatagacagtaacaacgagattttttttagggaaaaactcatatgtagtaaaccagacagtaacaagtagatctataaacagtaacaacgcagtaaccaaaaatttctcttgacaaaacttgcatgcagtaaaccggacagtaacatggtgatctatagacagtaacaacaagattttttagggcaaaactcacctcaagaaaaaaagaagggagtcatgagcggcgccgaaaggacgagctgagaggggtgcgtcgttagggttccccatgacggcacgacgctgtggaaggtatgagagttgttgcgagagatggaggaaaggagggaggagaaagacggaggaaaggagagggagggggacggagggaggagagggatggggaaggaggccggccggagggagcctccgtgcggcggcgcccgaggttggcgtagctgagggcagcgcgcgactccctcctctcggcggcggatgcgggagttttttttctctcttttttcgcgttccttttttttctcttttcgctattttggggtgggccggtggggtgcgggggcggatcacgggatggtgggggcggccagtcgggatggcgccttggccgggtgtagaatatatatatatatatacatatacatacatatatatatatatatatatatatacacacacatatatatatatatatatatatacatac

SEQ ID NO: 17109 - DNA, 1501 bp, Oryza sativa
gcgactacttctgttatcgggcgttcggacatatgcatatatggctgtgtgtacaatcgatcgatcgacagaagcgatcacctcggtgtggacgtctggatgtggtcacgccgcatcttggatggacgtttgtgtttctgtgtgtgtataaaggttttataccgaatgtttctatgtgtacttattttagatgtaaacaaaaatagaaaaaaaatcgaatctgacggaacgtggggctcctcaccgggagaccgcgcaggcccccctttgccggttcggccgggggcgctaagtgagattctttgccctcgatctgtggaatgttcgcgagagagagaatgcacgagacacggacgatgtagacaggttcgggccgctgagaaacgtaataccctactcctgtgttctggtggatctatatatgaaggagttacagagagctggagagcaagagagtttaggctatagaacctctcctcctctttctctcctctagagctcccctatttttgttcttttcttccttccccctttcttttttttcttttctcccttcctctttttttggtgggcaaggtcctccttttatatctcaaggggataccacatgcaccacttctacctactcttctttttggtggggacccaccctatcttgaccaaaatcacagcttgtccttgagtgaggcccagcgccgtcactcgcctgacacaggggatacccctgtcattcctccattaatgggcggagatttgcaatggccgctgtccgaatgaccctccgatgggatgggtcatacctacttccactccgccggaagcagatgcaatgtgggagcacggttgtctgccgatgacgtaaccggcgtcagaccagtcacagaccggtcattcttgtccaccacgcgtcagtttagcatgccgcacgtctgtccttcttcatacaatgacttccttgcaatggttgcgatgaagcctagaatgaatctggctgggactgacgtgccaactccaggagttcccacgccggctccggctagggacgagtgcctggaggctctcattattccgacgggacggggcgaggcgagtgaaaaggccgcctgctgccacctaacccacgatctgaccggtctgtgaccggtcatacgctgcgaccggtcacggaccggataagcgtgcgctgcgctgcattaaatgcagcgtggcgcgctcgtataacccgctataaatgcggttaggtgagcgccgctgtgctcacctaacccacacacgtggcgccaacaccacagggggtcggggcgccccagccctcggggccgaaacgggagcggcccgacccctcggggagacagagggtggggtgtccacgtcaccctcgggcccaacccccctgagggggtcaggccacgtgggtgagggcggctgcccaagcctctagtcacgatactcccggtcccatgtcaccaacagaatctaattcataggagtgatgtgacca

SEQ ID NO: 17110 - DNA, 1494 bp, Oryza sativa
  unsure (1)..(1494): unsure at all n locations
gtttttgtgaaagagaaaaaagaaaaatgtgttttaggaaaatttttgttagggagaaatatttgatttataaaagaggaataaaggtaaaaaaaaagggggggaaattgtaaaaaaatttgtttaaaaaagatttataaatggtttttttgtaggggtaaagtttgtgttaataaaaaattttttttaagggaaaaaaattaaaggaatttttttggatgaggatttgnaatttgtggggggggttaaataattggtgagtaaaagtgtaaattggggaaatttggtgtgaaaaaaaatttttaaggggggaataaaatttttttattaaagttagggatggggtaatgagaagggaggggataaaaaaatagaaataaggcatatttttattaaaaattaaanaaagaggacngtaaaanccccccccccccccccccccaacttgtgacttgttgttgcgcggctatctcgggctctcggcccccgcgcgcgcgcggcgcggaggcgaggtgcgtccgtgcgaatgattgcatctgcgcgagcgacgccgtttggatcttgttgccatctcggtttttctttttttcttttgctgtctcgtgcggtgcgtggtggtgaaccctccggggtttgggtctttttttgcttcggttggtcttgcctctcgcttagcctttttgttgccttgtgctcggactcttaggcgagagggggcaagcagggggaatcttttcttttcccctgcgagcgtcgctgcggttgcggtggctgggctggctcgatagctcgctatctcacacttcgtcgccggctgcttccgctctgaatcgccggctggctcgctgcttcgcctgggagagttcaaccggctgggctggctgggctggtgggtactgggtttcactgatgaaaaggtccttttccgcatcagggagtcacgtttcgtgagctggaggggagcactgtgatctcccccaccaactcggctgtttttggcgctacattacacgtctttgccttctcctttttcagctaagcttcttgaggccttttcagttcggtttccatctctgttcggtcccatgtttctcggcagcagcccctctctgtaaaaaggtttcttccctgcttcaccatcgaaaaaagacccttttttcacccaagctttcttgcttccatgcttttttcttgtccactctgctatctggactctggagtatctcatttcaaatcgtggcgtctctgttttattgagctatagcggtatactatagccttctttcccctgttcgcctacagtttttcaactttcaacaactcccgagttgatctttgcgtctcctattagttccattgtttcagcactggagtaatagttctagctgctgttcttgaatccttttatccacgctctctacacattttttttgacgcctctgttcgtggcattcgtcgtgctgcagataggttgattcaccatgggccgcgcga

SEQ ID NO: 17111 - DNA, 1501 bp, Oryza sativa
aatgacatgtggttcaggatggtatatcttaaattttgcaaaattataatggcatggttccaatttttccttgtaattattactagtggacgatgaggtggcatgttatcgcgctacatccatgaattttttcagtttttttcgattttttccggaattttgaatttggtcaaaattcatccaaatcatatcgccggtttcccctaccgtacccccgcgataagcgtgataagtgatgcgattatcacacgataagtgaaaccctggtccaactctaaaatattttatattttttattagatgtttctattaggtgatttattttttgaccaatgtagattataaattagtgtaaaattataatgtcattatagctcctaatagtcgttgtaccgctggaaaacgtctttttctagtatagacaaaaaatattttttacatgagttcttaggggaaaaggaacttacgttaaaatggtaaaaagcttagaaaaattgatgttttctgcatgctttttttccctaaacactaaaggaagcagggagtgtacattgcgaagaagttggattcttttgtctattatatcaatcaaattattattagtactgacggagcgtggggctcctcaccgggagaccgcgcaggcccccctttgccggttcggccgggggcgctaagtgaggttctaagccctcggtctgtggaatattcgcgagagaggcaatgcacgagacacgggcgatgtagacaggttcgggccgctgagaagcgtaataccctactcctgtgttctggtggatctgtgtatgaagaaactacaaagagttcgagagctagaacaagtttagactctagaactcgtttgctcctcctttccccttttttcttctccgtccctctctttggtgggcaaggtcctccttttataactcaaggggataccacatgctccacttctacctactcttcttttgggtggggacccaccctctcttgaccaaaaccccgttcgccttctcttggaagctaaaatatagcttgtctttgagtgtggcccagcgtcctcactcgtctgacataggggatcaccctgtcattccttcattaatgggcggagatttgcaatggctgctatccgaatgaccctccgatgggatgggtcatacctacctccactccgctggaaggaggtgcaaaatgggtgcgcggttgtctgcctatgacatgaccagcgtcagaccagtcacagaccggtcattcttgtccaccacgtgtcagtttagcaagctgcatgtctgcccttcttcatacaacgacttccttgcaatggttgcgatgaagcctggaatatatctgggcgggactaacgtgccaactccaggagctagcacgccggctccggctagggacgagtgcctggaggctctcatcaatccgacgggacggggcgaggcgtgtgtcaggccgcctgttgccacctaacccgcgatctgaccggtct

SEQ ID NO: 17112 - DNA, 1501 bp, Oryza sativa
tttctcgtaacatcggagctattcgtcattagcacattccattttatgacgattaattagtatgagatggggaggcttagtgacgaaaaattttgctttaaaaatcatggctggaaatatatttgtaatattctacgtggtctaaattattctctgaaatttttttgtgaattttcggagctcaataactaattttcataccacaaagttcattttaacctattataataaatggaaaacaaattaaaattcctctctatgtacttgggccattttcggcccaagtattactctcaccctccctcagcctgcagcccctctctctcttcctccctcttcaggccaccggcccagtccttttgctcctcccttgcaaggaagtctattttcctccctcctctcaattcaaataatttttcggtagtaaatgatttcaattgaaaaaattgtcaacaaaaaagttgtataacttattaagatctacaacttttgttttggtcattttgctatatgactttggttcaataatttgaatttgaatttcaaattatgataacttcaaacaacattttcaaatactaaataatttcaactgaaaaagtcatcaacaacaaagttgtataagtcatcaatatctacaacttttgttttggtcattttgctatatggctttgtttcaataatttgaatttgaatttcaaattatgacaacttcaaacaacatttttgaaatactaaatgatttcaactgaaaaaatcatcaacaacaaagttgtataaatcatcaatatctataacttttattttggtcatttcttcatccgataaagtgatggtaacattgttcacaaaatttacacatctcttatatagtttataaactataagagagatatataaattttgtgaacaatgttactatcactttatcggatgaagaaaaaaccaaaataaaagttatagatattgatgttataactttgtttttgatgacttttttatttgaagtcgttcactaataaaaaattatatttgaagttctcaaactttgaatttttcaaatttcaaattattcaaatagagtcagatggagaaatgaccaaaataaaaattttgcatctcgataagttctacaactttggttttggtgacttttccatttaaaattatttattaaacccaatttttgtttgaagttgttaaattttgaaaatttaaaatttgaattgttcaaatgaacttatttgtaaaaaggaccaatacaatagttgtagatctcgatgagttctacaattttgttgtttatgatttttgcatttgaaacataaaaatcagtctaaaattaaatttaaagttctcataaattaaaattaaaaagtacaagatattatttgtatttttttttgaaaaaaaagttaatgctggagaggcgccaaaattttggtgtggctggaaccaaatttttaggcgccaatcttggcggtcatgccaaaaataaaat

SEQ ID NO: 17113 - DNA, 315 bp, Oryza sativa
cgcaaccattgcaaggaagtcgttgtatgaagaagggcagacatgcagcttgctaaactgacacgtggtggacaacaatgaccggtctgtgactggtctgacgctggtcatgtcataggcagacaaccgcgcacccattttgcacctccttccagcggagtggaggtaggtatgacccatcccatcggagggtcattcggatagcagccattgcaaatctccgcccattaatgaaggaatgacagggtgatcccctatgtcagacgagtgaggacgctgggccacactcaaagacaagctatattttagcttcca

SEQ ID NO: 17114 - DNA, 1501 bp, Oryza sativa
atatatatttttttgaggtgcaacataatcaaagattcaaagtggccatcttttatgcttttgtaggattttattagtttattgtcaggttattctctaggaatatttgtttataaaggatatagaacaagaatagattaataaaagggattttagattagtagtacgcaatgctagaaagtcttataacctgaaacaaaggtagtacttgtcgatgacatggggccgagggtatcatgactagaggtttgggtagccgcggtcacccttgggtcgggcctgagggtgacgagacctccccgccttttatctccccgaggggtcgggccgctcccgtttcggccccgagggcaggggcgccccgaccccctgtggttttgacgccacgtgtatggtttaggtgagcacagcagggctcacctaaccgcatttattgcggtttggacgagcgcgccacgccgcatttaatgcagcgcagcgctcatccggtccgtgaccggtcgcagtgtgtgaccggtcacagaccggtcagatcgcgggttaggtggcaacaggcggcctgacacacgcctcgccccgtcccgtcggattgatgagagcctccaggcactcgtccctagccggagccggcgtgctacctcctggagttggcacgtcagtcccgcccagatatattccaggcttcatcgcaaccattgcaaggaagtcgttgtatgaagaagggcagacatgcagcttgctaaactgacacgtggtggacaacaatgaccggtctgtgactggtctgacgctggtcatgtcataggcagacaaccgcgcacccattttgcacctccttccagcggagtggaggtaggtatgacccatcccatcggagggtcattcggatagcagccattgcaaatctccgcccattaatgaaggaatgacagggtgatcccctatgtcagacgagtgaggacgctgggccacactcaaagacaagctatattttagcttccaagagaaggcgaacggggttttggtcaagagagggtgggtccccacccaaaagaagagtaggtagaagtggagcatgtggtatccccttgagttataaaaggaggaccttgcccaccaaagagagggacggagaagaaaaaaggggaaaggaggagcaaacgagttctagagtctaaacttgttctagctctcgaactctttgtagtttcttcatacacagatccaccagaacacaggagtagggtattacgcttctcagcggcccgaacctgtctacatcgcccatgtctcgtgcattgcctctctcgcgaatattccacagaccgagggcttagaacctcacttagcgccccccgccgaaccggcaaaggggggcctgcgcggtctctcggtgaggagccccacgctccgtcatctggcgcgccatgtagggggcgcgtgtgtttttctaagctctcatcctctttcgtgtgcgccaagcttctcccgttcaacccaa

SEQ ID NO: 17115 - DNA, 1501 bp, Oryza sativa
gggagagggagaggatagaagaaagagagagagaggagaggagagaaagagagaggggagagtaaaataatagaggggtagagagaggaaatgagttagaaaaaaattgaagtggtgagagggaaaagagagtggagggatatgaaaaaaataggggtggcatttttgcatacgggtatcttaagtggtccgcaattttacatgcggacaacttaagcgttcgcatgcaaaaatcatgcggctttctaaacttcgaatcgaattttataatactaaatgaactcatgtgaaaaaattgtcaaaaataaagctgcaaaactcattgagatctgccaatttgcttttggtcatttctccatccgaatttgattgcactatataaaatttgaattttaaaatataagaaattcaaataatttttcagctagtaaatgatttcaaacggaaaaattgtcaacaataaagttgtataaagcatcaagatctacaacttttgttttggtcatttttctatatgactttgtttcaataatttgaatttgaattttaaattatgacaacttcaaataatatttcaaatactaaataatttcaactgaaaaagtcatcaacaacaaaaacaacaaagttgtataagtcatcaagacctataacttttattttagtcatttcttcatccgacaaagttataataatattgttcaccaatttaacatatatctcatatggttttataaattataagagagatatgtaaattttttgaacaatgttactatcactttgtcggatgaagaaatggctaaaattaaaattttatatcttgatgagttctacaacttttatgttcatgactttttcagctgaaattatctactacttcaaaatattatttgaagttgtcatctttttaaattcaaaattttaattgataaaacaaagtcacaagaaaaaatggccaaaataatagcattaagaacacaataacatgatagagcatgattttaaaaatatttaggaaaaaaccatccaatttggagttcatatgagtaagataaactagtttcaaaatttcaaattttattttcgcatattttcaaattttattttcgtatatggccccttcaggaaaatcgatttttccatatgggcgtcttaaggagccatatgcgaaaatgccgctcgatttttccagacacggtaagttatggtccgtttgcaaatatcgtgagatctcgtacacaaaaatcgtttgtggactagtgtatagagctgttttaaagcgtcagaacacacgaatttgtactccgtaactcattaagtcataggttaaaaaacactcatttgtagtgttacaaagtactccctttgccctataaaaatccaatcatgtatatgtctatatttaaacgcaggattgggtttttacggaacaagggagtacgttgtaactatattctttacaaatgaaaaaaaataatgcaaaaccatatatgtagcg

SEQ ID NO: 17116 - DNA, 1501 bp, Oryza sativa
tgggtctctaaactttaggtgtataaactttagatgtgtaaacttgaggtgtataaattttagatgtataaatttactaaaaatagcaaagtaatacggtaccaaaaaagaaaaccacgttgaggaggagggggtgtcgccctgatcgcccttagcgatcaatcgcccattagcttttccatgttcgatatgcattcgagagtatcccgatacgcatttgtgtttgatacgatatctgatatggatatgcttgtttttagaagtatcgttttctctttttttctgtaataacaaattaaaatggttgtaaatttgtaattgctcttttattttttgaaaggcagcatccaatattggacatgactacacagcgctactacttcatctatgagaaatcctatccacctatacttcaaataaaaatttctcttaaactactcatccgatctacgatccgattacaccgtcgtgttcgtaattaaatctttgtagaaagatctcacatgattatattctgatgaaaaattgtaaattacatttataatatatcaaaattacttttagatttcactaaatcacttcttagatatatttttttagataatggaataaatatcccggcctttactcaaaagagctacagccaattattacatagacatataaaagtaaatttaataaagcctaaaagtaatttatatatattatagaagtaacttataataaaaagaaagtaactttaatatatgctttttttttcataggacgtgactacacaactagtggcagccgctccatctaatgtcttcttttaacttgaaaaatacaatagtgtgagtcttttttaacttcttcagattcgtgtactctagttgatgcctggactatgcacagatagccgggattcgggttgtcgaatctctgggcgtgacaagttggtatcagagccgatcttgaccgtaggacaaaccaaacggaaagcccatagagccctatgaaattctcttattcccctggaaatctcttcttccctccttttcaagtggtccagtgagtccaaataaatgagtttgttttcaagtttctgaatttcatcaaaaaaatatttttctttgtgccttttgattttttttaaaaaaaatgttttcggcatttcaaaaagaaaaataatattttcggaaaaaaattcttggcaaaaaaaaggaaaaggttttggcagaaaaaaagggaagggtttcggtttaaaaagaaagggagagtttcgtttttaaaaaaaaaattgggccaaaaatagtattttttaaaaaaatatttatattgcttcagtatttttgatttcagtttagtgccttttctttctttttgtttccagttttaatgccagcatctcgtttctgatcggagtcagttttgttccttctatcttttctttagatggccgattctccctgtactcaccatggtgaaggcatggaaggatttgttgcggagcttgcaaata

SEQ ID NO: 17117 - DNA, 1501 bp, Oryza sativa; identical to SEQ ID NO: 17116

SEQ ID NO: 17118 - DNA, 1501 bp, Oryza sativa
ttataaactgggattcaatatgttcaaggatgatgtgacttgccttgctcagagataacggccttccgaaccttcggcgacgaccgcaaaccacgcttcgggaaccttcagaacgacgaacactacgcgaagcacacacgcaaagctacaagcctataaagaagcaataacaatatataaaaagaaagcacagggttctttaggttataacaaacattaggagacttgaacggatcgattcggagctcgtatgaccaagacatggtcatccgaagtttaatgctgttatatggagatttgcggattattataattaggtttttcaactataaaatatgtgcaagcgctagcctggagaagacaggaaggctgcgctgttgacatgcggaccccacatgtcaacctaagggaccacggcagagcgggtacacagagacggtccacgggtcgacagaagcggatcccgtgtgtcaaccgaggcgagtggccaacaaacggactccactagacaccacacgggctgcacacgtggaaaccacgcggctaccgagcgggcacactaacacagtcaccacacgcacaagcgaacgactaccgacaccggtacacgggtaccggggtcgacaaccgcacaacgggcacggatgacaccgaaaggacgaggacggggcagcgaagaagagatccttaccaccacgtgacgaggcgagggaacgacaacgacgaacgggtgcggcggagacggccgggaatgacggagacgaaagcgaggggacgacttcagcagcgatccttggatgaaggcgagacatggccggcacgaggcttgacgacgcggagccgaggacgaagacgacgacggggctgcagcggctcgcttgatgaacgtggatgacgaacgcgatcggcttgacggagagatgagcgacacaacgagcgaaaccgggaacgacgagaggacgacgatgacgacgatcggggccggcgaggaggcgacaagggcagccgtcagcggctgcacggagacgaggatggcgtggaacacgctgctgcgatgctgatgacggaggcggcgccgcgagatgacaagccagcgaggaggaacgatgacgacgatgacgaacaccggcggggttcggtcgaaggggaggcgaggccgagggcgaccttgccgctgtgatgccggaggtggagatggtgacgtcggccggcgcacgggcacggcggaagaggctgccgaaggcgacgtcgacgaggaggaaggagaggtcggcgcgggcgacggcgttccggcgaaattcgggcgacgccgtggcctggccagggaagaggatggcgccgcggtgccggggaaggaggcgacgacgacagccaccgcacctgcgaggcggcacaagcggctgaagccggtggagtggtggcaacaccactaaacgtcgacgaggacaccgttccggcgagcttcggtagaggggacggtgaggccggtgaaggggatggc

SEQ ID NO: 17119 - DNA, 1501 bp, Oryza sativa
cactcctgggcgaagattactgagtgtgggactaggtaactctgttacggagtgtttttcatgcattggcaagtgtttttgacactcgggagtctccccgtctccagtatataactcctatgtattgaatagtatagggagaaaggatattgtttttattggacacgttgagcttcaggggggcggtatatattggagtacatggcgaggagataagaaaggattacagaaatggaaggagtccatacaaataaattctatcctaatatgactctaactgccatatactctaacataccctcgccgtccaagcgtgagcaatgcaaacactttgactggagaagaaaccgacaagagtgcttaatacggatgatagctcgttgtgccatagtcgatgtagatgaagcgaagggtgcgagggatccatggtcaatgaagccatgcatagagtagtcatggtcaatgtagccaaagtcggggagccaatgatgtcgaggttgcctagccgcagggcgcgcatggggcgccgtagagtatgtggtcatgggcgagaagcctagaacgcagtactgaagatgatgacggtgatgcgttcgtggaagtcattgaggaagatgacgccgaagagttgatgttgtcgaaccgtataggacgagacgtcatgccgggtttgctagacccggggacaactcgggacgaatgcacgctacgatgttgccaataccacgcgggcgagataggagactaccatgaatcatacaccaatgtcggaggagactagtagagaagacctccatgacggttgcggcgcgagaacgacgtggagggggggattgtcagagcaacacacgattgccagagaagagcgaagtgtagtcgagaaagatacggtgacattggcaatgaggcaagttggacaaagacaaaggcgaagtagtgggaccaacgacttgaaacggtgatgtcggtagccatgaagacgtagctagaccactggcctagagcggtgacggtggcaacttaaaaatgcagcgatgatgctcgaagcagtcgaagaagatcccgatggctgaagatgaccagtgcggacgatgagggtgtcgatacacgggcggtgaggaagacgacgaaagcagcaaggctgtggtccgaagggacgacacagatgagcttcatgtcaatgcagcggtgtaaactccaccagcggtgaggccgcgctgaggaaggcgtctctcagcgttccaacaaccagtggaggtggaccacgggtgtaggatcaaggaggccgactagaggggggtgaataggcggttttaaaactttttgctaaaaccgagttttgtatgcggaagcgtaaatcagaacggttttgcacaattcaaaacctaaatcaactagtctcaagtaagtgcacaaagaaactagcatatgttaaggtttgcaagcctagggtgataatagcacaaataagctctagtatgtaaacttgctcaaatgtaaa

SEQ ID NO: 17120 - DNA, 1501 bp, Oryza sativa
tcacaggcttctgacttgctaagtccactgaaatcccaggccatcaccaaatacagggccgggattttggcccattccgaacgacgcatcgagggaacgggccgaatgcgtgtcagtgtgtttctgtgccatatgcaagcggaccaactgccggtcgactccaacgccagccgtctgcttcgtcctcacatccaagtccggtgagcggtggcgagcctgggacccggcgagacaacccagctaccccgaccgacttggaaagggagaacgcaaccgtcccccgcattcccctcctcttcagaatcagcagcgaatcactctcctctctcgtagtccctgtcaatccgacgccgtgcatgcagttaaatcttccaagccacacgaatccgcagttttgtcacaggtgagacgtgcctgtgaactggcacggtggcaactcacctctccctacctttctctggtaccaaacctttccaaggaagaaaccaagctgcatgctgctgcggtaggaccaccggtgttaggacacactggagttgtcaatcgtctttacagccaaaccaccacgcatttttcgttctgtacagcataaaatatgaatgacttgtctgtgctgagattctttcttctatcatgcctagcgcatgctcacgagtcaagccatgcgcagaagaaaggtttaaccaaagttttaagggtaatttggaaacatgtcattataactttgcaaagtttaagatatgtcattggtatctcaatgacatgtaggacctacatgagtcaatgacatgtgagttagaatgacatatctcaaattttataaaattataatggcatggttccaattttcccaaattttttaaaccgtagcttaattgggcctttttgacaatgttggaccagccaacctaaacactttcatggaactgcctggtaaccaaaccagctgctacactaccgcttttgataggagcagcagccggcctgaattgactctagcttattgccttcgaattaggcttgaaaaatactactacttagtactctgttacagtctaaaatatgagattccaccaattaatcaacaatccaacaaaccaatcatctggacacgctgtctcaggcggccattggaattttaaattcgagaagtgattcattttctaatttaaatccgagtatttaaaaagtttcatctctcctcgatttaaaagaaatcctttttatagcttctgctcgtcaggctttagaaggtgtgatgaaaagtgccaacgcgccttcacatttggcaatatcggaaaaacgaagccttcctatttatttgccgttccgtgcaccgagcaatctcgcggacgcgtagccggaaatcgaatcaggccgcagggctgagagaaaaaaataatcagaagcaaaggggggagagagagagaaaaaaaaaagtcgaggaggcggcagcaggcggcggcgagcgagcgagcggaggaggaggaggagcagagaa

SEQ ID NO: 17121 - DNA, 1501 bp, Oryza sativa
caatgtaagtcattctagcatttcccacattcatattgatgctaatgaatctaaataggtatatatgtctagattcattagcatcaatataaatatgaaaaatactagattgacttacactgtaaacggaggaagtaaaatttagtccctgatccaaacaggccctgaaaccaatcgagagggggtgccggtacgtgaatactactcatgcattagtaattgctatgaatggtctcttttgatgcataattaattgaatatatatatacaacctagtgctacctccgtgtattgatccaggggcgggcaccgggtgagtcgatgacatccataaaccagtagaagaggttacctcccagcccagcgcatccagcgtagtacaaggtgccaagcttgaacaactcagagcggctaagcgatactctctcatagtcattctccatgatatcccgttgaacgtagcctgttgcgatcatgacaccaatccaacccaactcaaaaatcactctagcaaacggatccgaatctcgatccccagctcgaggcataattaattaattaattaatatcctccgaaatcttaatcttaatcttaatttcctcgctctagatcttctcttgttgaagaggccgatcaatcgattcgagaacacctcacctggctgcatatatatacacatagatcgatttgcctatgttaggtgcatatatattagtataaagaataacactgaagggaatataaaagctgcatgcatgtatgtatgcgttctaatggcaaaatctcgtttaattaatctgccaatcatatttgggggaaaaaaagagcaaagaaacaaacatagatgtgatgtaaaaccaatcgatgatttgctgtacctacggcgagcgagcgatcgatcgatcgaacaaaccaataaattattgggagctgggagaggaaattgcggcgcggcgaggcgagatgagatggactccgtccgccgcccgcgcaagcgatagatgcagcttctattctagctagggtgtcaaaacgcaagcgtatactttgagatttatttatacagagaatcgacttttgctgggtcgtatctgatcagaatttcgcaaaaaccgaccggttttcacaagcttgattattggtaattaaactcatgatatttatattcaaatattagtttatgaaattttttcgaaatctaccaaatttgaatacaaatatattccgactggtagatttaaatacaaatttggaatatatttgtatacaaatatacaaatacagatatattctgactgagattcaaatacaaatttatttgtattcagaatatattccgactagtagatgtttgaattcgaatttgatagattccgaataaatttcataaaccaaaatttaaatataaatgtcctgagtttacagataaactcgcgaaaaccggtcagctccagcgaaattccggcccgatacggcccagcaaaagtcgattcgccctgt

SEQ ID NO: 17122 - DNA, 1501 bp, Oryza sativa
caccgcgcctggccgcccctaaccccgcgccgccgtcgccgtcgtttccgtcgcgtcgccgcgccgccgtccatcgccttgcgccgcgcaccgccgctaccgccgtgccgttgcgcgtcgctcgccgccatcccgtcgcgccgtcccatcgcgccgcgcgccgtcacgtcgccactgccgagccgtcgccgtcgtcgcctcgcgccccgtgccgcgccgctcccccgagccccgtgccgccgctactaccgcgccgcgccgcccgttccatcgtcgcgcgccgtcgccgttcggccgtcgcgtcgccgctgccgcgccatcgccatcgcacgtcgcatcacctgccgcgccgcgcccccgagccccgtgccgccgctgctgccgcgccgctgccgctcctcgcgccccgcgccctgccgcgccgcgtcgtcgtcacatcgccgcgtcgagccccgcgccgcgccaccccgacgacgccatgaggccgccgcccctctcccctcttccccattatctctctcccccctcccttatataagcccccctactcccactcttccccttcatcctcacctcctctcctgtacccacgccaccacgccgccgcgccgtcgcatagagccgccgcgccgccgccacgaagccgccgcgccgcgctgcaccttgcgccgacgtcaccaccgtcgccgtcgccgccgtcgccgccaccgccgtcggtaagccgctgcctccaccacttgctcggccgccgtcgccgccccgggtagcagagagccgagagagagagagagagagagagggagaaaccgagggagagaaagaagaaggaaggatgagagaaaccgggagggagagggagaaggaaaaagaaaagaaaagggagagagagaaggaaaaagaaaagaaaagagagagagagaaagaaaagaaaaagaaaaagaaaggaaggaaaaagaaaaagaagggaagaaaaagaaaagggaaatagataggaaattagagggagattagggaagtttagaaaatttaaaataattagcatttagttatagactagttatagacgtagaattgcgaaatttaatataaattatggattattcttggtaatttctacaagaaatcaattcgcggtagtagtttaaatgtaattaagaactaaacgattagatgaattcttatagactattatagattattttgggtaatctctataagtaattgatttacggtagaaattcggatttaatcactaggaattttagacgtatattatatttagtcgtttagtcctagactaaaatttaattgtataatattataagataattttaggattccgtccgatatttagcttgcgatagaaatttccaacctattatatggatataatgctcgggtagattaaattaaaaacttatgataacaaaatatttatacccgcaaaatagtttaggatataaaaatcgaaattgggtttgccctagttcgcgaatagtaa

SEQ ID NO: 17123 - DNA, 1501 bp, Oryza sativa
atcgattccaaatacaaaactcagaattattttcatgcaagggaatgctgctataatctcaatagtccacaggccaacccacagggtatcaatggcccatcacccatgggtgggcagggcctgggagttggacacttgggcttcatctcgaatatatgtgatggaattttgattcttcgccctacaaaatagttaatactctgatgctttaacagtgtgaaaaaaatactacctccatattttaatatatgacgccgttgactttttatctaacgtttcactatttgtattattcaaaaaaattatataattatcatttattttattgtaacttgattcatcatcaaatgttctttaagcatgacataaatattttcatatttgcacaaaagatttgaataaaaggaatgatcaaactttgattaaaaagtcaacggtgtcatacattaaagcgtaatttggaaccatgccattataattttacaaagtttgagatatgccatcggtatcttaatgacatgtagtacccacatgagtcaatgacatgtgggtcagaatgacatatctcaaattttacaaaattataatggcatggttccaattttccctacattaaaatacggagggagtagtatattttgttgccactatcaattatatttgacatggctacatgagtttaattataacttttgacatgactgtcatgataattcatacaatcacaaccaaaaataatcatgacatattaaactattaacacaacttatctattatcatctggttatgtctaaaattcatatataactagttatctggatttctactttctaataggagttttgctagaaagaaatccaaaatctggccggccattaattcatcacaatggaattgtaaataaaaaagttatgaaattatagatgcagaattgccgaccacagacaagtttgtttttagaactaatatactccctccgtccctaaatagattttggttggatgtgatgcattctagtacaacgaatctagacatttgttgtactaatatgtgtcacattcaaccaaaatcattttttatttagggacggagggagtatataagccgtatataaacacctctccctcgtgttccgcgcacaccatttttaaataactaaatggtgcgtttttttaaaaaagtttctatatgaaagtttcttaaaaaatcaaattagttcatttttttttaaaatagctaatacttaattaatcacgcactaatataccgctccatttttcgtgcgaactgtttgtttccggttggaaactagagatgctgaacgcagcctaatccagtttgacatggatactatacaaaacacacacccacttacaagtggagcccacaaaaagtagcaaatccactgctgtacactgtactgcacctgcagtatgtgtcactggcatgtgggttccacctattccgggcccacatgtcagtggcacttactgcacataca

SEQ ID NO: 17124 - DNA, 1501 bp, Oryza sativa
tgacgtaacaaaataccggtaaaaacatcttcaatttttataatagtatagatttcagttgtttcaaaattgtattcctacttgaactctcttttaatttttctaattttggatattattttattttatattctgaattttaattaatcacgtattgggttcttatatggattcttctttcaatattgtttattttcaatttcgaatttcagctaattttaaattgtactcctatttgaactcttcttttgtttttgctaatttcggattttatttttatttttattcccaattttaattaatctcgtattgtgttcttatatggactcttgttttaatattccctatttttaattccgaatttcagctattttaaaattatattcctacttggactatccttttcttttttaattttggattttattttatttttatttcgaattttgattaatatcgtattgggttcttacattgaaacttatttcaatattgcttatttttaattccgaatttcagctatttttaaattgtatttctacttggactcttcttttcttttctaattttagattttattttatttttatttcaaattttaattaatctcgtattaggttcttatatagaaacttctttcaatattgcttatttttaattccgaatttcagctatttttagatagctattcttagattgtacttctacttggactctcattttctttttttttctttttttccgattaatgtgggaatttctagcctccacaaagaatgtgatgcctagctgttttaataatataatagataaaagatagaatgatttgtaatcttgaattggccaaccgaaaatgctagcacaacatgagaagtggatcgtctctattggtaatgaatgaagggacgaataaacaagccgggactcctcctcctcctccagcattgggaaaagcggcaagcaacggccaataaagaaacgcaacgttgcctgcaactgcacaggaaaggcaccaagtttccctattattatttctcccagcctggaccaacacccacacgcgcacacgggcgaaaccccaaccaagctcctcctcagctcagcttctcctgtgctctgccctcctcttctcgcaggagtgagagaagccgaggaggaggaggaggaggcttttgtttggttgagacgccacaaactccaccaagggccaatcaacgaacgcctcgatttcttttaagcggcgtctcaaggtggaggccgaatcatctgtggccactttggcatctgccggaatcgatgctgtagcatccataaataccgcccttctctgccgccccccatctcccctccccctcttcttccacctcccaagagctcgcttttgagaaagaaaggtgaaaaatcttggtcggttggcccggccagccagccagccgcctcgcggtcgcggagatgatgaaggagtcgtacatggaggtgctcccgccggcgccggcgcact

SEQ ID NO: 17125 - DNA, 1501 bp, Oryza sativa
gagtccatggccacgctgtcatcatctccctgcgtgtctacgctacattgtagtcgccatggttatattgtggtgcccccctctctatttaagagagttgccgggttacagagtccgactctaactccaccccctaacaccttgtcggtgacatggggccgagggtatcgtgactagaggcttgggtagccgcggtcacccacgtgccctgacccccacgggggggggtcgggcccgagggtgacgtggccacccctccctctgtctccccgaggggtcgggccgctcccgcttcggccccgagggctggggcgccccgaccccctgtggttttggcaccacgtgtgtgggttaggtgagcacagcggcgctcacctaaccgcacttatagcggattgacgagcgcgtcacgccgcatttaatgcggcgcagtgcgcgcttatccggtccgtgaccagtcgcagtgtgtgaccggtcacagaccggtcagatcgcgggttaggtggcaacaggcggcctgtcacacgcctcgccccgtcacgtcgaaatgatgatagcctctaggcactcgtccctagccggagccggcgtgctagctcctggagtgggtatgtcagtcccggccagattcataccaggcttcatcgcaaccattacaaggaagtcattgtatgaagaagggcagacgtgtggcatgctaaactgacacgtggtagacaagaatgactggtttgtgactggtctgacgccggtcacgtcatcggcagacaaccgtgctcccacattgcatctgcttccggcggagtggaggtaggtatgacccatcccatcggagggtcattcggacagcggccattgcaaatctccacccattaatgaaggaatgacagggctatcccctgtgtcaggcgagtgacggcgcaaggcctcactcaaggacaagctgtgatttagcttccaggcgaaggcgcgagccaagttttggtcaagatagggtgggttcccatccaaaagaagagtaggtaaaaatggtgcatgtggtatccccttgagatataaaaggaggaccttgcccaccgaagcaaggggacgagaaaaaaaagggagagactctcagacgactctgagaatacctgagctcgtagaggagagaaagaagaagagtggttctagagcctgaactctcttgctctccggctctctgtaactctttcacacacagatccaccagaacacaggagtagggtattacgcttctcagcggcccgaacctatctacatcgcccgtgtcttgtgcatttgctctctcacgaacattccacagatcgagggtgaagaacctcacttagcgcccccggccgaaccggcaaaggggggcatgcgcggtctcccggtgaggagccccacgctccgtcatctggcgcgccaggtagggggcgcgtgtgtctttctaagccctcgtcctctttcgtgtgcgccaagcttccctcgctcagcccaa

SEQ ID NO: 17126 - DNA, 1501 bp, Oryza sativa
atattatattagctatagataatttgcagctattaattggctatactattaaacttgtcgtaagtgtcaatgtgtcatactgtcatgtcagtactgaatcactgctagtagtacactttataatagtgtgtcattgacgaagtttgtttgttttttttttacaaaaggtcaacgttcttatcggcggggttacaaggaaggacaacgtgttaatcatccattagcagctggtctttgcatcgtgtgatgaccatcatttctcattgaacgagtgaccaactcgatgattctgtcagtcccagtgagcgtgattgttttggttgcatatcgatcgccccgaccctaccgaaacacatggaaaatatcaagcggctcgacattttttcgttgaaatcaaaaaagagaacttgtgcaactgtttaactttaattgcactaaaacacttttgaagtcccaaaatattgatatctatgtgacatatcctaacactctaaatttaaatacaatgtgttcatctatcactagatgataatattttaatagagatatagtattagacaacatagaagaaacaagtgtcattttaacgtggcattcgaaaccaacttacatcggctatgaaattttattaggaaaattggaaccatgccattataattttgtaaaatttgagatatgtcatcctgacccacatgtcattgactcatgtgggttctagatgtcattgagataccgatgacatatctcaaactttgcaaatttataatggcatggttccaatttacccaatttttatttctacgtcaacaaagagacaaagcacaaaacaattgtaaagggaagcttaaagcgggcgcaagatctgaaaaatgactatagcaaaggtttactatgttcgttggtctcacaaatgacaaacacgaaaaaaacgttgcgtcagctcatacgtctgccgtggccacagctctccagatccgttgaaccttagcatgtgctactttattacgcagagaaactaatccacatcaacacaccatcactcgcacaaaacacactaataaatgaattcacacaatcctaagcatcatattttatcaatccgtttaaaaaccattgaaaacgtaacagcgatacacatagattctcaacaagatgaacacacaggtgccactctttttccccattgtgagccaacagctataacggtttactacatgggacaccatttctttcccaatcattcgtgcttggtcacagtcacccgatgattttgtccggtctccgcgtccgggcccacctgacaggcgtgcccgaccctcggatcagatcggacggcccagatcgatctgccccgccattttcataaacgccaccgcccgcacgaatcggaagactcgagaggggcggtccatccacgtgaggaggacacagttgcaaatttccaaatccaaaccctcgtcggcgtcgtcaccgtggcggcgacggcggcggcggcggcgat

SEQ ID NO: 17127 - DNA, 1501 bp, Oryza sativa; identical to SEQ ID NO: 17126

SEQ ID NO: 17128 - DNA, 1501 bp, Oryza sativa
acttggaagataacagcagggatgaacttgggtctcctcagctttggtccaactggcccagtccggtttggattacacccagtcttgcaaaattgaatttgatattggatatgtagctgttttttttttaaatattgttatagatattcctgcttttaccattttttgtgtgtatcttatatgcaagtctaatgccaatttgagaacgcgtgaatggcagcacggtggtaacccacctagttgtggggttgctgaccagggttcagtctctgggtctcaccaaaaaaaaggtccttgatgagataactgctttcagagttatatgcgaaaagcgtccttggcagccagcgtttgggtctttctcgatctaagttcaaagatttgtgggatgtctctccccaatagttgagtttaaagtcaaatgcaaaagatactttttcttggaactaatgtaaatggtatatttcctaggtattattgagtgcatttctagtgataaaaacgtttcttgtttttgataagtttgagtaacaccgctgatgtaatggaccaaatgctagtatctattatattattaaaggaatagaaaaaggagcctccacgttcgctctcatggcctagaaattctcacattaatcagagaaaaagaaaaagcagagtccatatagaaatacaatttagaaataactgaaattcgaaatttaaaaataagaaatattagatgaggagactagagtccatatagaaatacaatttagaaatagttgaaattcggaattaaaaaataaggaatattagaagtagagtatagactccatatagaaatacaattaggaaataatagaaatttggaattaaaaataaggaatattagaagtagagtatagagtctatatagaaatacaattaagcaaaaatagaaattcggaattaaaaaataaggaatattagaagtagagtatagagtccatataggaatttaaaactaactaaaatttagaataaacataataaaattaaaattagagtttttagagtctgtataaaaatacaattcacaaataaataaaattcggaattaagaaaaacatgggaagaagagtttaaagtcaatataggaatacaatttagaagtaactgaaattcgaaattaaaaattaaagaatattgaaagatgagtttagagtccacatagaaatacaattagaaataataaaaattcagaataaaaataaataatattggaagaagagcatagagtctatataaaaatacaatttacagaaaattcggaattaaaaaaagaaatattaaaagacgattctagagtccatatagaaatattataatttacaaataactaaaatttgatattaaaaataattaataactaacacgtatatataaaatacaatatgaatattacatattagtagttttgtaaagttattgcaaaatttaaaattatgttgtcattttaatatatttgaataatataatg

SEQ ID NO: 17129 - DNA, 1501 bp, Oryza sativa
gtcacatctgggtagcccaatgagtatcccaacccaaaaaagactctctctctctctctcctcttcctctctttcctattctacccctctcttctctctctctctctctttctccatcatccacgcgagagcaccgagagaagcccaggccgccgccgctctctccccccctctctctctctcccgtggaaggtggtggcggcgaccccggaggtggcagatccggcgccgcgcgggtcgcggcggcggacagtggcggatggcgagcgcatggtggacaaggcggcggacggtggcgagcgccgtgctgatcgcggcagtcgaggcggcggatggcgagcacgaggtggatgaggtgcctactccgccgcggatttgtcgttgccgccgctctctatctctcttgtgggtccgcctcggtcggcggatactccagctctaccaaggggtgaaataggaaaactcgttggggaaccgatgtccacaggagcccatccccctcccaatgcatccctcggctgcatcgctcggctgaaaagtggcgagagacgcgtccctgggccgggggatgcgctccatcgtagggagctgacgcggacggaaaagcggatgtccgtcggcgagggaacgacccagagacgcatcggtgatggcctaagggtgttttcatttgcacaagattgtgagtagatttgactttttcatgcgtacacttcccaagtactaaatgatgtgttttatggaaaaaaattatatgtaaagttactttaagaaaatcatagtgatatatttttcaaatttataataattaatacttaattaatcatgcgctaatgaatcatcccgtttacctatttctcaaccttctcttttaccccctattaaattaacactcctaaaaatatttggcaagaatatacagcacgaacagtaatctattatattattaaaggaatagaaaaaggaccctccgcattcgctctcatggcctagaaattctcacattaatcggagaaaaagaaaaagcagagtccatatagaaatacaatttagaaatagctgaaatttggaattaaaaaaaaataagaaatatttaaaaataaggaatattagaagaggagactagagtccatatagaaatataattaggaaataactgaaattcggaattaaaaataaggaatattagaagtagagtatacagtccatatagaaatacagttaggaaataactgaaattcggaattaaaaataaagaatattagaagtagagtatagaggcaatatagaaatacaattaggaaataatagacatttggaattaaaaataagaaatatcagaagtaaagtatagagtccatatagaaatacaattaagaaaaaaatagaaattcggaattaaaaataagaaatattagaagtagattatagagtgcatataggaatttaaaactaactatattttggaataaacataataaaattaaaagtagagtttaga

SEQ ID NO: 17130 - DNA, 1501 bp, Oryza sativa
agtacctgcacaatcctatttattcttttcttctgtcctatttattcttttcttgtgtaattttctaatctatgcagattaggagcaaaagggacatttcctaattcaaatgttgattaggattatccatgaggcatattaagttggtccaaagatgattttaagttaaaatgaatacttaagaggacttatgtggacttatgtgcataaaattaaatctcagggtttaaattgtgcctttagtgaactttgagagactagattacctattcacccataaatcatcgataattcttacatagaaaaaaataagcaaattatcaagacaaacatcggcagactcggcataaaaataattaaacgacacacgaaaacgtacacgtcgtcagagctcttttttgttttcttactattattattattactagaaaaaatacccgtgtgttgcaacgggtaaaaatatttttggatcgttatatattttactctttggttttagaccaaaagctcatttcgttccttccttgtcaagtggagctgtgtaggtccggctcgcatatccgactgtagtcttcaacctccgaaagacaatgtcgtgtctgtacatgccaaaatcgatcctcccatcaaatttggtcgaatctttctcgatctttcaaaattggtcgagggtttttgatacactcgatcttctctttccgtttttattaaaatcagagcgacaaacatcgggataaaaacagtgatttttaaataaagattaaattcagtgaattaaagcagcgttaaaaggaaaatcataggaaaatgataagggagtagcggggaattgatttttggcaatcgattggaagagggaacgcatgggaaggcagatcgaccggcgacgctagtgttcagccgggcgtagaaaatatggcacataaaaaaacaaatgcttaccacgtgcgagaaaatacaactaaaaaaacagcaacaaacatatgaaaaaacccggtaaaaaggcatagaaaaaaattaagaaaaaacagcagagggaaaaaatgaaaaaaggcgaagagaaaaaagcagatggaaaaaaaggcgaaaaatacagacggaaaaactgggaaaaaagaaaaaagaaaaagagtgaaaaggacggaaagaaggaaaaaaacagacggataaaaaaagaaaaagaatcggagagaaagaaggaaaagaaacagactgagaaaaaaaaaaggaaaacggacagaaaaaaaaagaaaaaagggcgaaaaataaaaaaagacggacgaaatttttttttagggaaaccttgcttatttttaattaggtactagaaaatatgcccgtgcgttgcaacgggttgagccaatttaatttgtatatatgtgtcggtggataaataatcacttattcatgtgcttatatgaataacttattaccaaataaaagactaaccatgtacaaatctttaatataatgttcttagcgactgataagcatgttgtaa

SEQ ID NO: 17131 - DNA, 690 bp, Oryza sativa
ggagagggagggggaggcggccggctcgagggggaggggagagggagggttagggttagggatttcaaaatgatctgagccgtccatcaaaataaacggctgagatcgatcgaggatttgggccgcaccacttgggcggcacgcgggccaacagtgaacagtccagcaagtgagaggaagagtatagggatataaattagactttgtttgcttttaggctgaagaagaaagtgggctgaaaaaggcccatagagataaaagaatttttatttaaataaatactaaaatgatatttgtattatcaaaattagcaattaaactacgtaaattccaagaaaatttcaatgagtgtaattaatgatatagaaaatttaataaaaattaaatccaaccataacattttatttctcacacttactttacttataaattaatttaattatatacctacctacttaaaaaatacccaaatattgcagaaaatttatatttcatttaattagaatttaatatgttctaattcaattttatcacttactttacttataaattaatttaattatatacctacctacttaaaaaatacccaaatattgcagaaaatttatatttcatttaattagaatttaatatgttctaattcaattttatcacttcctgctgttcgtcaacgggccgtgggggaccagc

SEQ ID NO: 17132 - DNA, 1438 bp, Oryza sativa
gagaatgttatttgtcggatgaagaaacgaccaaaatagaagttatagatattgatgagttatacagctttgttgttgatgacatttcagttgaaatcatttagtatttgaaaatgttgtttgaagtcgtcataatttgaaattcaaattcaaattattgaaacaaagtcatatagcaaaacgaccaaaacaaaagttgtatatcttgatgagttatacaatttcgttgttgatgactttttcagttgaaatcatttagtatttgaaaatgttgtttgaagttgtcataatttgacattcaaataattttatacaactttgttgttgatgactttttcagctgaagtcgttcactaataaaaaattctatttgaagttctcaaactttgaatttcaaattattcaaatagagtcagatggagacacgaccaaaataaaaattttgcatctcgatgagttctacaactttgtattggtgacttttctatttgaaatcatttattaaccccaattttcgttcgaaattatcagattttgaaaattcaaatttttaatttttcaaatgaacttattcgtaaaaaataccaatacgatagttgtagatctcgatgagttctacaattttgttgtttctgatttttgcatttgaaacaacggtagttattttttacgtcattgacttattttaccgacggctgaccattcgtctaatgtaaaattttttatgcaaatataaaattatttatatcatgcttaaaaaacatttgatgaggaatcaagttagattcagtttgaatgattgtataacaaaccgttgacctatgcagaccgatcgacatcgagtataattgtccgaagggagtaattgcatataactttggcataatattacatatgaatataatttgtttttcgtctttaccacatatatatgttttcaattgaattttttggtaacattttcacaacacgtgtttattttatttaaaaaatatttatgtaggaatataatgttcttttgctcttgtaatttgttttggatacaccatttcagaaaattggtagcattctcacttattttcaccaaatgtcttcattttattaaaatatatttatgttggaatatactgtttatttgctcttgaaattatttttgcatatagtttgtattttttttccaaaaaagaatgatactgtagctgtagacgccaatttttttgtggggtgggagccaaaatttttcaaaagcaaaatcttcgcggtcgggccactttgcggtcaagccattttaaatttgaattgactgttttgtccaaataattcaataactattgtcaacgcactagggtcatttcggtaaagccgcgttgtgattgcttcataccctggttcctcaaaccctagccgattccaattcccaaatccactgaaacccagc

SEQ ID NO: 17133 - DNA, 1501 bp, Oryza sativa
agctaaaaaattttctccgtcttcccatttttgtctttttcgccgttttcctttctttttttcttttcccttttttccgttttcttccatccgaccgtctctttttttttctttttcacccttttttcctttcctttttccttttccattttttccgttttcttccgtccatcttttttcgccggtttttcctcttttttttctgtccttctctttcgccttctttttccttttttttcctttttttcagtttttcttcatcagctgcttttttactcttttttttcgtcaccttatttttcaattaattgcaaaaatcgattccccgttactcctttatcatttttcccatttttacctttcaattctgttttaattcaccggatttagtctttatttaaaagtcaatgtttttatcccgatttttgcggattcgcttcgattttgataaaaaggaaagagcagatcgattgtataaaagccatcaaccaattttggaaaatctagaaatatttgaccggatttgatggggaggatcagttctggcattatatgaacatgagatgttttcaccattttccagaggttgaagacgacagtcagctatacgagctggagctacagctctacttgtgggttaggtcaaagagaagcagtctaagcaaaggaggtggcggtctaggctgaaactgaaaagaaaaaaaaagggaataagcttttgttcaaaaagcaaagagtaaaatgtatagggagcttttggtccaaaactaaagaatctaaaaatatttttacccatcgcaacatacaggtattttttctagtgaaaactaatatccaccgaccaaatctagattagtctaaatttataatagaaattaagcacgagtaacgcgttgcacgcatggaacgatgaaaataagcacgatgaacacgtacatgattgcacaagggttagctctgatcgaaccaccacatgcacgctctctcgccaacatgcagcttataagcatctttagtggactaaagatccggcctgacaccctctagcaaccggcgaaccgacactaaagatcatatagtcctgttgtccttaaaaaccaggactaaataatgacgtttagtcctggtttataagagaaccgagactattgtaaaatttggccgaccgatcgaagatcgtttctccagtagtgttacttagtaattttatctaattaaatagcaatacaacagcatataaattaatatacacaggtcaacactgttatcgtcgtcaacataagcaaattaatcaagctagctagccttttgccattccaagttccaaccatggccagctagtggtgcacaagggggatcaccatggtctcaccatcaccctcctcttggccgcggccttcttcttcctcatcctcctctcctcctccctcgtcaaaatcaacgagaaaccgcccaagttagaccacaggaagctagcagctgcagcaggtggcacaaatgt

SEQ ID NO: 17134 - DNA, 1501 bp, Oryza sativa
gatttggctccggcgggtcggcgaaggcggtgcggcggtggtgaggttctgcggggagggaggagcaccagcgacggcggtgcacggtgagacgacgattgctcgcgaagggtcggagcaacggagccggtgagtagagggaggagtggtggcggcggctgctttgcacagatgggtttgggagttcgccgtcggcggcacgggtgttctgctgcttgacatgtttttttcttttttctttttgtttttggtagccataaatttgtgccatatatttgtgtttgtggcaatttaatatatgctaataagtgcacacaactgcattgaataaaaaactttgagataccgggttaaattcaaaagggtatagatggaacttccgtcttgagttaataccgtcatattgccttcacggaatagggtcaagtctcatattcgtttataaaaaagagggtcaaatgagaaaactcgaaaaagtatggccaaattagtagttagtcttaaaaaaaagataaaaacgcaattgccccatataaaaattaggagtaaagtatacgggcggtccttaaacttgtaggggtgtgtcatctaggtccctaaactcttaaaatgtatatccaagtcccagaacttgtcatagtgtgtcatttaggtcccaaatcgccacaaccccatcaggatcctacgtggcattgatgtggcttgccacgcgaacatgacgtggtattattttgactgacaaataggacccatttaaattttttcttttttcttttcccccctttattctcctttctctatgacctgagcagaagaaaggaaagaagaatgagaagaaaacagaaaagaaaaataaaaataaaagaagaaaatgacacgtcatgtccacgtggcatgctatatcagcgccacataggatcctagaggggatgtgtcgattcgggacctagatgatacactttgataagttctaggacctgaatatgcattttgagagtttagggaactatatgacacaaccctataagattagagaaccaccagtgcactttactcaaaaagtagtaaatgtattttctatacatcacatcccgggattactttctacgtatttcgtttagtctgtcctttcctaatgtatctgatcgatagagtaattagctaagctaagctcacttgatggcgctagcaagcaaggcaacagcaaaagaagaggagctcgaagggctagcggcggttgactttgaggccgcctcgcaccgatccgcggatcgctcctcccccaaatcccaatcgcgctccctcgcccgtcgcccgtcgccgcgccttcctctaccccgtaccaccgccgaaaccctagaccctcgtcgcatccgtcctcggcggctagatcggcgcacgcattcatctccggcccggctgacgcttcttccctggctcgattcgcgacccagttgggccgatttggatcagcagcggcccggccctcttcttagcccaa

SEQ ID NO: 17135 - DNA, 1501 bp, Oryza sativa
aaaatcacataataaaacaacaaaaccatctcatcgtggaaggttagttcctacccatttcttctccaaatatacattttcgtactgacaacttttctctcaaacacgctaggtgctaccatataactcaatccacaaatccactagaaaaatgaaaacatgataccttcaactagcgcaactagcaccagggagaagggcgtcaggatccaggaggatattgccaggtgggcaggtggccggccaggaaggagggcaccagggaggacgcctgcaggggaggagggtgccgccgcgccagccaggaggaggatgttgggaaggaggaggcctaccggggaggagtgtgacgggcagggaggagggcgccacccgggatgagggcgtcggcaggggaggagggcgccggccaggaggagcggcgtagatccgtggaggcgcagctagcgggatatttcacgtgaaaaaagaagtgcccgcgtgtctctgccgcggatgggggctgcggagaaagcccctgggactgggggcctgaggggataatttggaggccttcctattttaggggctttagtaggggccttattggacctgattttttagtctcaactctcaaaattagtataggggctgtgtttagaacctctactggagatgctctaagggaaaatatatggaatggagcctctgcaaccctaattagtgtggatccatcttatatatattgtcatcacataatatttcatgataggaaaaactataagctatagaactttaacaccgctgaggtcgataacatagcacacctcaaagtttaggtggatcaaacacgttagccacttgccactaggtcatggctgatcagtgacagtacatggtggattggtgccgccctgatgcttagaccattgctaagattttcagcccgtgtcaaaagacaaaaaaagaggtttctatttaacaaatactaaataaacagagtacattttacttcaatctatataaatatagaaaaattgcatgaatttcatgtgatcaacgtcaactagagctataccaaaggaacttactaactgacaacgatggtgatgatcatgactaagtaggaactaagaagaattatcatatcataaagcagtgattcagttctccttactaagcgaacaaatatagtggaacctttactgcctggaatgcacattcacatcatcatcatgagctttagttctttgaggtagctgtagccgagaaaaaacaagcttgttctagctaaataagtgaaagagaaaaagagactttaaaaaatagaacaagaagatcttaaaattatattaaaagtgcatttggctttgactggattataaaataagaggttattttttgaagggaagatgttgggttctggacagcaaagttgggtcacgtgttccactatgtcatataggacgctccgtctttggttgaggtagtgcactatgattaaatttacaatttttgtaac

SEQ ID NO: 17136 - DNA, 1501 bp, Oryza sativa
aacggtcaaatatttgatatagaaaaatctttacacttaaaataagacggacggattactagcctagccacaccaagctaggggacagctaaatagcttggcatatatcactggtgcagctaactccattcgttcgttttattatgatatgtaaaaacgattctttttaacttatttgtactaaattactccatattatattaatcgtacgctaattgcttttttttttcaaaaaaatctttttccgtgtcatgtaagagcaagtttaatagtatagcccactaatagctccaattcatctatagtcaatttaatagccaatttatataatagttgcttactatactattaactagcacggtggcccacgcagattgcgcggctagcatcattatattttttttctcatgtaatagcatatatgttttctcaatgtattattcaaatatattaaaaatgatattctaattttaaattttatactaactttacgaaactactaatgtgtaatatttatattttattatatatacgtgttagttattaattatttttaatatcaaattttagtatttgtaaattatattcctatatggactctaaactcgtctttcaatatttctttatttttaactctgaatctagactctagaccctagactctagactctagactctacttttaattttattatgtttattccaaattttagttagttttaaattcctatatggactctatactctacttctaatattccttattttttaattacaaatttctatcgacttttcctaattgtatttctatatggactctatactctacttctaatattccttatttttaattccgaatttcagttatttcctaattgtatttctatatggactctagtctcctcttctaatattccttattttttaattgcgaatttcagttatttcctaattgtatttctatatggactctagtctccccttctaatattccttattttttaattccgaatttcagttatttctaaattgtatttctatatggactctagtctcttcttctaatattccttattttttaatttcgaatttcagctatttctaaattgtatttctatatggactctgcttttctttttctccgattaatgtgagaatttctaggctatgagagcgaacgtggaggctcctttttctattcctttaataatataatagatagatatatggccatacatgtcatacacacattgcgtcttggagttcacgctgcagctggctacagatctgtagtccgctattcttctttcttatcttttatctcattaaaatatgttacatttggctaatagtatgttattgtaccagctctagctctaagagcatacgaacaacgaagccaaacagctccggaaaccaccatataaggagcatgcagggaggaggagagtagcgctagcgcgccgtgcgcgtgtggcatgcggtccatctgtcacaacct

SEQ ID NO: 17137 - DNA, 949 bp, Oryza sativa
gccctcccagagggcggtaggcgactatttccgtcaattttcaaaatggaaaattatttttgtaaaacttttaataaaaaaaattataaataaaaaaaattcaaacatcacctgctcagctcgtacgaaaccgattaaagagcagttttccgtgtacacacaaaagcgtgcctggatcaagcgagaccccaccacacacacacacacacactacgctagctaggttgctgtacgagagagagagatagagaagtgatcacgattcacatggcacatgcagatgcatgcatgccaagctcgtttttaaagggcgtgccatgcatgcatgcacgatgcatgaggacttgtggagtcgtctgtctagctagctgcatgcatgcatccatccatgccagcgtcctctctcgtctgaatgcaagattcacaatccatgtactccctcggtcttaaaaaaaaacgatcctaactatgtagctagacatatgttatattcaaatacatacctaggagttgctctttttgagacaaagagagtacttactgcatctcaaaatatagcgacaaatttaaattggataaatcttattatgataaatctgaatatatatccatccagatttattatgataggatatgttttatcccgtcttagatctatattttaaaacggggtagtaccttttgctcaacttaagtccatttttcatttatttcacacggttccacaaaactgaaaagattataatacctcaatttattaaattctaatacaattatttatttcccatgcattatctatccttaatatatattctttatttttacaaactacgatacaataattactaacaaatagtataatctaaaaatgattgtattcgagagagaaaccgccgggggtgagggagagtagatacaccactcacaccagtggctagctgcatctgca

SEQ ID NO: 17138 - DNA, 1501 bp, Oryza sativa
tcgatgtaataatacttactagtaaccatccctgagtccaccaaatttctcctgaccagctgtatcccagcagtagaagcggatcttgccgcagttagtgaagaaatccaaggggtggacctccacaccgatagtagctgcagcaaccacagtcaaattaacacgaaaaacacaatgatccaccataagaatacatgataatgcaaaataggagcagatactcacgctcatacttcttctcgaactcgccagtcaaatgcctcttcacaaaggtggttttgcctgcaaatcaaaaagattgcctggtttcagaacagacagaaattttcgagcctggcaatttcgagcacaggaaacaagaaatttttaatcctataaattttcgaaaataaaaaccagagagttcacattcatccgtgacaaatcaaatctaacacagtcctcccttccccaccatccccttcccgagtcccaatgctatgtactcgaagaggagcgagtctgccagattaatcggtgccagatcaaaactataataacacagccttatttctctatctctaactataataacgatcttaatttatttacaaatcaaaacaaccactacaacgatcttaatttacaaatcaaaacaaccgtggctgtatctctccgttcaatctatctagggttcagcgaaccattatcaaggtcgcatcaaccaagcatcaccacacctataccgcaacctagaaccaaacagatcgaaaaaaatcgtaagagaggggagggcgatcgcgaggctaacccgtgccgccgtcgccgacgatgacgagcttgaagctggggtagtccaccgtctgctgattcgggagcgcctaaaaaaaagtaaaaaaaaaacaaacgcaacgacggtgagggtgagattggggggagatcgaaggattgatagggcgagagaggccatggaggggagcggggcgatcaccattggcggcggcttccgtgcgctcgagattggggggaggcacgcggaggtgtgggggattagtttcgattcgaaggtggcgaaggcgagagacgaggagagggggggttggtgggatttatgggggaggggaaggcggcggcgaaccctagcggggctagtagcttctcgacgtttggactgttccaacgtcaaagggcttttttttttcttttttttccctttttttctttggaggcctttttctccttttttttaattccgtttttccttttgttgccttttaataatctgagtacattacttttgttgccttttaattatgactgcacttaaaatgagacaaagagagtatagttttttttggtgatacgaaatacctaagagattatatcgggctaaactaatatgcatgcttgttatttccctagtcgcctgactttaggcgatctttctaatctttctatgggagaagttaccatcacttatataatatgttattttaaacttcttgctatcaaataaagtaca

SEQ ID NO: 17139 - DNA, 1501 bp, Oryza sativa
accgacgagctccggccgccgctcctcgccgctccagccactgccaagccgcgccctaccaccgtcggcttcgctgcatcgcgtggtaccccggccgctcttccaccttcgttggagaccgccgaatcaccgccgtcgtcttcgccccgtggagtgctgccgcctccctctgctcgagccccatcagccgcctccttcgccgccatgcccctcggtgagctccgccgcctcccttttcgcctcctccgctcgttttcgccgctccccggccgccccctcgctcgtcgggccgacgccgccatcaccgttgtcgtcgtcgtccttcccgcgtcggtgagcatctccctcctcctcccctccctttctttttctctctttgcccgccggccgccgcatgcgtgtcgccgtcgcgccgcgccgcgccgccgccggtgtcgccgccggtggccgtccggccgcgcgccgccgtctggtcgggttggtcggcgagccaacccacccctccgccttgcacctctaccgtggactcggtccacggtgggctagatccttttgcccgctgacgcgtggggcccgctcatttggtggacccggtccaagcccgcacctccttgacccgctaacgtgttgggcccacctgtcggcgtcggcgccccttgctgacgtcagcgaatgccatttcctttgagaaaatatttaataattgcgcaataaatcgagtttaattctagaaattcatttaaatggcccaaaacttctaaaattcatgtctaattcattcgaactacgaattgagccattcaacttgcaaaattcatctaaaattgagctctacatgtttgttaagtttttatgtactgtttccttggtttttattagagtttttcctcgttttgcgtgccagcgtgtagtttccgtcgtttcggaagtctgcggtcgcaaggaaaagagttcggaagatcaaagtgaagaagcaaggcaagtcacacattccccttgagcattttgatcctaatttacaaatattttactgtttgcaaacaaatatgcatgttttgctaattacatggggtcagggttttacctatctgctcgcttgtgccatgtttacttgatatctgttctttgtcaaccttgggtaataaatcgactagctcatgttacttatgtgacctagctagaactatatgcttagccatgcttaattactactagctcagttgatgggataattacagtattagacctttttagtatcagaatgagctatgtgctcaagacatctggccatgcttcatggtcataattatccaactaaaatgcgactgaatggtgggctgtgggtgcatggttttgctagtcgcacccatggcagttaaggaccggttcgcgggatgccctggaagaacttatcgtacttaccacaagccagcgtgggcaacggctggacttgtagtgtatctttcctctagtcgacgcatccaggcaagggtgggcgtga

SEQ ID NO: 17140 - DNA, 340 bp, Oryza sativa
cgcccattaggattacccggtttaacgtgccacggcaacgaaagtcatatcggttttaatatagttagagcgattgatcgatatatacttcccgtttaggttgatggttacgaaatacgaaattcggctaatagttgagggggttacattggactttgtttcattccagcctaacaagaactgtagaatgaaaaccttggcccaacccaaacacaaatagtcttgcgcaagactgtgattattattagtttgttatctatctatctatctatctatctatctatctatctatctatctatctatctatctatctatctatctatctatctatctatctat

SEQ ID NO: 17141 - DNA, 1501 bp, Oryza sativa
gccgcccgccacgagacgccgcgccacgacgacgacgcgccacgccgccgccttcgccgccgccgcatgccaacgccacgccgccgccgccttcgccgccgcatatgcaatgccgccgccgccacgccacgccgccgccacggccccgcaacgccacgccgccgccgccgtcgccacgccgccgccgccgccgccacgccgccgcgcccaccgccgccccgatgccgccacaccgcccgttaacgaacgagaacgagaacgatcgaacgaacgagagcgagaacgaacacgtcaacgtacgttgccgcgagaacgtgaacgagaacgagaacgatcgaacgaacgagagcgagaacgagaacgatcgatcgaagacaagcgagaacgagggaacgaacgtgaatgagaacaagcgaacgaacgtgaatgagaacgagcgaaggaacgtgaacgagctagggaacgtgaacgagcgaacgaacgaggacgaacgttaacgtgaaatgcaatatatatatatatatatatatatatatatatatatatatatgttacttcgcatttatcctaatacatatttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattggacttatcatataagattgtgtagtgttctaatattatttgagttttaatataagattactttatttgtaattagacttagtatgtataattattgactacggaattggtgcgacaagtagcaattgactattgtagtcttaattagacttagcatatacgcacgaaacacttagcatagatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattgtagtcttagcatgtaatattatttgagttttaatataagattattttatttgtaattagacttagtatagggttgtataatatacgtcacctagacttagcttatatcacgatttataattagacttagcacgtaaggttgtgtagggttctaatgtacgacatttacacttagcatacatgacttagattgttaaaacataaatgtctcgtgacttagcagatgtt

SEQ ID NO: 17142 - DNA, 982 bp, Oryza sativa
tataagaacctaatacgacattaattaaaatagggaataaaaataaaaataaaatccaaaattagcaaaaaaaaataaaaggagagttcaagtaggaatacaatataaatttagctgaaattcggaattaaaaataagcaatatttaaagaagaattcatataagaacccaatatgagattaattaaaattcagaataaaaaataaaataatatccaaaattataaaaattaaaagtgagttcgagtaggaatacaattttgaaacaactgaaattgaaaataaaaaataaaaatattaaaagaacaataggatattaattaaaatttgaaaaaaaaactgaaattagaaaaagaaaaataagatttcatttaggaatacaatttataaataattaaaatttgtgataaaaaaaagactatggaaaaaaaagaccataaacatatgatgagataaattaagtaacaagcctataaatgagtagagtggtggcggttgatacgacatataaaaactattaataaaacaccaaatagaatcctaatgacgattaaaaggatggacgacaggcagaccgtgaagcaaatgaggtgattgccgggacatctagaaagtaaaaaaaaccattgataatcatattcgattaaaatctcaatgacaataaaaaagagaagcagcgggcagggtgtataggcgtatagttgcagagccaccaacggttgacgggacttttagaaaataaaaaatgaattccgatgatatttatgttcgatttttagaatcacaatgacaataaagagtaggcggcggacgggccataaaggaacatagtagaatcgtttgacgagacttctaaaaattataaaaaatgaaacccaacaagacaacaaactctaaaaactacaaggttcaatttttaaaggtttggaacttctaaaaagtaaaaaaaagaacgataatcatgttcgattttaaaatctcaa

SEQ ID NO: 17143 - DNA, 1501 bp, Oryza sativa
aaaagaaaaactaaaaaaagaagtccgattccccttaaaaaggaaaaaaaagttcgagaaaaaatagcgaaaaaaaggtagatccgattcccctaaaaaggggaaaaaaaagtccggttcaaaaaacagaaaaagtggcgaaaaaaaatagatctgatcccttaaaaaggggaaaattttcctattcccacgcacggtttttctttttttcttcctttttttcgtttcttttcagttttttctttcccttttttctttttctgtttttttatttcttaatactatgtatgtatacaaactttatatatacacatatacaacctttgtatacgtgtattttttatatgtttgtatataaactttgtatacatctctatctctactctctagtctctatctctactacttaaaaaattcaaaatgtttccttcgtccgtccctacttaaaaaattcagatagtgggaaaaaagggtttgtaaacgagaaaaaaaagtaaaaagggtgggaagcgcagcaaaaaaaaagtccaatttcttcgttttaatagtccgtatatatctcttctctatgcctaatctaatctaatctatttaaaaagagatgttttcatcgtataactaaaaagagaagttttcatcgtacaacttaaaaagaaaaaaatgcgcgagaaaataaaaacggtaaaaatgaaaaaatgcgcaagaaaataaaaatggttaaagaaacacgtgaggaaaaaatgtcagagaaaagcgctaaaaaaaggtttccgtagtcctaaaaaataaaaaaatgtacgagaaaaaaaaatatttccatcatccgtaaaaataataaaaaaacatgcgaggaaaaaacttttagaaaaaacgcacatttctaaaaaatggtttaaaaaaacctcgcatgaaaaatggtttgaaaaacgctaaattgatggacgccttgggtcagataggatccatcgatttttccatctcctacacaacttttgtttggtcatctattctcctgtattagagaccctgcacgtctctatatgcaattatcagactatttttgttaagtatagctactattgttgataacatatgatatggatataatattaaaaaataaacatatttttaattgttatttagagaagagttcacagtgactctattttgtgtagatttgaccatgcgaggtaatgtaggatttgattgatcgtattattggttgcaagaataagattcaaagagtattttagattatatgcatgttgtcacatgaataatctaattattttaggtaaagcaagcatcagtgaggttgtcatcgttgaggttgggccatttcatttaagatgttacaatttttttgattgtcttagctacaaacgatccatacaaacattgtcattgacatcgttatgtatgaaaatcctattttattattagaagtttttcacccgttgcaacgcacgggcatttttgctagtattataaaaatgagaca

SEQ ID NO: 17144 - DNA, 1243 bp, Oryza sativa
tttttactttatcggcaaagaaatgaccaaaataaaagttatagatattgatgagttatacaactttgttgttgatgactttttcagttgaaatcatttagtatttgaaaatatttttttgaagttgtcatgattagaatcaaattcaaattattgcaacaaagtcatatagcaaaatgacaaaaacaaaagttgtagatattgatgagttatacaactttattgtttatgattttttcatttgaaaatcatttagtatttgaaaatgttgtttgaagttgtcatattttaaaattcaaattcaaattattgaaataaagtcatataacaaaatcaaaagttgtagatgttgataagttatacaactttattattgacatttttttcatttgaaatcatttactacacgaaaaaaaatttgaattgagaggagggaggcaaatagtcttctcgacgagggaggagcaaaagggttgggccgacggcccgaagagggaggagtggaaggggaagccggcccgaggagggagaaagaagctgcgggctgagggagggagagagtaatacttgggccgaaaaagccccaaggacaaagagagggattttaatttgttttctatttattttaataggttaaatgaacttggtggtattaaaattagttattgagcttcgaaaattcatggaaatttttagagaataatttagaccacgtagaatattacaaaaatatttgtggccatgattttaaaggaaaattttagtttctttattaattcacttgattaaattgcttcaatttttaatatatttttttctagaaatacattatataaatctgtgatgttttctttttgactcttatgacaaattaatattcgtcacaatgtctcatcgaaatattttatgatgattttgtcagggtgatggataccacatacctaatagtagttgactaaatctcggcagaacccatcacataccatgttttatatggaaacaaccttaggatataggaggagttccgcataaggtaggatgactagagttttacatggaaacgacaaaaactactcgaattgtatccatattggttttcctagttctacttagacaaggggacatctacgggtataaatacaaggccccctaggaggagaggggacacagaacaatagatcaatacacaagatcaacatacaagccaacatacgccaagacaagacgccggatatcgacttca

SEQ ID NO: 17145 - DNA, 1501 bp, Oryza sativa
atgctactgcaaggttgacgttctcaaatgggcttgggacaaaggaaggatttgggaagagaagtatgtatggccactagtccgctatttccctttccggccttgcccatttgcccatcagcccagcacaggtacaaatctcccaaacactgaagaagaatattggaggacccaatactttcggcttgtaagacaaatagtaagatatacatatatctatctattctattatattattaaaatagctttgaaaggagacaatacgttcgctgtgggggctagaaattcccatattaatcggagaaaaaggaaaaaaagaaaaggagagtccaagtagaaatacaatataaaaatagctgaaattcggaattaaaaataagcaatattgaaagaaattttcatataagaacccaacactgtataaatcaaaattcaaaataaaaataaaataaaatccaaaattagaaaaaaaaaaaaagaggagagtctaagtagaaatacaatttaaaaatagctaaaatttggaattaaaaataagcaatattgaaagaagttaccatataagaacccaatacgagattaatcaaaattcgaaataaaaataaataaaatccaaaattagaaaagaaaaggatagtccaagtaggaatacattttaaaatagctgaaattcggaattaaaaataaggaatattaaaagaagagtccatataagaacccaatacgagattaattaaaattggaaataaaaataaaaataaaatccgaaattagccaaaaagaaaataagagttcatgtaggaatacaatttaaaattagctgaaattcggaattaaaaatacaaatactgaaagaagaatccatataagaacccaatacgagattaattaaaaatcagaataaaaaataaaataatatccaaaattagaaaaattaaaagagagttcaattaggaatacaattttgaaacaactgaaattgaaaataaaaaataaaaatattaaaagaacacaatacgatattaattaaaattttaaaaaataaattctgttagggttacgggtaaggtataccctttacccttcgatacatgccgcgtatcggtatggtatacctgcgcgtatacggacgctctctgcacacattaagggaatccatcatgcagttcacagatggaaagagtcctactcagacaagactgggtcgtcagtgcatcgtgcagggttcgatgtctccaagttctacttgaaaaccgcttgacctgcgatataaaagggacccccctaggaggacctaagaggaggaatctgatggccaacatcaccaccacagcctacgaagtcggagcctgcggaagccagattgccgagaggtctagttggattaacccgatacgatctcgtcggtttcatcgagttccatctttccctttgtaacctgtgatttccatcatataatcccataccaactggattagggctattacctatcaaggggcct

SEQ ID NO: 17146 - DNA, 1501 bp, Oryza sativa
  unsure (1)..(1501): unsure at all n locations
gctgagtaaaaaactgaaaatattgggatcactatacattataattgaaaaaggtaatgaaaattttaatattgggatcgctatatattacaattaaacaagttaatgaatatcttttctgggttttggccgaaagccttccttccttttagccctaggcaagtccgctacctccctccgtttggcctacttacctccatttggtctgcttccttcgacccatcaaatccctccctccatttggcctgcttcatttgactcatcaaatccggccgaatctttctcgatcacccaaaattggttgatgattttttatccactcgatctcctatttccctttttgtcccnnnnnnnnnnnnnnnnnnnnnnnnnaattaaaaacgataagggaaaatcgccgtcattatcgacaactgttagattaaatctgaccaaataaaataaagctgggaaaatcatggagaaaatgataaatgaggagtgggaatcgatttttttttgcaatcaaattagagtagaaaacacacgattgatatggcgtcggtgcagcgccagggttcaactcgggagacgtgcacagaataaattggattaaaaaactgagtgagaaaaaccaaaagggagaaaataaccggtgacaaaaaagttgacgaaaaaaccaaaaggtccgggaggggcggtgaacagatcggatgtaaaaaacggaaaaaaaataatagcacgtgcgggaaaaaaaaactctttcgcgtgaaagaaaaagtcagaaaaataccggtgaaaaaaaaccaaacggaattttttttactggcgagattttttttttcctttttttcaatggagtcggacgatttttttttttcaatttttactgacgcgcggcagaagcttttttatcgcttctgagtcggacattttcttttcctttttttacctttttagtcgcactattttttcctttttttgctcggccttttttttccttttttttttactcggaccttctattttaccggctatggaattttctcgtactttttaagtagagatagaaattaagaccgtaacataaaattaaaaccatatttgatataccaaagtaccggaaaaacatttttaatttttataatagtagagatttaagttaaacttaaaaaaattgactaataaaatacttcatccgttttataatataacactttttagtgttgtccatattcacttagatgctaatgaattgtatacatatagattcattaatatttatatagatgtgacagtgctagaaagtctttcgtcgtgaaaggtgtggggccagtgtcctgacacgagtgccctgggcctgcagctcctccgtctcaggcgacgtcggaggcagagctccagtcctcgatcgtctgctcgctgctccggcgggaggacgaagaggagcggcggggttgggggtgctcccgcctgcccgcccgccggccagccagtaccctatggcagcagcttccctact

SEQ ID NO: 17147 - DNA, 1501 bp, Oryza sativa
ttgcagggcctaccgtgcattttacatcctaaactggatttaccgttacttcactgagggtcaccacagcagatggatccgtaagcgcctgcccctcgtatgcttgtgtttcatatcccatgttctatatatgaaaagaagttctgacgatctgtttcttccagcttggattgctggtttggtccaaacagctctttatgcggatttcttctactactatttcttaaggtaaactggatactgttgtcaaacctcatttgcagactctctgggtactgacaattccatgtcggttgttgcagttggaagaacaatgtgaagcttgagttgcctgcttgatagttcttcgccacgccagaaaatgtgcacatcacatgagaattatcgagattagttgatgctggcagagacttggtaatgaagtgggcagttgcaatttgtactgttgactatgaaaattgatgatgttcatgtgatggtttcccttggcaaaggctattacgtttcagaagctaacagttgctactgcacagaagtagactagttcctttttggacctcatactgagatggaaaatcacacccaattcatttggcttgttgtttgcagctctattacacttggtgtaaacaaacagtgtgatttccggtgtcttgtaaaaaccaatgcactccaaactactccgaaataccagaaatattgattgtgcttcctggatcctctcaacgctacttcagcatttgcctgtggaacagatcaactgttcaattttagcttttcaatcgtgggagttgtcatgtgatgattaaactactgaattataatctgattgtcggatgatcgtgggtcagtcttctatcaagatttatttcgtctatcttacgacttaacgtcgttcacgtttagcattagtatatacttctacttcgtgctgatcttggagtaaccgcctttgcagcattttagcctgtgtcatcagttttctgaacatgtgtgtcatcagtatcattttactctctttgagatcgccgttattacaaaaataacgccaccttgtaaatgacagaaataggcgaagtgattaatttttatatcatactactaccttgtaaatgacagaaataagggaagagattagtatatggcttttgcgatattagtatatgacttttgcagccctgttgaagtccatgtcatttgcaaattgcaattggtccacgaactcccaagtcccaacatattgccgcaaaacataactaacaaaacgtctctgtcttatcgttcaaacaatttcctcacaagcctataaaacccaaagattgcaatcgtgaatggtcaaatttgtttgttatactttgttttgacacaaccgagttctccccatcctgcaagcaatcgctcgccggctttatctccgtctccaatctccttctacgaccagacgcgaacggcgaaccgcaaccacctctgctgctacgctagccaccaccaccaaccacga

SEQ ID NO: 17148 - DNA, 1501 bp, Oryza sativa
aaaaatacctgtatgttgcgatgggtaaaaatatttttagattctttagttttggaccaaaagctccctatacattttactctttgctttttgaacaaaagcttattccctttttttttcttttcagtttcagcctagaccgccacctcctttgcttagactgcttctctttgacctaacccacaagtagagctgtagctccagctcgtatagctgactgtcgtcttcaacctctggaaaatggtgaaaacatctcatgttcatataatgccagaactgatcctccccatcaaatccggtcaaatatttctagattttccaaaattggttgatggcttttatacaatcgatctgctctttcctttttatcaaaatcgaagcgaatccgcaaaaatcgggataaaaacattgacttttaaataaagactaaatccggtgaattaaaacagaattgaaaggtaaaaatgggaaaaatgataaaggagtaacggggaatcgatttttgcaattaattgaaaaataaggtgacgaaaaaaaagagtaaaaaagcagctgatgaagaaaaactgaaaaaaaggaaaaaaaaggaaaaagaaggcgaaagagaaggacagaaaaaaaagaggaaaaaccggcgaaaaaagatggacggaagaaaacggaaaaaatggaaaaggaaaaaggaaaggaaaaaagggtgaaaaagaaaaaaaaagagacggtcggatggaagaaaacggaaaaaagggaaaagaaaaaaagaaaggaaaacggcgaaaaagacaaaaatgggaagacggagaaaattttttagctgaagccttacgtatttctgggcgtggctgatgggcgatcgctcgccccatcccctatatattcctctcccccttcctcctccccttcttctcttcctactacaccataaatttaaaaaaaaataaaaaaaattagaaaaatttatgtatagaaatactatatataaaaaatatttgaattcaaattcaaatttgaaatggaaaaatatttgaattcaaatttaaatttgaaacgggtatataaactttttacttataaattttgggcctataaactaatatttgaatttaagttcaaatttgaatcgggtatgtaaacttttgacttataaactttgggtctatagactagatgtacagaaatactatatataaaaaatatttgaatttaaattcaaatttgaatcggatataattcaaactccaatttgaatcggatataattcaaattcaaatttgaatcgggtatgtaaacttttgacttataaactttgagtctataaactttaggtgtataaactttagatgtatagaaatactttatataaaaaatatttgaattcaaatttaattttttttgtggagataattcaaatttaaatttgaatcggatatataaacttttgatttataaactttgggtctgtaaactttagatgtgtaaacttgaggtgtacaaacttcag

SEQ ID NO: 17149 - DNA, 1501 bp, Oryza sativa; identical to SEQ ID NO: 17133

SEQ ID NO: 17150 - DNA, 544 bp, Oryza sativa
catatatatacacacatatatatacacacatatatatatacacatatatatatacacatatatatacacatatatacatatacatacatacatacatacatacattatacacatatatacatatacatatatacacatatatatatatatacatatatacatacatacatatgtatatacatacatacatacatatgtatatacatacatacatacatacatacatacatacatatatatatacatacatacatatacatatatatacatacatatatatacatatacatatatatacatatacatatatatatatatacatatacatatatatatatatatatatatatatatatatatatatatatatatatatatacgtatatatatatacatacatacatatatatatatatatatatatatatatatatatatatatatatatatatatatatatatatatatatatatatatatatacatacatatatatatatatatatacatacatactgtcggtgatatgggaccgggagtatca

SEQ ID NO: 17151 - DNA, 1242 bp, Oryza sativa
agttatacaacttttttgttgatgactttttcagttgaaatcatttagtatttgaaaatattttttgaggttgtcgtattttcaaattcaaattcaaattgttcaacaaattttatatagaaacaagaccaaagtaaaagttatagaacttgatgagttatacaactttgttgttgataatttttccatttgaaatcatttactacccgaaaaaatatttaaatttcttatattttgaaattcaaattttatatagttaaatcaagaccggatggagaaatgacaaaaataaaattggtagatctcaatgagttctacaaatttatttttgacatcttttttatataagttcatttagtattgtaaaattcaattcaaaattcgtttttgtctagaagtctgatttgcctcctcctcatgataatacttgcaaaatatatatttgatccaattaactcagttttactagtgaaatatgtgatcaaaatagatattatgtgaatgcgattgtgttaaatatattgatggttgtgtatgtgaataaatgtttatgaatagatgggatgctagggtgtgtcatactggcccagggctttataggattaatataatactcatgccaacaagttacaatatattttccggaagccaatcttcaaagaactatgaggttaaacgtgcttgttctagagcaattttgggatgggtgactgacatagaagttcttcccgggtgcacacgagtgaggtcaaaggcttgaggcgaacaaaaaaacaaaatttattttttttgattatactcatccgtgacgagctataatttagacccgttagagatgagagtcatccgtgatgggctataatttaggcccgttagagatgagagtcatccgtgacaagcttttgtgttggcacgattgagatgtgtgtcatccgtgatgaccggttgcccgattgagatattttctcacgtcactgacctttgcttagtcacgggggtcatgcccgaaagagatgatgtttaagcccgttagagataaccgatcccgttctagtaacataggtcatgattgtgatggattttaacaaaactaaatcaggataccatgatgttacaggactaatcgtattgcatgttacttttgtcaaaataattgtcctcttttagaacatggtttggatattagatctcttgaagaagagagggtagccgaataattacttttgtttgctgtgctacagg

SEQ ID NO: 17152 - DNA, 262 bp, Oryza sativa
aatttacataaaaccagatgtaaattttgtgaacaatgttatgttgtttgaagttgtcataatttgaaattcaaattcaaattattgaaacaaagtcatatagcaaaatggccaaaacaaaagttgtagatattgtgagtcatacaactttgttgttgatgactttttgagttgaaatcatttagtatttgaaaatattgtttgaagttgtcataatttgaaattcaaattcaaattattgaaacaaagtcatatagcaaaa

SEQ ID NO: 17153 - DNA, 1501 bp, Oryza sativa
ttttctacatccggtcttgcttgtgccgctgcagtctgtaggtctcctaaaattccttccaaacgattaccatagttgtcatcctctgtcaccatagttgtggaaccatcattattttcattcatatcaataggatgctcaataacattgacatctaagctctctccatgatgaatccaccgagtataagtagtttccataccattcatcagtatgtgcttcttcacaacagcctgtctttggtacttctgattaaggcatctgctacatgggcatagaatttcaacattctcattgaatttcccctgaatgaaactcataaattctttgacgccgtcaatgtattcaggggaaaatagtctactgtgcacccaacttctatccatctaatcaaacattgtagataaaccacaatgagcaagctgcaccaattcaaatgctacatccaactaaatcgaagaagaagaagaagaagaagaagaagaagaagaagatattaccttggctggctgttgaggcagatgggagaagaggcttcaggagtccggtcaacagttgaatttgtcaccaggtggacgcatggccgcactcggcatcgctcgttggtgcggcaatggagggcggcggtgctgcagatctacaggatggcgttgtagggcggcggtggtgcctgatgtcgctgttcggctggtgtgcagcggtgatgcgcgatggcacggtaggcaaggaggcggcgttgctgaacgacgcggcagtggtgggcagcggcaacgccgctcctgccaaatttcgccgtcggcggcggcggtgtcttagattggttgcggctgggtgtcgaactgaataactgagtcggggttgaggaaaccttactcctccatacatacacaggtcaaaaagagtacagaatcctacaataacacatcaaaccaactagcgcagtggtaggatggggcgccttctactagtaggtcatgggtttgattctcgttggttgcatttttttcttctattttacaaattcgagttctttttttcttttcgaaatgccaactccggctgctgggccccattttcgaaatgccaactccagctgctgggccacgctgtgggcaacatcctggaccaactcaactcgagtgaatggcattaatgggccacgccaacagggatgctgggccaataataaataaataaaaatatataagtgcagaagtggacatctacaacaagtggttcaattggtaacatatttcctaccttcctgctcaatgtgggttcaaatcccacatgctgtggatttttcccccatgcgcaccatatttttttagtttgccatattatgcatcatatacatgtaacaaattaacaaaattattttgttcaaatttaacaaatcatcatatacatgtaacaaattaacaaaaatattttgattttttccgcatgcgcacaatatttttttagtttgccatattatgcatcatacacatgtaacaaa

SEQ ID NO: 17154 - DNA, 1501 bp, Oryza sativa
gcctcacctccttaagaatcgattcgaaccatccgggtgtgaagcaggacggacacgaaatcggacgggggaatcagatcgaaatgcaccggagagaagaaacaggcggccgggcacctcgcggcagcggcggggcgagcctggtggtggaaggggagaggccaccaaccacgaaatccggcttagctgcttcgccgcccctgttcttggaggagagagagggagattcaggtggaggaggaggagagagaaagagattggagcaaacgcggaggaggaagaatgtgttgggttgggttaggttgggtcggcttcttcttcccctccgtggacatggtccacggggcgtggacgccgtgcaccgcgcggtcgtgatccgtgcaggcggaggtgtgtggtggaccgagcgcagcgtttggtcggtggagcccccgcctcgaaaatatagagggggaaaggatgatggaagggacacgaaaaatgggaacggaagatttgggtggtcttcgttttgcctacctgctgcaatgcaagtgcaagtgcactagcaggcgcagacaaacgttttgaccttttgacacacgttgcacaatggacttggccttcaacgaattttttttttggaaaatggtatgcatacgatctaactaaacaactcacgtacgtatgtaaagatgttcttctttaattgatctacgagtacatgtatttagttgtacatgagtatttacgtgtagcagtactattttttttctttttcagcatagcattctaatagtattaagaggagggggggagacacaaaagaccatcaagcttggccgtgcatcggagcgcatagttgagaatgatgcaccgaccatacaaacacaagccactgagggggaagtcttagcaccaaactcatcacaactatatgagatcgatcgctcctagaccaacgtttgaatatatctatatttgtgtttagattgaattgagttggaccttcaatttaaatccaaatggaaattgaatttatctttattttagtgtttgtgttgggttgactgagaataggtagtaacttggattaagggtgggggtaggggtgggaaaaaaatatagaaaaccggacaccgagccgaaccgagccgaagtagcagttttttctatgtttggttttttcttcggttttaatttctccgtttgttccatggttggtttttgtttggtttgctattcttaaaaccaacgcagccaaacaaccaaactatgtagggaattttttttatttataattttttgtattaaaagttttacaaaaataattttccattttgaaaattgacggaaggagtcgcctaccgccctcgccctctcagagggcggcgaaaatgacgtggcagacggccgttcgctctcgggcgacggccgtcaacgaaatttgcaggcggcccccttgccgccctccgctagggcgattttatactgtgcggggggccgcctgcaaattggcggc

SEQ ID NO: 17155 - DNA, 533 bp, Oryza sativa
ctggtttacactatctaattactacgttttttatggtcaccaccttagtgcacaaatttgtactaaaaagggtggtaactcttaaaaaacactcttaattattagaatgtattgcatctcttctaaaaaaatctacaatcaaatttctatttagagaaatcaaatttaataaaacattgacctattcaaactattacagtggtttaaggtacaattatacactagtacagaacactacatctgtaagggctcaaaaatcacatctataatggttggactaaccattacagaccaacagttacagacgtgaagactcatatgtaagggctagagagccgttatagatgaaagttatctgtaacggctcaaaacgtggagccgttacatatgtgaaaattcagcttaaaaaaaatataaactaaactcgtaagctgttacatatgtggagatttataatagaaagaacaaaaaacatccaatctggtttcatctctgctagcctcctgctactccggccatccctgctctaccga

SEQ ID NO: 17156 - DNA, 857 bp, Oryza sativa
atcctgcttaggataactaaaaggcaccacaaattaggcggatttgaaggaggacatcaacgtctttacaccatgatgtgatgttaatatgtgtgagattttctaaaaatcaactctttgtgtgatggatggagcattcgaggataaacattcaatcaattctttgtgggacagataagagtattaaaatgaagatatgccaaagtgtttaaagaaaaggagaaaaaaaagaaaatataagcatgccaaagttttagggattagaggatagaccactcaactcaacgagattaggggaaaaaaataaaaaggcaattaactaagcatgacaaagtttggaaaaggaaattagggaaaagggaaaaaaatatacatgttaaagtttcaaaagggggaattagggaaaaagaagaaaaattgaagtcaaagtttcagaaatgaaattaggaaaaaaaatagaagaaaaaagacatgtcaaaggttaaaaaaggatattagcaaaaaaaataaaaatgtcaaagtttcaaaaatgaaattagggaaaaaattaaaatgaaaattaggggaaaattttaaaaataaatgaaattagggaaaaaattaaaatgaaaattaggggaaaattttaaaaaaaataacaataagggcccatccgggttcgaaccggagacctcttgatctgcagtcaaatgctctaccactgagctatggaccctttgctgaatttattttggattttagtttactcaaagaaatttaatggcagtcttttctaattattgtgagatggtgatataatcaatgcaaatttcataaggtcactgtcactatactaaatagagcctatatttcttcca

SEQ ID NO: 17157 - DNA, 1501 bp, Oryza sativa
tgcatactgatagcagtgtcttgttcttggtgtccatcgtcatctcccatgtcgttctttcgaaatagggtttcccctgtttgtgattgtatggctcggtcacgaggaagcagatgacgtcagcgtcgtctgtgctgatgacagggtactccgggatgacacgtgggatgccggcgtaggcgtcgagggaccagagctcggtggcgtcgatcatggcgtccatggtccatgacaacatggtgtggtcgccgtcgccgtcgatcctgagtgtccagatgttgatgacgaaggcgtggcgagaatggtcgcagagggtggcgccggggtcgccgcagcagcagcgggggaagacgtcgatgaacttgagctcgccatcaggcatctccgcgtgctctcgtcgtcgctgtcctcctcgaattcgccggcgggggcctccacggggagcggcacgtactgcagccgcgggggaatttcgtcgaacaggtcgtcgccgcagaggatgacgccgcggtacaggtcgacccagcagagccgccggtcgccgacggggacggccatgtcggtctcccagtaggagagctcctcgcccttgctgccgtcgtggatgatctccgcccgcgtgacgctccactcgccggagcggagcacgaggagcttgacctcctccagcttgctgctctcgctctccctggtggtgatgagctccgccaccacgaggtcgtcctcgccgtggcggcggcggcggcggcggaggaggccggtgctatctgcgtccagctggtgcaccttcggatcctgacgccgccttctttcgtcctcgtccaatggatcccagtaggacgggagcagcgacaacgacggcggccgtggtgggtcatcgtcgtcgccgtcgtcgtcggcggcggcgtaattgtagacgaagtaatcgatcccgaattcgtcgtagccttccttgtcgtaacgcatctcgaggagcactacggagtggtcgtcgtggtcagcgacgaggtccatcgagggtccgtccttgccgcacggggagcagcggaagctcacactacgccggaccaggtcatctctgacgggcccaaaccctcacctttgacgggtttggtcttggtcagtgattagtggtcactgatgacaaaatcacctgtgatgtatgaaacacccgtcacagatcacccatctgtgaccggtatataagtcatctagtgggggttaaaacttgtctcccgtcacagataagtcatcagtgacgtgtagtaactacctgaccgtcgctgatgactcatctctgacgggttgtaacttacgacccgtcactgatgacaaagtaagaaatataatttttgaattttaaacgcaacaaaaaacctcaaaaaaatattttgaattttactagcaatcctatacatggttacacatcactacctacaaattcacaatttttcacgcaatataacttgtatgctacaagtgagattcgaactcagacctc

SEQ ID NO: 17158 - DNA, 1501 bp, Oryza sativa
tcgcagcttcctccgccctaacccagcaaacaatatttcttggttttagatgttggcttccgttttggatattggaactgcatagacggtgagttttccccattgttcaaatctaattcatccggtagtacatcaaaatcatagggtttaaggttgcatacaacgagtttttttttccattgttcatatcacaaagagaatacaaacaacgtggtattatactactaaattttcaatactaacaattcatattagtggatcaattgtttgctgcacgctagtttgattagtctcatgtgctcagaattgatgaattttagttgcactatggccacactaacattgtcactgtcgaaggttatattaaatggtttatacatacacacactacaacttggccgttgtctacattggaccgtatagcgcttttcccatatatacgataagttagataacttttttcatggggcaccgttttccgcatatgtttttttatatataaattgtctattatattatgccaaaaacttagattgaattcaacatttatatatgtttggtaaatagttcacgctactttcacatgtatatcaagtgaatgataataacatgttatttgttttttaggcacaactacacgagccatgataattgttcttgtgtatgcgggtggtgaaatcatatacgaagagaaggcaggtgcatcatatagtattcctcccaagatcacttttcctgctatcaagtctactacgctagaagatgtgaaaaatgagattttccgtggcctagatttttctgaggttgcatattcattggttataaaagtgaggtatgatgttggggcacctggtccacattttttccagttaatccctttatacgaggaaagatcttggcaaatgatccttgaaatgacatcagcacggaccaattggcatatggtagaattgtatgttgagactgcatcaattaatattgggagaagtcatacttcaagtattggtgtcatgacaagaggaaataatgaacctaacactgctccaaccatttaaattattgagcaaggattagttaatcaatcacctagtcatgtcatctcttctgaagctaatcaagatggagaagaatcaattgtgatgccttcccttgatggtcataatgctaggaatgtggtgcaaacaaatgttgaagaggaggcttatgttggagaagagacagacaatgaaggcaatattgacgaggatgaagaccaggaagatgtggaggagggtagcgaagacgaagagaatatgaatgatagtattgcattggttaattctgcaaaatcgcagccactcatgggtaggtctggtaagcaccccgtaagtgcctttcatgacatttctgtgttgcgtcagacaagagctgatgattgtttctttggttcaaagagacactttgagagtccattggccaaaggtcgaattttttactccaagcaacacctacagtttgcagt

SEQ ID NO: 17159 - DNA, 1501 bp, Oryza sativa
tagacgattataaatgaattgaacgttacaaagttgaaaatttacaatgttaaaaaggttaaataagaaatgatggtgaagaaagttacggaaagatcgcaataatctattacatatcccagacatcgtccgcggatccctatttgaagactttttaattcctctaaaaaaactatgcgtatgtgtacatatctattttttcaacatacaatataatcacagtattaatttactcaagagccactttagatttaagtgtataatcctatttatcgtcgtaaacacggggaacaaaacatgacacgtatgggataattggcatctaagattaatcgtttaatttcataactgaactagtgttttaattttttttttgaattaaactagtgttttaattaagatgggtcgtctagagatttggttttataggaatctttttttccatgtagtcatgtattatccgtttcaacatataagtatttactagaaaaatacccgtgcattgcgacgggtaaatactgttttaattttattattgttatacagtttagttatggtaaaattcactgtgggaattcgtttcgatttatttttaaaaaatcatgagctgcagttaggagtccgacttttcatctcaagttagtaggtggagttttctaaagagatttcttatatgactgattttgtatttttaaaagcaaacgagcttaaaatcgaattcaaacacgcatatatattttcccaaagcaaatgatcttaaaagccggcttaaacacggatgacataccaaaataacgacaaaaacatattcaaattttacaatagtcactactggagaaccccacaatactcccggttcgcaaccctctcttttcctgggtatgcaaccagatactcaatctttagttccggttaaaataaacgagactaaagatatatagatctttagtgctggtttgtgggctaaatgtttttctattgtttttttctgtttgcatattgattttaagccaaactcatcacaaatcgtagatcacaaattaattcacatatcaaaataacaacacaaattcacatttcattgacatcacaaaatcacatactcaataaaattcacagattcatacacaacatcaccacacatcgcagattcacataaacaacaacaaaaaaaaaaacaagcgctgggagggagacgagctgtcaccgcccgcggctgcctaggtagccgcggccctctgcccggccgtaattgccgcggctcttcgaggccgccgcctcccgccgccacccacagctaccccttgtgccaccctcgtgccgccgccgccgccgcccctcgtgcgggcccacgtgaggccgccgcccagccgcctgtcgcggggccggctcactccgctgccgcccgccggaaggggaggggaggagggggaagagagggggccggatctgaggagaagaggaggagaaaagagataaggtgttgaagggatcgagacga

SEQ ID NO: 17160 - DNA, 1501 bp, Oryza sativa
gggcagccgcgctcacccacgtggcctgaccccctcggggggggggggtcgggcccgagggtgacatggccacccctccctctgtctccccgaggggtcgggccgctcccgtttcggccccgaggtctggggcgccccgaccccctgtggtgttggcgccacgtgtgtgggttaggtgagcacagcggcgctcacctaaccgcatttatgcgggttggacgagcgcgccatgccgcatttaatgcagcgcagcgcgctcgcttatccggtccgtgaccggtcgcagtatgtgaccggtcacagaccggtcagatcgcgggttaggtggcagcaggcggcctgtcacacgcctcgccccgtcccgtcggaatgatgagagcctccaggcactcgtccctagccggagccggcgtgctaactcctggagttagcacgccagtcccggccagatacattccaggcttcatcgcaaccattgcaaggaagtcattgtatgaagaaggacagacgtgcggcatgctaaactgacacgtggtggacaagaatgaccggtctgtgactggtctgacgccggtcacgtcatcggcagacaaaccgtgctctcacgttgcatctgcttccggcgaagtggaggtaggtatgacccatcccatcggagggtcattcggacagcggccattgcaaatctccgcccattaatgaaggaatgacagggtgatcccctgtgtcaggcgagtgacggcgctgggcctcactcaaggacaagctgtgatttagcttccaagcgaaggcgtgagccaagttctggtcaagatagggtgggtccccacccaaaagaagggtaggtagaagtggtgcatgtggtatccccttgagatataaaaggaggaccttgcccaccgaagaggggggatggagatccagaacaagaataggagggacgactctgagaatacctgagctcgtagaggagagaaagaggaagaggggttctagagcctgaactctcttgctctccagctctctgtaactccttcacacacagatccaccagaacacaggagtagggtattacgcttctcagcggcccgaacctgtctacatcgcccgtgtctcgtgcatttgctctctcgcgaatattccacagatcgagggtgaagaacctcacttagcgcccccggccgaaccggcaaaggggggcctgcgcggtctcccggtgaggagccccaagcaccgtcactattaatgacctctaagcgtgccattagatagatctcgagatttgaggaattttggaagttgaacggagtcaaacggatttacggttgggaagatattgaatttctaagattattggatttttggtctaaaggaaaaatgatttaattaaatcctttttgaaaaaaaaaataaaagaaaagaaaagagggaggcaatatagacttttctcgggcgactagggtgcggcccgagagaattggggcggtccggccgagctaaa

SEQ ID NO: 17161 - DNA, 1501 bp, Oryza sativa
ggggaccgccttccatgacttcggttcgtcaccactactgccctccccaggtccatctcgccaccactaccaccctcctagctacaaccacgtctaattgactactacagttgacggagcttggggctccttaccgggagaccgcgcaggcccccctttgccggttcggccgggggcgctaagtgaggttcttcgccctcgtcgatctgaggatgtcagcgagaagaatcgcgcaagacacgggcgacgtagacaggttcgggccgctgagaagcgtaataccctactcctgtgttttggtggatctgtgtatgaaggagttacagagagctcgagagcgagagagagttcaggctctggaaccaagtggccggagttcgaatcaaccaaacccccattcggtgggcaaggtcctccttttatatctcaaggggataccacatgcaccactcctacctactcttctttaggatggggacccaccctatcttgaccaaaacttggttcgcgccttcgcccggaaactaaatcacagcttgtccttcagtgaggctcagcgccgtcactcgcccgacacaggggacaaccctgtcattccttcattaatgggcgaagatttgcgatggccgctgtccggatgaccctccgatgggatgggtcatacctacctccactccgctgaaagcagatgcaacgtgggagcatggttgcctgccaatgacgtgaccggcgtcagaccagtcacaaaccggtcattcttgtccaccgcacgtcagtttagcatgctgcacgtctgcccttcttcatacaatgacttccttgcaatggttgcgatgaagcctggaatgtatctggccgggactgacataccaactccaggggttagcacgccggctccggctagggacgagcgcctggaggctctcatcattccgacgggacggggcgaggcgtgtgacaggccgcctgttgccacctaacccgcgatctgaccggtctgtgaccggtcacacactgcgaccggtcacggaccggataagcgtgcgctgcgccgcattaaatgcggcgtggcgcgctcgtccaacccgcagtaaatgcggttaggtgagcgccgctgtgctcacctaacccacacacgtggtgccaatcccacagggggtcggggcgccccagccctcggggccgaaacgggagcggcccgacccctcggggagacagagggaggggtggccacgtcactctcgggcccgacccccccgagggggtcgggccacgtgggtgaccgcggctgcccaatcctctagtcatgatacccccggtcccatgtcaccgacagtagcccccggcgttacgccagggcgatcgcccccctggagggaaacgctcggtcgtgacgccactccttaggtctggtgacaggtggggccggtctcttcaggcgggcagaaacccagcggtcgcaaatcgcgcacatcggcaagggaaaaccgatcgacaataa

SEQ ID NO: 17162 - DNA, 1501 bp, Oryza sativa
agctccattcccttgttttccttcttagcactaaactccacaactactgtcatttcaattttccttcaatggtccaaacgatcatatgtgaaagcgtgtatggatagaagatgtgttgtaatattttgtggattaatgtatcgaaccttgagggagtacatggtttagatcttaaggagccctgatagattcaatgacaactaatcatatcctatcataacaattgaatccaatagagttatctatactctaacaaagctgctctaacaatatatcagggagaaagcaaaatgagagaagaagatgctatggactataaagcatggtttgtaaaacttgcgcggttatcatgattatcacgtacggtgatcttctcggttcttgaatccgcgataatctttgtggtaaccgtacggtttttcacgacaatcatatagttatcgcaataaccgtgtaacgctccgcttttcgtgagacgttaaaaactaattcggcaaaaatcctaattgcgaaaatttcgttccttgagtgttgagtctaagttgtgccaaagatctcaatttaaatccctcccttgtctcgataccctgttatcaaagatcgtctcctcaaaattaccatcccaatgtagtcccgaagctcgattccttctattcggaatcccctcctggaaccccatccgtgaactttgtcgaatgtccgaacccttctattcagacttctctccaaaatccttaccctcatatctcgttgaatagtcaaactcaaactcccaagttacactctctttctctgaattatccatccccttttgactcgtctccgaatattgttcccttccttgactccttcctattctcccgagaccgagtatcaacctcgaaattcgaatctagactccaactctaaaatctcccaattaaatctctctgtgaaagtctatttaacctccctcataggttggattccttctttctttttccgatccacctcttccttctcttccatcccatctctctcggagtctcgatctatctatctatcgatcgatccatctatctatctactatacctatctatctgtttatctatccatctgtcaatccatctgtctatccgtccctctacctatcaacctacctttctgtctatctatctatccatggcattctaccgctatctcccttgttccatttttgaataatgatcttccctttttgaaatcctctgaaataatccttcgtgccgccaaatataaatccatcccaagaataccaaaattcccgcttttgaagcccttccttgacccctcccttggatccaccttgaaccctcgtgtacaaatacacaaattaaattcaaattcaatctccacatcaaacttctctccaaatcaaaccttccagtaaaagtctattttgcctccctccaactcgctcgggccgaaaccatcctcggcccatcctcttctttcgccagcctctccatcgcacgtgcgccg

SEQ ID NO: 17163 - DNA, 1501 bp, Oryza sativa
attagaattagagtatagagtccatataggaatttaaaactaactaaaatttggaataaacataataaaattaaagtagagtttagagtccgtataaaaatacaatttacaaataactaaaattcgagattaagaaaaatatgggaagaagagtttaaagtcaatatagaaatgcaatttagaagtaactgaaattcgaaattaaaaattaaagaatattgaaagataagtttagagtccacatagaaatacaattaaaaataataaaaattcagaaataaaaataaataatattggaagaagagcatagagtctatatagaaatacaatttacagaaaattcggaattaaaaaatatatattaaaagacgagtctagagtgcatataggaatatatataatttacaaataattaaaaattgatattaaaataattaataactaacacgtatataaaatacaatatgaatattacccattagtagtttcgtaaagttattgcaaaatttaaaattatattgtcaatttaatatatttgaacaatatattgagaaaacatatatgctattatatgagagaaaatataatagttcatagtgaattgtgaacactgatttaaaaacaaacagattaacaaccacatcgtttggcttattcgtggaataagctaaacggcatatttgcaaacgaaaagtaatttgtgaataaaatttttatatacgtgttcttagcaatctaaaatcaaagagtgaaaaataaacttcgatgaaaaaaacccaaaatcagcttcaaatttaaagttaaaaatttaagtttagctgataagtataagtataaacgaaaagatgatgccgtaattttctagacatgaaagatcaatagaacggattgacattttcgtaatggcctgtagatagagatataagccacgagaaggagcagtgctgctctcttctttacaagctaacttcagtgtttttatacatgaaaaatcgaattgatatctttgggttggttcggattgataacgatctccattcaacttttgctttttgtttcccaatacgttatagatggctttgtgctccatgcggtgaccatgttaggaaaaaaaagtatatggatttaggcttgtttgagctccagcttataaatcagagccaatatgaagacaaatcccaatatatatatatatatatatatatatatatatatatatcaaaaacatgagagaaacatgcaggtcacggacgtcccagggcacaaataatgttaggtcgtccacacagtaatgcggcccgcccgggcctgccattcttctgcccttttgtccgactcagcaatctttgaaatctcaacgcttaggggaaaaaaaacagcgtcttttccataatgcatctcttcaccttcgcagtataaataggaccccctctcctctgctcctgctcatcctcctctcctcttctcgctctcacttcttgtgcccaagtgtgagagcaat

SEQ ID NO: 17164 - DNA, 1501 bp, Oryza sativa
gatattaagctagctcttgccatatattctaactagcatggtggcccacgcaaattacgcgtctagcattattatatttttctctcatataatagtatatatatatattttctcattatattatttaaatatattaaaatgataacataattttaaattttgcaataagtttacaaaactactaatgtgtaatattcatattatattttatatatgtgttagttattaattatttttaaaatcaaattttagttattcgtatatatcctatatgtactctagactcgtctttttaatatttctttttttcaattccgaattttctgtaaattgtatttctatatagactctatactcttcttttaatattatttatttttatttctgaatttacatattatattttatatacgtgttagttattaattatttttaatatcaaattttagttatttttaaattatatatattcctatatggactctagactcatcttttaatatttctttttaaaattttgaattttaatattctttaatttttaattttgaatttcagttacttctaaattgtatttctatattgaccttaaactcttcttcccatgtttttcttaattttgaattttagttatttgtaaattgtatttttatacggattctaaactctaattttaattttattatgtttattccaaattttagttagttttaaattcctatatggactctatactctacttctaatattccttatttttttaattccgaatttctatttttttcttaattgtatttctatatggactctatactctacttctaatattccatttttaattccaaatatatattatttcctaattgtatttctatatggactctatactctacttctaatattccttatttttaattctgaattttagttatttcttaattgtatttctatatggactctataatctacttctaatattccttatttttattccgaatttcaattatttccatattgtatttctatatggactccagtctcctcttctaatatttcttattttttaattctgaatttcagttatttcctaattgtatttctatggactctagtctcctcttctaatattccttattttttaattccgaatttcagttatttcctaattgtatttctatatggactccagtctcgtcttctaatattccttattttttattccgaatttaagctatttctaaattgtatttctatatggactctgtcttttttttttctccgattaatgtgagaatttctaggccatgagagcgaatgtattggctcttttttttattcctttaattatataatagatagattgctggacgtgacaaatgcccagtccaaaactgattttaagtgtcacgacttccgtacaaataaggtaccaaccctaactacatgatttgcccccacgtaactacgtactagtaagagtatatggcgagagctagctagc

SEQ ID NO: 17165 - DNA, 1501 bp, Oryza sativa
tcagaatttaaagctccccaaacatacccaaaatatactagaactactggtatctaggaatatatacatgcatggttaattatcatgcatttctaatttcctctctgagagagagagaggggtatgcatgcatgcacactgcgtgatgaggagaagaaaaaatatgaatgaatgttaattatattaattttacctcctggatcaccaccaccatatgcaaatatcagaggaatattaatatatatgcataatctctcaaattaaagtggtcaaagaaattaacgaagacacacaatttaggaccatccatcggccatatgcatgccatgatcatatcatcgatcaacactaccagctgcatgcagatgcaggcacccaacttaaggtacttgttacctttctttaactgaaagtcgttggcgtttcacatgcatgccgttctctcttcatcatctatatagtacatgcattcatgtgtacgtatatgcacttttcacttcagtgccaaatcttaattaatcaacgtccttcacaataaatttaaaaaaataatcaactgctcattttgattgcctctcccagcttctccctcagtctcaaaataaactaacacagtatgggacgtggtacatcctgtattagatgtgtttattttagaatggagagagtatatgatcaagtacagtatgctttctactgttgtgtactttctgtttccaaaaccacatctaattaattaattgcagtcgtagatgcctgaactgatgaagaaactactactgtcaagttaattgacacgagaggagagaacatttgcaaagcccatgatgggctggaatgttcaaacggttggaaacagttggctgtactgaaataggctactattaggctgtggactgtcctttcggcccaaaagctacaatgggctcttagcaggctaggtaggtgttcatgtcctagtagctaaataattagatcatccttatctcaaagaaagaaagaaaatataagggcgattaggtcattgaaatacagtacttaattggtcgtttttttacgcttttgatggtaccaggttgcgtatctacaacgcttaagcaaaaaattaactttcttgataggccagtccatgcaaaatacagtatctgtgcgtattgtatcagcaatttattattaacatagagcagacagtctttataaaatattaggcagtgattgccctatgcatgattgcatgattaactagtttaatcatcagtggccggaaactagcatccaaagcttcccttggtgagtggaggagctgcaggtgggtgtggcatggtttttggcgtacgaaggccagccggcagagggcgctggtgcaggggtcccacatgtcagcagaggttgattggtggtggagcatcagtgtgtcagccatggtttcgcatgtggtgagcggcaggtgaaaacccaacccagccttggccggaccgacaacgatggttaattcctcctc

SEQ ID NO: 17166 - DNA, 1501 bp, Oryza sativa
gcttattttgggtccatttggataatgggatctgaggagtgggattgagatatggaaatgaatgaagggttcggaattagcatgaaatggggtggaagaatggatgactattgtcggtgacatgggaccgggagtatcatgactagaggcttgggcagccgcggtcacccacgtggcctgaccccctcgggggggtcgggcccgagggtgacatggccaccccttcctctgtctccccgaggggtcgggccgctcccgtttcggccccgagggctggggcgccccgaccccctgtggttttggcgccacgtgtatgggttaggtgagcccggcggggctcacctaaccgcatttattgcgggttggacgagcgcgccacgccgcatttaatgcaacgcagcgcgctcgtttatccggtccgtgaccggtcgcagtgtgtgaccggtcacagaccggtcagattgcgggttaggtggcagcaggcggcctgtcacacgcctcgccccgtcccgtcggaatgatgaatgcctccaggcacttgtccctagccggagccggcgtgctaactcctggagttagcacgccagtcccggccagatacgttctaggcttcatcgcaaccattgcaaggaagtcattgtatgaagagggacagacgtgcggcatgctaaactgacacgtggtggacaagaatgaccggtctgtgactggtctgacgccggtcacgtcatcggtagacaaactgtgctcccgcgttgcatccgttttcggcgaagtggaggtaggtatgacccatcccatcggaggggtcattcggacagcggccattgcaaatctccgcccattaatgaaggaatgacagggtgatcccctgtgtcaggcgagtgacagcgctggtccacactcaagaacaagctgtgttttagcttccaagcgaaggcgcgagccaagttttggtcaagatagggtgggtccccacccaaaagaaggggtaggtagaagtgttgcatgtggtatccccttgagatataaaaggaggaccttgcccactgaaaaggggggataaaaaaaaaagatcgtagcttggaggggggagagagaagatggtagctgggatcggagagaaagaagatcgtagcttgtagaggagagaaagaagaagagggtttctagagcctggactttctggttctccggctctctgtaaatccttcacacacagatccaccagaacacaggagtagggtattacgcttctcagcggcccgaacctgtctacatcgcccgtgtctcgtgcatttgctctctcgcgaatattccacagatcgagggtgaagaacctcacttagcgcccccggccgaaccggcaaaggggggcctgcgcggtctcccggtgaggagccccaagctccgtcatctggcgcgccaggtaggggtcgcgtgtgtctttctgagccctcaccctctttcgtgtgcgctaagcttctcccgcttagcccaa

SEQ ID NO: 17167 - DNA, 1501 bp, Oryza sativa
aaataaacttacctagctagtagtagctgcgtcccgtgtatccgttcgtgtatgttagacttaatcttgttgtttagattttgtgtgtgtgctagttatatgcatgtacatgtgagtgcgttgagtcagtttgatatgcatgctagtgaatgcatgcaaaaggtcctagtttacaggtgcacgttggcctggagttgtggtagccgagtcaattagctggagctgtctcatggatggtggatggattagctccatgcatgtgtgttagttaccaggtgatgctctacatgcaaggagatgagggctgcatgcatggacagaagtggttaattagtggctaagtcaggtgagtggtggccggttagtgccgcaaaaacgtggctagtgagctgctgaacgtgtgtgctatttcaagcgtgtaatcagtgtgtgattaagtgtgtggagaatataaagtgaagtgtgtggtggttcgctggtgtgcagcgacaagaaactgtgtattgttcatcttctttgtgtgtgtttcatcgagtgaaagggagagagctgtgtgtgtgcaagtgagtggctgggccaacagtgtagcggtgtgtaagtgcagtaatcagctgttgggtacaatgtaagtttaagtttgcacgtctttcaattcattttgagatgaaaatgcatactaattcccattttggactacaatgttctgtgtgtttcgcacacatcccgcgggccgttaccccaccttgtctgccgctcacgaactggattttttactttgaaatcggttttaaaaacttattttacaataaatagatcctgaaaaatacttatttcagatatagactacttggcatcaatatcattgatgccgtggaccaatctgatgacgtcaatggcactgacgctgaggatctatttgtaacaaaaattaaaataaatctatttgtaataaaatatatatatttataaataggtccttgaagccaacaacacttacgccgaggaactatttctaaatattttattttgacaaataagttgtttttatttcttttaattacaaataggtcttttctagttttttttccaaaaaggttattggcgacgctgtcgccttttacatcagggacttagctttcgatgagagacgaggaggacgacgccaatgttattggtgctattagattggatcatgacgccaatgttattggtgctattagattggatcatgttgccaatgacaaattttcaatggcatggataggtttgccgtggtaagagatgcagaggagttggcctggacacggcggtcggacgccttcgtctcaatcaacgcaaaccacggaaatactctggcaagttcagttgaagtccgtggtctacacttgtaagtctggatccacgagcgctgcaccgcctacatggagcgggtgcagatgtggagctcctgttcactggcttggacaaccaatggcgtggcggccaaccgttaacagccaac

SEQ ID NO: 17168 - DNA, 1501 bp, Oryza sativa
ggctagataaaattttattaaatactatgcttgctcctctattttctagaattttctgggaattatttgagcaagggaagtatttttaatagttgaaacaacatttcacaaattgttttatttaaaaaagttcaaaaaaccccttctttggtcgttgggccgaattcggcccaatactccctctctctccgcgcggccgaaccggcccatgccggcccaagccgagccgcccgccccctcctcctccagccgctgacatgtggggcccacatgtcagggccgtcttcaacctccggccgccgcctcgcaagccgcccgagccgcctcctttctcctctcaaatccgcctcaatccgaccccgattcctccgggtttttgaggggttttgttcctctcgttctcctctttcttttcccccaaaaatcaaagcgaatcgttgagtattctctccgaatcgaattcgttttgattttatccctaaaatcgagtttgatttcttcccgaatcgattcctctcgtttggagctcgatctcttcaatccaatgctatataaagcttcccctcgtcgtcctattccgtttgccccctctcccgagctctcccgtgcctcctagcgccgccgcgacgcgctccaagtccgccgccgccgccggccgtcttcggtcacgtcgccgcgccgtctccgccgtcgccgccgcttgccgtcatcgccgttaggtgcgccgtggtgagaggaacctcggctgcccctcctctttcgccgccgaccaccggagcccctccgccgccgtcgacccgagccgccgcgccgcttcttctcgtcgccggccgccgtcgtgcatcgtttctcgtagtggtgagtaccatcgggttcgtctcgatgccctctacgcgtagatgccctccgattccgcggccgacctctctagctccggcgagctctccaacccgagccggccgtcattgcgacgtcagcatgacgtcagcatgacgtcatcaccagggctgacgtcatcattagggctgacgtcatcgtttccttttctttttcttttcccgattttctaatagattaaaacttcggaaaatcataactaaataaccgtagatccgttttaggtggttcaagtttctaaattcttctaaaatcaagatctacatgttaaaaatatccacatgtactgtttatgcttgtttttgtactgttttattgattttgtttatttgctttagtttccgacgttccggaggagagcgtttccgttgaggaaggttccgaagcgtttgcggaagctcaaggcaagtcacacagttcccaaacaaccctttgagcatgttgatcccatttaaagctattattttatttcaactgtgcattgttttcgaatgtcatcgggtggtgagcctttccctattaattaatggccgaagatgactttattttcctatgggttataatttgattagcatgaaccttatatattggattggttcagcta

SEQ ID NO: 17169 - DNA, 1501 bp, Oryza sativa
ttatatatggtgcatcaatctttagtcccgattggtaccaaccgggaataaaaatagtgggacgtctgacctattttgaaccgggactaaaaatgatctttagttccggttggtaaagattgtaacattttaaaccgggactaaagatattctttagttccggttcctagttgaaccaagactaatatagattttgcatgatccagcaaaaatcagtttttcagtagtgactcaggcactcatcacatgacatgcatcatcattatcaggatggcaagttcactgtttgccctctaaagcagcaaagccagcttattttagtgggcatcagatcagccagaaagcgagagcatctgcgtttaattagtaattggtacacccatgcatgcatgcaggcagcaagcagcagagctgcatggctcttatgatcgagtgcgctgggctgcgcaagcgttagcacgtcacatgcacggcatcgatggatcgatcaatcgatcggacggcatgcaatggtgaccacatgactacagtatgagcgagactaccggccgcggccggtgttgctaatcgatcgatcgaaacgaatcaaagccgtaatgatcgtgtcggggggtacgtaagtagtaagtaccctgtggtagcatatagcaatagaatgcagccgcctttaatttgatggcatgcatgcgtgcatggcaagggcacatgcatatgtgtgaggggagcaacgacgacttcgttcaatttgctttagctattgaacttgctctcttagagcagcaaccaacagtgttctactcactccatctttaaatataaaggattttggttagatattatatattttagtccaataaatctggacagaatcataggataagtcatatctaaccaaaatttcttatatttagggatagatgaagtacttatattattttcaaaactggagttcccttctccgtatttctcactccatcaatttgagtgagaacgtatgttcccttcctactcccaatctgtttctcgcacgccaggaggaccacgcgcttggaggaaaaaaatattggtaatttaacaaaatggtccacttttaatttttaggataaaatttaggctttcttagagagatcagtttctttacttcctatcttcagtttaggaaagattattcataatctcttgataatgctcttatttgtattcacatcatcgattcaatacaagttgagagacaggcttgacccaaaaaccagtgcaattattattttttattagtttaataattccgtagtagtgaatactagactacatgtatgattcattgttgttttatcagtagcaaattagtagacatttgattagttttttacgaatgcaccactggtggagaaaccctctgtactcccggttcgtaaccccctctttagtaccggttatctaaccggaactatgaatccgggactaaagatcgctatctttagtccgggtgaaataatcggga

SEQ ID NO: 17170 - DNA, 1501 bp, Oryza sativa
caactgcggtctgactgcccttgtgccgccggtcggaccaacctcgtgccaatgatcagactggccccacatagatggcttgagtactttttaaatctggccatgttttcctatttttcttctagatgtcaaatttaggtgttaacaataagtttgatattttattttatgaaaatgattatatgaatgttatttattttattatgatttggtctatcaataaaatcactttaagtcttgcttatattttttttaattctcttttagtaagttaagtggcctaccatatgtttaaaagttattaatcttatctatatatctagaaatagaagtagtaccgactactacggagtagtacaagtccatgtacacaagtgttatactccctccgtcccataatatgagggatcttaacattttcttgtactgtttgactactcgtcttattcaaaaattttttgtgtaaatataaaaaacggaaagttgtgcttaaaatattttagataataaagtaagtcaaaataataataactagcctggtggcccgcgcagattgcgcggctagcatcattatattttctctcatataatagcatatttgttttctcattatattattcaaatatattaaaatgacaacataattttaaattttgcaataactttataaaactactaatgtgtaatattcatattgtattttatatacgtgttagttattaattatttttaataccaaattttagttatttgtaaattataaatattcctatatggactttagactcgtcttttaatatttctttttttaattccgattttttttgtaaattatatttctatatagactctatgctcttcgtccaatattatttatttttatttctgaatttttattatttctaattgtatttctatgtggattctaaactcatctttcaatattctttaatttttaatttcgaatttcagttattttctaaatgtatttctatatggactctagtctcctcttctaatattccttatttttaattccgaatttcagttattttctaatcatatttctatatagactctagtctcctcttctaatattccttattttttaattctgaatttcaactattttaaattgtatttctatatgaactctagtctcctcttttagtatttcttatttttttaattccgaatttcagttatttctaaattgtatttctatatgaactctattttttctttttctccgattaatgtgagaatttctaggccatgagagcgaacgtagaggtttttttttctattcctttaataatataatagataattttaaattttttttaataagacgaatggtccaacagtgcaagcaaatgtaaaaatctcttattttaggggacggagggagtaggaaaaaagaaaatgtacggtacagaatacagcaagctctctggccaaagagggaagaacagcaagctctccgtactacagaattact

SEQ ID NO: 17171 - DNA, 1501 bp, Oryza sativa
atcgaaatatatttagagaaaaaactgttgatagatttgtagcttttccagtaaattaatactcttgttattgacgccagagataggagagagacgagttggcattgattactactgagcatagttggcattgattactgaaccgtgataaattggtcttggtcggactggcctagacatctgaattgtttaaataagccggaagaaggcccatttaactcgaatgctcgaaataactagatatttaggcaaaaatcaccaacaaaagggggaatggtggggagttgaactcaagtgggtgggttggaagttgactcctgtagcgatccaagcattgggttgttagtgctgatatggaaatataaagcatttgtaatccctccgactcataatataatgtattttggagagatgtgacattacccagttgacggagcgtggggctcctcaccgggagaccgcgcaggcccccctttgccggttcggccgggggcgctaagtgaggttcttcaccctcgatctgtggaatgttcgcgagagagcaaatgcacaagacacgggcgatgtagacaggttcgggccgctgagaagcgtaataccctactcctgtgttctggtggatctgtgtgtgaaggagttacagagagccggagagcaagagagttcaggctctagaacccctcttcctctttctctcctctacgagttcaggtatcctcagtgtcgtctgagagtcccccttcttcggtgggcaaggtcctccttttatatctcaaggggataccacatgcaccacttctacctactcttcttttgggtggggacccaccctatcttgaccaagacttggctcgcgccttcgcctggaagctaaatcacaacttgtccttgagtgaggcccagcgccgtcactcgcctgacataggggataaccctgtcattccttcattaatgggtggagatttgcaatggccgctgtccgaatgaccctccgatgggatgggtcatatctacctccactccgccggaagcagatgcaacgtgggaacacggttgtctgccgatgacgtgaccggcgtcagaccagtcacagaccggtcattcttgttcaccgcgcgtcagtttagcatgccgcacgtctgcccttcttcatacaatgacttccttgccatggttgcgatgaagcctggaatgaatctggccgggactgacacaccaactccaggagttagcacgccggctccggctagggacgagtgcctggaggctctcatcattccgacgggacggggcaaggcgtgtgacaggctgcctgttgccacctaacccgcgatctgaccggtctgtgaccggtcacacactgcgaccggtcacggaccggataagcgtgcgctgcgctgcattaaatgcggcgtggcgcgctcgtccaacccgcaataaatgcggttaggtgagccccgctgtgctcacctaacccatacacgtggcgccaaaatcacgg

SEQ ID NO: 17172 - DNA, 1501 bp, Oryza sativa
cctatcgggattttttttcttttttttcttttttccttaatgtgtaatttgatctgtattattgttgtgaatgattttgagaatgaactatgttgttgtcaatgatttgggatgaactatatacgttgctttgaatgatttaagataatgggcgtgagatatacaaaatagcaaaaaaagaaaaaaaaactttaatcccggttggtaacgatcttactcccggttgaaaaaccgggactataggaggttaccaaccaggagtaaaaatcatttctccaccagtgacgacagctgagaacttctttatatatgagattttcatagcaacaacagtttcggtggcataaccaaacttatatgattgggaggcaccaggaagcgaaggagcgcagtatcacttggcgaatcatccaagcccaaataagtagcagcattgtgtttgccaacacgaggtgcgataaaatctctatgattaacaactgcatctttctttgccactcgaacgaggagaccatacctcatggagggcaattgagagcagacgacacacaccaaactggactagccagcttgtgcagtttgtatcaaaacataatgatgcacactgccagggtgaagggaaggctggggttatggtcagcttggatttccggtgatatcgatggacactccgactccaaggacctttcttaggaccaaaaggttttgtaggtagagtgtagtaccgtgtaccacgcaatactttttcttcgcaatattgaacaatttgttgattttgtattagtaggagcagaaaacgtttataagtttgtttacaacatcccgtcgcaccaagatatataatgatccatagccatcgcgaaaactctgttccaatgagccgtatgtgtctatgaacaagtcatgcaatgatgtggagggaagccatgtatcttatttcaattgcccacatcctaggcgatcagcttaccaattccatactttggctatcaggcattttcaggttcctgtagcacagcaaacaaaagtaattattcggctaccctctcttcttcaagagatctaatatccaaaccatgttctaaaagaggacaattattttgacaaaagtaacatgcaatacgattagtcctgtaacatcatggtatcctgatttagttttgttaaaatccatcacaatcatgacctatgttactagaacgggatcggttatctctaacgggcttaaacatcatctctttcgggcatgacccccgtgactaagcaaaggtcagtgacgtgagaaaatatctcaatcgggcaaccggtcatcacggatgacacacatctcaatcgtgccaacacaaaagcttgtcacggatgactctcatctctaacgggcctaaattatagcccatcacggatgactctcatctctaacgggtctaaattatagctcgtcacggatgagtataatcaaaaaaaataaattttgtttttttgttcgcctcaagcctttgac

SEQ ID NO: 17173 - DNA, 278 bp, Oryza sativa
atagaagcccttctctaaaaaaaatttagaagccggctaagtttctaaaaaaggcggcatatatccgttaaaaaggcatttaaatccagttggatgtagttccctgtttctgtttgatatgctaagttcctaattttaaaaaggcattcaagttcctaaaaaaggctgcatatatccatttaaaaggtattcaaatccaattctgtttgatatgctaagttcctaattttaaaaaggcatctagaagctgggtaaaaaatacccttctctagaaaaaa

SEQ ID NO: 17174 - DNA, 1183 bp, Oryza sativa
ctaaacaaacttatgtggaagcgttgtcaaaaacaaagttgtataacttattgagatctacctattttattttggttatttctccatccgagtttgattgacctatataaaatttgacttttaaattatgacaaattcaaataacatttttaaatactaaatgatttcaactgagaaagtcatcaacaacaaatttatataactcatcaatatctacaacttttgttttggtcattttaccatatgactttgttttggtaatttgaatttgaatttcaaattatgtcaactttaaacaacattttgagatactaaatgatttcaactgaaaaagtcatcaacaacaaagttgtataactcatcaatatctataacttttagttttgtcattttttcatccgataaaataatgataatattgttcacaaaatttacatatctctgttatggtttataaattatataagaggtatatacattttgtaaacaatgttacaaatcactttgccggatgaagaaatgacccaaataaaagttatagatcttgatgtgttatacaacttttatattgatgactttttaaattgaaatcatttagtatttgaaaatattatttgaagttgtcataatttaaaattcaaattcaaatttttgaaacaaagtcatatgcaaaaatgaccaaaacaaaagttgtacatcttgataagttatacaactttattgttgatgactttttcagttgaaatcatttagtatttaatttttttttttaaatttatcataatttgaaattcaaatattatatagttcaatcaaacttggatggagaaatgaccaaaagaaaaatggtagatctaaatgagttctacgactttgtattttacaactttttcatacgagttgatttagtgccataaaaatcgattcaaaatttccaatgaaaattgaaaattttccctccgcaacccttcaaaatttttcatctttcctctcccctctctctctctctcccccctctgatatttcccccttctcactctttttcttactctctcaccctctcttctcttcctctctcggcgccgagcacgagtgggcggcgtgcgcgtgccggcggctggcggccgccgcgtcgtccccgtcgctcgggctgccccctccgcggcggcgccgaccccgacga

SEQ ID NO: 17175 - DNA, 1501 bp, Oryza sativa
atgccactttcccactcatttggagcattcagggtgatattttgcaaacaaacaatcagaattagcgagcaaaagttaaaccaacacaagaacaactgaacaacattatcatgcactatgcactagaacatgttttggatgctgcaactaatatcatttccattttgctttgtagatcggagagagccgctgcacctgcaagcatcatggcaacaacaatggacataatgcacacatcacacttcttgagtgactcttcaaactataatgaaattgtgaaggtcacatctcctatatggaagctgcacagttctagcatgatttcaactaattgcttgtaagaagattatatatagaaagagagtgctatttctgggagatgggcttgacgttcatatttctatctacagctgtttcagggtatgggatatttgtgggaaacaaatctactggtaagaatctgtcaatcagcccattttacttatttttcctatgaattatcatagtataaaatagaaattcattcatatttttaaatctaatttatgttgtttgtgttttaggctgtcagaggagtagtgatgtcgacattagcttcttcatcttagtttcaatcgatgagtgggtacaagaccacaattggctcctttcttcatcttagttctaatcgatgagtgagagtgggtacaagaccacaattggctcctttcttcatcttagtttgggagtgggtacaagaccacaattggctcctttcttcatcttagttccaatcgatgagtgggtacaagaccacaattggctccttcatcttagttcaatctcatcttaagttccagttgatcagtgtgtacaagattagacacggaaacacacattttcaatttatacagacacgaaaacatacacctttttcaatcactcctttcaatttatacagaaacacacattttcaatttatacagacacgaaaacatacacctttttcaatcactcctttcaatttatacagagacaaaaacatacacctttttcaatttatcatgggcggaaacacacaccttctcaatttatacagacacgaaaacatacacctttttcaatcactccttttcaatttatagacacacaaacatacaccttttctaatttattatgggtgagaccttctaatctttacataatacttatagtaaaacacactcacccattgaattcaaacacctgttcgaatacatgtattaaaacacccttcaacccatattaaaacgccctcaaacacctcttgttcaattaacatggtcaaatcaaaattgtaataacgttcaaattattcggtattttgtgtgttctagccatactagtcgtcaacgttacctgtagtgatgcaacacagtcctccctggactaaacgcaacccggtaatgaataagaacattttgaaatcgataagtgtttcaagagaagcagagcagagcttataacacacattgaaaaattg

SEQ ID NO: 17176 - DNA, 1501 bp, Oryza sativa
cccgatacaagtgcatattagcaaaaccaattagataagagttcgatccgggttatgtacatcctatgtgtggttgggtatatgcttttcccttttgacttaatcaataattatggtagagatttagagaaaacgatcgaatgacacattgaataatcaacattagggcatgttcaatggtagagacgggtatggtctcttaaacaatacaagattatttagaaaccatatctttacaatagttaagacgacaaatgctctaatcattaactcaaaaaatattccttttgttaatattctttccatatttatatcctcatgcaaccatattttcatattatagtgactaagagtcgttgttaagccgttgtcatgcataacaacgatgttttgtctctcctctttctctttcctccatgtcaacaaatattcctaattagcaatgctaaaagaccactattaacaaccattatacatgcccttatatttctaactaatttctagctatcctgtcggtaatgcagccgtgcatatatattttttggattggatacggaaatacagaaaggggtggtaactaaagtacagtaaacattgtttcaagatagatgccactaatttttacactgtattttgtaacttgtaaatatcaaactccacaagtgatgcttagttctccgatatgacttcatttctggcatatacccttcatttggttgatatgtgcagtagacatgctctcagcatttggatgagcaattttgccgtgattgtgtgatcttgaatttgatcgctaggaggatgaacgagcaacttattaggaggatccgctcccatcttgaggtcttgattaccaagggaaattgtttacactaaacctgaaaaaaaagggagaactgatacatgtcaggatataaaaagattgaaacaaattacccacgaaccatgccagcgaccggctatggcaacgacgaacctcgtggatgaccgacagagacaacaacgtatctcatgggcgatcgatgacgacgtcgtggcgtcaaagcttgccgatgactgccgacggcgaagaacctcgcagagtatgactggcaacaatgcggcagtgactaattaacctcacggatgacaggcggcgaaatgacattgtgacgaagcttgcagcagcgcggagcaacggcaggacgttataccggcatataatttaataaattctaaaatttggaatccaacgggatatatacggagtatatctatatatatacacagaaaaaatgaaacgtctaaattcatatacatgcaaagaaatcaattcaacgtaattaatggccttgattctacctatagctcaacaaatggtttcgctcgtcactctttctttcattcctcgtagaacggtccagattaactcgtgaaatccggacggctgagatcgatcccacatcccattgcccgcactctctcgctctcccactcgcacctgcgccgcatccccaatccc

SEQ ID NO: 17177 - DNA, 1501 bp, Oryza sativa
gatctgatctaatctaatatgacgatgtagcttagctaactacaaacatctctctgaagaacaattcaaaatccatatatacttgagcatcaagcttgtgattgccgatgatggattctaatatctcggatagacgtccacccgtttcttgcatgccacctaaatgattatgaaaaaattctaaaaaaattcacaagataggttaatatgtaatatatcacttcacaaacatgcaagttcaaattcgacttgtaccagttgtcacaaaaataacaaatcaaactctaagtagtatacgtatattcacagtcaaatttgttatttttgttataacttgtagaagtcgaatttgaactataacaaatttgactgtgaatatacgtatactaattagagtttgatttgttatttttgttacaacttgcagaagtcgaatgtgaacttgcatgtttgtaaagtgatatattacatattaacctattatgtcaattttttgaaaatttttcgtaaccatttagatgacatgcaaaaaaaacgggtggacatccacccgagtgtttaaaatagtttcctgtgattgccatatgacactctcacacatattgcattgagatcagacgagcgcggaatgaggatcgccgaaccgttccaaaaaaaaaagaggatcgacgttttcccagccgaaaaatggggtcggagttttagtctccgaaccattggcggtatattttcattttgtccttttcatttttccatctctcttcgttaattttttttcccaatctctcgttccatcagcacatcatcaggatgaacgttttcctccgcgggaagcaatctggaccgctgaaatttgatcgaacggtcaggacatgcccaaattatattacacaggacccacattttacaccgagttaaagcccaggctcacgaattaggtccggtctagtacagctggagctatagcccagccaaatagtttcaatttcaccttaaatgatagtagaactgaatgtagctctcacaaaatgaaaaaaaaaaagtagagctgagtttagcatgcttcataactttatttcagattcaacttctgtatctagatttaaaagttggagctgaaacaaatagacctttaatcaacccaacaccagcacaccgccaaccgttcacacgatctggaccgtagaagcttgatccaacggtccatggtccatggataatactgaattgcgagttcgtgacaaacgtgactagctagtgagaggtgctgagaatcgaagctggtgagtgtcacgactaacaagaataatatcatatccttcccagatatcggtgaattcgttcaagtggcgtacgcaaacctcaaggttagcattatgaaaacccatatgatactagccacgaggtaattgtctgagctaattagcacaaacagcacgtgcagatgtacttcgtagacttcatatacacgcctagttgaagttccaatatcctcgaaaaa

SEQ ID NO: 17178 - DNA, 1329 bp, Oryza sativa
tttcaatagctgagaacacgtatataaaagttttaccgagaaacaaaacaaattattttgtttgttaataaatagtatggataaccatgtgaataagcaaggaaatgaggctaataaacacatgaagaattctcactatcttacatatataagaagatatatatatatatatatatatatatatatatatatatatatatatatatatgtatatatgtatatatatatgtatgtatgtatgtatatatatatatacatacatatatatatatatatacatatatccatatgtatgtatatgtatgtatgtatgtatatgtatgtatgtatgtatgtatatgtatgtatgtatgtatgtatgtatgtatgtatgtatgtatgtatgtatgtatgtatgtatgtatgtatatacatatatatatatatgtatatgtgtatatatatatatatatatatatgtatatgtatgtatgtatgtatgtatatatatgtatgtatgtatatatatatgtatgtatgtatgtatgtatgtatgtatgtatgtatgtatgtatgtatgtatgtatgaaaataatccacgtgcagcgagcaaccagctgcaagcaggcgcgcgcatacgtacttaaatatcaacctttataaagttggtccttaacttttagctctcattaaactaagaaaatcgctgtcaccagttactatggatggtagcttgagtttcaagcacacatttgagatgctgtcccatgagacatgacatgtgaaatgtttgcatgtggatcaccctagctaggattaatgagttttctcttgcccgaattaaagcgtacacgtactactatcgctttccaaagcgattttttgtaggcacctatttattattattatttttactggcagattattaaaaatcagtttgcaataataccaatgagctcctataatctcgtgctaaagagcatcgcctgtaaaaaaatgttgccaccttaaaagtgtgagtcacctcgatcggcttcttcgactagcctcaatattggctaagtccctatagcctctgttccctcaatactccttccagccactctacctcaccatcaccacccttcttgccaaaagcagctgatcaagattgagggtccttatcgttgggggcaacaaagaggagggacgaatctaggcagcgaggatggagacagatatcctcaccgtcctccccagcccacctccacactcttcctctactcctcgccgaggagagaggaggcatatctaggcaagcagcaaaggagaggggcgatggcaagcggagtggcaggggcgaagcaaata

SEQ ID NO: 17179 - DNA, 1501 bp, Oryza sativa
attggaggaggaaacatatggggaggcaaataaaaaaatggtgaaagagaaaaggaaaaggaaaaaacggtgaaagaaaaaaaaaagagtaagaaacgcaaaaagaaaataaaatggacaaaaattataggggaatcggatctacggttttttttctgccacttcttaggagaatcatacttttttattttaggttgttttttcgctttttttttatttggacagatgaaggaaacatcttcaattttttaagtagtagagatagaggtagagataaaaattaaagatgtttttgttagaattttggtacgtcatccatgtttaaatcggttttaattttatattttcatccacgcgaattaattgggaacgtgtttgtcgcccgtaattaaaaaaaagggcgaacaaatccgattccgattccccgtaaaaagggtgaaaaaaccgtccataaaaaatgaaaaaaaaggtgaaaaaagtccaccaaaagaaaagtctgattcccctaaaacgatgaaaacaagtcgttcgtaaggaaaaaaaatcgggatttgtatgcaatgatttatataaaaagtaaaaaaaaaggcctaaaatacgtaaaaaggtttaaaaaaggcagtcgaaaaaaccaaaaaaatccgtgaaaaaagtccatccaaaaaataaaaagggcgaaaaaccaagaaaaataaaaaaaagaaaaaatgccttaaaaaaacaaaaagaacaaaacgttttcgtcgtaatctctactaatgattttaaaattaaatatgtttttaccagtattgtggtacgccatccgcgtttggatcggtttttaaagtttgttcgcttatagaaatattacatgcttgcaaattttatattgtgacataggaaaatgcttttcttgtctcgaaccccacatgctgttattctattaacgtaacacatggatatggcgcacctcctcctatttttagtcggataaattgtttgtatggatgtatggtatacataatctccaaggtgcgtctttgcgtgatggtactgctgccgcttgctggagatggattttagccagccagcgacacaggcgctcgtgcgtacgagatgaaatcttacgctgacagatattctacacaaatcattactgatccatctgatatgggttttaatataagcctgactgtgagctgactttttttttgtcttgaggctgaattgcattggaatactgagaattgtgtggctcattaaaataatgtgatctattgacttcaggcataatgcatagatctatgatgatatcttttcctacatttccatataagattgaaaatctaggttgaaacaaatcgaagctcaaaacaataattgtgagatgcatggtacaaaattgacgccttccaattgacttaagggcctaatgtaaatgtttgcagagggatgatacagaaagccctgcgtcctgtcaattgctctcgcaacttattttctcatgggttcccttaca

SEQ ID NO: 17180 - DNA, 1501 bp, Oryza sativa
tatcgtcacagagcccatgcagagtatactgtgacgatgattatgacagatacacggtttggtcataaacaactgtcaacctgtgaacaatcgtcataaacagcctctgtttatgacagatatgtgttccgtcatcaggtaatcgtcatagaagcccatatttgttgtagtgccagggcgccatggcatggacccagcctttgttcgacccatccatggtggcacaccaagcgtcaccgttcggagccgggcagccgaacactgtggcccaacctcacgcgcaaatcatgacttcgccctttgccacgccatatccaaagccaaacaggccttcgcagcaaggtgccgtgaacaaggcaggggcgaaaaggggctaccgctgagcgggggaatcaagattcgtccaatcccactccagttcaagttcccacccgttccgcggtactcgggcgaaacggacccaaaagagtttctgtccatctacgagtccgcgatcgaagccgcttacggcgatgaaaacaccaaggcaaaggtaatccatctcgctctagatggcatcgcccgttcttggtatttcaacttaccagctaatagcatttactcttgggagcaattgcgtgatgtttttatccttaattttcgaggcacctatgaggagccgaagatgcagcagcatctactcagcattcgccagaggcttggggaatcgataagagagtacatgcgtcgcttctcacaggcgcgatgccaagttcaggacataaccgaggcgtctgtcatcaatgccgcttcggccaggctactcgaaggcgaacttacaagaaagatcgccaacaaggagccgcagacactcgagcacctgcttcgtatcattgacgggtacgcatggggcgaagaggattccaagcgaaggtaggaaatccaagccgagtacgataaggcttctatcgccgttgctcaagcccaagcacaagtacaggtcaccgaacaggctctccctaccattcgtcaaccccagccggcgaaccaaggacagccgccaaggccgaatcaagctcccgtaacttggaggaaattcagaaccgaccgtgcgggcaaggcggtgatggctgtcgaagaagtgcaagccctccgcaaggagttcgacgcccaacaagcaaacagccatcaccagcccgttcgcaagaaggtcagaaaagacctctactgcgcctaccatggacgctcttcgcacaccaccgagcaatgccgaaacattcggcagcgcggcaatgctcaagatccaaggccgcaacaaggagcagttgtcgaagcacctcgcgaggttgttcaagaacaagcacccccagccgaacagcgccaacacgtgcagcagagagtaatccaagtaattacaagagccgatccgccagctcaaccgacaaaacgatagaagaagatgcagctgcgaatggcgcacaacatcgcttcggtgggcgaaggggctccacggtacttgaat

SEQ ID NO: 17181 - DNA, 1501 bp, Oryza sativa
actcgatgaaccctgcaggatcgtaatcgagttgattcgactagatccctagcgatgtggctcttgcaagctccgatttcgtaggctgtgggggttgtgttggctatgagattcgatgccttaggtcctcccagggggtcccttttatatcgcagatcaggtggtctccaagtaaaacttggagacatcggaccctacacgatataccgatgaccttgtcttgtctgagtaggacttaaacactgtggaagattttcttagtatatgcagataatgtccgtgtatgcgcgggtatgccatgtcgatatgtggcgtatatcgaagggtaaggggtatacctaacccgtaaccctgacagattccatatagaaatacaatttagaaataactgaaattagaaattaaaaaataaagaatattataagaagagtatagagtccatatagaaatataattaagaaataatagaaattcgaaattaaaaataaggaatattagaactagagtatagagtctatataggaatttaaaacaaactaaaattcgaaataaacataaacataacaaaatttaaagtagagtttagagtccgtataaaaatacaatttacaaataactaaaattaaaaataaaaaaaacatgagaagaagagtctaaagtcaatataggaatacaatttagaagtaactaaaattcgaaattaaaaattaaagaatattgaaagatgagtttagagtgcaaatagaaatacaattaaaaataataaaaattcagaattaaaaataaataatattggaagaagattctatagtctatatagaaatacaatttacagataatgaaatttggaattaaaaaataagaagtattgaaagacgagtctagagtccatatatgaatataatttagaaataactaaaatttgatattaaaaataattaataactaacacgtatataaaatataaatattacacattattagtttcataaagttagtacaaaatttaaaattatgttgtcattttaatatattttaataataaattgagaaaacatatacgctattatatgagagaaaaaaatataatgatgctagccgcgcaatctacgtgggccaccatactcgtttaggtgaaactctaggtatgaaaatccatctctatcatgtcattcaaaaattgaaaatcagatgagctgttccttggaaaaaatattctgaactcctcttttgaaaccataccaattaaaatcatgcttatctttgtaccaccgaaatatatataaaaaaactttttatatatggaccattggatcgcaggctcacctcatccaacggctaaaaatccacaagggttgcctatataagccaaaccctttcggcgtgtgctctggctctgccacctcccgtctgtcacaagcaccgaccgccatttccgtttctcccttctggcatctctctccagaggcgagccgctgagacggcgccactcccctcggca

SEQ ID NO: 17182 - DNA, 1501 bp, Oryza sativa
caaacagaaacaaagtcctaatcagctcaaacgaaaacagatgggagtttgtttcctatttttgtggaatcggacatattcttttaccgcgttgatgaatcggattcgttccggttttttttcacccggtttttttgacggacgatggaagcacctcttattttttaagtagtagtagatatggtcttccttgagctataagtggtctagagcccaaaccggagtacataaagcgcctctaccaccagcattttatttttgtccggtctcggattcatgcttatggttagcatcccatatgtctcgagcaagagatatcttgggcttggcaagcatcgggaactaggcccgtccgtacggacgcacaagctgtgcgaccacgcagcattcctgaaaattaggacgggtctcttataccactgttttttttttcttgatcttcattgcctttcaaccacgttaggaatgctggcattaatctgatacacttcttttttttcatctagattctcctagcaaacaagcagatattcattcacaaccaacgacaattagagctatatcaaagaatctcatccacctacataggagtatatgtgtagtagcgtttctgctaagtagaagaagaactgttacaacaattcaattttctcttactaaatagaaaaatgaattcctatcgtctagaacacatgttcatattatcgtcacgaaatacacttctcagatgtagttataattaccatcaaccatctgtcagagttgagaaggaaacaacttggtttagccgattcagtgaacttggaagagtgaaaactgaaaaaaaaaggaatctatagatcctaaatatatcgaaagtagtagcttaaattcaaacacataattaatattttgcactacaacggtcacccacatctcaatcgggcggcaaacctcatcggtgtcagatatggcacccatcacggtgtaaaggtcactgattgggaagtcatctctatcaggcataaggccgtcaaggatgaacttatctttgtcggacctaaactgaagcccgtcaccgataggtttgacccagatgactagtcaaacaagagcccatcaccgatgacctaatcttaatcgggccacaattagtgcccgtcatgtacggatgaatacaatcccaatcggacctaaactaaagcccgtcatagatgactcaacccaatcgggctttaacttaaacccgtcacggatgaggtcattcccattggtcttaagttaaagcccgtcactgatgagtatttcccccgaaagaaaatttattctgtttttttggctagcctcagtcctttgctagctatgcccgctgcaaaatgacagaaacaaatatatttcacaatatcccatcatccccgttcatatacaatcattcacatacacatatgccattcacatatttaacacatccattcacatacacatccattattcacatatttcacacatccattattcgcat

SEQ ID NO: 17183 - DNA, 1501 bp, Oryza sativa
tttaatttttctaattttggatattattttatttttttaattctaaattttaattaatctcatattgggttattatatggattcttctttcagtattgcttatttttaattcctaattttaactaattttaaattgtattcctacttgaactcttcttttactttatttttctaattttggatttatttatttttattctgaattttaattaatctcatattgggttcttatatggactcttttttttaatattccttatttttaattcttaatttcagctattttaaaattgtatttctacttgaactctcctttcctttttaattttggatttattgggttcctatatagactcctctttccatattgcttttggactctcctttccttttctaattttggattttattttatttttattttgaattttgattaatgtcgtattggcttcctatatggactcctctttccatattgcttatttttaattctgaattttagctatttttagattgtacttatacttggactctccttttcttttttctttttctccgattaatgtgggaatttctagcccccacagcgaacgtgtacctcctttcaaagttgttttaataatataatagatttggcttcatattggtatcaaaccaaacattaattttgctctatcaaaaaaattggtagcgtcgaaatttatctaggttatggcactaccaatgaattggtagggtaaagagcactaccaataaattggtagggtaaagaaccaggcgcatcttgcaaatcataatcggttcatctcatcaaatctactagcgtagcgtagcagtttgactcttgaggaagctgcatcctttaggcctctcatagtgcaagctatggggcccgtacccccagcccaaaaaattggtcctaagacacccatcccacagtgcaagcacccatggcttaatcggatagaggcactggtaaagggtaccaagcccacagtgggcgtgaccctagcttccggaccggtggagcgaacgaaaatttatttcctccacctaccccttccaccccttcctctctcgcgtgagacttctcctctcctcgagtactactcttctcctctcacgccgggaggcgacggcgctagcagttgccgcctcgttgtcgtggtggcggcgccgccgccttgcctccttcccctccctctctatccctcgccgcacctccttctcctccctcaccgcgacgccgacgggaagccgcggcgaggaggcgtccccggcggcggcggctggcgcggtggcggaggctcgaccgggggacgcctccaccgcggcgacctcgccgagggagacctcgagcagccgccgttgccgcgaggaggagcgagtgggctgggccggcggcggatctggcggacgcggcgctcgtcggcgtgaggagcggcgagtgattcgagacagcggcgaggaggagtccccgagaaggcaccggcgcaacggt

SEQ ID NO: 17184 - DNA, 1501 bp, Oryza sativa
gttaaagctccattgaagtatatgctacatgtttagattacatttacatactatacaagtaagcaccggcatgggatatctcatcttaattggccggcaagcgtcatctgtgtaggggagcggtcccgtcacggaccaaaggtcattgatatgagaagtcatctgtatcgggtattttgccgtcacggatgacaattatatttatcttgccaaaactaaagccctgtcattgatagatttgacccaacagatgagtcaaactagagccaaactagggcccatcaacgatgagctcatctgtgataggctcatacttgaaaacgactatggtatggcgcccgtcacagatgacttatctcaatcgggcataaactaaggctcaccacggatgacacatctcaatcggctttaaacttaagcccgtcacggatgaggtcatctcaatcgggtttaagtttaagcatgtcacggatgagtattttatcaaaaaataaataaattttgtttcttggctagtctcaagcctttgctagccatgcataaatccgtactagtgcaagcattaaatccgtgagtccatgatggtatctctaattttagtttcgtttctccagtgtaagttagcatataatctaccttggcttttacctctaagcttactttctacaagaaaagaacacttattacaaccacctaccaaattttgatacttctatccattttctcctctcctatttatactgatcactacgtaaggttgcttcctcctcctatctaccaattgaaacaatacatgctctccccttgtcattacctttttcggtcttgtaacatgtacaaatcacaaagcgtgtcacatgattttagtttgagaatggggggcattgggaaagaaaaacaatgcgcttgcacctatacacgcagcagtcagactcatctactgctagctagagtcactgcctgacaaccttgggaacaacttgggttcgtgggctcatttccagccagccatggcaaatatgagttttctaggtggtctaactagcgaagaggaacagggtgattttttgactattgcggtcaccatgccctcgcactgaattaggcctagtaggcagttgaattttgatccacatgagctaatacctgaagaaagcgatccatgcaatgaggcacgatcaagaaactgattcaaagcaaagcaaaactccaaatatggatatgcgtggagtatgtcgagatgtcgtagggttatatgatatgcaaagtgccagagagcagtacaaatcaaacacattaattacctactgtgacaatggttaatctagaggtaccttttattgtatttggacaatttaagacgttaatttgtggaagatggtatggtgtgatacattgcaccggcaattcttcaattacgaaactgtaaatttctgccaagaaattacttattactactccctaccctgttttgatatgcttccatctccttttctctctc

SEQ ID NO: 17185 - DNA, 746 bp, Oryza sativa
taatattagtggaggatattgattggggattgaaaaaggtgaaactaatgggagagagagagagacagaacatcagagggagatagagacatggagatcattacagagaaaaaaaaaagagaagaggcatctacctagatcagggaggaaaaagaaaaaggaaaagaaaaggaaggaaaaggaaaaggaaaatgttgagatttttcttggacttgggatttttttttaagaatttgggagaattcatcaaattgagctccacttccaaaactcaaataaaaattaaataactccaattaacaaaccgtaaaataaaagggcggcataattaaattatttagtcaaattaaaccctttttcatttatgaaattttcattaagctattttaggcgaataaacatgaacgttaattttcaaatcgagcaaaatagaagacacgaaaaacgggacgtgacacggcggagaatcgtatacaaagaatatagtacgcatcggctgcaagggcatcggctgaggactgcatcggctgagatgggtcggacagaagatagccgatacagccgatatagccgatttcgttgagatggctgtaaaaccgtctttgggatcgatcaacggactacacaaggattaccgcgatagagataagctcacagataggcaattgtatctattaattaggatattttgaataatttctttagagatatgtttcggcaagaatctgccataaagattcgtttgt

SEQ ID NO: 17186 - DNA, 1501 bp, Oryza sativa
gtagcgactgacgttgcttttaaaaactataaaattattagaatcacggtaatgataatttaaataaaatcatgtggtaaaaatagataattttaaattaatgctagccacgcaaatgcgcgggccgctcaactagtttttataatgtctgcgcaattcaaatgacatatctgcatgtgcaatataattgccatcttgatggtagctgtcggtgacatggggccgagggtatcgtgactagaggcttgggtagccgcggtcacccacatggcctgaccccctcgggggggtcgggcccgagggtgacgtggccacccctccctctgtctccccgaggggtcgggccgctcccatttcggccccgagggctggggcgccccgaccccctgtgattttggcgccacgtgtgtaggttaggtgagcacagcggggctcacctaaccgcatttattgcggtttagacgagcgcgccacgacgcatttgatgcagcgcagcgcacgcttatccggttcgtgaccggtcgcagtgtgtgaccggtcacagaccggtcagatcgcgggttaggtggcaacaggcggcctgtcacacgcctcgccccgtcccgtcgaaatgatgagagcctccatgctctcgtccctagccggagccggcgtgttaactcctggagttggcacgtcagtcccggccagatacattccaggcttcatcgcaaccattgcaaggaagtcattgtatgaagaagggcagacgtgcggcgtgctaaactgacacgtggtggacaagaatgaccggtctgtgactggtctgacgccggtcacgtcatcggcagacaaccgagctcccacgttgcatctgcttccggcggagtggaggtagatatgacccatcccatcggagggtcattcggacagcagccattgcaaatcttcacccattaatgaaggaatgacagggagatcccctgtgtcaggcgagtgatgacgctgggcctcactcaaggacaagctgtgatttagcttccaggcgaaggcgcgagccaagttttggtcaagatagggtgggtccccacccaaaagaagagtaggtagaagtggtgcatgtggtatccccttgagatataaaaggaggaccttgcccaccgaaggaggggaactctcaggcgacactgagaatacctgaactctttagctctccaactttctgtagttccttcacacacagatccactagaacacaggagtagggtattatgcttctcagcggcccgaacctgtctacatcgcccgtgtcttgtgcatttgctctctcgcgaacattccacagatcgagggtaaagaacctcacctagcgcccccggccgaaccggcaaaggggggcctgcgcggcctcccggtgaggagccccacgctccatcatctggcgcgccaggtagggggcgcgtgtgtctttctaagccctcgtcctctttcgtgtgcgccaagcttcacccgctcagcccaa

SEQ ID NO: 17187 - DNA, 1501 bp, Oryza sativa
aacatttgctaatgacagattaattaggcttaataaattcgtcttgcagtttacaagcggaatctataatttgttttgttattagtctatatttaatacttcaaatgtgtgtccgtatacttcaaaatttttacacctaaacaactaaacacggccataatagttatatagttatataattttttttacggaagcttaaactaactataggaatcggagtaaaaaaagcttgagatggacatgaccaaacaaaccacattcacaaagtttatttctaatttaaccaattggattaagaactaatgcattaacttatttaagtaataaggacatgtttagatccgctaacaggttttttcatcctgtcacatcgaacgttttaacacatgtatgaaatattaaatatagacgaaaaaaataactaattgcacagattgcgactaatttgcgaggcgaatttttaagcctaattgctgcatgatttgacaatgtggtgctagagtaaacatttgctaatgacggattatttaggcttaataaattcgtctcgcattttataggcggattctgtaatttgttttgttattagactacatttaatacttcaaatgtgtgtcagtatatccgatgtgacagggcaaaaattttcaccctggatctaaacacagcctaagaaaattagactccgcgtttgctgggcctagaaattctcatattaattaaagtccatatagaaaaacaatttacatagataattaaaaaataatgaatattggaagagaaggctagagttcatactggtgtacaatttataattaattaaaatatggaatcagagaaaaagaataatagagacaatatagaaatacaattttaaatagccaaaattcgaaattaaaaaaatattgaaagaaaaaacaatccatatcagtatactaaaatttgaaattaaaaaaagaaaatagaagtagacgtatgagtccgtatagaaatacaatttataactttaatttataaaaataaaaattaaaaaaatactaaaataagagtttacaatctatataaaaatacaatttagaaaaaaatgaaaatttagaatagaaaataaggaatattggtagttagccgcgcagtttgcataggccgtgttcgttattaatcgtacgtaggagataacaatatgattaatatgacacgggtaagcacataatcggtgacttaattttctggataccatgttgtcgcgactttcgtattcagtcatttaagatatgtcttaaatcaaatattttattttttaactagtaatttttataaactcatatagtttaatattttttagaagacatatagtttaatttagatgatttatattttaagatccgtcatgagaaataattttataatacatatttcacatatagttaaactatatgaatttttaaaaattagtggtcataaatcataactttagctaagaaaaaaaattaaaataacaagt

SEQ ID NO: 17188 - DNA, 1501 bp, Oryza sativa
cgcggttatgggcggtcaaccagattcaccgtgattagtctcaccttagtgtaatcttttgaatttggatagtttaggtggatggctgggcctgtcgcaacgtgggatagcgttggacagcggatgattaatattaattaattattacaactgtttaaatctttcaattcctgtttataaatgctcgctttatgcaaatgaaccactttagctcttctttgatgattccctgcaccatacccctattccggtatgacttgctgagtacagtgggtagtactcagtcttgctctacttttcccaaccccagagttcgagttcgggtcagatgaaggtttctccgaggagtaggctttgtccgtgccgtcgaggatgcctgtggagtggtgttcccgctgcagttttagtcaaggcttagctcttgttgtctttcttttcttccgctgcatttatgtaagacttttatgatgtttgtaagacgtggatctgaatgtcaacattgtcgtttgtgtaccccggccggtcctggacggggattttaatgcacattctgcttgaaattctattcgggaatttctgggcgtgacacttcccatccgatctcctcctcccccttctcctcttcctcctcccatcccggccctctcctctccactactacagatccggacttcagtgacgggtcaactgtgacgggccaacgcaactcgtcaaagatgacggctaccagagaggacccgtcacagatgtgaggtcatctgtgacggcttgcacttgtaacccgtcacagatcgtctgtgatgggtcacaaccatggctcgtcacagatgacatgtcatgtcatgtcatctgtgacgggtgtagtattatgaaccatcacaaaagagaccactcatctctgacgggtctttaactaacacacgtcacagaaaacgttatctctgacgggtggtagttatgacctgtcagtgatgagtgaaaattcaaatttttaaattttgcaaaaaacctcggattgagacatgtcctatataaaagttatagctctcgatgatatccacaactttataactaacaacatttctattagagatcgtttacatccctgaacatgcattacaagtgatcagatctacttttaaaaacaaaattttgagttttttttttcaaatgacatggatggatacatgctccgtatcaaagtcatagaactcaaccagatctacaatattataattgaaaatattttcatttcacagagtttacatgttcaaaatacatgttataaagtgagatatattttgaaaaatgaaattttgaattcttcaaacaacattggatgaagatattttctatgtaaaagttataaaacacgatgagatctataattatttagttgataatattttcatttgaagtcatttagggtgttaaatatatgttaaatgattcagacaagcatagacaaaataataacattgggtgcatagtcaatatgtgc

SEQ ID NO: 17189 - DNA, 1501 bp, Oryza sativa
tcctcgtactagcgtaccccaataccctctctatctggtctacgggtatcccccgtcgacagtggcgcgccaggtagggggacttggtgctcaaggttctactactatgacatccagcttcgccgacaacagcgtcaacaccaacctcaaccaaggagttcctacttcaacaacactggtgtggactcaagtcggtgaaatcatctttccggtttacaccacagtgccgatctcagctggtccgccaatggccagaaacgagaatgcagtggctacaacctggggcgactccatgtcgaaggatcctcccaccgaagcggagatcggaacgtcgacgacatccgagcccgagaaggatcctaatgcggccaagccttgtattcccaataggaatcacaagccgacgaggattacttccgaggtgacaaggtcctgatgtcctatcacaaaaccaggaaacacaccctgcaagcctgctggatctttctcaacgtccatgctgaaattcgtgcctgcaaagagcgtggaattcagcgtacctctccaactcatgatgtctattgtcctattcacaagacaaagaatcacgacctctcgagctgcaaggtctttctcagcgccatgaagacgccacctcctaaggtccagcagtcacacatccccatcagggatgaagacaaggaacagggagcgacgccattttcagatcgatttgttggggtaatcgacatcgatccccacaaaccatcagtcttgcactttctcgaagactatggatcatcgacaacaagtatgccgcatgaggtattggctatcgacgatgtcggcacgtcagcagcaccaatacggaagcggagaatcaagtgactactccggcccagcacatcagagccgtcaacacaatactgagggaaaccccctacgatcctgttctgaacgacgatctcgcacgttggacagaacgactacgggaatcaatgaccaacctcaacaacgcgttcgaagagaccgctgctgcagcgcacccggaacagccaccaactggcgatgctaatggtgaagaccctgaacggcgggaatcgcctcatcgagccacccctccgcctcgcggcaccggcgatctccgcgatcacctgaatggccgccgagaggcacgacgcacacgagacaacgagaaccgttcccggcgtcatgtctcttcacggtgtcatgatgacgaagatcgaggaggccgttcaagcgaagaccgagaccatgataaccgccacaatcacgacgatcacgaatggcaggtgctgggcgatactggtcaaggacgtcgccataatgatgacgatgatggagacgacgacaggattctcgagaacccagccgacgtcctcgtaataatacgctggaaccaagcgacccatcgtcatcgtcatcatcctcgtcatcttcatcatcagatagacatccacgaagaacgtatgatcgccgacaacccaccgcccccagcgct

SEQ ID NO: 17190 - DNA, 1501 bp, Oryza sativa
accaggtgaaccagcccgcggcggcgaggagcaccgccgtggcgacggacgcccagacgtggccgacgaacaggtagagcacgacgacgacgccgacgaacccgctccacagcagcagcagcctcgagcagcggtcggtccgcgccgtggccgggctccgccgcaccaggttgatctcccacgcgccgttgctccgccggcgaggtgcgtccatggccgctcgccgcgtgtagacaagtgtaagctgactagctgattaattactactatgtggctaaccgtggttgggcagaagtaatgtttgtacacatatatatatatagtactactttcactaatgtttggatgattattgattattaaaattgatgtgaatttactagaaaaggaatgggagaaggcatattcgtgcaaatgatttggtgatcgactaagacttggtgcttcgtgaggaagtaattaatctaggtggcagtgtgaagcatgcatgtggatgtaggagcgggcagccagttgaccaaggttgtttgaagcatattgttgcattgaattttgaattcattctttgtaccattgaatacttatcacaaaaaattcagctattcaatcatctattaacttattaaaagaatagaaaaaagagcctccacgctcgctctcacggtctagaaattctcatattaatcggagaagaagaaaaacagagtccatatatatagaaatacaaattggaaatagttgaaattcggaattaaaaaataaggaatattggaagaggagactacagtccatatagaaatacaactaagaaataatagaaattcagagttaaaaataacgaatattagaagtagagtatagagtccaaatagaaatacaattaataaataatagaaactcggaaaaaaaataaggaacattagaagtagagtacagtgtctatataggaatttaaaactatttaaaatttggaataaacataaaaaaattaaaagtagagcttagagttcatataaaaataatacaatttacaaataattaaaattcgaaattaaaaaaaacatagaaagaagaatctaaagttaatatagaaatagaatttagaactaactgaaattcgaaattaaaaattaaagaatattgaaagatgagtttagagtccacatagaaatataattagaaataataaaaattcaaaattaaaaataaataaaattagaagaagagcctagagtttatatagatatacaatgtacacataacgaaaattcggaataaaaaatactaaaaatttggaattaaaaaaaaagtattgaaagacgagtctaggtccatataggaatataatttagaaataactaaaatttgatattaaaataattaataactaacacgtatataaaatacaatataaatattacacattagtagtttcgtaaagttagtacaatagaagtagagtatagagtccatatataatacaattaagaaataatagaaa

SEQ ID NO: 17191 - DNA, 1501 bp, Oryza sativa
gtggagcatgggggcgtggtgccggcgacgagcgacgacgaggaggtgctgcccgggctgctctatttcatgctcctggcctccatgcggcggcggtctctacaggcggcgtcgacgacctccgcttctttcttccgcaagctaatgagctggtggtcgccaccgtcgcccgctggtggtcgttgccgccgctcctttttgcaatgctctctctccaaaaccgtgctccaacaacgacgggcaatgtttggatacaaattaatcgtcaaagctatcgcattcacaggaattcagttgcttcctcgaaattttgcaagtctattgtgatattttaattcaacttgtgtctgtttgccagctagtttggatagacacatatagaatattcatagtcataccatcagtcaaatgcgtgtgaaggtgtgcactccaccgggagagcacctgcccaaatgaagataattatcccttaattatggagtacttcttaacaagctagatgcaacaatacgtttagcaaccttggtcaactggctgcctgctcctctaaatgttttttttaaaaggatgaactagcatggtgatccgcgcagattacacggctagcatcattatattttctttcatataatagtataaatgttttctcattgtattattaaaatatattaaaatgataacgtaattttaaattttgtactaactttacgaaactactaatgtgtaatattcatattatattttatatgcattttatatgcatgttagttattaattattttaatatcaaattttagttatatctaaattatattcctatatggactatagactcgcctttcaatatttcttttttttattccgaattttcgttatgtgtacattgtatttctatatagactctaggctcttctttcaatattatctatttttaattctaaatttttattatttctaattatatttctatctggactctaaactcatctttcaatattctttaatttttaatttcgaatctcagttacttctaaattctattcctatattaactttagactcttctttctatgtttttttttaatttcgaattttagttatttgtaaattgtaatataaactctaagctctacttttaattttattatgtttattccgaattttaattagttttaaattcctatataaactctgtactctacttctaatattctttatttttaattccgaatttctattatttcttaattgtattatatatggactctatactctacttctattgtactaactttacgaaactactaatgtgtaatatttatattgtattttatatacgtgttagttattaattattttaatatcaaattttagttatttctaaattatattcctatatggacctagactcgtctttcaatactttttttttaattccaaatttttagtattttttattccgaattttcgttatgtgtacattgtatatctatataaactc

SEQ ID NO: 17192 - DNA, 1501 bp, Oryza sativa
acgcaggtggtatttggaaatgaaatttggggagagtggcatttgagaactggtatttttagaggatggcaaaaagtaaattctcccgaattgtgttgggccgtttctataagagaagggaaaagtagagatgaatttttaaggaggtatcttatcgtttcttgcatgtcacctaaatattgtattatgtccggttaggatgatctggcacatggaatgagcggcatgagctgaatccacggactatgtgcaatgcggttttcgctcaaaaaaatgcagtgcggatggcaaatgcctgcctgctgtcacggcgttggacatgccctgccgtgcgcagccgacatgtagcactgtagcatataccttttttattttttaaaagtactttgaccattttaaaaaacttattttacaaataaatctctaaacaaacttattccaagaatatataagatcattttctcgattcctagacatgaggttaatatatgaacttcactgtcgccgccacaagccttcctcggtactggtggtgttactacaattgttgttgccaccaccgtcgttatcatggtcattgttacaaggcaccatggctgacatacaatgactcgatgccaaaggggatggaattggtatgccgttgccaagcccaccaacgagggccctcgccgccaaacgcatagacctccgctccctgttccgctggtcgccgattttgaagcaataaacgatttcagttgaaaaagtcatcaacaacaaagttgtataactcatcaagatctataacttctattttggtcattttttcatccgacaaagtgatcgtaacattttcacaaaatttacatatctctctctatagtttataaaactatataacagatgtacattttgtgaacaatgttacacataactttatcgtatgaagaaacgaccaaaataaaagttatagatattgatgagttataccactttgtgattgatgactttttcagttgaaatcatttagtatttgaaaatattgtttgaaattgtcataattttaaattcaaattcaaactgtcgaaacaaagtcatatagaaaaatgaccaatacaaaagttgtagatcttgataagttataccactttgttgttgatgacatttctatttgaaatcatttattatttgaaaattttgtttgaagttgtcatattttgaaattcaatttgaaactattcaaacaaagtcatatagaaaaatggtcaaaataaaagttgtagatcttgatgagttctacaactttgtttttggtaactttttcatatgagttaatatagtgacataaaaatcgatttgaaatctaaaaagccacatgcaaaaaatcaatttttgcatacgggtggttaagtggcccgcatgtaaaaatggtccctcttccttccctctctaccagttcaaaaatttcacaccaaaccttatcttctcttcctctcccctcacttattatctcctctct

SEQ ID NO: 17193 - DNA, 1185 bp, Oryza sativa
cccctagggtggcggatccggccttcccgaagacggcgccgcctgatccgccgccgctcccgccgtctcgtcgtagggcgtcgccaccgcggctccttgctgccgtcgcccgctccctcctcgcggccgccgctacgcctccttgcttccgccgctactcccgccatctcgccatcgcccgctgcctccttgatgtcgccgcccgctcctcctagctgccgccgccgccgctcccaccgtcgcccaccgcctcctgccgccgcccaagtgtgagagagagagagagaggacttcacggcggtgaggagggggagcggcagtgaggagggatggcagtggtgccgccgcccgagggagtcaccgacgacggagggatggcgggggagtgagaaagtgagagagatagagagagacgagagatgagagatctacagagagagaggagataataagtgaggggagaggaagagaagataaggtttggtgtgaaatttttgaactggtagagagggaaggaagagggaccatttttacatgcgggccacttaaccacccgtatgcaaaaattgattttttgcatgtggctttttagatttcaaatcgatttttatgtcactatattaactcatatgaaaaagttaccaaaaacaaagttgtagaactcatcaagatctacaacttttattttgaccatttttctatatgactttgtttgaatagtttcaaattgaatttcaaaatatgacaacttcaaacaaaattttcaaataataaatgatttcaaatagaaatgtcatcaacaacaaagtggtataacttatcaagatctacaacttttgtattggtcatttttctatatgactttgtttcgacagtttgaatttgaatttaaaattatgacaatttcaaacaatattttcaaatactaaatgatttcaactgaaaaagtcatcaatcacaaagtggtataactcatcaatatctataacttttattttggtcgtttcttcatacgataaagttatgtgtaacattgttcacaaaatgtacatctgttatatagttttataaactatagagagagatatgtaaattttgtgaaaatgttacgatcactttgtcggatgaaaaaatgaccaaaatagaagttatagatcttgatgagttatacaactttgttgttga

SEQ ID NO: 17194 - DNA, 1272 bp, Oryza sativa
tgtagcatgtcgatcttatgccagatctgaaatattggtgttcttagtatgtgtatgcatatttcttatgctagatctgaagaaatgtcaactccgggaactagctcatcacctgctggaggtgctgttgctgtgacctctcctacgccttcaccctctccttccctagcaccagtcacaacacccaacactaactctaaagatactaatgtgatagagatagatgatgatgttgcagtagggaacaaaagaaaactaaaatatgctatttggcaagaatttggacaagtaaaggtcggaaatgtgtggaaagctaaatgtagttggtgtcaaaaattgctctctggtgagacaaagaaatgggaaaacacttaaaagaatcacctcaaaagttgtcagtctcgacaagctagacaaggccttaaacaatccaccctcacatttacaaataactcaacaggtggttcagtgataacaatccggtccaggtggggttggccgaggcccaacaaattaaggttgcccggaccccaacagttcttaggcccacccactcagggaaatgcctaatctccctaaaagactagtccaataggggaagggtggctctcccttttaaggtggcttcctcctcccaagttaagcaaggtgggattattcagaggctcacatggtcgccgcctgacttttgcgtctttgccaacgggtaatagcagaggatgtccttatcattcccacccccttaacaagctaatcaaggtgggattattcagaggctcacatggtcgccgccccttaacacccccttaacaagctaatcaaggtgggattattccgccccttaacacccccttaacaagctaatcaaggtgggattattcagaggctcatatggtcgccgcctgatttttgcgtctttgccaacgggtaatagcggaggatgtcctcatcattcccacccccttaacacccccttaacaagggcccagctctaataccaaatgataacaatccggcccaggtggggttggccgagacccaacaaattaaggttgcccggacctcacagttcttaggcccacccactcggggaaaggcccaatctccctaaaagactagtccaataagggaagggtgactctcccttttaaggtgacttcctcctcccaagctaagcaaggtgggattattcagaggctcacacagtcgccgcccgacttttgcgtctttgccaacaggtaatagtggaggatgtcctcatcattcagttat

SEQ ID NO: 17195 - DNA, 1501 bp, Oryza sativa
tcgacggaaaattgagggagaaatctatcgagtttttaacggttggatccgcgctgagatccatgttcaccgttggatggcgcatgtggggactcatcccgtgattggtaggatctcgtgggcgtactttcgtactggattaccgtgggttttgtatatttagaaaattgagagaaaaatatatcaacatttaaaattttggatgcgttcatattcatcctcaccgttggatggtgcacctggagactcatcccatgattcggaggatcttgtgagtgtgctttcccactggattatcataggttctgtatatgagtatattttccatccttgagaaggtatcatgaggcaccaatctaatctaatcgttgatttagcaggggtatgatcggactaacaaaaagaggtgtcctttcttcgtcgtccatgcccatccagcgtcgtcgtcgccaatcgaggccaccgccgccgtcgtgcatccagtcggtcaccggccgccgccgtcgcctatccagcccgctgtcatcgtcgccgttgttgccgtcgcccatccaattggccgcctgccgccgccgccgtcgtgcatctagccggccgcccgcgtcgcgcgtccagccgccatgcatccagccacccccgccgccgccaccgccgcgcgtccgtccgccctccaccgtccccctcgagcttgccgcgtctagccccctccagccgccgcgcatcccgccgccgcgcgtccgtctgctcgccgccgtccccctcgagcccaccgcgtccagccccatccagccgccgccgctgccatcacgcgtccaagcgcccgccgccgtccccctcaagccagccgccacgccgccgctgtgctctctcgacgttttttctttctatcgtgaaacagtaaaggacagaaataccctcccacccatagcaccacttcaatgaggaggtgcaggaccatgaggtacggacgatttctgaccgttggatgatgccagatcaatggtcaggatttggtactgcacaacctaaaggacagtaaaaaatctctttatatatagttgtacgtaacttgcagctaaattatattgtaattatatactatttacattacaatggtattataattatattgtagttatatttggtataattttaaaaaactttatgtttatcagctcctttttttaaaaaaatatccagattgtgtaccagataattttatgtttcaccaaagcaagtttatctagccatcgtttctctctcgttgagcaggcccgcacggcgcggcgccactcgcgcctcccacctgccacgtaagccgcagactaacggcgttcggccgtcaactcctcacggacagggatcagcgacagcgagcgtggagctacataacgccgtcgtcgtcgtcgccgtcgccgctcgctcgcgctgcgcggcgcggtgacgtgacgagctccgatttgtcggccgcggacgaacaccttgtcgtcgcaactcgcaa

SEQ ID NO: 17196 - DNA, 1484 bp, Oryza sativa
tgttgctgaaatgatgtgctgttgttgatgctgctggcctactgctagttgtgatctgctgatgattgcttgccatgctgctgctgatcacgctgatccgaattgatactactgatctgctattgttgaaaatgatacgctgctgttggttcttcaggtagtggtgttgcttgattgccgacaggatcagatttgctggtgtgctactgcatggagagggccgatagagaggcggtgcccgcgatcaggagccggtgaggagaaacatccaggggtcttccggctagctctacaagttggtggactagctggcctgggttcgaaaccccatccattctgtttatttgatattatgtcattccttgtttttttatcaggagtcggtgagcgtgatctcgcaggagcgagaggcggaaacagatttcaattggtaatttttgtagttttaggtagtcaattttggccaatctcttagctagattaatatcttaatatcataaattctatttagaattttcataaacaaaattttggaatacttttggtgatgctcaagagtaccgttccatgaatcttgcttggaaataagttggaaatattattcatattcgatcgatcgggccatgttgtcccacttgcacacatgcatggcagattagggtcgatcagatcacatgtacacagaaatatgcgttgattaacatggcatatataatataatgcatgaatggtacgtacccatagcatatcccatagttatatcaacaaggatgttgatcagctgtgatgtggtgatgccttcactcgaggtgtttcatctgtgctctcccatggcaacccctgatggcatcctccgtcgacctggttttgttatgaccagttgcatagccggcaacatcatcggcaatcgcaggagctcgccgcgcgcgccggtaaaatcgagcggaggtgagtcaaatttaactagcttacaaatcttcataggtttgaggttgtagtgaattatactataggaattctgggcttctgtgacgattatagtatgacgataacaacctgcttcctgtcactgcctgctcgcagtgacgaaatggctgtcatcacagaaggtgggtcactaaccatcttctgtgaccacaagaggacatcgtcattgatacagtgacgataattctcctgtcactgataaatgacgagacaaattcgtcataacaaattgaaccgaataacgccacgtgtatgatgacatgtgatgttgcaaatgacaaggcgggtgatgtggcaaatggcgtggcaattcacattcggcccatataacatgggcttttttattttcaattacaattggcccaaatatatttttttgacccagctacaaatttgcttttatggtttttttttcattatagcccaacattacaattctagcctatgggccagcccattaaaaagcaatcacagaatataaatcacagctatttgta

SEQ ID NO: 17197 - DNA, 1501 bp, Oryza sativa
ggacatagagagggattttaatttgttttctatttatattaataggataaatgtattaaaattagttattgagctccgaaattcatgaaaaatttcagagaataatttagaccacgtagaatattaaaaaaatattcccggacgtgatttttaaaggaaaattttagtttcctcattaattcacttgattaaattgctttaacttttaatatatttttctcgaaatgcattatataaatctgtgacgtttgctttttgcccttcagaacaaattaatattctacacaatgtcccattgaaatactttatgacgatttttagttggtattaacgacgaatacttttttttccgtcactaagccaccccatctcatactaatcgccatatttctgattttttttcattcataaaatgagactagagatgacttcaatccaaaaatcctaatatgagagactagaattgatgtagacaagaagagttaacctaggacaaacgatttgtggtctagtagcaatgtagtataataagattttttttgttttaaaaaaaattataatagttctatattttatgacgatccactattgtcatcgtgctatcgtcacagagcccatgcagagtatactgtgacgatgattatgacagatacactgtttggtcataaacattcgtcatactgtgaacggtcgtcataaactgcctctgtttatgacagatatgtgttctatcatcaggtaatcgtcacagaagcccagatttgttgtagcgacttaagtagcatcttaaagatctgagttcaaatttttataggagcgaatttcagattggattatttcaagtgctaagttttcaatttaaaaggctgctatatccgattggacatagaggtcgggtaaaaaaaacctcttaaaaaaagtaaaattagcttacaaattgatgcacaaatgtagtcggtcagtatatttatgcacattgatgcagaaactgaagccacgaaaacatattgtttctttgaaaatggaaaaatatttctatttctacgttttgctaggtcattcgcggcaacagaacaaattcgtcttacaatttgtttctatctgcatatcatacaatattccagcagtagcacgcagagcttcatcaagtaaataaataaatttagtaactttgatttggactgtcatttccaaaaatgccagtcaccttaattttcatccttttgatggcaatcaaatggttctcatcactctcctattattcatttaaataaagaaccatcttccttagacgaaaggtactaaactacaaagttacatgaaataaaattataattcataaaatttacaaaatttcattcaagatttttatttaatttgcatgtaattttcttcttcatttataaagtatagatatggagaaaaaatataaaaggggatcgttttatcctctctaaaatctttgcaaatttgccatgcctttgccagccgaatctgctgc

SEQ ID NO: 17198 - DNA, 1052 bp, Oryza sativa
tgaaatcatttagtatttgaaaatgttgtttgaatttgtcataatttgaaattcaaattcaaattattgaaacaaagttatatagtaaaatgaacaaaataaaagttgtaaatcttgataatttatacaattttgttgttgataacttttttatctgaaatcatttattacgcaaaaagttatttgaattcagaggagggagctaaaatggacttctcggcgagggaggattaaaagggctgggccggcggcccatagagggaggaggagggagagggagtctgcgggctgagagagggagagtaatacttgggccgaaaaaggcccaaggatagagagaggaattttaatttttttccatttattttaataggttaaatgaactttgtggtattaaaattagttattgacctccgaaaattcacgaaaaatttcaaagaataatttagaccacgtagaatattaaaaaaatatttttggccatgatttttaaagcaaatgtttttgtcactaagcctccccatctcatactaattaattgtcataaaatggaatgtgctaataacaaataactccgatgttacgaggaattcttcacagaaggtcatatttcttgtagtaatgcaggttcaaaccaacttatagccattttagtttgtttttttttagttttttcattcaatcataaaatgaaacgccataattttgattttttttcattcataaaatgagactagagatgacttcaatcctaaaatcctaaaatgagagactagaattgaagtagacaagaagagtacacctaggacaaatgatttatggtctaggagcaatgtagtataacaagattttttttgtttttaaaaaatataattgttctatattttatgacgatccactattgtcatcgtgctatcgtcacagagcccatgcagagtatattgtgacgatgattatgacagatacacggtttgatcataaacagttgtcatcctgtgaacagtcgtcataaacagcctctgtttatgacagatatgtgttctgtcatcagg

SEQ ID NO: 17199 - DNA, 821 bp, Oryza sativa
aactaaatgcccgattgagatgaggtcatctgtgacgggctttagcttaggcccgattgaggtcactagtcatctgtgacgggctctagtttaggcccgattgaggtcatcagtcatctatgacgggctatagtttaggcctgattgaggtgagtatcatctgtgacgggctctagtttaggcccgataaaggttagtagtcatctgtgacgggcgctagttgtggcccgatagagataggtcatctgtgacgggctatagtttgactggtcgtctgggtcaaagctatcggtgacgggctttacttagggcccgattgagatatattcattcgtgacggccgtttgcccgattgagataactcttcacatcagtgacttctagcctgtgacggacgctgtgcccgattgagatggggcttaccgcccgattgagatgagggtatccgttctagtggatgttttattatttttttcctttttactcctagcttgattgtcgaaaaaatatattgagaattacttagtaattcccgcaacaaagtacgggaaatcacctagtaaaatagcaaatcaagccttaggcgtgacaaaaatgaaaatgcaaactgcatgcattttgtggcttccttagtaactttgtcctactcatatacttcatttgataagcccaacgaactaaggatagcacacgtgcgaaagatgaatcaacgcgattgtgttcttgtaatatgccattgtccaatgcattgtgaacccaacaaaacgctgttacttatagaagattcacattgcttacgtacaaattataatttacaaaca

SEQ ID NO: 17200 - DNA, 1501 bp, Oryza sativa
gccgtgtaattgcgcaggccacctagctagttatattattaaaggaatagaaaaaggagcctccacattcactctcatagcctagaaattctcacattaatcggagaaaaagaaaaaacagagtccatatagaaatacaatttagaaatagctgaaattcggaattaaaaaataaggaatattagaagagaagactagagcccatatagaaatataattaggaaataactgaaattcggaattaaaaataagaaatattagaagtagagtacagagtccatatagaaatacaattaggaaataactgaaattcagaattaaaaataaggaatattagaagtagagtatagagtccatatagaaatacaattaagaaaaaaatagaaattcggaattaaaaaataaggaatattagaagtagagtatagagtacatataggaatttaaaactaactaaaatttagaataaacataataaaattaaaagtagagtttagagtccgtataaaaatataatttacaaataactaaaatttgaaattaagaaaaatatgggatgaagagtttaaagtcaatataggaatatagtttagaagtaactgaaattcgaaattaaaaattaaataatattaaaagatgagtttagaatccacgtagaaatacaattagaaataataaaaattcagaaataaaaataaataatattggaagaagagcatagagtctatatagaaatacaatttacaaaaaaaatttgaaactaaaaaaagaaatattaaaagacgagtctagagtatatataggaatatatataatttacaaataactgaaatttgatattaaaaataattaataactaacacgtatataaaatacaatatgaatattacaaattagtaattagtagttttgtaaagttattgcaaaatttaaaattatgttgtcattttaatatatttgaataatataaggggaaaacatatatgctattatatgagagaaaatataatgatgctagctgcgtaatctgcgcgggtcactatgctagttttattaaatattgctaacagccattgttgacttacttttttttttatttttttgacaccttggaatgccacgttaacctccccagttcaaaaccatctaaaacaggagttagggggttaattgtctagtatgaaaagttgatggtattggccccgtttggcacagctctacctcccaactccagcttatctggagaactgtgccaaacggtactgtcatggttacggataaggcatacctcatatcccacgccttatggaatatacggatacggtataccttcatgtatacgatatgtttccgtatgcgataagggaatttacaagatattatggaaaatatccttatgggcaagtgattatcagagtcctattcagagaggattaggtttattctatatcgtgcagggtttgttgtctctgagttctacttggagactaaggcaactcac

SEQ ID NO: 17201 - DNA, 1501 bp, Oryza sativa
tttggaaatatggggaaacatttgattttttttttaaaaaaaaatatccaccataacaagtttttcctacatagatgaattaggcattttcttcttttttttcaagagtgacatggaaagttcttgaatttggttttcaatgtttgtgtggaatttaaatccatttgctttaggcaaaaaactaaatccttttacagtgaacatgatctctatgactgacacaattcaagcatttacacatgtttattgtaagataagcagtaaaccactgtaccaagtgagtgcaagcaaacaacaaggacaagtaataaccaagatgcatgtgctacaagaacctcaatgtacgaagcagcaacatcagagtgcttctcgttcgtccttgcaatgaagatgtcccagaagacagaccaccactccaagaggaaaccccctggggcatcaattgctttttttgcaaaacaaaagctgacatctttcagtacaagaagattaaaatcgcattcattacaatgcagaaacatcagagactggcatgcataaatcagacaaaacaatgtggctgtagtattgttcctttgtatctgcccggtacgagtagctaataatactcgtgtctcgcacatgcacaaatgtaagtgtagtactaatcaagctaatcaaatgatcaatttgtaaccatcctattggcccaagaacaatggcagtctgaggaacaaactatctggtcctaatgcagaaagagcaaagattgcaaactacagtagtatgacaaaattcagaaattgatgcactgaccaacaggatcggaagacacgctgccttctgcttggaatgccttggcagtgctctgcaggttcctcttcaaaagataatcatggatgtacacgtccaacctgcttccaagaacagacatggataagttcagtgcggggatatataataagtaaaaaaggaaacatgggggtttgcatgcaagcacagcagcaacaggaaggaggggatcgaaagttttcatgagaaaataaaaaggtaaaatgcagattaaagtgtgaaagagcaaataaatttcgagaaatgaaaaggcagttgcaatgcaaggtaaaaggaaaaggcagttgaaaagctagcaagcaataaaccaaactagtactgtatccgagaaaaataaaaggaacaagaggaacaagaaaaaaaaaagaggcatggcttttgcaaaaggagaaaccaaaatgcagaacggaaaatgcagaaatttcagggaactcaaacagaatctcaagcgtctgcagccctctgaaatacaacaacaagggaagatgaaggacaagattcttgcaaaaatcaccagaaaaaaagacgatctaaaccgccaagaaacgaatccgaaacccctcccagaggaaaacaagaaactaatcttggggaaagataaccatgcggacaccaagagaaccaaatggaatgacaaaaaaatctcaagacaaaacggagaacatttcac

SEQ ID NO: 17202 - DNA, 796 bp, Oryza sativa
catttcccacattcatattgatgttaatgaatatatctatctagattcattaacaatctagatagatatacgatagatatatgagtctatattcattaacatcaatatgaatgtgtgaaatattagaatgagttacattgtgaaacggaggaagtactaatgtaagtgcatgaacccaacctttgtagttatatacacaatatcaattgctaagagctagtatttattaactcttaccatcattctgatagatgctgctaatacaaagtgatctttttcaaaaaaaaatatatatttcttcattatttaccagcaacaaacaatattgtttgataatgcatggccacaagtttccctttcttctactagcaaattaaagcagcaatgagattatcatgcatgaggtgatgagggggcatgcatgcatatagcgtattgcaacctgttggtccacattatggacatgcgcgggtgtggttgtgctgttttgtgtgactctagtaccgtggagtgcgagattagcgggagctcaatccctaagcaagtgatgcttagcttgctaagctagatagccatccgagcatgcaggaactgcacgctcattaagcaagaaagagctagtagttggagcagcaagagaggcatgcatgcaggagcgcatgtattgcatgagtgtgatgtgcaaccgtgcgtggattttttttttcttttgaagaaatgcaacccctagctttgacggatgtatccgcaccgcacatgcacacactcgtttctatactacttaaaacattagaaa

SEQ ID NO: 17203 - DNA, 628 bp, Oryza sativa
ctttgccggatgaagaaatgacccaaataaaagttataaactattagagagatatgtacattttgtgaacaatgttacaagtcgctttgccggataaagaaatgacccaaataaaagttatataccttgatgagttatacaactttgatattgatgactttttcagttgaaatcatttagtatttaaaaatgttgtttgaagttgtcataatttgaaattcaaatttaaactattcaaacaaagtcatatagaaaaaatgaccaatactaaagttgtagatcttgatgagttatacaactttgttattgatgactttttcatttgaaatcatatattgcttcaaaatattatttgaatttcttatattttaaaattcaaatttttcatagttcaatcaaactcgtatggagaaatgtttaaaagaaaattggtagatctcaacgagttctacaaaaatttttcatatgagttcatttaataccataaatttttgattcgaagttttaatattttaaaattaattgtttttcccttctcttcccttcaaattttttcatctccccttctcactcactctctctttctatcatctcccctcactctctctttctctcctctcttgctctc

SEQ ID NO: 17204 - DNA, 1501 bp, Oryza sativa
gtccttccctgggtgggggagtgaggcggggaagggcgaagaggtggctagggaaggagatgcaggtggcgcagtggatggaggaggagagtgagtagatggtggcggcggctgagtggatggatggagtttggctagggtttagagaacagagtatatggataagaagcaatcctatgcgaatttaccaaactgtccctggtgtgagggtagttacgaaattttatggacaaaatggacatttcaccttaaacttatgagaactttaaatttaattttagactgatttttatgtttcaaatgcaaaaaacataaacagcaaaattgtagaactcatcgagatctacaactgttgtattggtcctttttacatataagttcatttgaacaattcaaattttgaattttcaaaatttgacaacttcgaacaaaaattggggttaataaatgatttcgaatggaaaagtcaccaaaaccaaagttgtacagatcattgagatgcaaatttttattttggtcatttctccatctgactctatttgaacaatttgaaatttgaaattcaaagtttgataacttcaaatagaactttttgttattgaacgacttcaactgaaaaagtcatcaacaacaaagttgtataactcatcaatatctataacttttacttttgtcatttcttcatccgacagagtgatagtaacattattcacaaaatttacatatctcttatatggttttataaactgtaagagagatatctaaatttcgtgaaaaatgttactatcactttggcagataaaaaaatgaccaaaataaaagttatagatattgatgagttatacaactttgttgttgatgacattttcaattgaaatcattcaatatttgaaaacgttgtttgaagttgttataatttgaaattcaaattcaaattattgaaacaaagtcacatagaaaaatgaccaaagtaaaagttatagatattgatgacttatacaactttgttgtgaatgactttttcatttgaaatcatttactatttgaaaatagtgtttgaagttgtcataatttggaattcaaattcaaattattgaaacaaagtcatatagaaaaatgactgaaacaaaagttgtagatcttgataagttatacaactttgttgttgacaagtttttcatttgaaatcatttactacgtgaaaagttatttgaattgagaggagtgaggtaaaatggacttgtcggcaaagtaggaggaaaagggctgggccggcggcccagaaagggaggagaagggagagagaggctgcagactgtgggagggagagagtaatacttgggccataaaaggcccaaagacatagagaggaattttaatttgttttctatttattttaataagttaaataaactttatggtattaaaattagttattgtgctccgaagattcatggaaaatttcaaagaataatttagaccaatttatagccattttagc

SEQ ID NO: 17205 - DNA, 1501 bp, Oryza sativa
acgtcagcaaggggcgccgacgccgacaggtgggcccaacacgtcagcgggtcaaggaggtgcgggcttggaccgggtccaccaaatgagcgggccccacgcgtcagcgggcaaaaggatctagcccaccgtggaccgagtccacggtagaggtgcaaggcggaggggtgggttggctcgccgaccaacccgaccagacggcggcgcgcggccggacggccaccggcggcgacaccggcggcggcgcggcgcggcgcgacggcgacacgcatgcggcggccggcgggcaaagagagaaaaagaaagggaggggaggaggagggagatgctcaccgacgcgggaaggacgacgacgacaacggtgatggcggcgtcggcccgacgagcgagggggcggccggggagcggcgaaaacgagcggaggaggcgaaaagggaggcggcggagctcaccgaggggcatggcggcgaaggaggcggctgatggggctcgagcagagggaggcggcagcactccacggggcgaagacgacggcggtgattcggcggtctccaacgaaggtggaagagcggccggggtaccacgcgatgcagcgaagccgacggtggtagggcgcggcttggcagtggctggagcggcgaggagcggcggccggagctcgtcggtgagtggtggagagagggagcgcggtggggaggtggttccggcgatgaaatgggaaaacggagtggggccgaggtgcggcaaggcacggcgaagccggtggtgcaagcgccgcggcgcggggacgtcgacagtggcggcagcggccggctggagggtcgccggcgatcggcggcgcttgggctcgtgtggggagagcgggagagagcgcggggagtgcgggaaagttggggaaaagggagaggatggccgggggattgtttttataggggaggggaggcgggatcgagcccgggagaggcggagtcggggcggcaaccgccggtggcgtgggcggcatcgtggggtgtgggtggcggttttggaggggagaggtggggggaaacggcgcggacgtgggcggcgaggtcccacggacgagcgcgcgcgcggggtggaggaggtgggcggaaacggccgcgtcgtggggcggctcgggcggccatggcagcaacggcagctgccggcctgaggttggggatgacaggtggggtccacgggttccatctgtcggagagagagggagggagaggccggctggggaggcaaaacagacttgagggagagagagagagccgagcgggccgagggagaaggccggcccgagagggagataggggggaattgggccgaaaggggcccaaagagaggagggaggattttattttttttctttttattttaattgatgcaatgatctttgtgctattaaaactatttctcgagctccgaaaattcacggaaaattccggagagtacattagggcacaaagaatattacaaaatatttccggccaat

SEQ ID NO: 17206 - DNA, 1501 bp, Oryza sativa
atctaaggatagatgcaagcaaactgggttttaatgagaatcacaaaaaaaaagagagaacttcaccaacagtgcgctttccctgcatggaatactcatgacgcagaggttgctgagggaaaaaaaagctcatagtagcagcgatggactagctgctgcaggtcgcattcaataatcacacgagaaacaacattaatccttttccaaattatgtaactttgacaaaacatcctttacttttaactggcttgtgcaaaaagtaacatacctgatatgtagaggaagggtgagctatcaagagttccctctaacaaaaaggctgcggtaattaagtcacagtaatctattatataattaaaggaatagaaaaaggagcctccacgttcgctctcatggcctaaaaattctcacattaatcggagaaaaagaaaaagcagagtccatatagaaatacaatttagaaatagcttaaattcggaattaaaaaataaggaatattagaagaggagaccggagtccatatagaaatacaattaggaaatagctgaaattcggaattaaaaaataaggaatattagaagaggagaccggagtccatatagaaatacaattaggaaataactgaaattcggaattaaaaataaggaatattagaagtagagtatagagtccatgtagaaatacaattaggaaataactgaaattcggaattaaaaataaggaatattagaagtagagtatagagtctatatagaaacttaaaactaactaaaatttggaataaacataataaaattaaaagtagagtttagagtccgtataaaaatacaatttacaaatagttaaaattcgaaattaagaaaaaatgggaagaagagtttaatgctaatataggaattcgaaattaaaaattaaataatattgaaagatgagtttagagtccacatagaaatataattagaaataataaaatttcagaaataaaaataaataatattagaagaagaacatatagtctatatagaaatacaatttacagaaaaaagaaatattaaaaaacgagtctagagtccatataggaatatatataatttacaaataactaaaattttatcttaaaaataattaataactaacacgtatataaaatgcaatatgaatattacacattagtagttttgtaaagttattgcaaaatttaaaattatgttgttattttaatatatttgaataatataatgagaaaacatatatgctattatatgagagaaaatataatgatgctagccgcgcaatctgcgcgggccatcatgctagttagaatgtaaagagacaagtggaggtacaaccccaccgacgttttgtaacggacaaagattcttagggggatgataagacaggagcccacgcacgcacacgcttaagagaacaaagggaagaaagctcccacaaccaccagctttaaaagaaggggcaaatggggagggaggcctgcaaagaa

SEQ ID NO: 17207 - DNA, 1501 bp, Oryza sativa
aaaaaataaaacatatttagcgcaaagaaaaataaaaaatgtgattgcaagaagaatcaaacccaaaatacgatttgttaaatttgaacaaaatagttttgttaatatgttatatgtatatgatgcataatatggcaaactaaaaaaatatggtgcgcatgggtaaaaatctgcaacatgtgggatttgaacccacactaagctgaaggtaggaatgtgtcttaccatttgaaccacttgttctattggtcccaatgtgtacttaaaatatttttatttgccttttatttgtcccaatgtcactcgagttggcccaggatgttgcccatagcgtggcccagcaactcagagttggcgtttcaaaaaggaaaaaagaactcgaattggtaaaatagaagttcaaaaaggaaatattttttaaatattctacgtgatctaaattattctttgaaatttaccgtgaattttcgaagctcaataactaattttaataccacaaagttcatttactctattaaaataaatagaaaacaaattaaaatttctctctctgcacttgggccttttttggctcaagtattaaaatagaaaacaacttttgttttggtcattttgttatatgactttgtttcaataaattgaatttgaatttcaaattatgacaacttcaaacaacattttcaaatactaaatgatttcaactgaaaaagttatcaacaacaaaattgtatagttcattaatatctataacttttattttggtcatttctttatccgacaaagtgatattaatattgttcacaaattttacatatgtctcttatagtttatgaaaccatatgggagatgtgtaaattttgtgaacaatgttactatcactttattggatgaagaaatggctaaaataaaagttatagatattgataagttatacaactttgttgttgatgatattttcagttgaaatcatttagtatttgaaaatgttatttgaagttgtcataatttgaaattggaattcaaattattgaaacaaagtcatatagcaaaatgaccaaaacaaaatttgtaggtattgatgagctatacaactttgttgttgatgactttttcagttaaaatcatttagtatttgaaaatattatttgaagttgtcataatttgaaattgaaattcaaattattgaaacaaagtcatatagcaaaatgaccaaaacaaaagttatagatcttgataagttatacaactttgtttttaataattttttcacataaattcatttaatatgataaaattcgattcaaagttttaatactttgaaatttccaggttaaatgaccattttgtccaagtaacttgtataataggttttcagataccagggttattctagtaaaatcgcatcaaaattgctactcccctcaaccctagccgattccaaatctgagtccaaatctctttccgcaaaccctcgcgctcgcggctctgatccagcgcttgc

SEQ ID NO: 17208 - DNA, 1501 bp, Oryza sativa
attaaaaaataaggaatattagaagaggagactagagtccatatagaaatacaattaggaaataactgaaattcagaattaaaaataaggaatattagaagtagagtatagagtccatgcagaaatacaattaggaaataactgaaattcggaattaaaaataaggaatattagaagtagagtatagagtccatatagaaatacaattaggaaataactgaaattcggaattaaaaataaggaatagaagtagagtatagagtccatatagaaatacaattaagaaaaaaaatagatattcggaattaaaaaataaggaatattagaggttgagtatatagtctatataggaatttaaaactaactaaaatttggaatgaatataataaaattaaaagtagagtttagagtccttataaaaatacaatttacaaataactaaaattcgaaattaagaaaaacatgggaagaagagtttaaagtcaatataggaatacaatttagaagtaactggaattcgaaattaaaaattaaagaatattgaaagatgagtttagagtccacatagaaataaaattagaaataataaaaattcagaaataaaaataaataatattagaagaagagcatagagtctatatagaaatacaatttacagaaaattcggaattaaaaaaaagaaatacgagtctagagtacatataagaatatatataatttacaaataactaaaatttgatattaaaaataattaataattaacacgtatataaaatataatatgaatattacacattagtagttttgtaaagttattgcaaaatttaaaattatgttgtcattttaatatatttgaataatataatgataaaacatatatgctattatatgagagaaaatataatgatgctagccgcgcaatctacgtagctcacgatgctagttaatataatctactaattaaaatagtcgattgaataaaaataaatttaaagccctaatttacgtttcgttctggggcccactgatctcacctcggtggaatcgggctcggcggcgagagcgaactcggtcggcgccccctcccattccacctgcgcacggcccaagcgcggggcgtggccggcgagctcccgtccattccctcgtctctctggataggggatctggaaaatttgctgctctcttgatcgaacggtgaaactttctcaccattcatccatccggcgaaacttccactgatgaatcggacttcccaaacctttccacgctctcgctccaaatgaccaaaagccagaggaggagggtttcgcagcaacaacgtgggcgcccacggcccgcgcccggtcagcgaggaaacagatcgaaaaaaaacaaaagccgctgacgtcacgatctcgaggctcgcgattcccaacaatctctttaaaaagcttcctctcgccgaatccccctccacctccaccacccgccgccgccgccgccgccgccgccatggcct

SEQ ID NO: 17209 - DNA, 1501 bp, Oryza sativa
tgtaaaaaatcagtagtagcctgctttacctcttcagccttattaatgaggtattgcttctcaagcatataatcaggcacaaatgtctttttgacaacatagtttggtgtgccttcagtcagattttgttcactgagcttgaacttgaagatgagttgttttccacagagttgttgaataatgttaggaatttcgtcgtttttgccatctagtaaattgagtaatgatgagacaggtgtctctagcatgctttgtgccacatcatcaaatatagtgcagcttgtagatgtcgtatgatcacttatttggagtcgtagtcggtacctaatatgaaattatggttaatgcaaaaaaaattattacataagtattgttatttacaaaagatgaagtattcttacctaggcgttgtattttctggatatttattgcagttcctgcaatggtatttgtcgtttttctgaataactattttattacaaagattgcacgacatgtaccaccattgaatattttcttgtactcgatcaatcgtaactattgatgtaaacacaaattcctgcaatttatgaaaattttttaaggatatatatataattgccaatagcagagtatattaagataaaatttacgtaggaaagttgtaggaaagtttgatgttgccattacctgacttcctgggttacgatgccgcatttctttgttcctcccttgttccttgtgtactcttatctacttccatcacttttggtactgtttcttcggaggattgtctataaggcataaatatttgaatcaaagaaggatttatattatgttactagaaattctcatattaattgaagaaaaagaaaaacagatccatatagaaattcaatttaaaaatagctgaaattcggaattaaaaataagaaatattgaaagaggagactagagtccaaatagaaatacaattaagaaataatagaaattcgaaattaaaaataaggaatattagaagtagagtatagagtccatatagaaatacaattaagaaatagtagaaattcagaattaaaaataaggaatgttagaagtagagtatagagtccatataggaatttaaaactaagtaaaattcgaaataaacataataaaattaaaactagagttcagagttcgtataaaaatacaatttacaaataactaaaattcaaaattaaaaaaatgggaagaagagtctaaagtcaatataggaatacaatttagaagtaactgaaattcaaaattaaaaattaaaaaatattgaaagatgagtttacactactaaaaaactctcatagagaccggttcataggtgccggttcatttaaaaccggcacctatagagcttttcctacctccttgcggtgaaaaaatgtagaaccggcacctttaagaacatttgaaccggcacctataatatagatgctggttttttaaaagaaccggcacctaataatttttataggggccggttgtt

SEQ ID NO: 17210 - DNA, 1001 bp, Oryza sativa
atgctccatgagcaaaccgaagcttggacgaccccatacatatgcactgtaattgatagaccggagtttgaagacacggtgaaagagatggagaaggtggtgtaaaatgcaacaataggaaatactccagctagcccaaagtgaaaacataggataaggggcggtctaaagtgaaagtttggtaagaaatgatgacccaatatgcaattcactaaaaaagaaagtactaaagatgtgttcgtctccctcagctgggaactaatgccctacgcacgaaaaacggagcagtacattaacgcgtgattaattaagtattagttttttttctaaaaatggatcaatatgattttttttaagtaacttttgtatataattttttataaaaagcacaccgtttagcagtttgaaaaacgtgcgtgtgaaaaacgagagatatggattgggaacctgactaaccaacgcagagtagctcgcacgatggctgttagttcctgtcttttgataagacaaaggtcgcagctgagatggcaactcggtttcaacgtgaagcacatgaggacattcaatgccatcgcattatagagtcataacaacaaataaatccgaaaaaaagaacttgcatatggaattgtgaaaaacataatttcctaacagcatctttggagtacaaacacatctattgtctcgtaagtcatatctatggcacattcgcgcaatctcaattcttaaaaccaagagttcaaaaaaattcagaaaacaaggaaaagcaaaccaaatgacgcatcaaagtcatggtcatgactcatgactcatgtggtcatccaaaagagaccagcaaaaaaaaatagaaataccaaagcgatcgaggcgatactaatatcaatatattacgttacgccgatcatcaagggaagaagcccaggacaaaaatatccgcacgtcgcatccaagagtaaaagaaaataattattttgtgattatccataaaatacttatagata

SEQ ID NO: 17211 - DNA, 1501 bp, Oryza sativa
gctgaatagtggttcctaaaaaaaataaatactggttagtggttacagagataaagtgcaaaattacagtatcataatataattgcactataattatattgttactactatctaattacaatctattaacttattaaaggaatagaaaaaggagcctccacgttcgctctcacggcctagaaattctcatattaacaggagaaaaagaaaaacagagtccacatagaaatataatttagaaatagctgaaattcagaattatccaaaaagcgatttgctagatatgataaagaatattaaaagaagagtatagagtccatatagaaatataattaggaaataatagaaagacggaattaaaaataaggaatattagaagtagtttatagagccatatagaaatacaattaagaaataatagaaattcagaattaaaaataacgaatattagaagtagagtatagagtccatataggaatttaaaactaactaaaattcggaataaacataataaaattaaaagtagagtttagagtccgtataaaaataaaatttacaaataaataaaattcaaaattaaaaaaacatgggaagaagagtctaaaatcaatataggaatacaatttcgaagtaactgatatttaaaattaaaaattaaagaatattaaaagatgagtttagagtacacatagaaatacaattagaaataataaagtttcagaattaaaaataaatattatttgaagaagagcctagagtctatgtatattgaaagatgagtctagagtccatatagtaatataatttacaaataactaaaatttgatattaaaaataattaataactaaaacatatataaaatacaatgtgcatattacacattactccctttgttccataatataaggcacaactaatttttttggatgttccataatataaggcttgcatgcatgcatacaattaattaggagcacttccccattaaattattacttttttaaatcatctatcctcaatatctctaattctattggatgcatacattatatttattaaggtgatccaaactaggagatgataataattgtttcttggtctttgggttaagagtggttgtgccttatattttggaacggagggagtagtagtttcgtaaagttagtacaaaatttaaaattatgttgtcattttaatatatttgaataatacattgagaaataatgtatgctattatataagagaaaatataatgatactagccgcgcaatctacgtgggccaccatgctagttataattaatgtaactagatgtaataactttttagtagatgtcttagtaatatttttctttttgttaggcatcttgggcttttacggacaataataatgaagagccggctgggcttctctttatctgcactaacaatcggcccatggactgagatgcatatacataacaacaattaaccattataagtccgttttcacttggcatca

SEQ ID NO: 17212 - DNA, 1119 bp, Oryza sativa
cgacaaagtgattttaacattgttcataaattttacatatctccatatggtttataaactataagagagatatgtaaattttgtgaacaatgttactatcactttgtcagatgaataaacgaccaaaataaaagttatagatattgatgagttatacaactttgtttttgttgattttttcagttcaaatcatttagtatttgaaaatgttgtttgaagttgtcataatttgaaattcaaattcaaattattgaaacaaagtcatatagaaaaatgaccaaagtaaaaattatagatattgataagttatacaactttgttgttgatgactttttcatttcaaatcatttagtatttgaaaatattgtttgaagttgtcataatttaaaattcaaattcaaattattgaaacaaagtcatattgaaaaatgaccaaaataaaagttgtagatcttgttaagatatacaactttgttgttaacaattgttttatttgaaattatttactacccggaaagttatttgatttgagaggagggaggtaaatggacttgtcagcgagggatgagtaaaagggtgggccggcggcccgaagagagaggaggagggagagagaggccgcgggctgagggagggagagagtaatacttgggccgaaaaaggcccaaggacagagagaggaattttaatttatttttcatttattttaataggttaaatgaattttgtggtattaaaattagttattgagctccgaaaattcacggaaaatttcaaagaataatttagaccaacttatagccattttagtttgtttttttaagttttttcattcaatcataaaataaaacgccacaattttgatttttttattcataaaatgagactagagatgacttcaatcctaaaatcctaaaatcctaaaatgagagactataattgatgtagacaacaagagtccacctaggacaaatgatttatggtctagtggcaatgtagtataacaagattttttttgttttttttaaaaaatataatagttatgtgttttatgacgatccattattgtcatcgtgctatcgtcacagagcccatgcagagtatactatgacgatggtt

SEQ ID NO: 17213 - DNA, 1501 bp, Oryza sativa
gctgggatggtttgggctagcccagcacacatgcatgacgtcatcaatggcggcagcccaacatctacagtacagcctaatactgttggagcccatgcggagagttcgagagctattgggaaacctgacttttccccaagtttatcccctcggtagagcagtggatttgggtgaagcaaggagaggtgcaaccaaagctagggttccctgcgagaggtgaggaagtccggtgatttggtagtggtgctcgccggatctggagagttccagagcgcaagcgcgaccatcgttcatacacagaggtggtgatggacaagcgccctccaaattcggccggagtggcaagtcaacaagcgaagggtgacggatccgattagaggtggagattaggggaaccgtgatgcgcgcgaataggatgagcttcgacgccaacttctcgctcaaaatccaacggggaatctaggtgcaagatctcaagggcgtcaaggtggcgaggcagatcgtggtgcgagagcggcggatcgaggtgaggataaaatgcttcgagtgtgggcgtgaaggtcaccatcaggcaacgtgccctaaccctcacctctactactcctgtcacaatactggccatatctcttctcactgtccattgcttttgggaaagaagggtattaagctgtgtgggtttgggttccctgggcaaggtttttacagcttgcaagttgagatttctgatatagagttggctagagctcctgtgaaaggtatactaactgtgattcttggtgaagcttctgtgggaaaagtggttgcagagctgaagcatctatttgttgggctaaatggggagtggaaggtgaaacaactaaatgctaaagagtttttaatcaatttcccttctgatgaggtgagaagcaagatatcaacatacaagagttttgattttgagacctcactgatcaaggcaagtgtagtggaaactggtatgacagaagaggcggttgatgagctggttgctgtatgggtaaagatctatggtattccgaagctagctagaatagaagattctatcaaggtcattgttgacctagttaaaaaaaatgagatgctagatatgactagtcttagaagggatggcctctgtgagggtgaggcttgcttgtaagggccctatttagttgcatttctcagttcacatctacattaacaaagtgggttatatgattagatgggaaccaaaaggacatattccttatgacaacagacatgacccacctgaggatggtgatgataaggatgacaaggatgacgaaaggaaagagatgatataaacttagatgacgagttcaagtctcaggacaatcagagaggtagacagcttagaggtgaaggaaacaaccagggcggcatatttggagcctcttctgcacctcctgtgtacaaagggaaaacacagttacttcagagtgggggtgggaaaaaaatatcctctaagaaaacctctcttctg

SEQ ID NO: 17214 - DNA, 1501 bp, Oryza sativa
cgtcattagatgtgctggccctaggagctagggatgggcgtggtctggggtgggctgacccaaactcgtcccatgtgacccaccaattctacaacaacactagttccaatgggtaccatgggtcgacccatgaaaattgctagtgtactgaatttagaagacactcgacagagcaaaccaagtaaaagaaactaggtaaaaccccgcgcattgctgcgggaatttagtatgataacaataaaaaaaataacgtgtaagatagctagataacatcagattaagtaaattaatgtggtttatgataatttaaatttaaatagtatgtagaatgatgagtcaaacgtaaaaagtaaggtggtatgacttcatggaagaagaaaagtagggagatagtttggaccgtagattaatcatctaaaggctaaaaacaattaatgtgatatgacttaattagaggaaaagagaaagataatttggaccatagattaatcatttaagcactaagtgaggatgaactatattagtatataggatatcataaaacgtaataaagatatacattgaaacattatgtgaattatgttggatgataatttaacatgtttgtatttgaaaaagctcttaaattataaaaactataaagatatagcatgtttgcatgatgtttaaatgtgatgattgttagtggatgatgatgtggcatcttgttaattagtgaatgatgatgtggcatcttgttagtggatgatgatgtgtcatctttgtatgttaagcttaaggagttagttagaggaaaaaaagagaaagataatttggaccatagattaatcatttaagcactaaccaagtgaggatgaactatataagtatgtaggatattataaaacatagtaaagatatacattgatacattatgtgaattatgtgggatgataatttaacttgcttgaattttaaaatctcttaaattataaaaactataaaattatagataatataacatgtttgcatgatgtttaaatgtgatgattgttagtggataatgatgtggcatcttgttaattagtggattagtagatgatgatgtgacatcttgttagtggatgatgatgtggcatctttgcatgttaagcttaaggagttagtgggggataactttatagtaagataggatgtgtacgcttgtattcctttgtgaactatgaaatcaatgttatgttgaagcaatcgtggaagcaaaaacaaaaggaacaggcttttcattgtttcactagacctatctaatttcagagaaccaattaaggaagtatcatgagaaccaataacaaacaaaccggctatgaggatttgggtgaagggagaaaatgacggtgccgtcgcgtgcctgatgcaagggatcgatcgatacctactgaagcagacccaaatacccacttgaaccggtctttttagtttgggccgggccacatacccattaaagccaaatttatgggacaggcca

SEQ ID NO: 17215 - DNA, 651 bp, Oryza sativa
aaatttacatatctctctatagtttataaaactatataagagatgtacatcttgtgaacagtgttacaaataactttgtcgtatgaagaaataaccaaaataaaagttatagatattgatgagttataccactttgttatttatgactttttcatttgaaatcatttagtacttgaaaatattgtttgaaattatcataattttaaattcaaattcaaactgtcgaaacaaagtcatatagaaaaatgaccaatacaaaagttatagatcttgataagttataccactttgttgttaatgacatttctatttgaaatcatttattatttgaaaattttatttgaaattgtcatattttgaaattcaatttcaaactgttcaaacaaagtcatatagaaaaatgaccaaaacaaaagttgtagatcttgatgagttctacaactttgtttttggcaaactttttcatatgagttaatatagtgacataaaaattaatttaaaatctaaaaagccacaagcaaaaaatcaatttttgcatgcggacggttaaatggcccgcttgtaaaaatggtccctcttccttccctctctacctgttcaaaatttcacacctaaccttatcttctcttcctctcctctcacttattatct

SEQ ID NO: 17216 - DNA, 446 bp, Oryza sativa
atctcacttgtagcatccaagttatattgcgtgaaaaattgtgaatttgtaggtagtgatgtgtaaccatgtataggatggctagtaaaattcaaaatatttttttgaggttttttgttgcgtttaaaattcaaaaattgtatttcttgctttgtcatcagtgacgggtcgtaagttacaacccgtcagagatgactcatctaccacggacaggtgggtactatgcgacagtggtgacttacgtgtcacgggagactggcatcaaccaccactaaataatgactataaccaacccagatgggtgatatgggacgggcgcgtcatacatgacctgtgacggcgtcatgacaaaccactcttctctgccctagacctgctcctgtactagagcgggaccttgcatgccagacatgacctgcccctggacatcgacatgcgctcttagg

SEQ ID NO: 17217 - DNA, 1501 bp, Oryza sativa
ttctattagaaaaaataacaagttatatttcattgttgatttgtgatgcttagtttgagtggtttttatgttccgattaatattcgtcaccgtattcgttctgtttcgtattcgctccgtatctgtattcgacaatattcgattccgttttcgtatccggggtttccgattccgattccgattccgaaaaaaaatatgaaaatgaatatggtagagctagtttccgtccgtatccgatccgttttcatccctacacgtggcccaattaacatctagggttttaaccttgcaatcggtatataagatttgtagtttcactccatatgctttgttcaattcacacatatcgtcaaccatttagatgtgtgaaataaatgagaaggtgtggcttcatgctacaacaaatctgggcttctatgacgattacctgatgacggaacacatatctgtcataaacagaggctgtttatgacgactgttcacaggatgacagctgtttatgatcaaaccgtgtatctgtcataatcatcgtcacagtatactctgcatgggctctgtgacgatagcacgatgacaataatggatcgtcataaaatatagaactattatattttttaaaaacaaaaaaaatcttgttatactacattgctactagaccataaatcgtttgtcctaggtgaactcttcttgtctacatcaattctagtctctcattttaggattttaggattgaagtcatgtctagtctcattttatgaataaaaaaacagaattatggtgtttcattttatgattgaatgaaaaaacttaaaaaaacaaactaaaatggctataagttggtctaaattattctttaaaattttccgtgaattttcggagctcaataactaattttaataccacaaagtttatttaacctattaaaataaatgaaaaacaaattaaaattcctctcgctgtccttgggcctttttcggcccaagtattactctctccctcccttagcccacagcctctctctccctcctcctccctctttgggccaccggccaagcccttttgctcctccctcgccaataagtccattttacttccctcctctcaaatcaaataacttttcgggtagtaaatgaattcaaatgaaaaaattatcaacaacaaagttgtataacttattaagatctataacttttgttttggtcatttttcaatatgactttgtttcaataatttgaatttgaattttaaattatgacaatttcaaatagtattttcaaatactaatgatttcgtgtaacatactaaaaaattagctattttctaattatgcatcataccggttcttatgtttttattaacctcctaaacctaggatattataattaaagagacctcctaaaattaacctgcataaaatctctttctggtatttaatttcttttgtgcctttcctttaaaaatatatttagttaaattaaggtgtttcttgattttgggtttt

SEQ ID NO: 17218 - DNA, 1501 bp, Oryza sativa
tgattcataaaagtaaaaagattttcaaactaaatttgaataaaaggaattttttcaaaagaaggtttttaaattaaaacccaaaatcaagaaacaccttaatttaactaaatatatttttaaaggaaaggcacaaaagaaattaaataccagaaagagattttatgcaggttaattttaggaggtctctttaattataatatcctaggtttaggaggttaataaaaacataagaaccggtatgatgcataattagaaaatagctaattttttagtatgttacacgaaatcattagtatttgaaaatactatttgaaattgtcataatttaaaattcaaattcaaattattgaaacaaagtcatattgaaaaatgaccaaaacaaaagttatagatcttaataagttatacaactttgttgttgataattttttcatttgaattcatttactacccgaaaagttatttgatttgagaggagggaagtaaaatggacttattggcgagggaggagcaaaagggcttggccggtggcccaaagagggaggaggagggagagagaggctgtgggctaagggagggagagagtaatacttgggccgaaaaaggcccaaggacagcgagaggaattttaatttgtttttcatttattttaataggttaaataaactttgtggtattaaaattagttattgagctccgaaaattcacggaaaattttaaagaataatttagaccaacttatagccattttagtttgtttttttaagttttttcattcaatcataaaatgaaacaccataattctgtttttttattcataaaatgagactagacatgacttcaatcctaaaatcctaaaatgagagactagaattgatgtagacaagaagagttcacctaggacaaacgatttatggtctagtagcaatgtagtataacaagattttttttgtttttaaaaaatataatagttctatattttatgacgatccattattgtcatcgtgctatcgtcacagagcccatgcagagtatactgtgacgatgattatgacagatacacggtttgatcataaacagctgtcatcctgtgaacagtcgtcataaacagcctctgtttatgacagatatgtgttccgtcatcaggtaatcgtcatagaagcccagatttgttgtagcatgaagccacaccttctcatttatttcacacatctaaatggttgacgatatgtgtgaattgaacaaagcatatggagtgaaactacaaatcttatataccgattgcaaggttaaaaccctagatgttaattgggccacgtgtagggatgaaaacggatcggatacggacggaaactagctctaccatattcattttcatattttttttcggaatcggaatcggaatcggaaaccccggatacgaaaacggaatcgaatattgtcgaatacagatacggagcgaatacgaaacagaacgaatacggtgacgaatattaat

SEQ ID NO: 17219 - DNA, 1501 bp, Oryza sativa
gaggcagagacgcgcggtattgcgacgtcggcacttggaaaggttcttgcggcggcgcgtctggaacaacagaatgggctgtctatagttccacactaaaattaaaagtttaaaaaaattgaactatgtgacgaaaaagttgaaagtttgtatgtgtagaaaagttcaatgtgatataaaagttgaaatctaaacagagctatgctttgcgtagagataccagcggggcggctgcgtgcagttgagccgacatattgtcttccttccctgaccacgctggacggctgtttgtggttgtttctgttgcaacgcatattttctgtgtgatcaaattagcacatgataattcactagtataagtccggccatccttgacgattcatatgtgtcgagctaatgcaacctttttcggatgactcatctctaacggtttaaaaaagtatcatgtttaagatatgactatcggggatggtccgtcaccgatatgtcatctttgtggggtcgtagttctaacacgtcacggatgacctataacgagtcacaaaccatgccccatcaccaatttaaagtcatctttgtcagatcgtagactcgtagttctaacacatcgcatatgacctataacataacaggtcacaaccattccccgtcatggataacatgtcatccgtgacaggtgtaatgagataacccatcaaagatgagagcactcatccgtgacgggacttaattaacacccttcacggatagcattatccatgaagagtgacaatcacgaaccatcacgtatgaggaaaaattcaaatgtttgaaattttcaaacaaccttaaatagagacataccttatgaccttaaaactaataatatttaaatttgagatagtttacatgtctgaatatgccttataagtggtgatagctattttgaaatacgtaattttgaatttttcaaatgatctcagatggagacatagtctatatcaaagtcaaagggttcgatgagatgtacaactttctaattgacaatattttcatttaaagttgttttcatctccgaataagtgttacaggtgatgtgatatatttcaaaaatattttttgaatttttcaaacgaccttgaatggagatataccctacactaaagttctagagctcgatgagatctgcaactttgtacttgaaagcattattatttaaagtcatctagagtttcaaatttgtgtttcatatttggacaatagttaaaagaataacatctgattaccaatcaacatgtggtctgtaggtgagatggtaagattggtttgcatgtgttgagaagtcttatgttcaaatctcatatatgacatgtatgcatataccatttagaatatgctagtaatatttaaaatatattttttagggtttttatatatttaaaattcaaaaattgtaattctcgtacttatgaaccgtcacttatgagagtcatccgtgaccgtcttttatcgataaagatga

SEQ ID NO: 17220 - DNA, 1501 bp, Oryza sativa
taggattgaagtcatctctagtctcattttatgaataaaaaaacaaaattatggcgtttcattttatgattgaatgaaaaaagttaaaaaaacaaactaaaatggctataagttggtctaaattattcttttaaattttccgtgaatttttggagctcaataactaattttaataccacaaagtttatttaacctattaaaataaatgaaaaacaaattaaaattcctctgtctgtccttgggcctttttcggctcaagtattactctctccatcccttagcccgcagcctctctctccctcctcctccctctttgggccaccggccaagcccttttgctcccccctcaccaataagtacattttacctcccttctcttaaatcaaataactttttgggtagtaaatgaattcaaatgaaaaaattatcaacaacaaagttgtataacttatcaagatctacaacttttgttttggtcatttttcagtataactttgtttcaataatttgaatttgaatttcaaattatgacaacttcaaacaatatttttaaatactaaatgatatcgaatgaaaaagtcatcaacaacaaaattgtataacttatcaatatctataacttttactttggtcatttggctatatgactttgttttaataatttgaacttgaatttcaaattatgacaagttcaaacaacattttcaaatactgaatgatttcaactgaaaaagtcatcaacaacaaagttatataactcatcaatatctataacttttattttggtcatttcttcttccgacaaagtgatagtaacattgttcacaaaatttacatatctctcttatagtttataaaaccatataagagatatgtaaattttgtaaacaatactaaaattactttgtcggatgaacaaatgaccaaaataaaaatttttgatctagatgaattatacaactttgttgttgatgattttttcagttgaagtcgttcactaataaaaaaaatctatttgaagttctcaaagtttgaatttcaaatttcaaattatttaattagagtcagatggagaaatgaccaaaataaaaattttgcatctcgatgagttctacaactttggttttggtgacttttccatttcgaatcatttattaacctcaatttttgtttgacgttatcaaattttgaaaattcaaaatttgaatcgttcaaatgaacttctttgtaaaaaagaccaatataatagttgtagatcttgatgagttctacaattttgttgtttatgatttttgcatttgaaacacaaaaatcagcctaaaattaaatttaaagttctcataaatttaaggtgaaatgtccattttgttcatacaatttcgtaactactgtggacataccagggacagtttggtaaattcgtgtcggattgcttctcatccatataacctcttccccaaaccctagccaaaactaaatccatatgccgccggcgccacca

SEQ ID NO: 17221 - DNA, 1501 bp, Oryza sativa
ctttcatttttgtctcgtcagtcatcacaggttttgatcgatcttgtggccgactggaaatcatccctcgcatcgcttcgctctacgacttgtggttgttttgttggtattctttagcagaatttgttaattttgtgcctttccatctttccggtattgggcgatcctatgtcatacatccagcttcagttggattttttttttggaactgctaatttctcaaaggttttgtttttctttttaactagcatggtggcccgcgcaattttgcgcggcttgcatcattatattttctctcatataataacatatatgttttgtcattatattattcaaatatattaaaatgacaacataattttaaattttgcaataactttacaaaattactaatgtgtaatattcatattgtattttatatatgtgttagttattaattatttttaatatcaaattttagttatttgtaaattatatatattcctatagggactctatactcgtcttttaatatttcttttttttaattccgaattttttgtaaattgtatttctatatagactctatcctcttcttccaatattcttaatttttattatttctaattgtatttctatgtggactctaaactcatctttcaatattatttaatttttaattttgaatttcagttacttctaaattgtattcctatattgactttaaacttatcttcccatgtttttcttaatttcgaattttagttatttgtaaattgtatttttatacggactctaaactctacttttaattttattatgtttattctaaattttagttagttttaaattcctatatggactctatactatacttctaatattccttattttttaattccgaatttctttttttttcttaattgtatttctatatggacctatactctatttctaatattccttatttttaattctaaatttctattatttcctaattgtgtttctatatggactctatactctacttctaatatttcttatttttaatttcgaatttcagttatttcctaattgtatttctatatggactctattctcctcttctaatattccttattttttaattccgaatttcaactatttcaacattgtatttctatatggactctagtctcctattctaatatttcttattttttaattctgaatttcaactatttctaaattgtatttctatatggactctgctttttctttttctccgattaatgtgagaatttctaggccatgagagcgaacgtggaggctcttttttctattcgtttaacaatataataggttttgtttcacttagatttcacagattttgtgacatctaagtcaactttgtcacggatatgtcaaattcagttaaactgccagagatatgtcatttcattacaaattttatactacacagtaagggcacaaaattgaaccaaatgaacagaacctgtgagaaagtagtgtcaaataagca

SEQ ID NO: 17222 - DNA, 1501 bp, Oryza sativa
atttgttaattgtatttttatacggctaaacactacttttcattttattatgtttcttctaaattttacctagttttaaatttctatatagactctatactctacttctaatattccttattttttaattcttaatttctattttttttcttaattgtatttctatatggactctatactctacttctaattttccttatttttaattccgaatttctattacttcctaattgtatttctatatgaactatatactctaattctaatattttttatttttaattccaaatttcaggtattttctaattgtatttctatatggactctagtctcctcttctaatattccttattttttaattccgaatttcaactatttctaaattgtatttctatatggactctagactcctcttctaatatttcttattttttaattctgaatttcagctatttcaaaattgtatttctatatggactctgcttttttatatggactctatactctacttctaatattccttatttttaattccgaatttcagttatttcctaattgtatttctattggactctagtctcctcttctaatattccttattttttaattccgaatttcaactatttcctaattgtatttctatatggactctagtatcctcttctaatattccttattttttaattccgaatttcagctatttctaaattgtatttctatatggactctaccttttctttttctccgattaatttgagaatttataggctatgagagcgaacgtggaggctcctttttctattcctttaataatataatagattgctccatgattcgacaatgtggtgctacagtaaacatttgctaatgacagattaattaggcttaataaattcatctcgcagtttatatgcgaaatctgtaatttgttttgttatagtctatgtttaatacttcaaatatgtgtccatatatttgatgtgacacgttaaaatttttcacccctgatctaaacacagcctaacactacgctagatcggctcacatgtgatgggtcaaaagtacttgtcacggatggcctcatctttaatggattaataaggccataataggtgaggccatcggccgaggcctgtcatatttatttggttacctgtgatgggccaaaatttacacctgactgaggtctacctttgccgggtgcaaattctggccctttatcggtataaatttcagcccaacacaagtaaccatatacatgtgatgggtctcactattttagccaatgattgcaatttcggttgaagttggtcaaagtttatttaaattcagttaaaatttcggtcaaaaaagtgcaaaaaaatcccgaaattttggtcctaccgaaatcaccaaaatttctgccggaatcaaaagtgtaaaccttgtgttctaacctgtcaaaggtgagtttaactcatctctgatgggctcaaacactgacccgttagaggtgttggaa

SEQ ID NO: 17223 - DNA, 1501 bp, Oryza sativa
atagagaaaaggtgaagactttggctgagtttgaggtcggtggtctcaattgtgatagactaactacattttagtacttatatatgatcgatcaactaatctggaattatgacaatgtagggcacaataaccaagtctctgactaccagctttgaggaggttcgcgaggagatagccagcttcatcctccgcgaaataattaatcccaaaggaatgtttaggcttaaactaaaatgatgaataatgttgaacttctatgtttaggcaatgatgaacacttattatgcaactgtggtgatgtaactgtgatgcttatatttatgtatatatttcatatgtttatgttaagacttgctaaataaatatttgatccaattaactcggttttgcaggtgaaatatgataaatatttgaatggatgtgaaatatgtgaatggatgtgaaatatgagatggctgtgaatgtgtggttgtgtgaaatatgttgatgtctgtgtatgtgaatgcatatgtatgaatgggtgatgctggggagttggggatattggatatctgcgtttgtttctgtcatctttgcagcgggcatggctagcaaaggcctgaggctagccaaaaaacaaaatttattttttttgtggattatagtcatctgtgacgggccataactaaatgcccgattgagatgagatcatctgtgacgggctctagtttaggcccgattgaggtcactagtcatctgtgacgggctctagtttaggcccgattgaggtcagcagtcatctgtgacgggctctaatttaggcccgattgaggtcatcagtcatctatgacgggctatagtttaggctcgattgagatgagtatcatctgtgatgggctctagtttaggcccgataaaggttagtagtcatctgtgacgggcgctagttgtggcctgatagagataggtcatctgtaacgggctatagtttgactggtcgtctgggtcaaagctatcggtgacgggctttacttagggcccgattgagatatattcattcgtgacggctgtttgcccgattgagataactcttcacatcagtgacttctagcctgtgacggacgctgtgcccgattgagatgagggtatccgttctagtgagtgtcttttttttatttactagcagtatgtacttgtcatggcagaaaaacacacatatcacattgaactataattagtaggcactgatcttccgaataccgattctttttttttcataagctatatactgaaatagaccagtagtatatatctaaacctgaaatgcgtgggtgcataattaattattatggagctacatacatgcacgatatggtcattgcattgcatatactgcaaatatcctcgatcgatctattctgccaataaagaggatgaactgaatgtttcaaaaacgaaagaaaacgaagatggtttcattactgtcaggatttcagcatcatttcctcagtcggccgttcgc

SEQ ID NO: 17224 - DNA, 1501 bp, Oryza sativa
tctatactcctcttataatatttatttttagttccgaatttcagttatttcctaattgtatttctatatggactctagtctccactttttttaattttattatgtttattccaaattttagttagttttaaattcctatatggactctatactctacttctaatatttcttattttttaattccgaatttctattttttttcttaattgtatttctatatggactctatactctacttctaatattccttatttttaattccaaatttctattttttcctaattgtatttctatatggactctatactctacttctaatattctttatttttaattccgaatttcagttattttctaattgtatttctatatggactctatactctacctctaatattccttatttttaattccaattttcagttatttcctaattgtatttctatatagactctatactctacttctaatattccttatttttaattccgaatttcagttatttcctaattgtatttctatatggactctggtccccccttctaatattccttattttttaatttcgaatttcagctatttctaaattgtatttctatatggactctagtcccctcttctaatattccttattttttaattccgaatttcagctatttctaaattgtatttctatatggactctgctttttctttttatttctaaattgtatttctatatggactctgttttttctttttctccgattaatttgagaatttctaggctatgagagcgaacgtggaggctcatttttctattcctttaattatataatagatagatagaagatagatttcctcaagcatctggcatgcatgtatttctaggagtaaaagggcatcttgtcggatacagcgtcggcggtcgatttaactctgtttaacgtccaagaagaatgagaatttgcatggaataatgtacgaaacgctatgcattttcacgtcagatggcatgaaggaaacgattttgctaaatcttcgcctgacagatttttcgttggaaatcactcgttgtttcaaccctccaattcatagtgagattcgtgctaacaacatccaaaaaaactaacgcagcttaccaccaaacctcgggcggtaggattcaatctcacgatcagatgcttaccatgtgcagctcttggctaattgagcatgaggagaatttgactgtatatataagacactattaacgttgtaatataaaattgcattttatataaaattacagtcatatataactaaaattgtatttgtaaattcagttgatatgacatgtaaatgcactataattttgataaaaaaatctgtaagtaatatatatttgttattttatttaaaatataaaattgcagtcatatataattaaaattacatttataaattcagttatataacatgtaagtgcactgtaattttgataaaaataatgtgcaagtaaatatgtatttgttattttctt

SEQ ID NO: 17225 - DNA, 1501 bp, Oryza sativa
aatatccgattcccaaagtggcgaaaaagccaaaaaaaaaacacgctatagatccaattcctcctaaaacggcaaaatataaaaaaaaaatcatattcctataaaaggggaacagaagtggtgaaaaaggaaaagaaaaacataggtctgattttccataaattggagaaagcaataaaaaaatccgattcctataaaaggagaaaagaaaaaaatcgtaaaaaataaaaaaaatagaaaaggtcggactccctaagaaagtggcaaaaaaaaaggtgagaaaaaaaaagtaaaaagggcggaaaaaaggcgcggcaaaaaaaaatccgatttctattcgttttaatagtcattatcatctcttctctatctctaatctaatataatctaactatttaaaaaggaagtcagaaaaaatgtgcgagaaaataaaaacgcgtgagaaaaagttagaaaaaagagcaaaagaaaacacgatagaaaaaattttccgttgtccataaaaaaagcgcgggaaaaaaatatttccattgcctgtaaaaaaaagcaaaaaaaacatgcgaggaaaaaactgatagaaaaaagggaaaaaacgcgccatttctaaaaaatggtttgaaaataccgcacaagaaaaaaaaacatcggtcataaaaaaaacaagttgctcttgaaaaaactgtaaagaaaatgctaaattgatggacgcttggggtcggatatgatccatcatttttttttcatctcctacctacctagcttttgtttctttatctattctcctgtattgaaaaccctacatattctgtaggcaattattagactattttttaagtatagctactattttggataacatattatatgaaaataatattaaaaaataaacatattttaattgttatttagagaaaagtacaaaataactctattttgtctagaattgaccatgcgaggcactgtaggatttgattgatcttattattggttgcaagaatgacattggaagagtattttaaattatatgcatggtgtcatataaataatccaattattttaggtaaagcaaagcatcggtaaagttgtcatcatcaaggttgggccattacattgaagatgttctaattttctgattgttttagctataaacaatctatataaatattatcattgatatggttatgcatgaaaaacgtatattgtaattagaattgtttcacccgttgcaaatgtacgggcatttttgctagtaagtaaaaaaaaaagaacagcaaaaatgtccgagcggttaggtaggagcagcgagcacgagtcagtcctgtgtccgaacagaagccgcagtactgtgtccgaacagctccatctcccttttaaagtcgcgagaaccaatgccaaagtcctcgccaaccgtctccgttcactgccctcgattgcaatccacgttcgtcgtgagtgacgatgggaagcgccggtgcggcgccggtggcgacggcggccggcg

SEQ ID NO: 17226 - DNA, 781 bp, Oryza sativa
aatttaaattcaaactgttcaaaagaaatgttatatagaaaaatgaccaaactaaaagttgaaaatcttgataagttatacaactttattgttgacattttttccatttgaaatcatttactacccgtaaaattgttttgactcataaaatgaattattatactgcacttaattattttcctatagtcaacttacaaatataaacatttcatatgaaaaatataaaaatagtcatcggtgacgggctttagttaatgcccgatagagattaagtatatagcccgtcactaatgagtcatctgtgacgggcctgttgttatctcaaacgggcctcaagttatggcccgtcacggatgatggtcatccgtgacgtgccacaacttgaggccgagatatggaatgttatctcaatcgggcctaaactacggcccgtcattgataggtgtcattcatgacgggcttaagttttatgcccatctaacatgtctgtacgaccatatctcaatcgggcacttttcggcccgattgagatgactttcttatgacggcccgctatttctaagcagattagagcccatcacagatagaaggatctgtactagtgttaacaaatcataaattaccatcctactgtggtttgtcttaaaaaaccgacaagcacaacactaaaatccactataatatatatatgttgctttgaaagtatggtttctgttggcattaaattaactaagaatgtttatagtcaatctatgtatttatctaaccatgatcgatcaaa

SEQ ID NO: 17227 - DNA, 1501 bp, Oryza sativa
cgggggcgacagcggcggaagcgtgagagaggcgatgcatgcaacttaatatggtatcaaaaaacggtggccgcccccgggaggagatcaaaaccctcccaggagcgacagcggcggaagcatgagagaggcgatgcatgcaacttaatatggtatcaaaaaacggtggccgcccccgggaggagatcagaaccctcccgggggtgacagcggcggaagcgtgtgagaggcgatgcatgcaactcgatgcatgcaacttaatatggtatcaaaaaacggtggccgcccccgggaggagatcagaaacctcccgggggcgatagcggcgaaagcgtgagagaggcgatgcatgtaacttaatatggtatcaaaaaacggtggcctggcgatgcatgcaacttaatatggtatcaaaaaacggtggcctggcgatgcatgcaacttaatatggtatcaaaaaacggtggccgcccccgggaagagatcagaaccctcccgggggcgacagcggcggaagcgtgagagaggcgatgcatgcaacttaatatggtatcaaaaaacggtggccgcccccgggaggagatcagaaccctcccgggggcgacagcggcggaagcgtgagagaggcgactagatcgcccgctcgataccatgttggatagtataggagaggtatactgcgtaacgtgggactcattgtattgagccttgggggataccatgttggatagtataggagagggtggccgcccccgggaggagatcagaaccctcctgggggtgacaacggcgacaatcctcgggaggagatcagaaccctcccgggggcgacagcggcggaagcgtgagagaggcaactagatcgcccgctctgataccatgttggatagtataggagaggtatactgcgtaacgtgggactcattgtattgagcctcgggggataccatgttggatagtataggagaggtatactgcgtaacgtgggactcattgtgttgagactcggggggccgatatatataggagtacatggggaggagataatgaaggattacagacatggaaggaatccaaacaaacaaatcctatcctaatataactctaactaccatatactctaacatttgcattaaagaaagagcacattattcccttcccaaaaaagaaagagcaaattattcccaatacagaataattttacagaaatattggaagtgaaaagaattgccattgccgcacatgaatcaatttggaaatatatatgtaaaaattgaactgaagagattgacgatctaggaatcaaatttagttcaagccatcgaaatgaagttcatgagaaaaaaaaaacagatcgtttgttgcaattgaaatagagcaagagaaagacaaatgcccccatcgattaactaggagttgattataagctaaatcggctttattagcgataaaaaataatttataagtaaaatttttatatacgtattttagtgacttaaaa

SEQ ID NO: 17228 - DNA, 1501 bp, Oryza sativa
aagacgagatgctctcggcccgtcgtattcctcgtctccagcaactactcgccgcaggatctgccaccacaagctcgctatgcccctgctaccaacgccggctcaccgccctcctccgtccccacggctctggcactgccaccaatgcctcgctgccactagtaggaaatcgtccatctatgacgttttgctcatgacgttgtataatttcgtcattgaatacaacatatctatgacgaaatttcatgtttcgtcatggatcactcatggcggagggtagacatcgaaactccatgacgaaatttaaaatggtgtcataaaacaatagataatttcgtcacaaaatggtgcgcaccattcatgtaacacacttatgacgctcctttattaatacaatatgctgaaatatatttcgttagttgtaagtaaatctctattctgctgttggtcccaccttgcatatgtggctatctaggttgtcactggaccccacattgtatacgtggctatccagattgttattggaccccacattgtatatgcagcacaggtgcgttttcgggccagcagatgctttgtgcagtccacgtgaatttgtgcagcccatgtgtcaatctgtgcagcccatgtgaacttttttttcgcagcccaaatttgtgcagtccgtgaatttgtgcagcccatgtgtgaatctgtgcagcccatgtgaactcttttttctaaaaaaaatgctgcagcacttgggggtcgaacccatgacttgtgactaaccataattctagcttaaccactacgctgcaaggagctttcatgctgatgatgttttacttttagttttcctttcaattctcgaacacaagaatgattgaatgctttatgcgggcgacctagtggtttggtcagggagggaggggggcggtggcgcagggtttggtcacagccagggagggagggtggcggcggcgcaggcggagctcagtggggcggatcctagccaccgggacggcgcagaggaggaggtttcttatcccaccggtgcagggaagggcggctccacaggctggccggcatcgtgatgtggagcatcgtggtgggtggcggcgcggtgaagtgatcttggtcggtggggctgcggagggatcccggtcggcgcgggggatcctcgacgactgagacggatcggctgctcctcgcccaccgtcttatcctagcacctcctctctcaatcctgtcgtcagcgcgcacagcccatcaccaacgccgttcagtagatataaggtatgattttccataagtacattactctgagtatgaaatgcaagttcagctatgaaagattatgctttgtgttgtatgaacagagaaacaagtcagagtattatgaacaaatcaacatggtttaagtcatgtagcaaccagctattccatctaatgttttagaaaatattctgtcctaaaaaatggattagctttgtttgcctaattgctttttttaacatgc

SEQ ID NO: 17229 - DNA, 1501 bp, Oryza sativa
tttttataatagtggagaaaagatagagatagcgatagagaagagatatagattaaaaccaaaatataaaattaaaatcgactcaaatacggatgacaaatcacggaaacatcttcaatttgtatttccaaaagcaaacaaacttaaaaaccgacttatacacggatgacgtactaaaataccagcaaaaacatttttaatttttatgataagagatagagatagagaggatatatagattaaaaccaaaatataaaattaaaaccgactcaaacacggataacgaaccgcggaaacatatttaatttttataaccgactcaaacatggattatggacgagatagagatagagattaaaactattcctatctaccgtaacaacctgatattgtcccgtctctaaacgtaactgtttgtaacggtttgcatccgatcgggaccaaactaaaattaactgacctaatagctgtagtaacttgtgttgcatatgaactgatccgtacgtatatatcccagtaatagctgctttatcgaattcgaagttgataatgacacacttataattgttttttttagaacgagagataattatatttacccggcttttcttctatgctatccgaatcaaactactatacggatagagacatatagccgcgcgtacgtcaaacgtgtggttaattacctctcctaatctatttaaccaacgttaaccctgcaccgagttcttcgtccccgatcgatctcgccgtcgaccaccagcgccaccaccaggtagctgctagctagcttgccatgtcgtcatcgccgacgaaggacgtcgtcaccgcgtcgacggccaccactacgtcggcggccgccaccggttgcaaccttctcaagatcaaagtacgcaacgcgatcaagaaatctcaccacggcagcaaatacgacatcgagtcgtccaagttccaggccgcaggtcacacctggagcttcttcttccacctcaacgcgagcaattattcgggcaacggccactacaggaattttgggcttctgtgacgattacattatgacgataacagcttgtttcctgtcactgactgcccacagtgacgaaatggttatcatcacagaaggtgggtcactaaccagcttctgtgaccaccagaggacatcgtcattgatgcagtgacgatagttctcctgtcattgatgaatgacgagacaaattcgtcataacaaattgaactgaataacgccacgtgtacgatgacatgtgatgttgcagatgacaaggcgggtgatatggcaaatgacgtggcaattcacattcggcccatatagcatgggcttttttattttcaattacaattggcccaaatatttttttttgacccagctacaaatttgcttttacgttttttttttcattatagctcaacagtacaattctagcccatattatgggccagcccaattaaaaagcaatcacagaatataaatcacagccagttg

SEQ ID NO: 17230 - DNA, 691 bp, Oryza sativa
ctcaccaactgggagtaaagatattttcccgctatttccaaattcttttttaaacccggttagggttaagaaccgggactaaagttaatagcactgaatattgaatttcgttgcatatgtgtttctaaaatagaaaataatgcattaaaaattctaattaacatatttaatcccacatgcatgatttaaaactttaaaaaattctaataatcatatataattagcatatgcatgatattaaattgttaaaaattctaactaacatatgtaaatcccacatgcatgatttaaaacttttaaaaattctaataaccgtatataattagcatatgcatgatattaaattgttaaaaattgtaactaacatatgtaaataccacatgcatgatttaaaacttttaaaaattctaataatcgtatataattagcatatgcatgatattaaattgttaaaaattgtaattaacatatgtaaatcccacatgcatgatttaaaacttttaaaaattctaataatcgtatataattagtatatgcatgatattaaattgttaaaaattgtaattaatcatatataactagcatattcaatacatccaaaataggttacaacaattacggcaatagatcggtggtgacggttgtccgcacatactttctcctcattatcgttccttccttgtgatcgcta

SEQ ID NO: 17231 - DNA, 1501 bp, Oryza sativa
tcggaattaaaaataagcaatattggaagaagtttctatataagaacccaataattaattaaaattcgaaataaaaaaaataaaatccaaaattagaaaacgaaaggagagtctaagtaggaatacaatttaaaaatagctgaaatgcggaattaaaaataaggaatattaaaagaagagtccatataagaacccaatacgaaattaattaaaattcagaataaaattaaaaataaatccgaaattagaaaaagaaaataaaagaagagttcaagtaggaatacaatttaaaattagctgaaatacggaattaaaaataagcaatattgaaagaagaatccatataagaacccaatacgagattaattaaaatttcgaataaaaaataaaataatatccaaaattagaaaaattaaaagagagttcaagtaggaatacaactttgaaacaactgaaatctcaattattataaaaattgaagatgtttttgccggtacttttggtacgtcatccgtgtttaaattgaatcggtttttaaattcaatcgcttttggaaatacatatccgtgtttgagtcggtttttaattttgttcgtttttagaaatacagaaggagtcgtataagaaatctctttaaaaaacttgcatgctaacttgagatgatcggacccttaattgcggctcatgattttgtaaaaagaatatccaaacaaattccaacagtgaatttaaccttagctaaaccataataaaattaaaatagccttcacctgttgcaacgcacgggcatttttctagttgaaaataaaaaataaaaacattaaaagaacacaatacggtattaactaatttttttcaaaaaaaataaattctaaaattagaaaaaagaaaaataagatttcaattaggaatacaattaataaataaataaaaattgtgataaaaataaagtattgaaaaaaaataccatctaaaacacatgatgagataaaattaagtaacgggcctataaaggagtaaagtggtggcggttgatatgacatataaaatttgttaataaaacaccaaatagaattctaatgacgattaataggagggacgtcaggcatgccataaagcaaacaagtaaagcggttgccgagacttttagaaagtaaaaaaaaacccattgataatcatattcgatttagaaaatctcagtgacaataaaaagagaagcagcgggcagggtgcataagagtatagttgtagagccgccgacggttgatgggacttctagaaaataaaaaataaattccagcgatagttatgtttgatttttagaatcacagtggcaataaagagtgggcaggagacgggctgtagaggagcacagtggcatcgtttgatgggacttctaaaaattataaaaaataaaactataagtccaatttttaaaggttcagaacttttaaaaagtaaaaaaaaaacaacgataatcatgtttgatttaaaatctcaa

SEQ ID NO: 17232 - DNA, 1501 bp, Oryza sativa
atgcccgattgagatgaggtcatctgtgacgggctctagtttaggcccgattgagattagttgtcatctgtgacgggctctagtttaggcccaattgaggtcagtagtcatcagtgacgggctctattttaggcgcgattgaggtcatcagtcatctatgacgggctatagtttagacccgattgagatgagtatcatctgtgatgggctctagtttaggcccgataaggttagtagtcatctgtgacgggcgctagttgtggcccgatagagataggttatctgtgacgggctatagtttgactggttgtctgggtcaaagttatcgatgacgggctttacttagggcccaattgagatatattcattcgtgacagccgtttgcccaattgagataactcttcacatcagtgacttctagcctgtgatggacgctgtgcccgattgacatggggcttaccgcccgattgagatgagggtatccgttctagtgtaggcctgaagttgagaattgacctgtaatatattcagcgtcactgcctctatatgaattcaatttattgaggctttacagggtcttctatcgactgagaagaaacaccatttgaaagataattaattattaagggaaaattcataatcttacctcgaagaaccatacatctagaaaaccatcatattgtttctagttaaccaaagttgtcacctcactgttgctagtaatgtaattataactccattctgatttactccagctctacctcttaccagcttgtaaaaatgttcaaaatcagagggggcttcatgcgcccggggcatctctacgcatacaccaaacaaactttgcaatggggcaattgaaaacaatatgttgggatggttctaaatctccacaaaatttacagaagtcagagcactaccaatttttttctttttttgcggttcaaccgctggctgaatcctatctgtgcttggaagccattaaatatatttaactttaagggggcaggggcctgccataagtctagcatcctcaaatcagagaaacctctaaagcataaagctcaatatatacatggattttgagggataacattaatttcttctttttctaaatcccaggttagctgggtcaactctattattcaggttaactatttatgctatcctatactgctttttatttcaatggagatgacacaggagatccctagccttgatccgccccttgggggccctatgcgttctcagggctccatacgcaggtagaaccgtttgcgcaaggtggatattccctaatatgtatggattttagcctaaacttgcaacccaatgaccggaccaaatatgggccttgatgttggatatatggtcacaattcggcatattttaatccaaattatcaagataataatcatgactttaacaaggaataaactagtgcaattgttaaacaaatgtaacgaacggatcatgcttaatatataataaccatagacat

SEQ ID NO: 17233 - DNA, 1501 bp, Oryza sativa
gaatggatgtgaaatatgtgaatggatgtgaaatatgagatggctgtgaatgtgtggttgtgtgaaatatgttgatgtctgtgtatgtgaatgcatatgtatatgaatgggtgatgctggggagctggggatattggatatctgtgtttgtttctgtcatttttgcagcgggcatggctagcaaaggcctgaggctagccaaaaaacaaaatttattttttttgtggattatagtcatctgtgacgggccataactaaatgcccgattgagatgaggtcatctgtgacgggctctagtttaggcccgattgaggtcagcagtcatctgtgacgggctctattttagtcccgattgaggtcatcagtcatctatgatgggctatagtttaggcccgattgagatgagtgtcatctgtgacgggctctagtttaggcccgataaaggttagtagtcatctgtgacgggcgctagttgtggcccgatagagataggtcatgtgtgacgggctatagtttgactggttatctgggtcaaagctatcggtgacgggctttacttagggcccgattgagatatattcattcgtgacggctgtttgcccgattgagataactcttcacatcagtgacttctagtctgtgacggacgctgtgcccgattgagatggggcttaccgcccgattgagatgagggtatccgttctagtgactctattgtatctatgatgtgtgacactgaagcaaaattagcactaatatcttcttagtcaaactcatcttggtctcatgtttgaacagcctagtatatggaatacattgttgctaaggacctagatacaattagtctaccttgacctttacaatcaagtactcccttcatccaaaaaaaaacctaggattaggtgtcgttttggttaaataaccgccacctttcatacaggtgccggttttttatccacagccgccacctatgcgattttcggaccgttggcgggagtatttttggcaccaatgaccttcccaacaaaaaccgacaccaataaatcgttataggtgctgtttttttgctatattgacgggaaatgacttataggtgccggttgttagctaaccggcacctttgtgaccgacacctatgggtgtttttgtagtagtgagttcttcttaattactttgtttttcctaactactgagtccaaccttttttttatcagactgagcccaactttctaacacactagctaatatacggaaacgttcaagcttccaaggctcggggtgcatacatgcatggacacatcccatctttttttccaagatcgagtacgagtatacaaataaaatacaatgatgcatggatgcgtacgtccagaagcagatatggttggctgagttgtttaattacggtgtgatcttttcttcatgataaattaaataacgtaccatatgtgcatgtggcatctcattgcctacttttatcgagtcccatatatatatgtag

SEQ ID NO: 17234 - DNA, 1501 bp, Oryza sativa
aaagggaaaaattaatcgagcatgcatgtgcagttcatttgcagcagaatgagggataataaactaattgattgattaacaaaacgcgtattggagaaagcaaactaagacctggaaattgacgtccatttcagtagtatttcacaccaaaactatatactaataactcaaatcacattgacctttgtttctaaggtagacttatccccttgtacggtccaattaatctaattgcattcttaattaaccttaactaaccaaccaaccaaacctgctggctgttgctcaactgcagccacatatggatgcatcaacataattaactaatttcactaaaagaacataattaactaactagatgatcatcattaattatatgatcaattgcataatcttctccatggaatcttcctagaagttgcacatatatcttcaatacatatgcttgctcatgggcagcaccaccaactatagttaatcttgttccgcaaatcgcgctgttgatagacagatcgacggctggcgcgagtgacacgtgtcgtcggctcgtcagatatatatatgcaggatcagagatcatgaggtacattgcatgtacatattattgtagtggtggccaagaggagaatatttgtcattgtgggagagcatgagaagagaacatggcaaaatcaagccccaaatcagggagattaatctacatgtgcaatgcaatatattgcaaattaatatctccatttgccctgattgcatggcacattgggtggctatcatgatcagctccccataggggaacatggtggcacacaatgtgagtataatctatgattctatattataatagcatcctctaaacacacttaactacacacaaggtacatttatataccatgcactagctacataagtatatacatgtatatcatcttttttttaaaaaaatgcatgttgcacatgatgcaggagaggagaggagactttttctctctatgcatgcatgaacttttgctgaggtggcagcagtccacatgacacacaacacatgcatagagatattagagagttgatgatgcaagggtatagccagggtgttgtgatgaggaggcaaatcaaaagggagcttagcttagctagctagtgcatgcacttacatgcatgctaattcatggttggttggtttggtggtgtgcttggatacatgagagagagagacaggtgttgtgttgttggctgtgttaaggtatatatgatatgatcatgtggtggcatgtggccttgagttaggagaacatgccctcatggcctcatcctcaagcaaagctagcctccttcctctcccatgcatgcatgcactctcacacactaattaacataacattttgtatcatgtaaagagcattatccacacatcatctaatagctagccatgtttcatgcaattaattaagcttgtgatcacatatcaataattaatctctaactttccattcatgccacctaa

SEQ ID NO: 17235 - DNA, 1501 bp, Oryza sativa
accatgtcgtccgccatgtcgagcgccgccagctccttccttgcggcagcagcgaggaagccgccgcgccggagctccctccagcggtgcttcatgacgcgcgatgtgcggccgtaaacggcccggccaatctccttccagcggtcgccgaggcggtagtggaggcgcaggagctcgtcgtcgtcgcgggcggtgaaggggcggtggtagacgtcgcgcgggcgaggtggtggcgccacctgtcgcggcacgacctagcggagcggcgtggcatgctcctggcgacccggctccagcggcggaagccgttctccttggcgaggcgctgcagccgcgcgtcctcctccggcgtccatgccggcggcagcttgaggcggacgatgcacctcgcgcgaggcggcggcggcagcggtggcgtcgccatgatcacctcctgatccatcgcgacctctcaatctgctcgagctgagagctacggcgacgacaagtgaggattcagatgaagaatcgcgattcaccggtcgatgatgaaagacagggcaacgccgttgcactgtatacatacctatatagcgctaattccttcattcgtgtcggattacgaatcggagtcggagtgattaattaattagcttagcatgcacgcgtggattaatcgctagcttcggactccgtatatttactaatagtctaatagtgtttccaatcgaaggaaagtattcaagtgcaacgtaacggtgtttactatcccgtctgacatttgaaacaaaatcatgagaaaatctatgaaataccatcgacaagcactttaatcccataaatgccatcgacatacgcaacttcctgaaaatgccgtcatacaagcctatttcttttgaaaatgccatcacaccgttagtccacactgttagaacgaaaaaaatttacaaaaataaccaaattgccctaactccaaattatactaacccaatccagctcccgataggcgacaattgcgaggcagcgctcacaggcggcggcaacgtgggccccccaggcggcggcgcggggctcccaagcggcagcgcgtcggcagcaagcgttcgtgcggcggtcccaggtggtgagacggccgctcccaggcggcggcgagatggccgccaagcgaacgcgtggcggtcccaggcgacggcgtggggctcccaaacgacggcgacgaggcggcgctcccagatggcggcacggggctcccaggtggcgtcgcggggtccccaggcagcgacgcgtcggccgcaagcgcggcggtcctaagcggcggcacagcggtcccaggcgacggcagcgaggtggcgctcccaggcgacggcgcagggcccttgggcggcagcgcgtcgttcgcaggcgcggctgtcccaggcggcggcacgggcccctaggtggtggcgcggcggtcctaggcagtggcgtggcggcagcaagcgttcgtgcggcggtcccaggcggctgctcccaagcggaggtg

SEQ ID NO: 17236 - DNA, 1501 bp, Oryza sativa; identical to SEQ ID NO: 17235

SEQ ID NO: 17237 - DNA, 1501 bp, Oryza sativa
aactcacaacggtaatatccgcatagtactgttcccaccagttgcttgtgacactttcaacatcaaaataattataaggtataataggtgattacatggaaacacacaagcatttatgaaaattaagtagtactgtttggcatccatataaatgtacttaccggccacttattgcggacggatatgcgttctcttgagtttttgtgttattcgcctcgctggtaataccttttaaatgcactgttttgcactttaattaaaatccatagtttgcagttaatatgattggaactaaacatatattatatgctacgtaccaccagttcggggggaacgtagccagagtcaacttcattgtcgctaccgccctttctcttctttgccggagaaggatgggggtcactcggcaagtgatacgatccactgcctggttcacttgagctagacgacgaagattcctccacgactacttgcgtgcaaatatcttcctccatgactagctgagtttccttgcccttgtcacccgtgggttgctcttgggtgggtttgtccattgatatcgcttgaatgtgaattaatgttagttgcgaaatggaatcattttcttattgtaaatccaaaaagaaggaaaaatttagatactaattttgtactacaagtataaatattgttaccaatcaatgagatcggcaacgacatcaatattacaatccaccaaccctgaccatttcaaactacctaattaagttccttaattatcaaagaatgacataatacaaaatgcatggagaattatggtgtgtaggtcggttccgtccatggactacactgaccaatccaccataattccccatgcattttgtattctgtgatggtttgataacctaggaactacattaaatctgcggccaatctatcaattcttccatttgaactaaatttcaaaccctaaacctaattaagttccttaattatcaaagaatgacataatacaaaatgcatggagaattttggtgtctaggtcggttccgtccatggactacactacccaatccaccaaaattccccatgcatttttgtattctgtgatggtttgataacctcggaactacattaaatctgcggccaatctatcaattcttccatttgaactaaatttcaaacctgaaatctaattaagttccttaattatcaaagaatgacagaatacaaaatgcatggagaattttggtgtctaggttggttccgtccatggactacactgaccaatccaccaaaattccccatgcattttgtattctgtgatggtttgataacctaggaactacattaaatctgcggccaatctatcaattattccatttgaactaaatttcaaacaacacattttgatcgccatagtatcaaactaacaaattactcaatttcagtcaaactaacaaatttgtgcatctaaatattcacccaacagtcatctcaatgcatcatattcagatcagca

SEQ ID NO: 17238 - DNA, 1053 bp, Oryza sativa
atatatatatatatatatgtatatatatatatatatatatgtatatatatatatatatatatgtatatatatatatatatatatatatatatatatatatatatatgctgatctgaatatgatgcattgagatgactgttgggtgaatatttagatgcacaaatttgttagtttgactgaaattgagtaatttgttagtttgatactatggcgatcaaaatgtgttgtttgaaatttagttcaaatggaataattgatagattggccgcagatttaatgtagttcctaggttatcaaaccatcacagaatacaaaatgcatggggaattttggtggattggtcagtgtagtccatggacggaaccaacctagacaccaaaattctccatgcattttgtattctgtcattctttgataattaaggaacttaattagatttcaggtttgaaatttagttcaaatggaagaattgatagattggccgcagatttaatgtagttccgaggttatcaaaccatcacagaatacaaaaatgcatggggaattttggtggattgggtagtgtagtccatggacggaaccgacctagacaccaaaattctccatgcattttgtattatgtcattctttgataattaaggaacttaattaggtttagggtttgaaatttagttcaaatggaagaattgatagattggccgcagatttaatgtagttcctaggttatcaaaccatcacagaatacaaaatgcatggggaattatggtggattggtcagtgtagtccatggacggaaccgacctacacaccataattctccatgcattttgtattatgtcattctttgataattaaggaacttaattaggtagtttgaaatggtcagggttggtggattgtaatattgatgtcgttgccgatctcattgattggtaacaatatttatacttgtagtacaaaattagtatctaaatttttccttctttttggatttacaataagaaaatgattccatttcgcaactaacattaattcacattcaagcgatatcaa

SEQ ID NO: 17239 - DNA, 1501 bp, Oryza sativa
actttgaaaggaggcaccatgttcgctgtgggggctagaaattcccacattaatcgggaaaaaagaaaaaaaaagaagagtccaagtagaaatacaatttaaaaatagcggaaattcggaatttaaaataagcaatattgaaaagaagtttccatataagaacctgacacgagattaatgaaattcaaaataaaaataaaatacaatccaaaattagaaaaaaaggagagtccaagtagaaatacaatttaaaaattgctgaaatttggaattaaaaataagcgatattgaaagaagtttccattaagaacccaatacgagattaatcaaaattcaaaataaaaataaaataaaatccaaaattacaaaagaaaaggatagtccaagtaggaatacaatttaaaaatagctgaaattcggaattaaaaataaagaatattaaaaaaagagtccatataagaatccaatgcaagattaattaaaactcgaaataaaaataaaaattaaatctgaaattagcaaaaacgaaataaaagaagagttcaggtaggaatacaatttaaaattagctgaaattcggaattaaaaataatcaatattgaagaagaatccatataagaacccaatacgagagtaattaaaattcagaataaaaaaataatatccaaaattataaaaattaaaagagagttcaagtaggaatacaattttgaaacaactaaaatttaaaataaaaaataaaatatattaaaagaacacaatacgatattaattaaattttgaaaaaaaaattctgaaattagaaaaagaaaaataagatttcaattaggaatacaatttataaataattaaaatttttgataaaaataaagactagtgaaagaaaagaccatctaaaacacttgaggagataaattaagtaatatgctgtcacaccccgaagttctttcccaagcctaaattgaatttataattcacctgagaaaataccggtgtaaaagcaagagaaaaccctaataaattaatgcaaataataatcggatttggcatgtggaatttttcttgagttctacatgtcgaaatacactaacaagatttttagtggaattttcaaagctctcgaaataattttaatcaattaaaattgagcacaggcaatatttaaatcctggaaattcctttcttcctttttcttttttctttttccttttcccttagtgggccgccggcccattccccctcatctctccccgcgccttgctgggccggccggaggccacggcctggctcagcctgcgccccttcctctctctcggggtcaccgacaggtggggcccacctgtcgggtcctcccccaacctccagccgctcgccgccgcgcccgcaaccgccgccgcgcccacgtccccgcctcctccgggccacgtcggccacgcccgcgcatgcgccgcgtctcccgcacccacttccccctctctcccgctcgcgcccgcgcccgaga

SEQ ID NO: 17240 - DNA, 923 bp, Oryza sativa
tgtcgcatctgaacgtgtcgagtcacaattgtgtgttaggtccgatcgtacgtgacttgtcgtatctgaacgtgtcgagtcacacctgtgtgttaggtccgatcgtacgtgacttgtcgcatctgaacgtgtcgagtcacacctgtctgttaggtccgatcgtatgtgacttgtagcatctaaacgtgtcgagtcacacctgtctgttaggtccgatcgtacgtgacttgtcgcatctgaacgtgtcgagtcacacctgtgtgttaggtccgatcgtacgtgacttgtcgcatctgaacgtgtcgagtcacacctgtgtgttaggtccgatcgtatgtgacttgtagcatctgaacgtgtcgagtcacacctgtctgttaggtccgatcgtacgtgacttgtcgcatctgaacgtgtcgagtcacaattgtctgttaggtccgatcgtacgtgacttgtcgtatctgaacgtgtcgagtcacacctgtgtgttaggtccgatcgtacgcgacttgtcgcatttgaacgtgtcgagtcacaattgtgtgttaggtccgatcgtacgtgacttgtcgcatctgaacgtgtcgagtcacacctgtctgttaggtccgatcgtacgtgacttgtcgcatctgaacgtgtcgagtcacacctgtctgttaggtccgatcgtacgtgacttgtcgcatctgaacttgtcgctcattggaatattaatcatgttttatcatctaacaacaatgaaaatacgaattataaaaaaaattcacataagacgaacacacaggtatgacttggaaaatgtctggttagtctttttttttttacggagggagtagtcgtgtgcacttgtgtacatgtatatgactgatttatgacagccgtgcatgtgtatttgtgtacgcctaatttaatgtgca

SEQ ID NO: 17241 - DNA, 1501 bp, Oryza sativa
cccacaaactcgtgacggttttatcaggaccgtcacaatgtatgattttaaattcgtcatactctagttagcctagaaaaataaaaaacaatgtatgattttaaattcgtcatactctagttagcctagaaaaataaaaaaattgtagcgcaaagaaaaacaaaaaatatgattgcaagaagaatcaaaatatttgttaaatttgaacataatatttttgttgatttgttacgtgtatataatggtttgttaaatttgaacaaaataattttattaatttgttacatgtgtatgatgcataatatggcaaactaaaaaaatattgtgcgcatgcggaaaaaatcaaaatatttttgttaatttgttacatgtatatgatgatttgttaaatttgaacaaaataattttgttaatttgttacatgtatatgatgcataatatggcaaactaaaaaaatatggtgcgcatgggggaaaaatccgcagcatgtgggatttgaacccacattgagcaggaaggtaggaaatatgttaccaattgaaccacttgttgtagatgtccacttctgcacttatatatttttatttatttattattggcccagcatccctgttggcgtggcccattaatgccattcactcgagttgagttggtccaggatgttgcccacagtgtggcccagcagctggagttggcatttcgaaaatggggcccagcagccggagttggcatttcgaaaagaaaaaaagaactcgaatttgtaaaatagaagaaaaaaatgcaaccaacgagaatcgaacccatgacctactagtagaaggcgccccatcctaccactgcgctagttggtttgatgtgttattgtaggattctgtactctttttgacctgtgtatgtatggaggagtaaggtttcctcaaccgtgactcagttattcagttcgacacccagccgcaaccaatctaagacaccgccgccgccgacggcgaaatttggcaggagcggcgttgccgctgcccaccactgccgcgtcgttcagcaacgccgcctccttgcctaccgtgccatcgcgcatcaccgctgcacaccagccgaacagcgacatcaggcaccaccgccgccctacaacgccatcctgtagatctgcagcaccgccgccctccattgccgcaccaacgagcgatgccgagtgcggccatgcgtccacctggtgacaaattcagctgttgaccggactcctgaagcctcttctcccatctgcctcaacagccagccaaggtaatatcttcttcttcttcttcttcttcttcttcttcttcttcttcttcttcttcttcttcttcttcttcttcttcttcttcgatttagttggatgtagcatttgaattggtgcagcttgctcattgtggtttatctacaatgtttgattagatggatagaagttgggtgcacagcagactattttcccctgaatacattgacggcgtcaaagaatttatga

SEQ ID NO: 17242 - DNA, 1068 bp, Oryza sativa
tccattcattggaccggctggcagaatctattatattattaaatgaataggaaaaggagtctacacattcgttctcatggtctagaaattcttacattaatcgaagaaaaagaaaatgcagagtctatatagaaatacaatttagatatagctgaaattcgaaattaaaaaataagaaatattagaatagaagactagagtccatatagaaatacaatttagaaatagttaaaattcagaattaaaaaataagaaatattagaagaggagactagagtccatatagaaatacaatttagaaatagttaaaattcggaattaaaaaataaggaatattagaagaggatattagagtccatatagaaatacaattaggaaataactgaaattcggaattaaaaataaggaatattagaagtagagtatagagtccatatagaaatacaattagaaaataatagaaattcagaattaaaaataaggaatattagaagtagagtatagagtccatatagaaatacaattaagaaaaaaatagaaattcggaattaaaaaaataaggaatattagaagtagagtatagagtccatataggaatttaaaactaactaaaattcggaataaacataataaaattaaaggtagagttttgagtctgtataaaaatataatttacaaataactaaaattcgaaattaagaaaaacacgggaagaagagtttaaagtcaacataggaatacaatttagaagtaactgaaattcgaaattaaaaattaaagaatattgaaagatgagtttagagtccacataaaaatacaatttgaaataataaaaattcagaaataaaaataaataatattggaagaagagcctagagtctatatagaaatacaatttacagaaaattcggaatataatttacaaataactaaaatttgatattaaaaataattaataactaacacgtatataaaatacaatatgaatattacacatttgtagtttcgtaaagttattgcaaaatttaaaattatgatgttattttaatatatttgaataatataatg

SEQ ID NO: 17243 - DNA, 1476 bp, Oryza sativa
tccattcattggaccggctggcagaatctattatattattaaatgaataggaaaaggagtctacacattcgttctcatggtctagaaattcttacattaatcgaagaaaaagaaaatgcagagtctatatagaaatacaatttagatatagctgaaattcgaaattaaaaaataagaaatattagaatagaagactagagtccatatagaaatacaatttagaaatagttaaaattcagaattaaaaaataagaaatattagaagaggagactagagtccatatagaaatacaatttagaaatagttaaaattcggaattaaaaaataaggaatattagaagaggatattagagtccatatagaaatacaattaggaaataactgaaattcggaattaaaaataaggaatattagaagtagagtatagagtccatatagaaatacaattagaaaataatagaaattcagaattaaaaataaggaatattagaagtagagtatagagtccatatagaaatacaattaagaaaaaaatagaaattcggaattaaaaaaataaggaatattagaagtagagtatagagtccatataggaatttaaaactaactaaaattcggaataaacataataaaattaaaggtagagttttgagtctgtataaaaatataatttacaaataactaaaattcgaaattaagaaaaacacgggaagaagagtttaaagtcaacataggaatacaatttagaagtaactgaaattcgaaattaaaaattaaagaatattgaaagatgagtttagagtccacataaaaatacaatttgaaataataaaaattcagaaataaaaataaataatattggaagaagagcctagagtctatatagaaatacaatttacagaaaattcggaatataatttacaaataactaaaatttgatattaaaaataattaataactaacacgtatataaaatacaatatgaatattacacatttgtagtttcgtaaagttattgcaaaatttaaaattatgatgttattttaatatatttgaataatataatgagaaagcatatatgctattatatgagagaaaatataatgatgctagccgcgcaatctgcgcgggccaccatgctaattgtattaaaacgtttaaccaagatgttctgtacggacaaaatgtgatcgaacacgagctgaattcagagagagctttaaaaaactagtgcagtactgtactagtgtgttccgttgggactgcataaggtactcgtggttagctagttatagctgtttgacacggcaatgttcatgccttcattcacccacaaatttcttgactggaatagtggaatgcatggtctttatttttactttctgatgagcacttcatctggattaaccttgtatgaataatcagcttgacagctttgcagtagctgagtcaaatgccaatccgtgttaattagc

SEQ ID NO: 17244 - DNA, 912 bp, Oryza sativa
acctcctgctaacttttctccaaatctcaataggattactcattccatagaaattttttcaatagaattgaaatcctccaaatctattaacttattaaaggaatagaaaaggagccttcacgttcgctctcacggtctagaaattctcatattaatcggagaaaaagaaaaatagagtccacatagaaatacaatttagaaatagttgaaatttggaattaaaaataagaaatattggaagatgagactagagtccatgcagaaatacaattaagaaataatagaaattcagaattaaaaataagaaatattagaagtagagtatagagtccatatagaaatacaattaaaaaataatagaaattcgaaattaaaaacaaggaatattagaagtagagtatagagtccatatagaaatacaatgaagaaataatagaaattcggaattaaaaaataaggaatattagaagagaagactagagtacatttagaaatacaattaagaaataatagaaatttggaattaaaaataaggaatattagaagcagactatagagtccatatagaaatataattaagaaataatagaaattcgaaattaaaaacaaggaatattagaagtagagtatagagtccatatagaaatacaattcagaaaaaaaaaggaattcagaattaaaaataaggaataatggaagaggagactagagtctatatagaaatataattaagaaataatagaaattcggaattaaaaataagtaatattagaagtagagagtccatatagaaatacaattaagaaataatagaaactagcatggattgcgcggctagcatcattatattttctccgaatttcaactatttctaaattgtatttctatatggactctgttttttttctccga

SEQ ID NO: 17245 - DNA, 1501 bp, Oryza sativa
ttgtttttcgtcacagatgagcccagtggatattcacagcccacgaactcgtgacggttttatcaggaccgtcacaatgtatgattttaaattcgtcatactctagttagcctagaaaaataaaaaacaatgtatgattttaaattcgtcatactctagttagcctagaaaaataaaaaaattgtagcgcaaagaaaaacaaaaaatatgattgcaagaagaatcaaaatatttgttaaatttgaacataatatttttgttgatttgttacgtgtatataatggtttgttaaatttgaacaaaataatgttattaatttgttacatgtgtatgatgcataatatggcaaactaaaaaaatattgtgcgcatgcggaaaaaatcaaaatatttttgttaatttgttacatgtatatgatgatttgttaaatttgaacaaaataattttgttaatttgttacatgtatatgatgcataatatggcaaactaaaaaaatatggtgcgcatgggggaaaaatccacagcatgtgggatttgaacccacattgagcaggaaggtaggaaatatgttaccaattgaaccacttgttgtagatgtccacttctgcacttatatatttttatttatttattattggcccagcatccctgttggcgtggcccattaatgccattcactcgagttgagttggtccaggatgttgcccacagcgtggcccagcagctggagttggcatttcgaaaatggggcccagcagccggagttggcatttcgaaaagaaaaaaagaactcgaatttgtaaaatagaagaaaaaaatgcaaccaacgagaatcaaacccatgacctactagtagaaggcgccccatcctaccactgcgctagttggtttgatgtgttattgtaggattctgtactctttttgacctgtgtatgtatggaggagtaaggtttcctcaaccccgactcagttattcagttcgacacccagccgcaaccaatctaagacaccgccgccgccgacggcgaaatttggcaggagcggcgttgccgctgcccaccactgccgcgtcgttcagcaacgccgcctccttgcctaccgtgccatcgcgcatcaccgctgcacaccagccgaacagcgacatcaggcaccaccgccgccctacaacgccatcctgtagatctgcagcaccgccgccctccattgccgcaccaacgagcgatgccgagtgcggccatgcgtccacctggtgacaaattcaactgttgaccggactcctgaagcctcttctcccatctgcctcaacagccagccaaggtaatatcttcttcttcttcttcttcttcttcttcttcttcttcgatttagttggatgtagcatttgaattggtgcagcttgctcattgtggtttatctacaatgtttgattagatggatagaagttgggtgcacagtagactattttcccctgaatacattgacggcgtcaaagaatttatga

SEQ ID NO: 17246 - DNA, 1501 bp, Oryza sativa
atccttcattatctcctccccatgtactcctatatatatcggccccccgagtctcaacacaatgagtcccacgttacgcagtatacctctcctatactatccaacatggtatcccccgaggctcaatacaatgagtcccacgttacgcagtatacctctcctatactatccaacatggtatcagagcgggcgatctagttgcctctctcacgcttccgccgctgtcgcccccgggagggttctgatctcctcccgaggattgtcgccgttgtcacccccaggagggttctgatctcctcccgggggcggccaccctctcctatactatccaacatggtatcccccaaggctcaatacaatgagtcccacgttacgcagtatacctctcctatactatccaacatggtatcgagcgggcgatctagtcgcctctctcacgcttccgccgctgtcgcccccgggagggttctgatctcctcccgggggcggccaccgttttttgataccatattaagttgcatgcatcgcctctctcacgcttccgccgctgtcgcccccgggagggttctgatctcttcccgggggcggccaccgttttttgataccatattaagttgcatgcatcgccaggccaccgttttttgataccatattaagttgcatgcatcgccaggccaccgttttttgataccatattaagttacatgcatcgcctctctcacgctttcgccgctatcgcccccgggaggtttctgatctcctcccgggggcggccaccgttttttgataccatattaagttgcatgcatcgagttgcatgcatcgcctctcacacgcttccgccgctgtcacccccgggagggttctgatctcctcccgggggcggccaccgttttttgataccatattaagttgcatgcatcgcctctctcatgcttccgccgctgtcgctcctgggagggttttgatctcctcccgggggcggccaccgttttttgataccatattaagttgcatgcatcgcctctctcacgcttccgccgctgtcgcccccgggagggttctgatctcctctcgggggcggccaccgttttttgataccatattaagttgcatgcaccagccagttgtacctaaaagcctaagctgataggaaaaggcgggcaattcactttatacactccaacactccccctcacgcgagaccccctcaagtctcaagcgtggaatattggagtgggctgcaattattttttttaattgcgcgccagccaggattcgaactcgagacctctgactctgataccatattaagttgcatgcatcagccagttgcatctaaaagcctaagctgataggaaaaagcgggcaattcactttatacactccaacagcaaagaatcatgccatttgcaaaaattgctccatggaagacatgaattagtgcttgtacctttttagcggctcactgtttgcaggcatgatatgttgacatgttgtt

SEQ ID NO: 17247 - DNA, 625 bp, Oryza sativa
tagtcatataccaaaatgaccaaaacaaaaaagttgtagatattgatgatttatacaactttgttgttgatgactttttctgttgaaatcatttattatttgaaaatgttgtttgaagttgttataatttgaaattcaaattcaaattattgaaacagagtcatatagcaaaatgaccaaaataaaagttatagatattgatgagttatacaactttgttattgatgacattttcagttgaaatcatttagtatttgaaaatgttgtttgaagttatcataatttgaaattcaaattcaaattattgaaacaaagtcatctagaaaaatgaccaaaacaaaagttgtagatattgatgatttatacaactttgttgtttatgacttttttagttgaaatcgtttagtatttgaaaatattgtttgaagttgtcataatttgaaattcaaattttacataggtcaattaaactcagatggagaaataaccaaaataaaattggtagatctcaataagttatacaactttgtttttgacaacttttttcacataagttcatttagtatgataaattccgattcgaagttttaatattttgaaattaattgaaaggggggaggcaaaa

SEQ ID NO: 17248 - DNA, 1501 bp, Oryza sativa
agaaaaatgcagactccatatagaaatacaatttagaaatagctgaaattcggaattaaaaaataagaaatattagaagaggagactagagtccatatagaaatacaatttagaaatagttgaaattcggaattaaaaaataaggagtattagaagaggagactagagtccatatagaaatacaattaggaaataactgaaattcggaattaaaaataaggaatattagaagtagagtatagagtctatatagaaatacaattaggaaataatagaaattcggaattaaaataaggaatattagaagtagagtatagagccatatgaaaaagcattgtccatatagaaatataatttagaaatagctgaaatttggaattaaaaaataagggatattagaagaggagactagagtccatatagaaatacaatttagaaatagttgaaattaggaattaaaaaatcaggaatattagaagaggagactagagtccatatagaaatataattaggaaataactgaaatttggaattaaaaataaggaattttagaagtagagtatagagtccatatagaaatacaattaggaaataacagaaattaggaattaaaaataaggaatattagaagtagagtatatagtccatatagaaatataattaagaaaaaaagaaattcggaattaaaaaaataaggaatattagaagtagagtatagagttcatatagaaatttaaaactaaataaaattcagaataaacataataaaatgaaaagttgtgtttagagtccatataaaaatacaatttacaaataactaaaatttaaaattaagaaaaacatgggaagaagagtttaaagtcaatataggaatacaatttagaagtaactgaaatttgaaattaaaaattaaagaatattgacagatgagtttagagtccacatagaaatacaattagaaataataaaaattcagaattaaaaaagaaatattaaaagataagtctagagtccatataggaatatatatatatatatatatatataatttacaaataactaaaatttgatattaaaaataattaataactaacacgtatataaaatacaatatgaatattacacattagtagtttcgtaaagttattgcaaaatttaaaattacgttgtcattgtaatatattttaataatataatgagaaaacatatatactattatatgagagaaaatataatgatgctagccgcgcaatctgcgcgggccaccatactagtttttataatatatcaatccgagtccttcatcatttctccattatctaacatatatccagcagcaaagcgttgggcatctctaaacccgagtttactttaacacacctataatatatagacgtgtatatatatataagctctcacaatccagcctcctacctagtggctggcccagaagtcgatcgatcgatcgtgacggcgacggcgcgagccacgaccatggcca

SEQ ID NO: 17249 - DNA, 1501 bp, Oryza sativa
  unsure (1)..(1501): unsure at all n locations
atgtctctgcagagtacacacaatatgaatttaagatgcatgcatccagcagttataagagaaggccatatatatgttagttaaattgagaaatagtactgtaatgatttcacaaatgatcgatgttgaaaacttactgaagtaactctgccatgcactctttgaaactggagtacagattaattgtgtcaggaaactgaatggcgaatccacctctcattagtttgacgacatccgcatagcttgcattcggatgtagccaggcactcgccacaggagtcatggccaggtacccacaagaaggctcgagactcttgatataattagcgaaccagccagttagcacgtaaacgaatgagctgctgttgcttaggcaagcgacaggactgtacatcccattgttcgttacttcccgcgaacaagtcacaaaagcagcggttatggtcgaataagatggcatcagctcttggacgatgttgcggcttgagtcttcgacaaccccgtaccttcggtaaggagtgcgattccagcgaggaagagggcaactgttacttgaatccaacatgttggcgtccacgacactgaaggtagcatcggtgtagttgattcccctcacaaggtacgttccgttgtcgacctgaataatagccttgtcatcggtgcaagtcagctcgtacgacgcaacgccgcactcgggcgggtcacgtggcaggcggaaggggtagaacgggttcgtgagatgggcgccacaggtgaacgtagcacactcaggctgaagctgaatctgatgatgccgccgcccacntgcatctgggacaagaaccgcaagcaggcacaagacataatgacctaagccgggtgagcgatagaacaacccccagggcgtgnnaaacaggctccgtttgcaggcncagagcgggagatgaaagatgaatcagaggtcgccatatatatatatatatatatatatatgtatgtatatatatatatgtatgtatgtatatatatatatgtatgtatgtatatatatatatgtatgtatgtatatatatatgtatgtatgtatatatatatatatatatatatatgtatgtatgtatatatgtatgtatgtatgtatatatatgtatgtatgtatatatatatatatatgtatgtatgtatatatgtatatatatgtatgtatatatatatatatacatgtatgtatgtatatacatatgtatgtatatatatacatatatatgtatatatatatacatatatatatatacatatatatatatacacatatatatatatacatacatatatatatatatatacatatatatacatacatatacatatatgtacaatatttattcggctgaatactattcagtttactgtttattcggctgaatactattcaaaaacactattcagtttactgtttaaattactgatcaaaaaacactgttcactttgagagatattttaactttaggatctttgcagg

SEQ ID NO: 17250 - DNA, 1106 bp, Oryza sativa
  unsure (1)..(1106): unsure at all n locations
accctccattccaccaattcttagtagtagtgactttagcctaccttgcatagtatattaagcaaggagttgtgtaataacgctgtgtaaggtaagaacagcttgcttgtacctaccttcgggtttcccgaaagggaaaaccatatgtaagcttatctgtttaatatgaagtaattttccttaagtattcctgcacgtttgttctagacaagtgtttatgctaaggaccctataggagaaacctcttcggtttgttctcgtttttagcctgcatcttgcataggcatctggagaatcggtatccgtagagaagtgttcccttcgggtggaactgcctggggagacgataaactcttagctagaacaagtgtgacttggaatatctttttaagttgcttctaaaaagacagataggtgaggcatacggtgagtaccgagtaggactttacatcatctgaaacaagcttctgaggctgtctaaataggattcgccaccctgcaaagatcctaaagttaaaatatctctcaaagtgaacagtgttttttgatcagtaatttaaacagtaaactgaatagtgtttttgaatagtattcagccgaataaacagtaaactgaatagtattcagccgaataaatattgtacatatatgtatatgtatgtatatatatgtatatatatatatatatgtatgtatatatatatatgtgtatatatatatatgtatatatatatatgtatatatatatacatatatatgtatatatatacatacatatgtatatacatacatacatgtatatatatatatatacatacatatatatacatatatacatacatacatatatatatatatatacatacatacatatatatacatacatacatacatatatacatacatacatatatatatatatatatatatatacatacatacatatatatatacatacatacatatatatatatacatacatacatatatatatatacatacatacatatatatatatacatacatatatatatatatatatatatatatggcgacctctgattcatctttcatctcccgctctgngcctgcaaacggagcctgtt

SEQ ID NO: 17251 - DNA, 1501 bp, Oryza sativa
gatatggggggggcgggtggtgagaggagaggggacggcggtagtgacgcgacgtggtcttggccagtggctacaggacggatggacagtgagagaggtgaaagaaggaagagaggaaagagaaagagagagggaagaggtgagaaagaatatgagatgaggaggaagtcactgatatatgggtcccacctgctgactcagcaaagtcagccatatttaactggtcatgccaacaaaaaacaactttctcagccaccaaagaagtctaattgcagcaactttcgaagatgggaatgcattataccctgtttatggttgagggatgatcactacaacaaatctgggcttctgtgacgattacctgatgacagaacacatatatgttataaacagaggctgtttatgacgattgttcacaggatgacaactatttatgaccaaaccgtgtctatgtcataatcatcgtcacaatatactgtatgggctctgtgacgatagcacgatgacaatagtatatcgtcataaaatatagaactattatatttttttaaaaacaaaaaaaatcttgttatactacattgctactagaccacaaatcgtttgtcctaggtggactcttcttctctatatcaattctagtctctcattttaggattttagattgaagtcatcttaaaaaatcagaaatatggcgtttaattttatgattgaatgaaaaaacttaaaaaaaaaactaaaatggctataagttggtttgaacctgcattacatgggccttacctttgactgttttgaacccatgaacaagtgctgcaccagaattatataggataaaaaggggggaaaacataaaaaagaagcaagctttgggttcgaacccatgacttaattctagaggagttttacatccacttcgataaccagtcgagacaattgttttttgtgacctaggattgttattttatatttgtagattgtgtgtggatgaagagaaaaaaaagagattgcaaattggcgtcgcccttgcccgtggccgcacaccacaccatagccggcagcagcaaagcagagcgcgccgaggccagctccctggtcgaggcgccggagcgccgccctccgctagcttctagcccgtggtctccgccagctgctagccctccgctcactactcgtcggtcggcgctaccccgtggccacgctttcggccgctgcccactaggccagatccagcgcgtcgcgtgctcggcgcgatggccagcaaccgcgacaacctcccgagctgtaggagcacagagccggcctgccggcgagcctgactgctccagttctctccgaaggctgacttcgatttgatttcttcgacttcagaggtaatcaaaattcaatgctatgttctgtagtgagtcatggtcagtgatagaaagctagaaggaatagcagtttgttatgatgattggttagttcttgattccttgattattgccttatttcagtgtgtcgc

SEQ ID NO: 17252 - DNA, 1501 bp, Oryza sativa
acgtgctagtcatcccataaatatataagtgagtctcaacttctcctttatgttgatgtaaccgattcaaacacttacgacatggacataatatctcctgactatcatccaaattagcagaaacaaagttcatgaactcagtgacccttctagatgttccttgctaaatagcctagtattcacccaacttctgtccatctgcgacacactgaaataaggcaataatcaaggaatcaagaactaaccaatcatcataacaaactgctattccttctagctttctatcactgaccatgactcactacagaacatagcattgaattttgattacctctgaagtcgaagaaatcaaatcgaagtcagccttcggagagaactggagcagtcaggctcgccggcaggccggctctgtgctcctacagctcgggaggttgtcgcggttgctggccatcgcgccgagcacgcgacgcgctggatctggcctagtgggcagcggccgaaagcgtggccacggggtagcgccgaccgacgagtagtgagcggagggctagcagctggcggagaccacgggctagaagctagcggagggcggcgctccggcgcctcgaccagggagctggcctcggcgcgctctgctttgctgctgccggctatggtgtggtgtgcggccacgggcaagggcgacgccaatttgcaatctcttttttttctcttcatccacacacaatctacaaatataaaataacaatcctaggtcacaaaaaacaattgtctcgactggttatcgaagtggatgtaaaactcctctagaattaagtcatgggttcgaacccaaagcttgcttcttttttatgttttcccccctttttatcctatataattctggtgcagcacttgttcatgggttcaaaacagtcaaaggtaaggcccatgtaatgcaggttcaaaccaacttatagccattttagttttttttttaagttttttcattcaatcataaaattaaacgccatatttctgattttttaagatgacttcaatctaaaatcctaaaatgagagactagaattgatatagagaagaagagtccacctaggacaaacgatttgtggtctagtagcaatgtagtataacaagattttttttgtttttaaaaaaatataatagttctatattttatgacgatatactattgtcatcgtgctatcgtcacagagcccatacagtatattgtgacgatgattatgacatagacacggtttggtcataaatagttgtcatcctgtgaacaatcgtcataaacagcctctgtttataacatatatgtgttctgtcatcaggtaatcgtcacagaagcccagatttgttgtagtgatcatccctcaaccataaacagggtataatgcattcccatcttcgaaagttgctgcaattagacttctttggtggctgagaaagttgttttttgttggcatgaccagttaaatatggctgactttgc

SEQ ID NO: 17253 - DNA, 1501 bp, Oryza sativa
gagtacaaatagaaatacaattaagaaagaactaaaatttaaaaaaaaagattgacacgagagtctagagtacctattggaatataatttagaaataattggaattcaaaattaaacgataagaaatattgaaagaagagggtagagttcatatagaaatacaatttgcaaataacagaaattcgaaattaaaaaacaaaaaatattagaagagtagtctagagtccgtacagatacgatttagaaataactaaaattcagagtttaaaaataaacaatattaaaataaaggtttagagtctatataggaataaaatctattatattattaaaagaatagaaaaaggagcctccacgttttcgctctcatggcctagaaattctcacattactcggagaaaaagaaaaagcagagtccatatagaaatacaatttagaaatagctgaaattcggaattaaaaaataaggaatattagaagaggagactagagtccatatagaaatacaattaggaaataactgaaattcggaattaaaaaataaggagtattagaagaggagactagagtccatatagaaatacaattaggaaataactgaaattcggaattaaaaataagaatattagaagtagagtatggagtccaggttagaaatacaattaggaagtaatagaaatttggaattaaaaataagtaatattagaagtagaatatagagtccatatagaaatacaattaagaaaaaaaattagaaattcagaattaaaaaacaaggaatattagaagtagagtataaagtccatataggaatttaaaactaattaaaatttggaataaacataataaaattaaaagtagagtttagagtccatataaaaatacaatttacaaataaataaaattcgaaattaagaaaaacatgggaggaagagtttaaagtcaatataggaatacaatttagaagtaactgaaattcgaaattaaaaattaaagaatattgaaagatgagtttagagtccacatagaaatacaattagaaataataaaaattcagaaataaaaataaataatattggaagaagagtatagagtctatatagaaatataatttacaaaaaaactcggaattaaaaaaaaagaaatattaaaagacgagtctagagtccatataggaatatttataatttacaaagaactaaaatttggtattaaaaataattaataactaacacgtatataaaatacaatatgaatattacacattagtagttttataaagttattgcaaaatttaaaattatgttgtcattttaatatatttgaataatataatgagaaaacaaatatgctattatatgagagaaaatataatgatgctagccgcacaatttgcgtgggacaccatgctagtttataaataaaggaactttgaaatttaaaaataaggaatattagagaactttaaaatttaaaaaaaatattggaagagaagtctaga

SEQ ID NO: 17254 - DNA, 1501 bp, Oryza sativa
aggagtcatataagatatctctttaaaaatctcacatgctaacttgagatgatcaaactcctaattgcaactcatgattttctagaaaaatatatatccaagccgcgaattcctagagtgaatatcatcttaactaataaatcgtataacaacaataaattaaagagtaacgtgtacgaacattccttaaacttgtaggggtgtgtcatctaggtccctgaactctcaaaatacatatccaaatcctagaacttgtcataatgtgttatctaggtctcaaatcgtcataaccccttcaaaaatctacgaggcattgatgtgacatgccacacagacatgacatggcattattttttctttttctttttttcttctcttttttcccatttattctcttttctctatgacccgtgtagaaaaaaagaaaaaaaagaatgggaagaaaccgaaaaagaaaaataaaagaagaaaaaaaaagagaaaaagacatgtcacgtccatgtggcattgccacatcagcgtcacgtaggattctagaggggatgtatcaatttgggacatagatgatacactttgacaagttatgggacctggatatgtattttgagattttagagacctttataacataaccttacgagtttaaggactgccaatgcactttactctaaattaaaataaccttcacccgttgtaacgcgcgagcttatttttttctctagtcttaattagtatcttttaaatatactcgtgatcgtgccgcgcctactggatctctgcttctgaccaaaatgttccgcattgaatcatcacaggactgaaaatcaatcctcgcaaaccacgagattatcagtatattaagtctcctgggaagctcacatgtatacccttgcaaactgtactgctatatgctaaattatctgcctgcatgatcattgaacgcaatcgtgagattctatggccttcttaagagcaacaaatgcacacctttctggacggggaaaccaacaaccaaatgcatatattgttgcacatcatcaaatgcccttcaaaattgtattagggcgcatgtgtatttcttccgttagatcaaaaattacaattcaaattaaaattcaaaaagagagagagagagagagagagaggattgagagagtaatcctgaaatgcaatgttttctgtaaaatacaatcggcttgtggtttttccccaaagaaacaacattggatgttactcctaattaagaatttcggcatttagcaagtactaaaaaataccagtaacaatttcattataaaaaaagataggataaatcacgatcgcaaaaactgaaaaagaaattctcaaaagaatgaaacagtttgcatcatgagaagaagaagacaagaagaggatgagccttcagtggcatatataaaaactggattactactgtactactctcagtctctcggcttctagactagggaagctcaccaacccaagaacaagaagtgatcgg

SEQ ID NO: 17255 - DNA, 1501 bp, Oryza sativa
acgaaagaggggtggacggggtggatctcagccacgcgaacccgacggcagcgatggcgcggtgcggcggtgagcctagcggcggctagcggcggtcggagtagcggagacggtggcggcgggtggttgcacggcgcgggagcgatggagagcacgagggagtttggcgagaaaaggaaaaagcgagagggagtgacggggaagcttaaataggggaggggagggccggacgtggccgggagaggcgggatttcgccggccaacgtgggagaagtgggggaggagagagaggcgggattcgaaaatcgaatcccggccatctcgggcacgggcgcgagcgggagagagaggggagtgggcgcggggaacgcggcgcacgcgcgggcgtggtcgacgtggcccggaggaggcggaggcgacgcggcggcggttgcgggcgcggcggttgcgggcgcggcgtcggctggaggagggagacgggcccgacaggtgggccccacctgtcggcgaccccgagagaggagggaggcgggacggcctggatgggcctcggcctgcggccggcccaacaaggaggagggggaagaaaggagagaatgggcaggcggcccattcggaaaaatggaggaaaaagagaggaaaaagaaaaagaaaaaaggaaaaaggattttcccaggaattaaaatattgcttgctcaattttaattggttaaaattatttctagagctctgaaaattccactaaaaatcctgttaatgaatttcgacatgtagaactcaagaaaaattccacatgtcaaatccgattattatttgcattactttcttagggttttctcttgatttcaccagcattttcttggggtcgttttaaaaaaaaatttaaattttaggcttgggaggagaacttcggggtgtgacagggaggaaacctgagagagagaggcgaagacaaagcgacgctagaaggaaacctgaccaaagatttttccgctgatttcgggatcgaccgcaatttccagacttttttctttgaatgggccaaacaggaacgggctagatggccgtaattgaaacaggcccgacatctcaccgagttggggcaatcagcataccgatgaccagcgcccaaacagcgggagcaattgaaacccccagataacgccgaatttaagcccgaatttgaaagggagcccgaatgatgcacaagagtaatggcgggcatagaaaatggcatctaattcaaaaaaatgggcgaagaacacggtagaacaggctttggtaggattttcgtacctgaagatgaagccttgggagggcgaatgtaagaatccccattggaaaagaacatccttttgaacactgaaggtttattcacttgagatttaccctttgactgattaaaatttaaaacttctgtggaggccttagtagaatgaacgagaaaatcacccttggtgtcagatagcctcttgaacattgaaagattattcacttgaga

SEQ ID NO: 17256 - DNA, 1501 bp, Oryza sativa
ttcattccgaatttcagttatttcctaattgtatttctatatagacagattctagtctcctcttctaatattcctttttttaattctgaatttcaactatttctaaattgtatttctatatggactctagtctcctcttctaatattccttattttttaattccgaatttcagctatttttaaattgtatttctatatggactctgtcttttctttttctccgattaatgtgagaatttctaggccatgagagcgaacttggaggttcctttttctattcctttaattatatatttaattccaaatttctttgtaaattgtatttctatatggactctagtctcctcttctaatatttcttatttttaattccgaatttcagctatttttaaattgtatttctatatggactctgtattttctttttctccgattaatgtgagaatttctaggccatgagagcgaacgtggaggctcctttttctattccttaaattatatatttaattctgaatttctattttttcctaattgtatttctatatggattatatagtctacttctaatattccttatttttaattccgaatttcagttatttcctaattgtatttctatatggagtctatactctacttctaatatttcttatttttaattccgaatttcaggtattttctaattgtatttctatatggactctagtctcctcttctaatattccttattttttaattccgaatttcagctatttgtaaattgtatttctatatggactctagtcccctcttctaatattccttatttttaattccgaatttcagctatttgtaaattgtatttctatatggactctgttttttctttttctccgattaatgtgagaatttctaggccatgagagcgaacgtggaggctcctttttctattcctttaattatataatagatgtttcagcacttagaaaaaaaaatgttacagttcttaaaaaaaagtgaaacatagtgagatagttagatgaaacaatttaattcaatatatacaataaacgatttaagtcattgaaacacttaaaccttgtatacatcaaaacaaaccccgtgtatttgaaaatattaaacactatctaaaatccacttcaaacatttgatacacacacacaaagaaacatcacaagtacactaactgaaacattgtttttgaaccattgaaacatcaacaaaacctgtgtgtcgaaaatagaaatatagaacactatcgaaatatccactgacatttgatccaaacacaaaagaacatcacgagtatactagcttgaaacacagaaaaaaaaacacacagaacctagtatggactgcatcttccttctctccgatgaacacaggcttgctcgcgtaggtcttctccaccactcccatcatcggatctgtaggaggagaagggggagggcggcggagatgaggagagagtgctcctgggggagagagggagccggcgagc

SEQ ID NO: 17257 - DNA, 1501 bp, Oryza sativa
gattgaagatctgtttgcaaaaatggaacctatcggttgagagcattccatttttatatgattttaatttttgatctgtacttttgcatttgagtccctgtaattttgtaatttttatatttacatttgagtccctataatcttgtgataagatacttgaggttgtttttgatttaaaaaataataaaagggaaagaacataggcagaaagctgcataaaaagaaaaagaaaaaccgcaaaaaaaaagaaaaagaaaaaataaacaacaacaaaactccgtttctcctaagtggcgaaaataaccgtagatccgatcctataaaaagcaaaaaaaagtgaaaaaaatactagatctgattcatttaaaaacggaaaaaaaaagtccgattcctataaaggcgaaaaaaattcgaaaaaacatataaaaagttcgtccagttctctaagaagaaaaaatggtttgtataaaataaaaaatacgcgtgaggaaaaaatagaaggggcgaaacaaattccgatttctaaccaatatatatctcttcgctacgtataatctaatctaactatttaaaaagagaaaatgcacgacaaaataaaaacggttcaaagaaacgtgtgagaaaaatcagaaaaaagcgcaaaaaaaacacgctaaaaaggttttccatcttccataaaaaataaaaaaacgtgcgagaaaaaaatatttccatcgtcagtaaaaaaattttaaaaaaacatgcgagggaaaaactatcagaaaaaacgcgccatttttaaaaaatggtttgaaaaaaccgtgtaaaaaaacatcgcctattaaaaaaacaaatcgatccgaaaaaactgtcagaaaaaagttaaattgatggacacttgagccggataggatccatcgattttttgtcatctactacacggcttttatttcgtcatatattctcctgtattggaaaaagaaaaaaagaacattcgaaaaaacaagcaaaaaaacacgcgagaaaataattgtcagaaaaaacatgcaaaaaacacactagaaaagaaaagcaaaaaaaggagaaaaatatggttttcgtcgtcagtaaaaaaaaagcaaaaagaacatgctaggaaaaaaaatgttagaaagaaatgcgccatttttgaaaaatggtttgagaaaatcgcgcaagagaaaaaaacatcgtttataaaaaagcatgtcgctcattaaaatacaaacattgtcattgacatgattatgcatgaaaaacgtatattatcattagaatttttttcacccgttgcaacacacgggcatttttgctagtatattagaaggaaaagagttttagttaaacaaacgcaatcagccagactggcttatgctaagggaaggaagaaaaagtaaaagaagaaaaaaaacctgaagcttacagaaattacggtggctaaaacagactccaagcagcgggaaggggctaagccatgctaaactcccaacaaatccccaaaagc

SEQ ID NO: 17258 - DNA, 1501 bp, Oryza sativa
agggcaaagggcctgacgagccgaagcgccacgtggttctcccaggcaaaaaaaatcgttggagtagacgacaagactgacgaggattacgatcagtttgatgggcaaccccctttcacggtgacggttgaccctagcatcctcctatcaaacgaagataccccttactcacgtagcgatcacaaggaaggaacaatagtgaggagaaagtacgtgcggacaaccgtcaccgccgatctattgccgtaattgttgtaaactattttggatgtattgaatatgctagttatatatgattaattacaatttttaacaatttaatatcatgcatatgctaattatatacgattattagaatttttaaaagttttaaatcatgcatgtgggatttacatatgttaattacaatttttaacaatttaatatcatgcatatgctaattatatactattattagaatttttataagttttaaatcatgcatgtgggatttacatatgttagttagaatttttaacaatttaatatcatgcatatgctaattatatacgattattagaatttttaaaagttttaaatcatgcatgtgggatttacatatgttagttagaatttttaacaatttaatatcatgcatatgctaattatatacgattattagaatttttaaaagttttaaatcatgcatgtgggatttacatatgttagttagaatttttaacaatttaatatcatgcatatgctaattatatatgattattagaatttttaaaagttttaaatcatgcattgtcacgtcctgataaattcatcctgaaataaaaatcattttctaaaaggaataatagaattaattaaaattcaaaaagaaattggcaaacattaaaatgcgtacaagaaaatttcgaatgtggcccggagaattttcgttaaattctccttggtctaaaaagagcactcaaattttacttaaattttcagagcaccgaaaatatttattaagcaacaacaactatgatcaaagtttaataaaaagaaaaacctaaaaataatcctccttcctcctttgggccaagtctggcccaaagtcctctctctctctcggcccgcggccaaagtcctctcttcctccctctctttttccttccctctctctcttgggccgccctccctccttcccctcggcccagctccctcctcctccctctccctcccgggctgcctctccctcctctcctcgtgggccgcctccgggcacaagccgagcggcgccctcccgcccgtgccgcgcacatgcgtgcgctgaccgcgcgcctggccacgtgggtcccacccgcccggtcgtcgtcctcctcccgcacagctcctctctctctcccgtgaaaaccctagttcgttcctccctcaaatctgcgcgatttaagcgttggattccaaaattaattggggggaattaatcccctttccttcctctccctatttcccctaatctcccctttga

SEQ ID NO: 17259 - DNA, 1501 bp, Oryza sativa
tataaaagatacacatgtatataaagtttgtgtgtatacatataaaaaaggaataagtctacataaccccctaatgtactgttggttgattacttagccccctgacctaacaaaccaggtatttaaccccttaagtttgttaatgccgtttacttaaccccatacggtggtttttaacctgattttgccctgctggcactccacgttggacagatgggcatgcataaaagattcgagcggttcgccaaacaaacatacccccacgacttctcctcgttctctccggcggcgcatcctccgcctctgcctccccggcgagacgaagcgagctgatgttaagaagtggatccactttatcggattgcagagccgggcaaaggtgagtgtctgcaactcgtttttgtgtttttttttcccaatcagatcgttgtcactccaaggattagggctaatactacaggggtttttagtattgatattttgtattttctctctgcagtctagatggtgccatattgtgggtagtaaggctcatcgatttcaatgaatttcttgtggtaaattaattaggtgacttgacgattttagtgtttaggtctttatgtatccccgcgcgcccatcgatctgccgtggcaggcctatctaacgtggagtgccagcagggcaaaaccggacaaagaaaccactataaggggttaagtaaacggtattagtaagcttaaggggttaaatacatggtttgtaaggtcagggagctaagtaatcaaccatcagtatgttgggggttatgtagacttattcctataaaaaaatctaaaatatacgtgtatacaaactttgtatacgtgtatacaaagctggtataagtatgtataaaaaccaaaaaatacacgtatacaaactttatatacacgtatatacaaaatttatatacgtgtatacaaaatttgcatacgtgtatacaaaatttatatacgtatatacaaagtttgcatacgtgtatacaaaatttatatacgtgtatataaagtttgtatttgtatgtatacaaagtttgtatacgtgtatacaaaatttatatacgtgtatataaagtttatatttatatatatacaaagattgcatacatacgtattaaaaagggaaaacagaaaaatatacgagaagaaaaaaaagaaaaaaaagaaaaccgaaaaaggtacggaagagaaaaaaaacaaaaaaaaaggaaaccgtacaccggaaaaaacggaccgtacgcacgtcgtcgccgcctcctctccacgcgcgacacgtgtccagtcgcgcgtgggagggtgagcgcgaatagtcgcgtattagccgtttcgcccacgggaggacccacgttctagccccttcctctctgagttgacttccccctagaagtctacatcaccaccctatgctttagtataaaagccagagagatttttcacctactgaagtctacataatacccttcgcagagcctaccagtag

SEQ ID NO: 17260 - DNA, 1501 bp, Oryza sativa
ctccttccccctcgcgcccaccgccgccaccgctcgggtaggagggagagccgagagagagagagagccgagagaaagagaggaagaagaaaagaaaccaagggagggagaagccgaggaagagagaaaggagccgggagggagagaagaaagggaaaaagaaagagaggagagaaagaaaagaaaaggaaaagagagaaaaagagaaaaagaaaagggagaagagaaaagaaaagaaaaaggaaagggagaaaaagaaaaaggaaataaataggaaattagagggagtttggggaagtttagaaaatttaaaataattagaatttaattatagattaattatagtcgtagaattacaaaatttaatataaattatggattattcttagtaatttctataagaaatcaattcgcggtagtaatttagatgtaattaataactaaacaaatagatgaattcttatagattattatagattatttttgggtaatccctataagtaatcgattcacggtagaaattcggatttaatcgctaggaattttagacgtatattatatttaatcgtttagtcatagactaaattaaattgtataatatttctaggatttcgtccaatatttagctcgtaatagaaatttctaacctattatatacaatgctcggggagagtaaattattgacaatgaaataattatacccgcaaagtagtttaaatcgaaattgggtttgccgtagtttgcagatagtaaagttaataaaaaggaatcgactttcgcattcgactttcatttggatttatttggatttttatttgaattctaatcgaattcaaatcaatttttgcacgtaactatagagcccgagggagttgcggatccaagcgaaggccaagacccgcaagactttaagcaaggcaagtcatcactattcgttgaacatgttgatcctaattgcgaaattgtttgtttacaaataaaattgcatgcaatgatgaacgtcctacttgtgattatgccatgccttgattattgtttacccttaaaatccttgtacccatgattacgtatgagtccctagtcaattatgacaactgcttagaaatgctattctaaaatcatgcatactcatatttatcaaatgctatatgcttgggcaattacctttgggaaggtaattgagatgcggcatgtgaagacatgagcgccacattgccatgatgttgatgacatgatttgtgaaaggagaaataaaattaaacaactgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacgatgggacagccgttgaggta

SEQ ID NO: 17261 - DNA, 1501 bp, Oryza sativa
atcaaatagggaatttagccctcaaataatccaatctgaaattcgatcctatggagatttaaacttaggaccttggggtgctactcaggtcactgcaaccactaggctacatgcccttttaaaaatgtatgtgtttcataatcaccactcactgaaatagtttatctaaaatggcatttcatggattttctcttacatattttaggcattgaacgtgcagactaataatcaagtcaaaactcgtcggccctgcgaccaccgtgccgatgcatgaggcccttgagtcactccttgtgccgccacctgccacctccttgccgcccgtcacattgacgcctgggaccgccgtacaaacgcctgctactaacgcgtcgtggcctgggagccctgcacctccgcttgggagcagccgcctgggaccgccgcacgaacgcttgctgccgccacgccactgcctaggaccgccgcgccaccacctaggggcccgtgccgccgcctgggacagccgcgcctgcgaacgacgcgctgccgcccaagggccctgcgccgtcgcctgggagcgccacctcgctgccgtcgcctgggaccgctgtgccgccgcttaggaccgccgcgcttgcggccgacgcgtcgctgcctggggaccccgcgacgccacctgggagccccgtgccgccatctgggagcgccgcctcgtcgccgtcgtttgggagccccacgccgtcgcctgggaccgccacgcgttcgcttggcggccatctcgccgccgcctgggagcggccgtctcaccacctgggaccgccgcacgaacgcttgctgccgacgcgctgccgcttgggagccccgcgccgccgcctggggggcccacgttgccgccgcctgtgagcgctgcctcgcaattgtcgcctatcgggagctggattgggttagtataatttggagttagggcaatttggttatttttgtaaatttttttcgttctaacagtgtggactaacggtgtgatggcattttcaaaagaaataggcttgtatgacggcattttcaggaagttgcgtatgtcgatggcatttatgggattaaagtgcttgtcgatggtatttcatagattttctcatgattttgtttcaaatgtcagacgggatagtaaacaccgttacgttgcacttgaatactttccttcgattggaaacactattagactattagtaaatatacggagtccgaagctagcgattaatccacgcgtgcatgctaagctaattaattaatcactccgactccgattcgtaatccgacacgaatgaaggaattagcgctatataggtatgtatacagtgcaacggcgttgccctgtctttcatcatcgaccggtgaatcgcgattcttcatctgaatcctcacttgtcgtcgccgtagctctcagctcgagcagattgagaggtcgcgatggatcaggaggtgatcatggcgacgccaccgctgccgccgccgcctcgcg

SEQ ID NO: 17262 - DNA, 1501 bp, Oryza sativa; identical to SEQ ID NO: 17261

SEQ ID NO: 17263 - DNA, 1501 bp, Oryza sativa
cacccggccgtcgccgagcccgccaccgtcatcgccgtcgagcccacccgccgccgccacagtcgcgccaaatccgggcaggggccgcccgctcaccgctgcttcgctggtgtaccgtggaaagggaggcacgacgaggacgacgaccgtggaaaggggccacccgctcgccgccacctgctctccgccgctgccttgatgacgcacgtgacgacggcatcgtcgtcgagggacccgagcgacaacgtgcacgacgaggatgacgaccaggaggagggtcccaccatggttatctttggacggaggaatagacgaacggacgacgacgcctccgcctcgctgctcaggacctcgctcggtcgccgcctcacccggccaccgccatcgtcggcctgacagaggggaaggggagtaggggagggggaggacgagtggaaggggccgccaccgacgcccgctgttgacggaggaggggagggggaggaggaggggaagccgggaaggtggggaggaggtgggaagccgggaaggctgagaaaggagataaggtagagagagaggggggtggttgatggagaataaaagggaaaaaggaagggagaggatgtgaaaaatttgaagtgggtgggagggaaaggtgggaggtattttcctgtgtggtccacttaaaaagcccgcatgcgaaaatcgatttttctatacggtcatcttaagtcgaccacacgggataatgacaattatcccgtgcgttcggattaagacgcccgcacgggaaaatgcatttttccatgcgggcgagaacccggcgccggtccccctatttttccgtgcggttccacttacagaccgcatgaaaacaaaagggggcggtgtccaggagaatctatctttgtagtagtggtagtagtaatttagaattacattcttttcagaacaaaatttgaatgctatgattatatatagggacaatttgcttatatatatattgtcttttggacgaatgtagcacgatatgaatgcagtacatttggaaagtgttgcaataagtagccgatcactgtaactcactgctgaaacagaggtcaaccgcagtttacaaggagttaagacccagttcgattattgtacttaattattgttatgattcattcatgcataaagcggtgcgtagatcctacgtatacgtaccaaccgatcgatagattattatgatgtcgtaggtaaagctgcagaggcgactatattggacgtacgtgatcaaatcattcagtttggacggccttaattcgcccatctgcaaattcggcgccaaattggccctttttgcattgctcatagctagctggtcgatccatcgattgatgtatcaataatgcaagcaagctgtgtttgtattcatcgatgcctatataaaccacgcgttgcctcacctttcacttcatccatctctacacatcagcaatatttagctacacagagctatctaggattagctgatcag

SEQ ID NO: 17264 - DNA, 1501 bp, Oryza sativa
atactttgatataataacgtgattttgagggattttcgtaggtattgaactaactcttacaaaattcctgatttctttccctataaaatgagccaaattctccaaatgcgataagtatttttttaattggaatcctatatgcgttacttccctccaaggagcacaaactccaccagcagccagcctgaccagattttctccagctaggagtagaaaagaatgaaagatacagctacaatagactagtactactaccaccagtatacatcccccattctcgttggtagtaaaacacatgtggtcattaaaagaagctagggagaaacagcaggtgaggtgagccataagaaaaaaaaaactaataaaaaaagatggcgtcgtgtgacacccaaaatccacacacacaaaaccctttcacacaaataaaaataaaataaaacaaaataatagaaaaaaagaataaactatagatagataagtatagaggaggagtaaataaatacttttctccactacctcccttccctttggcctttcgggacctcaacagagacgcacctcggtctctctcctcctccacccaaagctcccacctttcccttcctcctccctcctgcgctcgcctcctcgcccaattccgtccccaattcggcgctctcccgcggcgcgatccgtcgaatctgcccggattcggtgtcgattccacgcggccgccgggggagcccccctcccgccgatttgtttcggagcttttcttcttcttcggattcttccttccccaatcctttggttcttgttctttggtctctccttcgaaattcgatccctcgccggcagcttagccggcgcggcgcggcgcggcggcgatccatctcccgcggtttcgatttgggtttatttgggcggtggggagaaatccgtggttcggtgcgtttggtatgagctgaaaaggtcgtcctttttttttttgggttttttccccctgatctgcgcgtgttctcttctcctggctcgattgcgtgttgtagattttgtgtttttgttcttgcgtttaaatcaggggggaaaattcctactctgtaaacatttcagcccgattttctgttcatttccacgtttgatttggtgcaggaaaagctagaatttttacccttcttttttccgaataatatttctctgatttctacctgcgtagatctcgttttcctctttggttttgggtctaaggcctgcaccgattcgatcaaggaataaaaaaaaagccattgatttcccatttccgaaccttttatttacctcaacaaactccatttcttgctgttcctacgcccaattcgtcctgatctggttgtccaagcttgggattcgcctccacttcccttgatttgttcgtccgcgttaaatccgatggcgcaggagagctgtgatctcaacaaggacgaggctgagatcttgaagccatcatcatcatcctcaccttctccttccccaaccacagcct

SEQ ID NO: 17265 - DNA, 1501 bp, Oryza sativa
ggattagtcttccatatagttcatagatcatacaacctacaaggtttcaatgaatggaaatagttgaggtcaattaatgtataacatctacagaaactatggagaaatggaaaaaatatatatacatgaaacaaggatgtgcaaatgccaagaacaacctaggaactaggaaaaatgaaatgcagcattgtgcaaatgatgagacaggaaccagcaacaagaaaataatctcagaagttaatccagctgagtcaaataatctcacagtttggaatgcaaataagtaaatcaatttgcaacttaaagaaatatatcatttagaaatactatacattggaaacaagcatcacatcacgatgtataactgttaaaatgacaattcttatctgccaaacaaaatgctaccttgagtgtatggcattttacatcttataggaactaagcaagcagggaatcataacaaaaaattacaaataatgatgtatgatcatgggtttatacctcagatcttaatatgactccaccacagaagtgtttatacctcagatcttaatgatcttggcagccctgatcacaggattcgcgcgggcaatctcctccctgcccgcggttttataatcgaaggagcactcatgggtctcggaatgccggtggcgaggacagaagagctccccgcagcggcaccggaatccggtcaaaccgaccctcttgcggcacacgttgcaccggttaacaaacagcaccggagataatggctcggctaccgccgccacgaccacggcattagcatcggtggcggtggcttcggctagtttcctcttcttggaaacctctatgagaataccttcgcagttcttggctgagaattgaggagctgctgctgccgatgccgctgctgctgctgccggtggtgttggtggtgtcgattgcggaggcggtggttctgtcatttgtgctgttggtggcgatggggaggctgtggttggggaaggagaaggtgaggatgatgatgatggcttcaagatctcagcctcgtccttgttgagatcacagctctcctgcgccatcggatttaacgcggacgaacaaatcaagggaagtggaggcgaatcccaagcttggacaaccagatcaggacgaattgggcgtaggaacagcaagaaatggagtttgttgaggtaaataaaaggttcggaaatgggaaatcaatggctttttttttattccttgatcgaatcggtgcaggccttagacccaaaaccaaagaggaaaacgagatctacgcaggtagaaatcagagaaatattattcggaaaaaagaagggtaaaaattctagcttttcctgcaccaaatcaaacgtggaaatgaacagaaaatcgggctgaaatgtttacagagtaggaattttcccccctgatttaaacgcaagaacaaaaacacaaaatctacaacacgcaatcgagccaggagaagagaacacgcgcagatcagggggaaaaa

SEQ ID NO: 17266 - DNA, 1501 bp, Oryza sativa
aatattcctttttttcattccgaatttcagttatttcctaattgtatttctatatagacagactctagtctcctcttctaatattcctttttttaattctgaatttcaactatttctaaattgtatttctatatggactctagtctcctcttctaatattccttattttttaattccgaatttcagctatatttaaattgtatttctatatggactctgtcttttctttttctccgattaatgtgagaatttctaggccatgagagcgaacttggaggttcctttttctattcctttaattatatatttaattccaaatttctttctaaattgtatttctatatggactctagtctcctcttctaatatttcttatttttaattccgaatttcagctatttttaaattgtatttctatatggactctgtattttctttttctccgattaatgtgagaatttctaggccatgagagcgaacgtggaggctcctttttctattccttaaattatatatttaattctgaatttctattttttcctaattgtatttctatatggactatatagtctacttctaatattccttatttttaattccgaatttcagttatttcctaattgtatttctatatggagtctatactctacttctaatatttcttatttttaattccgaatttcaggtattttctaattgtatttctatatggactctagtcccctcttctaatattccttattttttaattccgaatttcagctatttgtaaattgtatttctatatggactctagtcccctcttctaatattccttattttttaattccgaatttcagctatttgtaaattgtatttctatatggactctgctttttctttttctctgattaatgtgagaatttctaggccatgagagcgaacgtggaggctcctttttctattccttaaattatatatttaattccgaatttctattttttcctaattgtatttctatatggactctatagtctacttctaatattccttatttttaattccgaatttcagttatttcctaattgtatttttatatggactctagtcccctcttctaatattccttattttttaattccgaatttcagctatttgtaaattgtatttctatatggactctgttttttctttttctccgattaatgtgagaatttctaggccatgagagcgaacgtggaggctcctttttctattcctttaattatataatagatttccagatattcttttacccccaaattccaagtagtaacagagaaagaggggcaaagctagtacaaattacaaaagcaatagcacttgagagaaaaagaaggggagaaaaagtaaacacacatccacccagctagtgcttaaccccattgtgtgtatggattcagtgcagcagctgcaggccaagcaggcagcacagcactacacatacaaggcacacacatcccatgctactagtgctgttgcc

SEQ ID NO: 17267 - DNA, 1501 bp, Oryza sativa
cggccgccgtcgccgccccgggtagcagagagccgagagagagagagagagagagagagagagagaaaccgagggagagaaagaagaaggaaggaggagagaaaccgggagggagagggagaaggaaaaagaaaagaaaagggagagagagaaggaaaaagaaaagaaaagagagagagaaaaaaaataaaaagaaaggaaggaaaaagaaaaagaagggaagaaaaagaaaagggaaatagataggaaattagagggagattagggaagtttagaaaatttaaaataattagcatttagttatagactagttatagacgtagaattgcgaaatttaatataaattatggattattcttggtaatttctacaagaaatcaattcgcggtagtagtttaaatgtaattaagaactaaacgattagatgaattcttatagactattatagattattttgggtaatctctataagtaattgattcacggtagaaattcggatttaatcactaggaattttagacgtatattatatttagtcgtttaatcctagactaaaatttaatcgtataatattataagataattttaggattccgtccgatatttagcttgtgatagaaatttccaacctattatatggatataatgctcgggtagattaaattaaaaacttatgataacaaaatatttatacccgcaaaatagtttaggatataaaaatcgaaattgggtttgccctagttcgcgaatagtaaagttaatataaaagaatcgacttacgcgttcgacttccatttggatttatttggatttttatttgaattctaaccgaattcaaatcaattttcgcacataactatagagcccgagggagttgcggatccaagtgaaggccaagacccgcaagactttgagcaaggcaagtcatcactattccttgaacatgttgatcccaattgcgaaattgttttgtttacaaataaaattgcatgcaatgatgaacatcctacttgtgattatgccatgccttgattattgtttgccccttattccttcgtaaccatgtttacgtatgagtccctagtcaattatgacaattgcttagaaatgctattctagaatcatgcatactcatatttatcaaatgatgcttgggcaattacttttgggaaggtaattgagatgcggcatgtggagacatgagcgccacattgccatgatgttgatgacatgatttgtgaaaggagaaataaaattaaacaattgttttcgactggggcggacggaggatttgggtggtatttgggaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctaagtgaggcaggtgcgctacgatgggatagccgttgaggtag

SEQ ID NO: 17268 - DNA, 1501 bp, Oryza sativa
ctaggtatctcttatctcaccactatataatattattgtatcttgttgttataaccatgtttttatcataactctgctggtcaacaacgatgttagaattatctatgttttacaattattttcataggatctaaggacgagatatagtggtttctaaggaggatatgtgcgactactgctccctatttcattgtcatcattagtattcttggattttttttctcatagtcgtgactttttcatgccatatgatttataattaaatgataaaaatattaaatcatgtgatggtaaaaaatattaaatattacctcctgtatttttacaagcatacaaagtgtacatgtgaaggcatatatatttacatgtaatgacataccagtttaaaacatcaacttatcatgtttttcacctcaatatgaatctgttcaaaacaaaacttcaaaaggcatgctcttttgttttatgagatgttgcaagacagttggcatgtgcttggctggagtttgtgggcagattggaaatggttttggttaggtccatgagcacagtgaaaaacaaacagaacaaaagaggaagataaaaaaaagaagaagaaatacataagcagataaagccaagagcaaaggaaggacacaaagtaaataaaataaagtcccctggggtcaaataaggtagaccctttaccaatgcaatcctgacgtgcttcacctcacctgctcattttttatttcccaaattataaaaccttttcttttttgttccccaaagattacgtgctagtaggggcgttaagaaaaaggaaaagaaagagaaggaaaaaaaaaacggagagagaaaaattggagaggcgggcgagttaggggaatttacgtaggagacaagcgaaatccctaaattttctctcctctcctcgcgagttgttttgagtgagtttctgcgagtgctcttgagcttccatctttccgcataaggctttgcaagctttgctctagcctttttttttttgttcagattattttcttgcggtttgttcttaagtactcgctagtgtccctaatttcctggtaatttcttggtaatttttggctgcttactttgctcgagctgggatctgtgtttcagtgctcacttgctaaatccgaaccaaattaaaccttggattttaaaactccttccagctatttttccgtttttatttgggaaattgtgggtttaccatttcttcctccgattttcttttccattttctcccctcatttgagcttccttctcacccattccaagaaatcaccatccttccgctgtaaaatcgttgaaaaaaaaattgttccacagctttgagcagcgcggggtttatggtggtttttgcagctctcgtcttcttcctcagctcgccttgaaatttcggtccaagaaatcactgagctgagtgagctgctgagctgagcttctgcgagagaaggtgtgggaatgatggaggtgactcaggtgagggcgt

SEQ ID NO: 17269 - DNA, 1501 bp, Oryza sativa
gatttcgtcataaaccggcccaaaacctgtgacgttatagcaatttcgtcacgatttaaatacttcaaaaccatataagagatatgtaaattttgtgaacaatgttactatcactttatcggatgaagaaatgaccaaaataaaagttataaatattgatgagttatacaacttggatgttgatgactttttccgttgaaataatttagtatatgaaaatattgtttgaacttgtcataatttgaaattcaaattcaaattattgaaacagagtcatataccaaaatggccaaaacaaaagttgtagatattgatgatttatacaactttgttgtatatgactttttcagttgaaaccatttggtatttgaaaatgttgtttgaagttgtcataatttgaaattcaaattcaaattattgaagagagtcatatagcaaaatgaccaaaacaaaagttgtagatattgatgatttatataactttgttgttgatgactttttcagttgaaatcatttagtatttgaaaatattgtttgaagttgttataatttaaaattaaaattcaaattattgaaacagagtcatataacaaaatgaccaaaacaaatgttgtagatattgatgatttatataactttgttgttgattactttttcagttgaaatcatttagtatttgaaaatgttgtttgaagtagttataatttgaaattcaaattcaaattattgaaacagagtcatatagcaaaatgaccaaaacaaaagttgtagatattgatgatttatacaatttttttgttctggactttttaagttgaaatcgtttagtatttgaaaatgttgtttgaacttgttataatttgaaattcaaattttatataggtcaattaaactcagatggagaaataatcaaaataagataggtagatctcaataagttatacaagtttgtttttgacaacttttccacataagtttatttagtatgataaattcgattcaaagttttaatattttgaaattaatttttttccctcctccctccttcaaattttttcatctcgtcttctctctcccattctctcctatattttcacttccccatccttatcttatcctctcctctcctctctgcctcttagggcatccataatgttgctagaaaccaggcattagacattcaatacatccttactacctggtaagaagtattgtgagggtgatacataactactatttagtcatatagctaatacctagtaagaagcgctgtatgcctgacacatggagtaaaaaattaaatgaaagcaactggttgccacgtgcaggtgtacaattgagtgatggatgatgttttttcaagaggggtctaccttattcctccctattacacataagcattgtggcctcctgtgatatactattgctatgtactgtttgggcccaccctcctaccgatttgggtaggatacattgagcttgcccttactctttcctcctc

SEQ ID NO: 17270 - DNA, 759 bp, Oryza sativa
ttgatttgaattcggttagaattcaaataaaaatccaaataaattcaaatgaaagtcgaatgcgaaagtcgattattcgcgaactaaggcaaacccaatttcgagttttaatatcctaaactattttgcgggtataaatattttgttgtcctaagtttttaatttaatctacccgagcattatatccatataataggttagaaatttctatcgcgagctaaatgtcggacgaaatcctagaaatattatacgatttaatttagtctatgactaaatgattaaatataacacatggctaaaatccctagtaattaaatccgaatttctaccgtgaattgattacttatagggattacccaaaaataatctataataatctataagaattcatctatttgtttagttattaattacatctaaattactaccgcgaattgatttcttatagaaattacaaagaataattaaattttgcaattctaggaccatgattattctatacttaaattctaattattttaaattttctaaactattatcccccctaattttcttcctaatttttctatttatttttcctttttctctttctccctttttttttcttttctcttcttttctttttctttcttttctctctctgctctccctctcggctctcttttcctctctctctctttctctctctcggctctcttttcctctctctctcggctctcttttctctccctctctttctcggctctatcctacccgagc

SEQ ID NO: 17271 - DNA, 1501 bp, Oryza sativa
agtggaaatagtgggagaatcgctacaccgctggtcgaggacctggtgtagtctaaacccgaccactagaagtaagggtagtgggagaatcgctacaccgctggtcgagaacctggtgtagtctaaactcgaccactagaagtaattgtacgagagatcgctacgattgactggttgagaactagtgagtaggtgtctctcgatcatttgaagtcgtctgaagtcgtagtgcaaggaccgctactctgctggtcgaagaccagtcatagtcgtacctcaaccgtctaaagtcatctgaaatcgtggtgctaggaccgctactctgctgccggtcaaagaccagtcgtaatcgtaccttgaccatctgaagttaaggcgcgagagattgctatgatttactggtttgagaaccagtgagcgaatagaattatctctcgaacgccaatggaagtcgcggtgtgagagattgctgctgtcgaatggttcgggaaccagcgagttgaattatctctcaaacgccaatgggagttacggagcgagagattgctacgtactggttcgggaaccagcgagcgagcagaattatctctcgaacaccaatggaagctgcagtgcgagagattgctacgtactagttcgggaaccagcgagcgagcagaattatctctcgaacaccaatggaagctgcggtgcgagagattgctacgtactggttcgggaaccaacgagcgagtagaattatctctcggacaccaatggaggtcgcggtgcgagagattgctacgcactggttcgaggatcaacgaatgtgtagaattatctctcggacaccaatagaggtgttgcggtgcgagagattgctacgtactagttcgaggaccagtgaacgtgtagaattatctctcggacaccaatagaggtgctgcggtgtgagagattgctacgtactggttcgaggaccagcgaacgtgtaggattatctctcggacaccaatagaggtgctgcggtgcgagagattgctacgtactagttcgagaaccagcgagcgagcagaattatctctcaaacaccaatggaagctgtggtgcgagagattgctacgtactggttcgggaaccagcgagcgagtagaattatctctcgaacaccaatggaagctgtggtgcgagagattgctacgtactggttcaagaaccagcgagcgagcagaattatctctcgaacaccaatggaggttgcggtgcgagagatttctacgcactggttcgaggaccagtgaacgtgtagaattatctctcggacaccaatagaggtgttgcagtgcgagagattgctacgtactggttcgggaaccagcgagtgagtagaatcatctctcaaacaccaatggaagtttgcggtgcgagagattgctacgtactagttcgagaaccagcgagcgagtagaattatctctcggacaccaatggaggttgcggtgcgagagattgctacgcactg

SEQ ID NO: 17272 - DNA, 1501 bp, Oryza sativa
actaccccacatattatactggtgtgattatggtgaataaaaagcaacatcggctccggccaacaggatgtagcgctattacctgattgctcaggggcccaaacctgtataaaaatccctgtctccatctcttttacctcagtctcgcgtataccctagcaccgacgatccccatactgtccaaataccgtagtcgagacatcaaacgtcaacaggcgcagattggacggaaccctaatgacgatggcattttttggacacacacttgtcaatagcatttcttggattttgacatttgtcaattgcatttcttggattatcacatttaattaagtttgaccaggaaaaaaatcaaagtgacatagagtattatattttaggatggacgtagcattaatctatcttactaatgattttttggacgacaataatccatctccgaggtatgtgacctggtgccagtcagccggtttagcttaatatgttcagcccccacctcctccccacccacacaaacttttctattttattgttggatccgcctctgtagctactgaagtgtaacagcagcagcactaggccaggatgccactgaacagctgcagcgccggtggcagtgtcgatgtaatatgtgttcccttcgtcttgaaaaaacaacattgataataattataggacataaacgaatatggatatgagccatattcagattcactcatatctagttttgatgtactaagttatattccatccttaccaagaatagttttcacttttctttgacggagggagtactccggagccagagctgcaccagtacacgatagattttcgtggacgctatccccttttgtttccatgcgattcgtaagtggaaccgcacgaaaaaataggggaactggcgcctggctgtcgcccacacgggaaaatcaattttctcgtgcggtcctcctaaacggaccgcacagaaaaatgagccgattttccagtgcggatctattaagagagccgcacgcgaaaatagtattccctcttttccctctcacccacttcaaaatttttcctcatttatctcttttaatttctcctcacacccctcccctcttatctctcttctctctccccctctctctgtcacacctctcctctcgtctcctttcggcacgcggggacagtggcggcgcggcggcggcctcagctccacacggcggcggtggaggtacgggatccggcgggcggcggccgtccccgcacggatccggtggccggccggcgttcccccacgcgggatccgctcccctccccagatccggcggaggggaagggcgtcggtggcggtgcggccggaggggagggtggatccggcgggcagcggaggcgggcggcgcgaaggggagcatagatccgtcgggaggcgggcggcgcagatccagcgggcggcgacgcagaggccgccaccgatgaggaggaggaggaggaggcggcggcggcgccgccaatt

SEQ ID NO: 17273 - DNA, 526 bp, Oryza sativa
aatgggccgacggcccatttgacaaaaaggaggaaaaagaaaggaaaaaagaaaaagaaaaggaaaaaggatttttccctggaattaacaatattgcttgctcaattttaattggttaaaattatttctagagctctgaaaattccactaaaaatcctgttaatgcatttcgacatgtagaattcaagaaaaattccacatgtcaaatccgattattgtttgcattgttttcttagggttttatcctgatttcctctgcattttcttggggtcatttgtaatttacaatttggcttgggaggaaaacttcggggtgtgacacgcgccgcacgcacgctgaccgcgcgaccgcgtgggtcccactcccggtcgtcgtcctcctcccgcctggctcctccctctcccgtgaaaccctatccgttccctccctcaaatccgcgcgaatcaattaacttctttccaaattgattagggggaattaattccctttccttcctcttcaattccccctaattttcccattgaa

SEQ ID NO: 17274 - DNA, 750 bp, Oryza sativa
aaaagatccgtctcgcaatttacatgcaaattgtgtaattggtttttttcatccacatttaatgcttcatatatgtgtccatacatttgatgtgatggaaaagttagaagtttaaagggaaaacacagcctaagtgggttctatatgcatggccggctggccagattccctcaaacttaaaaggaatataccagagtgatgcattctgttttttcgagcagctgcgaccatactgttgtcttatttgaggcgctacctagttgctctgttctttttttaaaaaaagaaaaaatgaatcaaatcttgtcttatagcatgtacaaattgaactatctataactgctagctatagataagtcatatcacctaagtccaccattatctatttttttcatccgatgagacctgcaaaaataaaatattgtatcacctctttccacgtggcacgtgctatagctttgactaaaaatttgagagaaaattcgatctgaaaaaagggtaaaaaaattagcacacgttttttttcctcttaagttaaaagcacaggtcaccgattttccttctgataagtagcatttccgtctcattttgagtaaatgacgttagattttatccgagtagagaaatttatcctcaggctaattaaatttgctctttgctttcatcgtcactgagccaagtgccaaagaggcggttcggcacgggagcaggcatggtggtgtgggtggtgcaggcgcattgcggacctca

SEQ ID NO: 17275 - DNA, 1501 bp, Oryza sativa
ttggattgataccaaaatatgccctaccaatttattagtaccttaaatagtaatcatataggtttggattgaagccaaattgttagtcatacctatgattaatttgtcactaatctagaaccttcttctctatatcatcaatacttgtcatcatattggtagcaatccaaacatatataatgaatctctacccaaccaaaaaattgatagtaccaaaacatgtcaagaatttggcactaccaatgatttggtaaggtagagatctaaacagcctcttaaagtcgtgtgactttatcgctgatatgtgaacctaataaatactacatccgttttttaatagatgacgccgttgatttttctcacatgtttgaccattcgtcttattaaaaaattttatgcaaatgtataagatataaatcacacttaaagtactatgagtgataaaagaactcataacaaaataaattataattacgtaaatttttttgaataagacgaatgatcaaacatgtgagaaaaagtcaacagcgttatctattaaaaaatggagagagtattggattcatatgtcagtgacttgtgactttgaaggtggggtatcttgatcaatccccacctcaccaactgcagggcgggcaagcaggttgaaaaagaaaaatacaaagagaacccaagtaatcaagtggtaatataaccgtggtctgagtcctctgataggtaattaggtagatatctgatgctaccggaaatcaatctgcaatctggcatgcggagcggacctcatcattttctcagttaagtggctaattaacgcctgatcttttccgggcatttttatctgaatccgatcgataatacgcacgatgcaattttcacaggtactccacagtgtccgtcgatcggcatgcacgtacgcatgaatcaacacggcagcttttcgatgggtagcatgttaattaccaccatggccaaccgacgttaatttgcatcaaaaggggttaattagctgccagagtgacacgtcgaccactgaagctgtgaagactgaagaatcatcccgctccatgatttgccgcgcccatcgaagcttttaaacgtacgatcgacaaggctttgctttttttttgggtagcgatacttcaacgagagagaacaatacttccatcgttttgttttcccacatgatgatgttttgcacaggtattcagaaatgatgcagagcaagtgcagaatatacaatataatgcactcttggatactttggtgggtgtagccttgtatatatatgttcagaaaataatggttgatacttacctccaggcataatcaggaccatgggttaaactattcctagggcttggtaaacaaaaccatgacagatgtacgggttagaagagatgtctttaggccttgctttgacagtttgactgcatatcaagttatgaaccctatagctaagctagctagctaaacctgcaatgcatttgcactgtatatcttc

SEQ ID NO: 17276 - DNA, 675 bp, Oryza sativa
gccgagcgcgggagggagtggggcgacggcccaagaagataaaaggggaggaaaaagaaaaaggaaaaatgagaggatttttcatgtgattaaatattgcacttgctcattttaaattagttaaaattattttcaaggctctgaaaattctactaaaaatgcatgcggaactcaagaaaaattccaccatgtcattttcgattattaattgcatttattaattagggattagctctaggttaattaatcaatttcttcggacaatttatttaacaaatttttaaagaaaaaaaagggaaacttcagggtgtgacaggagatggcggagacgatgcgatggtgccgctagccacgaaggccaggacgtcgcacgcggagagacaacgcccgtgaggtctgtgtgctcacttgctatcccctcttcccattcacaatttgattcggttcgattttatttactactagctcatagtgatctctgttcaatcccaaatcttatctatccaattcaatctgatttgtacctatccaatggaagcagagcctctctgtatctgtctctatttctccctctcttcaacttaattaatggataaagaacattttcttgagtgattggagtttgaggatgatgcgtgcgggtccggaggatgaacaggaccacaggagacgaga

SEQ ID NO: 17277 - DNA, 677 bp, Oryza sativa
ccatccgcacctcttcgccagctcttctgaatctcggggtcgagattctgtttaaggggggtaggtttgtcacgccctgaagttcccctcccttgctctaaattcataaaataaatcgtccgaagaaattgtttaatttaacctagagagaaaccctaaagtaataaatgcaaataataatcggaatcggcatgtggaatttttcttggattctacatgtcaaaatatgctaacaggatttttagtggaattttcagagccttggaaataattttaaccaattaaaaatcactaaagtgcaaattttaattccagggaaaatccttttcctttttctttttcttttccctccctttttccctccttttttcttttcggatgggccgccggcccattcccctccttcctccccctcctccttgctgggccggccgcaggccgaggcccagtccggcagccaggccgccccgctgcctcctctctcggggtcgccgacaggtggggcccacctgtcgggcccgtctccctcctcccgccgatcccggcgcgccgccgcgccgaaaccgccgccgcgcccacgcctccgtctctcccgggccacgtcagccacgcccgcgcgtgcgccgcgtctcccgcgctctttcccctctccctcccgttcgcgcccgcgcccgaga

SEQ ID NO: 17278 - DNA, 1413 bp, Oryza sativa
  unsure (1)..(1413): unsure at all n locations
catgttttctcgcacgtttttttgcttgtttttttcgaatgttcttttttgccttttttcgatacaggagaatatatgacgaaataaaaccatgtagtagatggcaaaaaaatcgatggatcctatccaactcaagcgtccattaatttagcttttttctgacagttttttcagagcgatttgtttttcaatagatggtgttttttttcttgcgcgattttgccatttatatgaatcagattttttttccgttcggatctacagtttttttcgccacttaggggaaaaagacttttgttgttgctgtttttctttattttcttttttgtacggcttttctttttctttttatgcccctttctaattttgttctctctcttttattatttttttaacaaaaacgacctcaagtatcttattgcaagattatagggactcaaatgtaaatataaaaattacagggacttaaatgcaaaagtacagacccaaaaattaaaatcaaataaaaatggaatgctctcgacttgtatgttccgtttttgcaaacagatctccaatccgacacatcaattttttttcaccaattagagtcggacttttttttcccttctaagagggaatcggatataggagttggactttttaattttttcgctatttttttacggacgaaggaagcatctcttattttttaagtagtagagatatcaacatttttttcctgtcctatatattatataggaatgttttccgaaactatgtttatcatttaaagaaaatgctatacatacttttaaatatttattaaaatgtctatgtacaacaaacttacgaatattataatcacacaacaaatttctatacttccaacaatatagtttacgaatttctacatatccctcatgtattgaagggtaaaactgacttttctatacctattaaacggtcaactaacagacaattgatggcaagggtatggaagggatccaaatcaaaattcagaggntatacaagggagtgaagaaaattcaggggcatagaagagatcagctaaaatttcaagggtatggaaggaattttctcgctgatataactatatggagtatatggagtagtttgtagccactagcaattattaaaatctaaaactcaacacgtaaacatatcaactcaccattcactagcaatttctaggacattataaatctcatacaagtatgacacatatcttccccacatcatttcacaacatttcaatattcattatttatataataattcacatatatttatctctgaatttcacgggaaagcctggagtatcatgtggtatatatgtacttacttactacctccgtcccaaaatatagcaactttaatttatagataagaatacttatattttaggacgga

SEQ ID NO: 17279 - DNA, 1072 bp, Oryza sativa
attcctgcagccccattggagaactttccaccgcccgtttatctatctattattatattattaaaagaatagaaaaaggagtctccacgttcgttctcatggcctagaaattctcacattaatcggagaaaaagaaaaagcagagtccatatagaaatacaatttagaaatagttgaaattcggaattaaaaaaataaggaatattagaagaggagactagagtccatatagaaatacaatttaaaaatagttgaaattcggaattaaaaaataaggaatattagaagaggagactagagtccatatagatatacaattagaaaataactgaaattaggaattaaaaataaggaatattagaagtagagtatatattccatatagaaatacaattaagaaaaaaaatagaaattcgaaattaaaaataaggaatattagaagtagagtatagagtccatataaaaatacaattaagaaaaaaaatagaaattcggaattaaaaaaggaatattagaagtagagtatagagtccatataggaatttaaaactaattaaaattcggaataaacataataaaattaaaagtaatgtttagagtccatataaaaatacaatttacaaataactaaaattcgaaattaataaaaacatgtgaagaagattttaaaatcaatataggaatataatttagaagtaactgaaatttgaaattaaaaattaaagaatattgaaagatgagtttagagtccacatagtaatacaattagaaataataaaaattcagaattaaaaaaaaagaaatattaaaagacaagtatagagtccatataggaatatatataatttacaaataatattaaaaataattaataactaacacatatataaaatacaatatgaatattacactttagtagtttcgtaaagttattgcaaaatttaaaattatattgtcattttaatatatttgaataatataatgagaaaacatatatgctattatatgagagaaaatataatgatgctggccgcgttatttgcgcgggccaccatgctagtttttttaaata

SEQ ID NO: 17280 - DNA, 362 bp, Oryza sativa
ttaactgatatgttgtgctgtacttagttgactgatgtactagtaattttctattcctacatttgttctatttggaattacttgaaaattaatttatcccctgcaataatgatgacttttttctatttggaattacttgaaaattaatttatcccctgcaataatgatgattttgcttagtatatttcaagatgaatttgactgatgtatcacagtatagtaattttcttttcctacatttgttctgtttgaaataattacttgaaaaattatttatctccttcactaatgatgaatttgcttagtatctctcaagatgaatttgactaatgatgtttcactgtgtttgaccccttctcagg

SEQ ID NO: 17281 - DNA, 1501 bp, Oryza sativa
tggtggggcccgccagtggatcccacagtctttcttttcctctctttcttttattttttctctctctcttatccttcccttctctcggttccttttcctgctctctcgatttcttctctgttttctctctcgttctcttctctgcctttggctccttcacgcgcgcccgagaggagagaggcgccggagatggcggcctggcgcagggcggcggtgggggaaggagagaggagaaaggggcggcatcggtggggaggaggaggctggggcggtgcggcggcgctcggcgcttggctcggtggcacggaagccggcggtggagcatgggggagggaaggtggccggctgcgacggaggccgtcggggcgaaggaggttgcggccggcgtcggcgacctggtggcggcgcccaacatggcgcggcggtgccccagcgccgatgaagacgacgatgcggtcaggcctagttggcttctttattcggaatgggctgctccttaatgcctaatgggctcctcctcctgctagccaggcctagccgacttccttcttcggaattttgtcggaaatttgacggaaattaccgataaaaaacagttaccgacaaaacggtcggaaaaaaccccatatcatttccgctaccatttccgaaagagattaccgtttccatttccgataccgacaattaccgataccgattgaaacggtcggtgcaaaccggaaacggttgccggaattctcggaaatttccgtaccgttttcacccctacttaccagtatttcttcgtacatgtttggaactggaacaccttcaatatcacaaaattcttgcaccacattaaataattcatccatttctttcatatgtaacggttaaccgagctttgatatcatgaaggagcagcaattaaaacaaaatagattgcagtcaggttaaactggaacagaaaggtataataagaaatggaacaatggactaaccacacctctagagtaattataatgttgatattactagtacaaaactgcaccggacatccaaatcgaccaatctgtgatggagtcgtgcggcctgttatagagatattcatctttatcagacctcaaagaactctatcacataggcaccgagagaggcagtatgtgagtcctcggggccaggcccgtccctcatcagtgatggggttttgttgcggtctgtccaagataattgataataggccacaacgaaaatccatcaccgatgagggtcatggtcatcggtgacgggccaggtataacagcctgacaaaaataactgtgaagcccatcatcgatgaaggttgatctttgatggggtttgcttgtggcccattactgataacccacagtataaataatgcaagaccttcaaggaattgttatcccaacctagtatgttgttcacacttcaggacagatggctagaggggatattttttttccttttaatttaaggaaagaaacaagatgcttccaaggta

SEQ ID NO: 17282 - DNA, 1501 bp, Oryza sativa
atagaggggtgggattcgaaatcgaatcccgcccatttgcggtgcgcgcgcgagcgggaaaagcgaggcgtgggcggcaacgtgggcgtggggcgtggggatgcggagtggggcgtgggagagagcgagcggcggcggttggggcggttgccgccggccgggcgcgggcagctggagcttggggacgacccaacaggtgggccccacctatcggcgtcctagaaaggagggagggggcgcgggccggcctagcaaggagggaggcgcaggaggagggttaggccgacgacccaacaaagggaaaaagaaggaaaggagaaaaaggaaaaagggaaaatgatttccagggatttatattgcggataaatgaattttaattggttaaaattattttcaaggctctgaaaattccactaaaaatttccacgacgctgattccaattattaattgcatttattaattagggaattagctctaggttaatttaaacaatttcttctggcaatttattcaacaaattttaaagcaagacgaaagggataaacttcagggcatgacacacgtgcaccataactaatagattctagttgagaagatggatttttttttctaaaaatatacgtttttttgaccgaaattgcaataatatattgagtagggaaagatttaccaaaatataccgttgccgcgctttggttaagcaagaccgtgatatcgctgaaaggattaacgaaagcgctggcgttgtcactaattgggaaagcgggagtgctaatgcatcggtatcgctcttcaaaagcgtgataccgactcggtctcgcacatgagctacgcgataccgcctgttgtctgacgtagcgcgaggaaaagcggtctcgcactttgttagtgcgagagcgcacttggtatcgcacaaccatagcgcgataccgtagcgacgtggcccaccgtgctaatcacgtgcgtgagcgcctaacggcgtgtggggacggaccggtctcgcacaatgcaagcgcgatatcgcgcgttgtggggcccgcaagagcgaccgcttcggtcttgttctttcaaatcacgagagcgcgtgcagtatcgctcaacgagagcgcgataccgatccactaattgtggttatatttcatgcgaagatggttgatatttcatgtgtgattaagccattgctatggagagtaaacgtttatttcatgatttttttagttatatgtgcaatatatatatatatatatatatatatatacatatatgtatatatatatatatatatatatatatatatatatatatatatatatatatatatatatatactacttcagacaatatacactgttcaaaaacactatttattcggctgaatactattcagtttactgtttattcggctgattactattcaaaaacactattcagtttactgtttaaattactgttcaatactgttcactttcagagatattttaactttaggatctttgcagg

SEQ ID NO: 17283 - DNA, 1501 bp, Oryza sativa
acctcgcgcccacttccgtcgccgcccggggaagcaaagagccgagagagagagagatagaaaggagccgggaggagagaaagaaaagaagagaaaaagagagaaagaaaagaaaaagaaaggaaagaaaaaaaaagggaaagggagaaaaaggaaaaggaaataaaaagtaaattagagggagattagggaagtttagaaaatttaaaataattagaatctaattatagaagttttatggtctcgagtctatgacatgtgggccccacttgtcattagctcttcctatttccctttagaaaataattcggtaggaaaaagaaataaacccgggtcccacttgtcagttggtacaaggctgtggatatgtcttaaaaataaatcgtttatgaacagtagcttttcgcaatttctcggattaattcaaatttgaatctttacactagcataacttattcattttaactcggatttgagtgaaacttgaacctaaattcatctaaattcataagctttccaatgatatataattcactatttaacaaaatatacttataattataaattaattaatatcaaatgattagataatagttaacctaaatagtgtgccaatgaataaaaatggatattgtacagtagcataattatctttaacatgtcttgtcactgtagcaactaaataaattagttataatcaatccttcaaattaatggatgtataggaaaatactagtacttatttaatattcgatggccatataattaaatccatggcttataggttatttaaatcaagtatagccttatgattatgtaactaaaatctaaacacacatagatgaatctttaacctgtttaggagaatcataacagagctagatgtggaggaatcactaagtaaattaatcgatgcaataccatatagaatagcatatatatgcctaaattgattaccacttattagtaacccaatagaaccaatgcttaaacttgtcgcatcacatatacaatatcactcatagaaactagctaatgtataattaaactacaatatatttaggaatcacttggagcattgggtagtacactttctaaataagctcatgtacagtaggcgaccaaaaccttatatgttgttgcacacatatattgtacatcccattatagttacacaattaatttatctttttcatatattaaactggggagtatatagcaaacatgaatagtagataagtactaattataaatcttgacctcctatgttcatagttcaattgtaactccggattgttcattaagagataatctgtaactataatattataaacttcccgaatttaacatatagagcatggataattattagcccttttataatttataatggcaagtaaaatatgttcataattaaagtaaagcttccatcaataaaataataatacaaataattcactgtaattgtttgattgatcctaaatccatctaacaaaagaac

SEQ ID NO: 17284 - DNA, 852 bp, Oryza sativa
aactaatttaatgttattttatgaaaagttaattcctttcagaattgagttacttctataatgtgagcaaatcacttttaaatatttgaatatatttaatattgtactcatcttgtcatacattttaaatagagtaagtgttaacagcaaaatttggtaagccccgaagtcattatcggccgatgggaattatcaagtcatcaatagtcggattattgctatattcagttaaggaaattaatctaccaaaggaagtttatccagaagagaccgagttcaagtaggatgcagcatagtagtttatctattaattaggaatagtctgttaatttccttttatctttaggaaagtgtgtttagtgtccgttaaggactttatcttttccttttttatctttaggaaagtttctttcttatccaagaaggactagtatctacccatagatataaatatgtgcacccgggtcattatgaactatctctacgatcaatacaaattcggcgcatcgccataccttttacttttctactttttcgacgagtttatacttgtcatggttgctttgcatcggcagggctagggctttgacactctgatctcgtcaatgtaagcacatatttatcatatatattagttaatctagtttggtagttgaatttacttgtatcggctaagattcgttttagggtttgtgtcagcatcggctaaaatgttgtactagattaaattagctagggtatctagcaccctgaaaatcaatcaagggcttgattttctagatattatgtttcctttcatactttgcgctgcatcagccttagttgtgcttagaaccataacctctagcctgc

SEQ ID NO: 17285 - DNA, 1501 bp, Oryza sativa
ttaaaagcaatctattatattattagaggaatagaaaaaggagcctccacgttcgctctcatggtttagaaattctcatattaatcagagaaaaaaaagacagttcatatagaaatacaatttagaaatagctgaaatttgaaattaaaaaaagaaatattataagaggagactagagtccatatagaaatacaatttagaaatagttgaaattcaaaattaaaaaataaggaatattagaagagtagactagagttcatatggaaatacaattaagaaataactgaaattcagaattaaaaataagaaatattagaagtagagtatagagtccatatagaaatacaattaggaaataataaaaattcagaattaaaaataaggaatattagaagtagagtatagagtctatagaaatacaattaagaaaaaaatagaaattcggaattaaaaaataaggaatattagaagtagagtatagagtccatataggaatttaaaactaactaaaattcggaataaacataaataaattaaaagtagagtttatagtccatatataaaaacaatttacaaataactaaaattcgagattaagaaaatcatggaaagaacaatttaaagtcaatatagtcaatataggaatgcaatttagaagtaactgaaattcggaattaaaaattaaagaatattgaaagatgagtttagaatccacatagaaatacaattaaaaataataaaaattcagaaataaaaataaataatattgaaagaagagcatagagtctatatagaaatacaatttacagaaaatttggaactaaaaaaaagaaatattaaaagacgagtctagagtccatataggaatagatataatttacaaataattaaaatttgatattaaaaataattaataactaccacatatacaaaatacaatatgaatattacccattagtagtagtttcgtaaatttattgcaaaatttaaaattatgttgtcattttaatatatttgaataatatattgagaaaacatatatgctattatatgagagaaaatatagtgatgttagtcgcgaaagctgtatgggccaccatgctatttgaaataccccatcacgggttaaagaacgtgcggccgtccgttggttatttcctgggtcaacttctttccggtgcaccgtctgcttcaccgttaaggcgacatccccgtaccgtggtccgtgcggccggcgctgctctgacttccccaacccaaagccgtgtttgttcacgagtcaccgtagccacggctcgtgaagccgccttctcccttttagctccggccatcaaacgccgcccgcccggcgtcatcacccgccgatctcaataatactaagtcgccatttcggttgcacacacatgcagtgcagcacatttggggatcaatcgaattatgcttgatacctcacagttcacagctgctgcacaccaaacagacactgtttaatcggtgacag

SEQ ID NO: 17286 - DNA, 1501 bp, Oryza sativa
tctcccctcatttgtcattgttgtgttcgagatggacttttttaaaaaaaaaattccacatctttcaccatgatatttttaaaaaattgtattcctacttggactcttatagttatttttctatttttggaatttattttattttttatttcgaattttaattaatcttgtcatgtgttctatatggtctctttttcaatagtctttattttttattacgaatttcagttacttataaattgtattccttgttaaacttttattttttttctaatttctgaatttattttattttttaatttaaattttaattaatctcgtattgtgttctatatggactattatttcaatattccttattttttattctcaattttagttgtttcaaaatcgtattcctagttgaactctattttttattattctaaaaattttgtaattaactttatttttatttagaattttaattaatcttgtatcgggttcttacatggactcttcttctaatattgcttatttttaatttcaaatttcagttatttctatattgtattcctatttgaactatccttctcttttctaatttcagaatttattttatttttaatttcgggttttaattaatatcatatttgttctatatggacccttatttagatattagttatttttaattccgatttcagataattctaaattgtattcctagttagactctttttttctaatttcagaatttattttatttttaattccgaattttaattaatgtcgtattcggttctatatggactcttcttccaatattagttatttttaattccgaatttcagatatttctaaattgtgttcaacttgaactcttcttttctttttctccgattaatgtgaaaatttctaacctccacagcgaacgtggtgccttttttcaaggttgttttcataatataatagatataaaatagattatatggtgcacattggcacttttatcaatctagaaaacattggcattattgatgagcgtcatggtcctatatgccacagttaaacctgtgagtaagtattagataaggtatcacatctataattggaatcataacgccctgaaataccacatacctaatattgtgcggaaacgtatacgcaattatgaaaatacaatggataattaagaacatagtagagtagtacgttgttggactccgattcgtgaaaggcaagtttatatctatttgtgccctacttagagtatctgagttctattcgaagagaaagttgtctagtagtatatatacaaagccccacaagagggtaggacattgaatcacaagccctagccacccgccacattgagaaacaggcgggaggaagtcaatggctagccgttgattacatgtcgtcgaatagttcttggctaatcctagtctggcaagacgctattcgttgatgcgccaccaacttccaccaactgttgatgctggtaagggtcaacgctggc

SEQ ID NO: 17287 - DNA, 361 bp, Oryza sativa
aataaatcatccgaagaaatgatttaatttaacctacgaggtgaatccttaattaaataaatgcatttaataatcagaatcggcatgggaaatttctcttggattctacatgtcaaaatatgctaataggattttcagtggaattttcagagccttggaaataattttaaccaattaaaataagcaaagtgcaatatttaatccttgggaaattccttttctttttctctttttcttttcctcatttttctatcttgttgggccgtcggcccctcacctcccgcgtccaccccttccttaccgggtcggcccgttttccctcctcctcccgaagtccaggctacctccccctcactccctc

SEQ ID NO: 17288 - DNA, 1501 bp, Oryza sativa
cgtgccgtgccggcacggcccgttactgtagcaggccgtgccgggccgtgcctgctacaggttcggccgtgctccgggccgcccgtttggcccggcccatttggccacctctatgcatgggtcactatcgctgaaccattgcatgcgctggtcgctatcaccgtcaccaccttcttctgcttctaatcccgccatcgtagcggccgctgctttgtgttgctcctgccgcctccaccaccactgctttttgattcttcttctgctgctactaccacagccttctacttctgctgcagctgttgcctccgctgtcctactcctctttggccagatctgggaaagggaagggccgtcgatgccccctctaccgctttcactactggcttccacccctgaggtagatcagggggagggtaggcgaggggagtggagggtgagggagggagtgagcagactaaggctgcgttctttccacaagtttcccaacccctttccctcgttttccgcgtgcacgcttttcaaactgctaaatggtgtgtttttttgcaaaaagtttctatacgaaagttgctttaaaaaaacaaattaatccatttttgaaaaaaaattaactaatacttaattaatcacacgctaatggaccgctccgttttccgtgcggtggagttgggttcccaaccccaagtatcaaacacagcctaagggatgaagataaaataatagatggagacttagctgcgtggattttttgagcgctcgtaccttttcgcatgctaacatctttacatctcacctatgataattcgttcatcttttttcgtaagcgaacctcttatggctccgactgtaaaattcgaccaagcgggactaaatcatgggggcctttggctatttttgtaagcagtaaccagagggtatttttttactccatatagaaataaaagcctggtattggtaataaccatttttctagtagtggaagctgttgctcactgttgctgtctaggcccgccgatgctgctgaatcagtgtggcactctggctgggtagtggagggaaagtatgcagctttctagctgtggttgacaatgatggtgccatgacgcctgggagtgggagggagcggacgaggagagtccaagggactggatttaaccatagctggttgggctggccggttttttagtgtctcctgaattgtatagccgtctttggtaaaagaactgcgtgtgaaaatacgggtattttctttggtaaaaatatggctatttcctttggtgatctcttatggtctgcacaacaaatttagacgatatagacctctcgatgctttttcaagcgcataaacaaaaaacacggtgctcttataaacaaaaaacacggtgttgaaaaaaatcttgagatgaaaaaacccctcttgttccataccaatttcctgagatttttccgccctgtacaccagtgggtattgtcttggtttgcttcaaaatgaagacgagat

SEQ ID NO: 17289 - DNA, 1501 bp, Oryza sativa
aaaccaagacaatacccactggtgtacagggcggaaaaatctcaggaaattggtatggaacaagaggggttttttcatctcaagatttttttcaacaccgtgttttttgtttataagagcaccgtgttttttgtttatgcgcttgaaaaagcatcgagaggtctatatcgtctaaatttgttgtgcagaccataagagatcaccaaaggaaatagccatatttttaccaaagaaaatacccgtattttcacacgcagttcttttaccaaagacggctatacaattcaggagacactaaaaaaccggccagcccaaccagctatggttaaatccagtcccttggactctcctcgtccgctccctcccactcccaggcgtcatggcaccatcattgtcaaccacagctagaaagctgcatactttccctccactacccagccagagtgccacactgattcagcagcatcggcgggcctagacagcaacagtgagcaacagcttccactactagaaaaatggttattaccaataccaggcttttatttctatatggagtaaaaaaataccctctggttactgcttacaaaaatagccaaaggcccccatgatttagtcccgcttggtcgaattttacagtcggagccataagaggttcgcttacgaaaaaagatgaacgaattatcataggtgagatgtaaagatgttagcatgcgaaaaggtacgagcgctcaaaaaatccacgcagctaagtctccatctattattttatcttcatcccttaggctgtgtttgatacttggggttgggaacccaactccaccgcacggaaaacggagcggtccattagcgtgtgattaattaagtattagttaattttttttcaaaaatggattaatttgtttttttaaagcaactttcgtatagaaactttttgcaaaaaaacacaccatttagcagtttgaaaagcgtgcacgcggaaaacgagggaaaggggttgggaaacttgtggaaagaacgcagccttagtctgctcactccctccctcaccctccactcccctcgcctaccctccccctgatctacctcaggggtggaagccagtagtgaaagcggtagagggggcatcgacggcccttccctttcccagatctggccaaagaggagtaggacagcggaggcaacagctgcagcagaagtagaaggctgtggtagtagcagcagaagaagaatcaaaaagcagtggtggtggaggcggcaggagcaacacaaagcagcggccgctacgatggcgggattagaagcagaagaaggtggtgacggtgatagcgaccagcgcatgcaatggttcagcgatagtgacccatgcatagaggtggccaaatgggccgggccaaacgggcggcccggagcacggccgaacctgtagcaggcacggcccggcacggcctgctacagtaacgggccgtgccggcacggcacgagtagccgtgccgtgcttggg

SEQ ID NO: 17290 - DNA, 1501 bp, Oryza sativa; identical to SEQ ID NO: 17261

SEQ ID NO: 17291 - DNA, 573 bp, Oryza sativa
cctccattccacccctccaattcctcaaccaattgaactgcacattggattctctcccttgaatttaccaggtaggcgttcgtgaaaaaatatttaccaggtagaggaaatgtttgattttcaatggcaagcattttgcctttccagacctctcttagcttggtatcgaccaccccatcaaactttatcagtctgcacagtgatctggttgagaaaattcctcccttagcatgaagccagatcagtttatcggataattaaaatcttcaatttccatcacccttgcatctctcttaaactagctagctctgagccctcttgactgtccacattccttccatagttaaacctccaaaccccattctgattcaagtcagcaacagaggcattcatattatttgatcgatcttatgaactagtttgtaattcagaatgatgtagtaataaactttctgtcatgacagttaattattggcttgtcaattatcaaggcagcggcagccggaagcccggaaggagtctacccaagtgaagcctagctatgctatctgattacttgtgctgttgtgcagt

SEQ ID NO: 17292 - DNA, 668 bp, Oryza sativa
ataattaacctataaaattccaattattttaaattttctaaacttccctaatctccctctaatttcctatttatttcctttttctttttctccctttctttttcttttctttttttttctttttattttcctctctttctttttctctctctctgccggcctctcttttcctctccctctctctctcggctctctctcccacccgagcggtggcggcggtggacgcgaggggaacggagggcggctcaccggcggcggcagcggcgacgacggcggcagcgatggtggcgcacggcggcgcgggagtggcggcacggcgcacgagaacggcggtgcgggggcacgggaacggcggcgcggcggcacgggaatggcggcgcggcagcacgaaggcggcggtgcggcggcactacggcggggtaaaaagggaggtgatggaggggaatgggtgtgggggagaagagaagggctgggggttttatagggtgtgagagaggagagagaggggccggtgaaggggggtgaggcgacggcggcgcggcagcgcggggcgcgaggcggcgataagacgcgcgtggcgacgggacgcgcgcggcgcgacggcgacggtgcgcggcgcagcggcgggcgatgggacgcgcgcgcgacgggacgggtggtgacagggc

SEQ ID NO: 17293 - DNA, 1501 bp, Oryza sativa
gtacctaggtatcagaccttggtacctgggtaccaggcctgatacttgtgggtatcagccatgattccctaaggtaccaggcatgatacttggtatcagccatgatacctcctgataccagtcaagaatgacttatttccatggtggccgcctcgtctccaacgtcgttgtcgctcccttctccctcttcacaaccttggctcccttctcctcttcctcctcctcctcctccgccaccacccccataaccggacgcttctctagggcgcccacgagaccaccacaaccacctccgtctcccccaccttcgccgggagagaccctcatgaccggggagtagggaggaaggtggaagatggagagaaagaatcggagagaaaggaggaggagaaacggatctgtggagaagaaatggatctcgggtgtatcccgtccccacgagattccgtccactagtttttctcttttttctaggttgttttttttaacggagggagtagttttcttgtttttattatcaaattactataccgtacattctatgtaatatatatatatatatatatatatatatatatatatattgcaaaaaattaaaatcatataaatataaaaatagaatgctctcgatatgtaggttccgtttttgtaaacatatctccaatccgcctagaggagagatgtcttttattttcagatttgctaaaaaaatccgcctagaggagaggtgccttttattttcagattttttgtcaaaaaaatagtcgattttgtgacagtacgatttacattaaggcgccgttacggagagtcgaatggagaccttcgaagtcgcagacagagctcctaaccaaccgagcacggtattggcattcactttattgccaaaacaaattaatattgaattttgaagtacttatacactaaccacacccccacttacattcacttacacaacacttacactataattacatatgtaatttattcacttacacggcacttatacaacacttacactataattacatatgtaatttaggaacttataatgtaaatacatgctgactattttttggtgaaaaatatggtgccataaatatagctactccctttattttttgtttttaagggggaatcggatatagagttggatttttttagagacagaatcggacatattcttttttttttattttcttcctttttacccggtgtcggattcgtacagatccgatttttttttcctttttttcgcccatttttttggtcggacaggtttaggttttttttttcatccgaatttttctggatcggatagatttggttttttcgccctttttaatcggacaggtttgttttttttcttttattccgcctggttttttttttgataattttggtttttttttcatcaggttttttttgacgatggaagcacctcttattttttaatagtgtatatatatatatatatgtatatatatatatatatatgtat

SEQ ID NO: 17294 - DNA, 1048 bp, Oryza sativa
ctaaggctgcgttctttccacaagtttcccaacccctttccctcgttttccgcgtgcacgcttttcaaactgctaaatggtgtgtttttttgcaaaaagtttctatacgaaagttgctttaaaaaaacaaattaatccatttttgaaaaaaaattaactaatacttaattaatcacacgctaatggaccgctccgttttccgtgcggtggagttgggttcccaaccccaagtatcaaacacagcctaagggatgaagataaaataatagatggagacttagctgcgtggattttttgagcgctcgtaccttttcgcatgctaacatctttacatctcacctatgataattcgttcatcttttttcgtaagcgaacctcttatggctccgactgtaaaattcgaccaagcgggactaaatcatgggggcctttggctatttttgtaagcagtaaccagagggtatttttttactccatatagaaataaaagcctggtattggtaataaccatttttctagtagtggaagctgttgctcactgttgctgtctaggcccgccgatgctgctgaatcagtgtggcactctggctgggtagtggagggaaagtatgcagctttctagctgtggttgacaatgatggtgccatgacgcctgggagtgggagggagcggacgaggagagtccaagggactggatttaaccatagctggttgggctggccgtttttttagtgtctcctgaattgtatagccgtctttggtaaaagaactgcgtgtgaaaatacggttattttctttggtaaaaatatggctatttcctttggtgatctcttatggtctgcacaacaaatttagacgataagacctctcgatgctttttcaagcgcataaacaaaaaacacggtgctcttataaacaaaaaacacggtgtttgaaaaaaaatcttgagatgaaaaaacccctcttgttccataccaatttcctgagatttttccgccctgtacaccagtgggtattgtcttggtttgcttcaaaatgaagacgagat

SEQ ID NO: 17295 - DNA, 762 bp, Oryza sativa
ccctagcacgtgctaaccgtggggggtaacctattatcctgtgcggttggtataatttgaccgcattatcccgtgcggtcggccttattacaccgcatgggataatacattatcccgtgcggtccgtataacccgaccgcacaagataatcgattatcccgtacgggcaggccgaccgcacacgaaaataaagattttcccagacgaggagctgcaggcgggccgggcaaccgcacgggataatctattcaaccgcccggaaaaatgggtattgtagtagtgcatatttagggcctcttatatataggcaccgggaacatgaggtacatggagtgatgtacacaagcagatcctctgatcacttacttcccactgactttgaatcactggtacgtgggttgttgggtagatggcccacatatcagtgacccacgttagagaaaagtaacttggaggatctcaatctgtaatatactacttctcataatttggtttataataacaatccattgattccaaatagttcagtgaatactacggattagtctacaaatgcaacacatatagtagaatcaaagtagcaagtcgatcatggcacgctgcaatggaacacttcgggctagacccttttgttttatgaaagaacatgcgacccttcttgccttaatgagcaaatataaaaaatggtgagtgcatcaaaacatgtctctggacgaggggttctgttttttctggaacttgttgatggatgtagagtggaga

SEQ ID NO: 17296 - DNA, 1501 bp, Oryza sativa
tgatataaacttaaacataaggttttcttaaaaattttccctaaaaccttggggttttcaaaacaaatcataatacatgggttttgtgttacgagtgttctaaaatctatgttttgtgaaatttacttttaactgttaaaggcataccagcttaactgataatgcaattcaacttcacagttcagaaaaaggagttaagaaatttttaaaaacaattccaggagaaaaggaactagtaataagtagttaattctagcttagcacgtaatgcaattatttaccattataaaaattgaagatgtttttctagtattttggaatgtcatccgtgtttgagtcggattttaagtttgtttgtttttgtaaatacaaaagaagtcgtataagaaatcttttttaaaaaacttgcatgctaacttgagatgaatgccagactcctaattgcagctcatgattttcaaaaaaagaaaaatccaagcgaatttccacagtgaattttaccatatctaaattatataacaataataagattaaaatagcattcgtccgttgcaacgcacaagtattttttctagtaagagaaaaaaaataaagaaaattaatgcaattcaactccccaattcaggaggaaaaaaatggagtcatgaaatttaattccagcttagcagataatatgattcggggggaaaatggatttaagaaatttcaggaaaaaaatataaatttgtttaaaaacgttggagatgcggggtatcgatccccgtacctctcgcatgctaagcgagcgctctaccatctgagctacacccccgaagtgtttgtgagattcaaaacaaagtttataaaagcaataattaactgttgaaaggccaaaagtccataatatccattggtgtttggaaaaattacaccgaaggtccctcaacttgtcatcgggataaaaaaaaaaagtactcaaaccgcaaaaccagatatgcggagtcccttaactatataaaaccggtagcccgacgtgacgctgagtcagcgtgggacccacgtgggccccacatgtcagcctgtccacgtcagttcctctctctttcccctcctctcccttcctcttctctctctcactcttctctctggtgctgtgggtaggccggcgccgccggccgacgggtggggaggagaccgacggggcgagacgggagaggaggtccggcggccggcggcggcggcgacggcgacggcgacgacacgagagcaggggagcaaggcggcggcggcggcgacgacgcggcgccgatgtgcacttggtctcggtgaagattgggaagccgtcgtccccgtaggattcgtgcctcccgacgatgcgcctggcttgccgccgccgcggagatcgttggcaccatgaagttcttcgcggcgcccgcagggcgagcgggcttgggcgccgtcgtcctcgtcgccgcgtcacgctgcccgctgttctccttcttcgcgctacttgttcttctcc

SEQ ID NO: 17297 - DNA, 1501 bp, Oryza sativa
caaaaaaaaatcggcctaaaaataccgaaatttcggtgatttcggttctttagccccaccggcaaaagcccctgtttcaaaattgcaaaccctgattagccgtgccactagcttccatgtaatcaaacacaaatattttactaatatgaaatctattatattattaaagaaatagaaaaggaagcctccacgttcgctctcatggcctagaaattctcacattaatcgaagaaaaagaaaaggcagagtccatatagaaatataatttagaaatagttgaaattcggaattaaaaaataaggaatattagaagtggagactagagtccatatagaaatataatttagaaatagttgaaattcggaattaaaaaaataaggaatattagaagaggagactagagtccatacagaaatacaattaggaaataactgaaattcagaattaaaaaaggaatagaagtagagcatagagtccatatagaaataatataatttcgtaattaaaaataagaaatattagaagtacagtatagagtctatatagaaatacaattaggaaataatagaaattcggaattaaaaataaggaatattagaagtagagtatagagtccatataaaaatacaattaagaaaataatagaaattaggaattaaaaaatatggaatattagaagtagagtatagagtccatataggaatttaaaactaactaaaattcggaataaacataataaaattaaaagtagagtttagagttcgtataaaaatacaatttacaaataactaaaatttgaaattaaaaaaatatgggaagaagagtctaaagttaatataagattacaatttagaagtacctgaaattcgaaattaaaaattaaagaatattaaaagatgagtttaaagtccacatagaaatacaattataaataataaaagttcagaattaaaaataaataatattgaaagaagagcctagagtccatataggaatataatttacaaataactaaaatttgatattaaaaataattaataactaacacatatataaaatacaatatgaatattatacattagtagttttgtaaaggtagtacaaaatttaaaattatgtagtcattttaatatatttgaataatacattgagaaaacatatatgctattatatgacagaaaatataatgatgctagccgcgcaatatgcgtgggccaccatgctagttttcaaataaaataagtaggagattagagaaccaaaacacgaagaaaaccggccactgctaccccttttgttccttgctatctcctcaaagaatcgcccatgtacgcgcaacaaaagaaacccaaaaaccaacttgccatgcaacctctacgtatgtacacgcgtacacacctccttaacctctcccgaattccatcttctccggcgatgctttgccgcccatgctttgctgcaccaacgagctccatcccatcgtcgtcgaagctcgccggcc

SEQ ID NO: 17298 - DNA, 1501 bp, Oryza sativa
aaaatcggttccccactacctcgtccacctcttcccccacttttccccaattttcggcgccgtttcgtgccccatctccacccacgttgagctccatgtcgccggccgttgccgcccaaattcaccactccccggcctccccgttgctccctcgcgctataaaaagcctccccgtgctttcctctttcgtttccccctcctcgccgagctcctcacgccctctcccatgctccccgcgcaccacctctctccgccgtcgccggcgagctccggccgcctctaaccgccactctcgccgccgccgcgctgcgccgccaccgctgtcggtcgccgtgccgaactccaccccagcctccactcctttttcccccttccaccccgaaacgctgccaccacgtgcaccacctctctccaccaccgttgccgactccagccggccgccaccgccgcttccgtcgccgtcgcgtcctgccgcttgcgctgctagcttcgcaacgccgcgctccaccccggcaacccctcctttccccaaaacatcgccgtagcactgcttcccccatcaacccgagctccaccaccgcctgtagcctccagccgcgcaccgcgccgccttcgtcactcgcttcgtagcgctgaggagcacctcggttgctgtttttcaccgccggaaccccgccaaaacatgttttcccgtcgccggtgagtatcttctttctttttcctcttcggccggccatactcacgcctcctcccttttccctaatccctccaatcgcttccccaggtgtagccgcccctcggcctcccctcctccttcgttggaagcggtcgaatcgccgtcgccgttgtcttcctccataccagctgccgcttccggtgaggatccctcctcccttcttcctttcccatccccttccttgctagctgccgcctctcggccgcttgccgtcgttccgcgcctccggtggctgtgcgctgctgtcacaccccgaagttctttcccaagcctaaattgaagttataaatggtctcaagaaaataccagtgtaaagcaagagtaaaccctaataaattaatgcgaatggtaatcggatttggcatgtggaatttttcttgagttctacatgtcgaaatacgctaacaagatttttagtggaattttcagatctctcgaaataattttaaccaattaaaaatgaccacaagcaatatttaatcccaggaaaatcctttttccttctttttcctttttctttctttttcttttctctttttcctttgaaatgggccgccggcccattcttctttttcttccccctcctcccactgggccggccgaaggccgaggcccagctaagcccgcgcgagccggccgcccgcctcctctcacccggggtcgccgacaggtggggcccagctgtcgggcccgtcgcccacctcacgcccgcgccgccgcgccaacaaccgctgccgcgcccacgtcggccacgcccgtgcatgc

SEQ ID NO: 17299 - DNA, 1501 bp, Oryza sativa
gcgacggtggctctcccaccactggcagcgcggctgcgtcctccctcaccaccggcagcgcggctgcgtccttccccaccaccggcagcgcggcggcgtcctcccctaccaccggtggcagtggcggcgcccttccccatcaccagcaggcggcaacggtggcggcgcccaacccaatcccaagcaacggcgacggactcgatgtatttggagtttttggtcgatatatttggtgtttttgggtgttgaagtttgggtttctattttttttttcaattttttcgatcattcacaaaatcgaaatcagattaggatttgatggagggacgaaaaatacgaatcttttaattagttaagatagagaagagatatttacggactattaaaacgaatagaaatcgaattttttgccgcgcttttttccgccctttttattttttttttgttcgttttttactttttactaaccttttttttttgccacggaatcgaacagacctctgtagatgtgaattttttaagtagggacaggagtagagatacatatgtatacaaagtttatatacaaaacgtataaaaatataaacgtatacaaagtttgtatacgtgtatataaaatttgtatatatacatagtattaagaaataaaaaaaccaaaaaaacaaaaaaaggaaagaaaaaaactgaaaagaaacgaaaaaaggaagaaaaacagaacaaccgtgcgtgggccggaataggatttttttcccctttttaagggatcggatctatttttttcgccactttttgtgtttttcgaatttgactttttttttcccgtttctaggggaatcggattacagtttttttccctattttttcctccgattttttttgtttttcttttttaagggaatcagacttcttttttttgttttttttcgctattttttatttgtgacggacgaaggaaacgtctcttattttttaagtagtagtagaagaagtagaggtagatagatagataccggtcaaaaacgaacgaatttaaaaaccgatccatacacggatgacgtaccaaagtaccgacaaaaatatcctcaatttttcgagaagtctttttcgagggagtcggactttttttaaggagtcggacgttttttttcttttttaggtagaagtttttttcctttttttgtcgcctttattttctccacagggagtcggatttttaagagtcgaacgcctttttttttgcgacagattttttttctcttctttttttgtttttttctctcctttttattttccaccgggggagtcagacttttaggagtcggacttctttttttttcgtttttttatttaaacggtgttttttctcggacttttttttttccttttaacggatccgatctttttttttcaggggaatcggactctttttgttttgtttttttttcgctttttttatttattaaacggacgaaggaaacgtttcttttttttaagtagtagt

SEQ ID NO: 17300 - DNA, 1501 bp, Oryza sativa
aatagggagagagtaagagataaagagtcggatgaattttggagttttctatattttccttttatcttttgtatcttgtcaactaatctgctttaatagataatatctttatcgagtaattgagatttactttgtaaggattatcttttagttcagctgcgcaggaatatgttccttttacctttttttatcttgtcaattaatctgctttaatagataatatctttatcgagtaattgagatttactttgtaaggattatcttttagttccactgcgcaggaagatgtgccccagcccgaaccgctgcccctcaaattcttcctgccccagcccaaaccgctgcccctaaaattcgagatttattaaggctaatctatttgttccactgcggaggaagacgtaccgccaccgccaccgcgaggaagtccggttgatgtgccgcgcgagcctccagccccagcccgaaccgctgtccctcagatagcttggttactgctgtaatgtgaattgctttctccaggatgtgagattgtcaattgctttgtgtgtgtgtgtatatatatatatatatatatatatatatataatgtcatttttctcttttttttagctaatttcatttaaacaaacagtcagttttgaatgtgtgtattttatctctaagcacttcttggttatccctgaatgtgaattgctttcttcagaatgtgagcgaaaattcttaggatcggtcaatcgggggagggggaaaatcggtcgctccccctccccacgcgcgcacccccgctgggcccaccaatctgtccctccccttattccataaaaaatgtttcacctagtgtatctacaatgtttcactatatatagagatctaatgttacagtggattaaaatattcttttgcaacaaatcaccaacatattttgtaaaccctctatgtcaccaacatattttggaaaccctctatgaaaggaatttatttcattttttgttccaccaaaaatgtttcacctagtgtacttataatgtttcactatgtatggattaaatgttgcagtgaattgaaacattctctcgctatttgctgaaacattgtttttatataaggtgaaacatcgtccgatttaaacgattgaaatattgttgatttacttagtaaaacaatttcgatatacttggtagaatatcgtgcaacatttaaaaataattcaataataagctaaaaaaattcgtcggaatatatccatatgtgtcttgttttaaagatttaattgcaacgaatttaatggtgcaatcgaatcatgatttggataagtaatttaagagaaaaaaaatagtttaaagtggttttacacatatgcgtgacgctgacatcatgctgacgtcagcaccgatttgaccccctcccgggcacccaactgggagtcgcgtccggacttgtgaattgcttgtgagaatgtatacatgtcattttctctttttttagccaatttcattta

SEQ ID NO: 17301 - DNA, 1501 bp, Oryza sativa
tttttttcctagcatgttctttttgctttttttttactgacgacgaaaaccatatttttctcctttttttgcttttcttttctagtgtgttttttgcatgttttttctgacaattattttctcgcgtgtttttttgcttgttttttcgaatgttctttttttctttttccaatacaggagaatatatgacgaaataaaagccgtgtagtagatgacaaaaaatcgatggatcctatccggctcaagtgtccatcaatttaacttttttctgacagttttttcggatcgatttgtttttttaataggcgatgtttttttacacggttttttcaaaccattttttaaaaatggcgcgttttttctgatagtttttccctcgcatgtttttttaaaatttttttactgacgatggaaatatttttttctcgcacgtttttttattttttatggaagatggaaaacctttttagcgtgttttttttgcgcttttttctgatttttctcacacgtttctttgaaccgtttttattttgtcgtgcattttctctttttaaatagttagattagattatacgtagcgaagagatatatattggttagaaatcggaatttgtttcgccccttctattttttcctcacgcgtattttttattttatacaaaccattttttcttcttagagaactggacgaactttttatatgttttttcgaatttttttcgcctttataggaatcggactttttttttccgtttttaaatgaatcagatctagtatttttttcacttttttttgctttttataggatcggatctacggttattttcgccacttaggagaaacggagttttgttgttgtttattttttctttttctttttttttgcggtttttctttttctttttatgcagctttctgcctatgttctttcccttttattattttttaaatcaaaaacaacctcaagtatcttatcacaagattatagggactcaaatgtaaatataaaaattacaaaattacagggactcaaatgcaaaagtacagatcaaaaattaaaatcatataaaaatggaatgctctcaaccgataggttccatttttgcaaacagatcttcaatccggcacatcaattttatttttcgtttttaagggtgaatccgatctagagtaggacttttttttccctttttgagaaggaatcggtaggagtcggactttttttcgctacttttttttgttttgacggatggaggaaacatctcttattttttatttttttataagtagaagagatagagattaacatgcaattcttttgcgcgttcgtaaaaaaagacatttaaatcgctgaagacatatatgatttctttaatacgttgtatggtatgttacgagcatttagctagccaaaagatgggacctaagttcttttcaagccatatttccttttttttcattctattttggattacattgcagaaacatactgacatatatt

SEQ ID NO: 17302 - DNA, 1501 bp, Oryza sativa
caccgaccgcctcggcttctccacttccttcctcgagtgttttacccctatgccattaagaaagttggaggtacgcatgtgccataaaaaagttttgagtcatttatatgccatgacacaaattttcgtttacctgtgcgccactttggatggaatcagcactaacggagactaacggaggtttaaaaggtctattttgcccttgctctatttcagccactttggatgaaacatttggaagagaaatcggctcacacaccacatagaggctgaaatgtagattgaagaaaatgaaataaagtgaacatttttaaaaaatgaaaataaagttaaaacaggaaataaatatggaaaaattcgtaaataaattttaaaatgatggaaataaatagaaaacagggaataaataagaaaaaaaattcgtaaataaattttaaaaatcataaataaatacaaacatatgaaaacataaggaaaattcgtaaaaggataaggaaaaaaatgcgtggataaataagaaaaaatgcaaaaaaaattagaaaaagcaggaataatacttggttataggatcaacgttcaagcaactaaacttggtcatagcatcaacattcatgacataacttgcatccatagcaacaagttcatatcaccaacatttaaagtagtaattcaacacactaagtccacacataaaaagatcaccaactgctagcattacagaatcacacccaaactgaacaaactctgaactctgcaacaatatgtagcagcaagaaagcaagaaatgcaacaagctgttcgtcctcacagctgcttcagtccgtcggcgaagcatgagctgaaccgcgccatgtcggactccggcagcgccacgccgatctcgatgccgcgccatggacaccgtgccgggcgtcttgtcgatggacaggagctccaccttcgtcggctggcccagcccgaagtcggtgtcgtacacggcgtacagcggcgagccgccgatggacatcggccggtgcggcatcagcgacacgatcttctggaaccacccgtcggcaccgtccagaacgccgtcgtcgagccccctgatggcggcgccgatgcccgccgccgccgtcaccacgctgccggcgccgagcaggctggatctggcgaggcgacgcgagacgaggcgaggcggcggcggcggcggcggcatgccggcgaggcgaggcaaaggcggcggcgtgccggcgacggcgacgaccggcggcggcggcggcggcggctatagaggcggcggctaggctagggttcgagtgaggcgcacgggagaggaggagtagagatgaaaatgcttcaggggcaatttagtcattttcatacgtgagtcccacatgtcagagctcattctctaacatggatggaatggtacacgggtaaacgaaagtttgtgtcatggacaggtaactctcaatttttttacggcacacgcgtaagcttcaacttacttaatggtacaggg

SEQ ID NO: 17303 - DNA, 1501 bp, Oryza sativa
ttttcttattttattattaaaatatcttagaataacaacataatttaaattttgtactaacttgaccaaactatcaatgtttactattcattttgtgttgtatatacgtgatagttcttaattattttttaataccaaatctattatattattaaaggaatagaaaaagaagcctccacgttcgctctcatggtctagaaattctcacattaatcggagaaaaagaaaaagaagagttcatgtagaaatacaatttagaaatagctgaaattcggaattaaaaaaaaggaatattagaagaggagactagagttcatataaaatacaatttagaaatagttgaaattcggaattaaaaaataaggaatattagaagaggagactagagtctatatagaaatacaattagaaattcggaattaaaaataaggaatattagaagtagagtatagagtctatatagaaatacaattaagaaaaaaatagaaattcggaattaaaaataaggaatattagaagtagagtatagagtctatatagaaatacaattaagaaaaaaatagaaattcgtaattaaaaaaataaggaatattagaagtagagtatatacagagtccatataggaatttaaaactaactaaaattcagaataaacataataaaattaaaagtagagtttagagtccgtataaaaatacaatttacaaataactaaaattcgagattaagaaaaacatgggaagaagagtttaaagttaatataggaatgcaatttagaagtaactgaaattcgaaattaaaaattaaagaatactgaaagatgagtttagagtccacatagaaatacaattaaaaataaaaaaaattcagaaataaaaataataatattagaataagagcatgaagtctatatagaaatacaatttacagaaaattcggaattaaaaagataaatattaaaagacgagtctagagtccatatacgaatatatataatttacaaataattaaaatttgatattaaaaataattaataactaacatatatataaaatacaatatgaatattacccattagtagtttcgtaaagttattgcaaaatttaaaattatgttgtcattttaatatatttgaataatatattgagaaaacatatatactattatatgagagaaaatataatgatgctagccgcgcaagctgcgcgggccaccatgctagttttagttatttctaaattatatttctatatggactctagactccttttccaacattctttgtgtttttaattatgaatttatttttattaataaattttattcctatatttattattttaaattcaaaattttagttttttttctaaattatactcctgtatgaactctagacttctctttcaatatttcttatttttcaattctgaatttctattatttataaattgtatttccatatggactctagacttttcttttagtaatgctttttttaatt

SEQ ID NO: 17304 - DNA, 1501 bp, Oryza sativa
agaaaagtctagagtccatatggaaatacaatttataaataatagaaattcagaattgaaaaataagaaatattgaaagagaagtctagagttcatacaggagtataatttagaaaaaaaactaaaattttgaatttaaaataataaatataggaataaaatttattaataaaaataaattcataattaaaaacacaaagaatgttggaaaaggagtctagagtccatatagaaatataatttagaaataactaaaactagcatggtggcccgcgcagcttgcgcggctagcatcattatattttctctcatataatagtatatatgttttctcaatatattattcaaatatattaaaatgacaacataattttaaattttgcaataactttacgaaactactaatgggtaatattcatattgtattttatatatatgttagttattaattatttttaatatcaaattttaattatttgtaaattatatatattcgtatatggactctagactcgtcttttaatatttatctttttaattccgaattttctgtaaattgtatttctatatagacttcatgctcttattctaatattattatttttatttctgaattttttttatttttaattgtatttctatgtggactctaaactcatctttcagtattctttaatttttaatttcgaatttcagttacttctaaattgcattcctatattaactttaaactcttcttcccatgtttttcttaatctcgaattttagttatttgtaaattgtatttttatacggactctaaactctacttttaattttattatgtttattctgaattttagttagttttaaattcctatatggactctgtatatactctacttctaatattccttatttttttaattacgaatttctatttttttcttaattgtatttctatatagactctatactctacttctaatattccttatttttaattccgaatttctatttttttcttaattgtatttctatatagactctatactctacttctaatattccttatttttaattccgaatttctaattgtatttctatatagactctagtctcctcttctaatattccttattttttaattccgaatttcaactatttctaaattgtattttatatgaactctagtctcctcttctaatattccttttttttaattccgaatttcagctatttctaaattgtatttctacatgaactcttctttttctttttctccgattaatgtgagaatttctagaccatgagagcgaacgtggaggcttctttttctattcctttaataatataatagatttggtattaaaaaataattaagaactatcacgtatatacaacacaaaatgaatagtaaacattgatagtttggtcaagttagtacaaaatttaaattatgttgttattctaagatattttaataataaaataagaaaatatatatgctattatatgagag

SEQ ID NO: 17305 - DNA, 1501 bp, Oryza sativa
ctcgggtgtcggcgaggtgtagtaggagggatggaggacgggagacgacggcctgggcgcctcttgtgccccccgagaggaggtgacgtgagagtcgtgactacactcagtcacctgaattactgcatatgcatcgtcacaattggtgaaaatggtaatggtaattcacggccaaccggcattcgtttttgactttctcctggccgagccatatggtcgggccttcatttttgactttctactggccgagccatatggaaatggtaaacgactgaataaaatggaaatggtaaaaaatatggaaattgaaatagaaatggttttgccgttataccaatcgtttccgtatttaccttgttcttctgaaaatcaccgtttcttataatatggtaattaccgcatctctaaaaatgtcgatattcataagacatatttctacttgacccacagtttagagattgattgactcttcaatcaaatccctaacttgagtgcatggctaaaatggagttaatttgtaatttatatagtataagcttgaatttatttatacatataacatacttatgtaaagttaaatatatgttttacagtttaatatatgtttccgtatttgttaccggtttctgatatgtatcaatatgtttctgtccatattgttccgattcaggttttccgatattgtttttgttcctcacattaccattttttatttttgaaatggtttaggttgttttccgattgtttccgaccgctttcatccctactgcacacactgatcaagacactacagctccccagcaactcgtacccctcagtgcatctccctgcatacaaattgaattgattttccatgctaattgccagacaattaaaccggctattctacataatatggccagctcaaatgaaaccaaatattgaccaaattatggcacaaacaaagtaagatctagctagtccaatcagcggttccatgtgagaagcgtgtgcactagcttgaagatcacaccaaaaacaaaatgcccccgtttcccacttgtacctctccttgtgtgtcacatctacattttgtttgccttttttctttcaaatccatttgactattaagtagtaattgttgtttttttcatagtactcattattttttcaacttcctttgaatgtagttctttaaaaagtaaatgtgacaatctagtggattaaaagtatattaagtattcggatagttacataaacattttcttgaagtacgtgattacacattgtcaggttacggataagacatacctccaatcctacaatttactaaatataccggattggcaaacctcatatccaacgatatttttccgtatgcaataaggaaatatacaagatattatggaaaatatcctcacgggctgatgattatcaaagtcctactcggagaggatagggactattctatatcgtgcagggttcgttgtctccgagttctacttgaagactaaggcaattc

SEQ ID NO: 17306 - DNA, 1501 bp, Oryza sativa
acccaaaattggttgcggacttttaatctactcaatactctttctgtttttccaaaaatcagagcgtaaaacctgggataaaaatgaccggggaagatggccgtcatcatcggtaacggttaaacgaagattagatctggcaaattaaagccgaatcgaaagggaaaatcataaagaaaatgatgagggaggagtagggaatcgatttttgcaatcaaattggaggagaaaacgcactattgatatggcggcggtgggaggcatgcggcgaacggatcggattaaaaatccggatgagtaaaacaaaaggcacacgggataaaaaatggcgacaaaaaaatgacgaaaaaactgagtaaattgcacccacattgcaacaacttggtaggtggggtgcaatttggtgcaataacttgagaaatgagcattatagtgcaacaacttagcagaaatatgcaatttagtataataactttagaccatataaataaagtaggtacgattttgatacaataaattaagaagttatgtgacaacttaattatttggagcattttttatataaatttaattttttaagtatttattttgacaatatagtagcgtggatttgtataagcatatttatatttttatcctaataactaataactaaaagttaataaaactggatgtaggaattattacattttggttgatatttgagaaggtgaagaaaacaaaaaattcttaaaggtaattggatgcaaattttatgtgcactataattcttaaagattaagttcaatattataaggtaatatctgattgatatttgagaaggtgaagaaaacaaaaaattcttaaaggtaattggatgcaaattttatgtgcagtataattcttaaagattaagttcaatattataaggtaatatccgtaggaatactgtgtaatggcatattaacatcgtgaaaaaaactcacctagcatatgcttcgccaagttgatgcaccaaaatactaaattgttaagttcttgtactagaatgcacccacttgtcaagttgttgtactcggacgtccaattctcaagttcttgcactatatcgttgttataccgtgggtgcaatttactaaaaaaacaaaagcgcccgggaggcgcgcagtgaacacatcggaataaaaaaaagacgaaaataaccaaaagccttagcgtgtgggcaaaaaaaaaagtctttcgcgtgcaaaacaaagtcgggaaaaaaccggtgaaaaaaaccaaacggacttttttcttttttttttactggcaagattttttttctttttttttcgagagacaaacaatttttattacgacgacatatgtttttaccgactagagaagctttttttatcactttttagttggactttttcttttcttttttcacctttttgagtcggatttttttatttctttttttacagtcggacttcttcttttcttttcttttttacctttttaagttggacttttt

SEQ ID NO: 17307 - DNA, 1501 bp, Oryza sativa
tcccatcgccgctcgcccgtcgtctcgccccgtcgccgccaccgccgtcggtaagccgccgcctccttcccttgctcggtcgccgtcgccgccccaggtagcagggagccgagagagagggagggagaagccgaggaagagagaaagaagccgggagggaggggaaaagaaaagaaaaggaaaggagagaaaaagagaaaaagaaaagaaaaagaaaggaaagaaaaaaaaggaaagggagaaaaaggaaaaggaaataaataggaaattagagggagattagggaagtttagaaaatttaaaataattagaatttaattatagattaactatagtcgtagaattgcaaaatttaatataaattatggattattcttggtaatttctataagaaatcaattcgctgtagtaatttagatgtaattaataactaaacaaatagatgaattcttatagattattatagattatttttgggtaatccctataagtaatcgattcacggtagaaattcggatttaattactagggattttagccgtgtattatatttaatcatttagtcatagactaaattaaatcatataatatttctaggatttcgtccgatatttagctcgcgatagaaatctctaacctattatatggatataatgctcaggtagattaaattaaaaacttatgacaacaaaacatttatacccgtaaaatagtttgaatcgaaattgggtttgccttagttcgcgaataataaagttaaaataaaggaatcgactttcgcattcgactttcatttggatttatttggattttgtttgaattctaatcgaattcaaattgttctttcgcacataattatagagaccgagggagccgcggatccgggtgaaggccaagacccgcaagaccttgagcaaggcaagtcatcactattccttgaacatgttgatcccaattgcgaaattattttgtttataaataaaattgcatgcaatgatgaacatcctacttgtgattatgccatgccttgattattgtttatcccttattccttcgtaatcatgtttacgtatgagtccctagtcaattatgacaattgcttagaaatgctattctaggatcatgcatactcatatttatcaaatgctaaatgcttgggcaattacctttgggaaggtaattgagatgcggcatgtggagacatgagcgccacattgccatgaaattgataacatgatttgtgaaaggaaaataaagcgaaaacaactgttttcgactggggcggacggatgatttgggtggtatctggaaaaggctagtaccgtccccagtcaattaaggaccgagccatgaagttaagcatgaaacaaccccgtacaaccgtacttctcgaatgggtatagacctagcggattagatagccgagcggaggcagtatccctgcatagatggttcacccctgagtgaggcaggtgcgctacgatgggacagccgttgaggt

SEQ ID NO: 17308 - DNA, 1501 bp, Oryza sativa
aaatcaacttctgtaattcaaactttgtcccaaaataaatcaacttctattttcttatctactctcggttcgcaaatcgaaaaattttatttcttaataccccttgccacctacccaccaatactaatttattatcaataaagggtattttggtcttttatcctcctttaattttacattggaatgttaggaggtgcttcattgtgagacagagggagtatgtatttctagctgattggaagcttgtagtagcattttaaacttttgataaactagcaaaaatacccgtgcgttacaacgggtaaataaattctaatgataatatacatttttcatgcataatcatgtcaatgataatgtttatattttaatgagcggcttgtttttttataaacggtgtattttttttcttgtgcgattttctcaaaccatttttcagaaatagtgtatttctttctaacagtttcttcctagcatgttttcttttttaattttttttaccgacgacgaaaaccatatgtttctcccttttttgcttttcttttctcgtgtgttttttgccggtttttcttgacaattattttctcgcgcgttttttgcttccttttttttaatgttcatttttttgcttttttccaatacagaagaatatatgacgaaataaaagccgtgtagtagatggcaaaaaatcgatggatcctatccgactcaagcgtccatcaatttagcgttttttttttctgacaggtttttcggagcgatttgtttttttaatagacggtgtttttttcttgcgtgttttttcaaatcattttttagaaatggcgcattttttcttacagttttttcctcgtatgttttttttaaaaaaattaccgacgatggaaataatatttctcgcacgtttttttatggaagatggaaaacctttttagcatttttttgcgctttttctgacttttttctcacgcatttttttgaactgtttttatttttctcgtgtattttctctttttaaatagttagattagattagagatagagaagagatatatactgattagaaatcggaatttgttttgccctttctatttttttctcgcgcgtattttttattttgtatgaactagctttttattttttacgaaccctttttttcgccactttcttagggaattggacgaaattttttagatgttttttcagattttctcacctttataggaatcagacttcatttttccgtttttaaagtaatcggatctagcctttatttttcaccacttttttttttgccttttataggaatcggatctacggtttttttcgccacttaggggaaacaaaattttattgttgttgtttctcttttttgcagtttttctttttctttttctttttctttttatgcacctgtctgtcattgttctctcccttttattattttttcttaaaaaaacgatctcaagtatcttattgcaagattatagggactcaagtg

SEQ ID NO: 17309 - DNA, 1501 bp, Oryza sativa
acaatataaacaaacttcaataataattcagcatcgataagttgaggagaccaaagtttagcaaagtccacatgtcacgtcttaacaaccttttcccctggccacttcccattcctaacaggctgcaagcctaccagacttccttcatttataggcttctggttggttaggctagctagatcactagggaacttttcgaattttgacggaaattactagacaaatatggttaccgacaaaacggtcggaaaaacctccatcctattttcgttaccatttccaaaagctattaccgtttctatttccgacaccgataattaccgataccgacagtcggaaagtggaaagtggaaatgacagttggaaatcttggaaatttttgtaccgttcgtcaaactaaactaaacttaaaaagagagaaaaaaaagtttgtttggcttcgcttagcatgctcgaatgatgttatagcctgccactccgtagacaacaccaactagcgccgtaaacactaccattgccctaccctccacagttaagtccaatacaaaagccaacacaaggcaagtgacgaatacccccagcgatacgcccgtaacgattatctgaaaatgaggacagaaaagagagtgattagaagaatatatatatgcatagatcaccgtatatacgggaaaatttgtactttcagtcaaaaagatttgagttgtaaagaaaaaaattatcagttacattgattttctttttatatttcaaaaatagagtactttcaacgatgtggcttctacatggagtccatataggcaattagtgatggcatcaacataccaatcaataataaataataacaataaaaataaaaatactgcttatctatgtgtcatgctcacctccgttttctctttctatcatagacattatatatttatatattttaaatttctaataaggatatcaagtgacgctatgtcttcgaaaaacaccctggtttaggccaatgatgaaatacgaatagtttcaagagtagagagattagttaagagataatcggactatgaccatagctgagggagcaatatggactttttcctattaataattaatgatgtttttttaatatactagatattttccagatcaaggcatactatactccctctgtttttttatatttgacaacattagcttttgcacatacgtttggttaattgtctgatccaaaagtttcgtacaaacacaagtcatggttaaagtgcttgtaacaacaaaacaagctacaacaaaataaacaataattacataatttttttacaagaaaattggttgatcaaatttaaaattttagaaaatcaacggcgtcaaacaaaaaacggagaggagggagtgtatatatatagaacacaagcttaccattagcaatatcttcaagttggcgtccaacaaagcttctggcctctcatgctcgggcgtgacactcactttctgcggcagtgttgttgtcttc

SEQ ID NO: 17310 - DNA, 1501 bp, Oryza sativa
gcaatgtggtgctcatgtctccacatgccgcatctcaattaccttcccaaaggtaattgcccaagcatttagcatttgataaatatgagtatgcatgatcctagaatagcatttctaagcaattgtcataattgactagggactcatacgtaaacatggataaacaataatcaaggcatggcataatcacaagtaggatgtgcatcattgcatgcaattttatttataaacaaaataatttcgcaattaggatcaacatgttcaaggaatagtgatgacttgccttgctcaaggtcttgggggtcttggccttcacttggatccgcaactccctcgggctctatagttacctgcgaaaattgatttggattcgattagaattcaaataaaaatccaaataaatccaaatggaagtcgaacgcgaaagtcgattcttttatattaactttactattcgcgtactagggcaaacccaatttctttttgtatatcctaactattttgtgggtataaatattttgttatcataagtttttaatttaatctacccgagcgttatatccatataataggttggaaatttctatcgcaagctaaatatcgaacggaatccaaaaattatcttataatattatacgatttaattttagtctaggactaaacgactaaatataataaacgtctaaaattcctagtgattaagtccgaatttctaccgtgaatcaattacttatagagattacccaaaataatctataatagtctataagaattcatctaatcgtttagttcttaattacatttaaactactaccgcgaattgatttcttgtagaaattaccaagaataatccataatttatattaaatttcgcaattctacgactataactaatctataactaaattctaattattttaaattttcaaaacttccctaatctccctctaatttcctatttatttcccttttctttttcttcccttctttttctttttccttcctttctttttcttttctttttttttctttctctctctcctttcttttctttttccttctctctctcccttttcttttctttttccttctctctctccctcccggtttctctcctccttccttcttctttctctccctcggcttctcccttcctccctctccctcggctctctctctacccggcggcacggcgacaaacagggggggaaggcagcggctcaccgacggcggcagcggcaacgacggcggtggtaacgacggcgcacggcgcggcacagcgcggcggctcgaaggcggcggcgcggcggcacgatgacagcgacgcgtggagaagttgagggaaaagggagaggaggaggggatggagtggggagaggggagattggtgggcttttataggggaaagagaggataagggggagagggaaagaagggaagggcggtggaggggggtgaggcgacggcggcgatgtgacggcgcgcggcgcgcgggcggaga

SEQ ID NO: 17311 - DNA, 1501 bp, Oryza sativa
attcagagtacgggatcatcatacactataatcaactaaaatacagtgatttactttagtgtgtagctagcattaaagtaagtaatttccgttgttttcatacgactattttgtgatacagatcaacaatactcttagtatcagtttttactcttatactatatattgaacacatcagtaaacatattactacatggtggctatgagatcatggctatatcgagaggaaggtggtaattgttttacttgcaaaccacgaaatctcagtttttactcttatactgtgtaatgagcacatcagtaaacatattactacacagtgactatgagatcatgggctatatcgagaggaaggtagtaattgctttactcacagaccacgaaatctaaacaatatttataatattggtaaaagaataactagcgttgtaagttgtagtaattcttttaagaccatctaggtatggcgtcatacgatgtggaggcattggcgtcatatgatgtggaggcattcatgcaagtcaatttgttacttttgattgagcagatgtgggaggctgggactaaatgaaaaacttcacggagtaaattcgttacttttgaaacgtgcagagacactagaaaaacgaaaactcagaaagaaaaactagacggtaaatagtttactaaaacacgaaaatagaaaaactacatagagggaacaaaaaaacaaaaaaatctggatggttaatatttaactgggcccatgatgaagcacggatgagatggaaaagtgaaaaaaagaaacacggaaggtagagtggtaaaaaagaataaaacaaaccgagaaaaggtgggatgcggaggaaaggtggggtggtaaaaaaaagggaaaaccggaaggagagggcgtcgtgcggcgctcgaactaatattccacgctgtagagcgcagaatagcgctacctgtaacttttaatatttatttaataatcaagttaaaagtaaaattgtattaattattaacaacaaataaaattggtttgtcaaactatgttcaaagagaaataaataatgtgaacgatatatatgtgttaaaaatattgtgaagaataatgtgaaggaagatgattggatgttgatttgcataattcaattataaatgatgttgcatgcttgcataagttttgcatataatcattgctagtggatgatgaggtggcatgtttacatgttgagcttaggattagtgggttattactttatagtaagataggataacactagggctgtttccgcttcacgctccagctcccttatcttgtgagctcgccagatttgactattagacatgagaggcgtgtagaagtggagccagggaggttcgagcggaacagagagacgagagggaggaggtatgctgccgcaacccataaggagagaggtaaaggggagaggcagatggcggctagggtttgggggacggaaccaggacatggggattaggtaatatgtgtaaattt

SEQ ID NO: 17312 - DNA, 1400 bp, Oryza sativa
caacaccgaagggaaaaaggggccaaagctgcatgctccttcagacccaatgtctgcaccgctaaagatggtgccgatgagcgggacggggccaagcagcccgccatcaaggggcacattgagtgaatcatcgggcggcccggggagcccgctgaaccaaggtgtcacggccagcaaccatggccagccagggctacccagcttatcctggaagtgagctcctcctcctcatcatcatcagtgaccagaccttggtcccgtctgaccgccgtagaacttgcgaaaggaaatgtcgtggcggtggtactcgaggtactccggtgcgacgccatggatcctaactagcccccctatctagtgtaatgtctgaacctgaatcagggaagaaaactgtagccgttgcatctctagctagctcttctggtgtaggtgctgttactattggagactagactcaatgtgttatttaggtggttaaattgtttttttatcttccagacaccgatgaaaaagctcattgcttctatgtaactatgttggcatgttgcggttagcttgtggctcagttcttttaccttctggtatgctctctctgtgtgaagctgaaaaatgttctgcacatttttcatttttctctgttgctgatgctaacccatttgtcactgtatgtcttgcattgtgtgactgtctgtgaagttgggagatcatgtgttttcggttggcaaggacatgccaacagaagaggcatctcttttatgccgcatctcagatgctgatactttggattctttggaacattagaaattagctcaatttctaccaaaatcctcaaaaatgaaaattttcaaaggaggtcataggtaggatgaaaatagtcacgaaaattctcaaccgaccgactaaagcccgtttcttatttgtacctaccaaaccgtcggaaacggtaaaagaaaaaggaaaatgaaaatggtaaaaatagaaatgaatttatgtggttatattatatagccatgttaaattaaatatgtgattttgattttttgatattttctatttttctaaaccatttctgtttccgagaaaagtatggttactaaaatggtcgaaggacgaagatgttttcccaaccgttttcatcctgctggcttgttgcaagtttacaaagagtacgtgttcacttgatgattacggttttctggaatacgttttctgcgggctttcgcagtcgaaagcgtacggacccaggagagttgctgactcagcagaggctgggctctctcccacgacgaaacgagcggcccacgaaaatttcgccgcgccgcggccgcatcggagccctagcccagccgccggagtccggcgccagcggcggcgaggcggcgaagtgcgggggagggaga

SEQ ID NO: 17313 - DNA, 1501 bp, Oryza sativa
ttaccggcgaaggattgacttgaccgtagttggaatcggctggcgacgtgttggcgccaatccgagcacgacgcgcggcagcggcgagggtgaaaatggccggctcgggggtgaatggtttgaattgtgagaggggataccaccatctatctccaatccaaccatgcggcaagaattggcgcgattcaccccgggtagaagcaaaatcgcactcggcggcggcttggacgggtgcgcacggcgtcgagcggcaatttcttgcggcgatcgtcgtcctggctttgtcgtcgtcaagattggtgcggcgacggtgggctgagggcgtcggacgggcgacggcgcgccaaggcagtcgggcacgtgcaaacggccccaaggccgacgcgcggcgacacggcgcgcagcaaaatcggatgccagtgcggtgtgtgcaaggggaggaagaagtaaagaaatccacggtttttgagtggggtgtggtccctaggatcaaatctaaactttgtgcaagattggatggagttgggctgctctaggtgggctagacattctaccgaacaccttatgtgcaatgaacagtagaattcagaatttttgaatatttcctagaaaagatttgaattcaaactaggagtttggaaaggtttcactagggtttagagtatagcaaatctccactaatattagggtaagctaaagaaataatctatggtttgaatttgagagaatttgctcaaattcactagggtttagaataaagggaataagttagagtaaattggttgggttataatacttaaaccaattttaaataaaaatcaaatagatttttgaaccaaacaaatttaattaaaagccagaatgatgcagtcaaattttagtttaaaatttgaggatgtttgtcacaccccgaagttctcctcccaagcctaaaatttaatttataaatgatcctaagaaaatgcaggtgcaaatcaaaagaaaaccctaagaaggtaatgcaaataataatcggatttgacatgtggaatttttcttgagttctacatgtcgaaattcattaacaggatttttagtggaattttcagagctctagaaataattttaaccaattaaaattgagcaagcaatattttaattccagggaaaatcctttttcctttttctttttctttttcctctctttttcctttttttttctttcgaatgggccgtcggcccattctctcctttcctccccccctcctccctgctgggctggccgcaggccgaggcccagccaggccgtcccgccgccctcctctccggggtcgccgacaggtggggcccacctgtcgggtccttcccccacctcccgccgctctcgctcgcgccgccgcgctcgcaaccgccgccgcgcccacgtctccgcctccttcgggccacgtcgaccacgcacgcgcgtgcgccgcgtttcccgcgcccactcccctctctctcccgctcgcgcccgcgcccgaga

SEQ ID NO: 17314 - DNA, 1501 bp, Oryza sativa
gctgaagtgtgatctatcactaaaatgtcgatatgaaaataataaaatgaaaaggattaaattcggggccctcattacaccttgtatttctccttcgtgttttctaataatgaagatttgttttttaaactcatatatataaattctaaagggataagtctatttgacccccctgaactattgcgttcgtctaaaatacaccccttcacttcaaaatcagatatctatcccccttaactttcaaaaccattcaaattacccccctgtcttcaattgaagtggttttaaacagatctttaatccagcacatcattttgtttcactaagatgtgtgagatatcatggtatagattgaaactgagaggagtggtggctggtatatcggactcaaaaggagtggtgccttttatttttcgtttttaagggggaatcggatctatagttgaacttttttttcgtataagagagggaatcggatagaagtcggactttttttttaatttttttcgctttttttttctttcgcccggtttttttgaccagacaattattgttggggaatcagacaaattcatttttcccctgatttttcttttaccgcatcagatttggtttttcttttcttttttcgcacgttttcttctgcccgttttttttggatcggactattttggttttttggcccggtcttttttcgccccttttttctagataggacagatttgcagatttggtttttcttttttttcgcacgttctctttcgccctgttttttttgaaagaaccacggtaggggaagcctccaccgttaagattttatattaataaaggggaaaaaattacaataaatttaaccactgtaacaatgtatttctctcagaatttttgactctatgaactaaaagggagagatcattcctaaagagaactctccaagagggaacaatgttttcaaaaattaaactattcctctgcttccaaatgttccaagcagcataaagcaccttctcaacaaaatgggtagagttatatgaatttctggccgtgaccaacatttcaccaaagcttaaagaaagattccaaaccacactaaattacgcccaacattgagtgctaaaaggacactggaaaaataagtggagagttgtttcccttgatcctgttgaacaaagtacacagagcaaggaagcattttgaggggagcaacgccctattttttttggatcggataattttggtttttttttcgctggtttttttcgccttttttttctggatcggacatatttggttttttttcgtactttttttcgcccggtttttttattggataaatttagtttttttcgtccgttttttttacggacgatggaatttaagtagtagagataaagataaaagaggctactgtataacaacttctccgtgcttatcacctcgtccagtccagatagaaacctcaacaaactggccctagctattcgctcccgcagcattcgaa

SEQ ID NO: 17315 - DNA, 1407 bp, Oryza sativa
aaaccgggagggagagggagaaggaaaaagaaaagaaaagggagagagagaaggaaaaagaaaagaaaagagagagagaaagaaaaaaaaagaaaaagaaaggaaggaaaaagaaaaagaagggaagaaaaagaaaagggaaatagataggaaattagagggagattagggaagtttagaaaatttaaaataattagcatttagttatagactagttatagacgtagaattgcgaaatttaatataaattatggattattcttggtaatttctacaagaaatcaattcgcggtagtagtttaaatgtaattaagaactaaacgattagatgaattcttatagactattatagattattttgggtaatctctataagtaattgattcacggtagaaattcggatttaatcactaggaattttagacgtatattatatttagtcgtttagtactagactaaaattaaatcgtataatattataagataattttaggattccgtccgatatttagcttgcgatagaaatttccaacctattatatggatataatgctcgggtagattaaattaaaaacttatgataacaaaatatctatacccacaaaatagtttagaatataaaaatcgaaattgggtttgccctagttcgcgaatagtaaagttaatataaaagaatcgacttacgcgttcgacttctatttggatttatttggatttttatttgaattctaaccgaattcaaatcaattttcgaacgtaactataaagcccgagggagttgcggatccaagtgagggccaagacccgcaagactttgagcaaggcaagtcatcactattcttgaacatattgatcccaattgcgaaattgttttgtttacaaataaaattgcatgcaatgatgaacatcctacttgcgattatgccatgccttgattattgtataccccttattccttcgtaaccatgtctacgtatgagtccctagtcaactatgacaaatgcttagaaatgctattctagaatcatgcatactcatatttgtcaaatgctatattcttgggtaattacctttgggaaggtaattgagatgcgacatgtggagacatgagcgccacattgccatgatattgaggacatgatttgtgaaaggagaaataaactaaataactgttttcgactagggcggacggaggatttgggtggtatctggaaaaggctagtaccttccccggtcaattaaggaccgagccatgaagttaagcatgaaacgaccctcgtacaaccgcacttctcgtatgggtatagacctagtggagtagatagccgagcagaggcagtatccctgcatagatggttcacccctgagtgaggcaggtgtgctacggtaggacagccgttgaggtag

SEQ ID NO: 17316 - DNA, 853 bp, Oryza sativa
ctccctcgggctttatagttacgttcgaaaattgatttgaattcggttagaatcaaataaaaatccaaataaatccaaatagaagtcgaacgcgtaagtcgattcttttatattaactttactattcgcgacctagggcaaacccaatttcgatttttatattctaaactattttgtgggtatagatattttgttatcataagtttttaatttaatctacccgagcattatatccatataataggttggaaatttctatcgcaagctaaatatcggacggaatcctaaaattatcttataatattatacgatttaattttagtctaggactaaacgactaaatataatatacgtctaaaattcctagtgattaaatccgaatttctaccgtgaatcaattacttatagagattacccaaaataatctataatagtctataaaaattcatctaatcgtttagttcttaattacatttaaactactaccgcgaattgatttcttgtagaaattaccaagaataatccataatttatattaaatttcgcaattctacgtcaataactagtctataactaaatgctaattattttaaattttctaaacttccctaatctccctctaatttcctatctatttcccttttctttttcttcccttctttttctttttccttcctttctttttcttttttttctttctctctctcttttcttttctttttccttctctctctcccttttcttttctttttccttctccctctccctcccggtttctctcctccttccttcttctttctctcccttggtttctccctctctctctctctttctcggctctctgctacccagg

SEQ ID NO: 17317 - DNA, 1501 bp, Oryza sativa
tttaaactgataaaaaaggttacacagaaaaatgaccaaaataaaagttgtaaatcttgataagttatacaactttgttgttgacaaattttccatttgaaatcctttactactcgaaaaattattttgactaataaaatgaattattatactgcagttaattattttgctacaggtcgactcacaaatataaacattccatatgaaaaatagaaaaaaatactaagtcatctcaatcgattacggatgagtcatctgtggcgggcctagttgttatctcaatcgggccctaagttggtgcccgtaacggatgatggtcatctgtgatgggagccaacttgaggcccgattgagatatggaatgttatctcaatcgggcctaaactacggcccgtcacggataggtgtcatccatgacgagcctgagttttatgcccatctaatatgtctgtgcgaccatatcttaatcgaatgcttttttggcccgattgagatgacttccttgtgacggcccgctaattccaggcatgttagtggctatcacagatgaaaggttctgtgctagtgaacgaaagaaattcatgtccaactttcatgatacttgggattttattttgtgaaaattaaaaattcttttagagcaatactccttagtgactatattattacctaccaaggccatatatgattctcattgcaaaaccttatatgtgtataggccgcttgacattacattgagctttgtcaaattattgtgacctgtgtgagatacttttcatactttcatgatcaagatcacaccacactcctcatacgcacgttatgctaaacttctacactggaagttagcatctctcatccatcatttattatattcattatccacaaaataaatactccatgtcatttatgtctcttcctccaaaattctttcaaagaaaaaagaaagagagatgcatgactatgcacaagaaggaaaaataaagtcttgctcatataagtatggagcattgataaaaaaaaatgagagagagaaaatagaaaaaaaatctgctcatacaaagtatggggcatgatgaaaaaaaaaggagatagccatgcactctctcaaatttccaaagagagaaaattggaggaagcggtataccaaaggagttgttgttttttattttcctttttccatccaaaaatatactatacacatacacatacatacccatacacatatcacacacatgcacattcttgatcagagagtataactcgctatctccttgggtccgaccttttggctttgcaaaatatgtgatgcaggtatgccccgattgatccctaccaagctccacatatacaaccttttagaatagggacaattcggcaaaatatgccttggtgaggatccacaaattaaaccacatgcgtgatttgagagaaagtcatttgaggagtatagatactttgtgaaaacatatgaaaactcaagagattgacaggagaaaca

SEQ ID NO: 17318 - DNA, 932 bp, Oryza sativa
ctgcaccccctatgtttaatagagtaatgttgttgataaatcctaatacaagaaaaaatattcttatgtaacttcggagtggcataacaaatattttttaaaaaataacagccaaacaccataggattaactatttagtgcttaaaaaaaagaatccagggtatttcagtcacaaaatttttggaaattccaagaaaatttccggaaagattccgaccgattccgagttccgacgaaagctgcccttattattttcgattccgtttccaagaaaatatttccgaattcatttccatttccgaaaaattctaaaaaaaaaatccaaccgatagattcttttttcaaaaatagatccggaattcggaaagtttccataccgttttcacacacataccttgacccccaccaaaaaatagagagaattggggaaaagaataggaccccttgtgattcagatggatgggttcgcaggccacgtggtggaccatctccacctctccctacctatctcccacgcgatcactaaaacatcatcattaaaataagattcgatcgaatgccactcttaaacagcgggcattcgctgtaactgtaatgtcacttttcttcttttttttcatctgcaaattgttttttcacaatttctttttttttctcgaacgtacttacccttggctcaattggtccatgaaaaaagaaaaaaacaatttacaaatgcaaaaaaccatgaagctatgctattccagcgactccctttttttgggtttctctcgggcaagcgaagcgagagaagcgcaggggcaggcccactgacacgtggggtccacgcgccgtgcaccgcatttctcccaagccttgccggcttctctcccatcacacccgaggccacgcctccaccacctcctcctcctcgtcctcggcgtcgccgcagc

SEQ ID NO: 17319 - DNA, 396 bp, Oryza sativa
cctcccttcccagatccggctggagggaggccgggggagggcagcagcggcggcggtgacgtggacggctcccctccggcgacggctccccggctgtcacaccccgaagttttcctccctagccaaattttaattttataaatgaccctaagaaaatgttggtgaaatcaggagaaaaccctaagaaaataatgcaattaataatcggatttgacatgtggaatttttcttgagttctacatgtcgaaattcattaacaggatttttagtggaattttcagagctctagaaataattttaaccaattaaaatggagcaagtgcaattttaattccagggaaattcctttttctttttctttttctttttcccctctttttcctcctttttgcgaaa

SEQ ID NO: 17320 - DNA, 509 bp, Oryza sativa
aggtagagaaagatatgtgtgcgccatatataatagacaaaaagaggaggatttgtgttgtcttttgtcccacctttatttgtccccaacatagtgtccgaaaaattttgtgtggtggttttcccccaatattttttaaatatatacaacgcccccctgttataatattaacaatggttataattgtgggtcttataatgaccacacggttttttttactgatatgaaaatggaatttttctctttttggccggtgttcacttttttttaactttgttgggcggttcccaaattttttttccatttcccacttttttttgtccatttaaaaccacaccccatttttgtttttttttccggtttacccaaaaacctaatcctaatacccttctatttttcgctttttcaaattaaagccgaatcgaaaggaaaatcatggagaaaaagatgagagaggaatggggaatcgatttttcaatcaaattggaggagaaaacgtacaatcaata

SEQ ID NO: 17321 - DNA, 655 bp, Oryza sativa
  unsure (1)..(655): unsure at all n locations
agtgtgattgttgcctgnagaatctctggcnnnnnnnnnnnnnnnnnnnnnnnnnnnnnnnnnnnnnnnnnnnnnnnnnnnnnnctgggcgagctggatcgggccgacggcccaagaaagaaaaagaggaaaagaaaagggaaaaaggaaaaaaaaaggaaaaaggatttttcctgggattaaaatattgcgcttgctcatttttaattggttaaaattatttccaaggctctgaaaattccactaaaaatcttgttaatgcattggagcatggggaactcaagaaaaattccaccatgcatttccgattattaattgcatttattaattagagaattagctctaggttaattaagataatttcttcggacgatttatttagccaatttttaaagcaaggagagggggaaacttcagggcgtgacacgcggcgacgacaatggcggcgggcggcagcggctaggtcaggcgaggcgaatccggtgcggtggcgagcggcgtccacgagctcgggcgccggctggtagggttttttttttggacttttatttttttcgcgattttttctttttgtatgcggttgacttaagtgcccgcatgcggattttcgcatgcgttcggcctagccgcatgcaaagatcgccatctttgcaga

SEQ ID NO: 17322 - DNA, 1501 bp, Oryza sativa
ttccggcccaacctaagccaacctatgcatgcattcacattggccttgcaaataaactgatgatcaggagcaagcaaatatttaaagtgatgaccgatgaagaaaatgttgctgcgaaaaagttctgaagttaagaacttctgaatatgtactcatgagacgagacagagaaatggaaggcatttggaaagccaatactgaccagagtttgagaaaaagctcgatcaaagggcctccaccaacttctctaggtttcctgggacttgcatgtgttctatttgtcatttgaatccaagaaacggagacatgcaactacgctcgtcatcaaatagtgttccttaattgatcaaggtttacgaaaagtgaagtgatcaaaattcgtttgagctcaatatgctaacaagcagggatctgtctcaaacttaattggattaattatacgtgattactgatcattgtggtttagctttgaacaaagatgacaaactgatttggcaggccatttcgctgcagccggcctaaaccaagcaagtaatttttttgagcggtccgagatcaattatgcaagcatataaccaagcaaatcaaagaaactattatctcattggaacacatgatttccaaacttgtttgtaacaaggatttttgacagatcatgctggttaattaggaagattctactaagtgtcaaattttccaaataatattgctatctcctcggctggctgtatttgcctgaactgccaaacatgcatttttaaaggtataagcaaaagaaaaatcatttccacaaataaaagcttagatgagttatgtctgactaaaatgttggggaatcaatccatttcaaacatttttttccttgaacttaaataaacaagattgtgattaacaacattgctactgctatatgcatatagcgaggtatttgaaaaattggcgctgctataaagggaaatgtcccctagctagctaaagtacgtattaatagatataaacatgcttattattagataaagaaacaaggaaatagaaaaagggaaactgagaagatcatatatgggcagcaggtaagctagctgtaacttttatttttagtcggaaaatcaaagtgtgtctaatgaattaccgataaccatttacggtaaaatacgaatgaaaagccattacccattttttcataagtagttcaaatgtacttgagctattaattcctcaatcatttttcatccaactattccacacgctttgtcagcatgccccttgctcagattcaaaaacattaaggacttagaattatggaatttataaccagggtctatgacggtacatcactgtagcattgttgcaatccttcttcaacagaatataaaatgagggtagataaacgaccaagaatatgcactactggagaaaccatctttgatcggtcgaacaaattccacaatagtcccggttgcaataaaaatagggactaaagttcaattggttagagctactt

SEQ ID NO: 17323 - DNA, 1501 bp, Oryza sativa
ttattttttagaaaacttcccattgtgttcagtgagctaatcttatgacttatgagacctatggagcggttggttatcctatgtgaagccacataacgagtgattatgcagaaggcaaaagaaaagccatgctgagttattacattaatatttctaggtaaaaattacacacataattatatcatatcgatctcacgtaaagggagaagttgtatcaggaaaattggttgtttaaccgatgatgatgaataatattaatgcgaaggttaaccttggcattcgttaccgtaagagactaatacaattagttggaggtaaggaaaggaataggatgtagctagagaaaattatagcttttagtccattacttttaagtaaatcaccactaaaatattagaatttttaattgtccagacatggtccaccttggtgggtctaatgcgcgaacgcgcgctagcatcgaacctagcgaacagaaaacgacaaaaagaaaaatagagccgcgcaaaaaaaattgttttcctgtttctcgttttcctttcacgcgatggtaaaagataatcttttcctttttatcgtttttctgttaggaggtttgatcagattggattatactttttttttgaaaaatatattagtatttttaggctgtgtttagttcacaccaaaattaaaagtttggttgaaattgaaacgatgtaacgaaaaagttgaaagtttgtgtatgtaggaaagttttgatatcatagaaaagttggaagtttaaagaattattttggaactaaaaacggcattagttttatatttctagtaaaatttatgcactaaactttttaattatagatttaatttgtatataaagtttgcatatacaaagtctacatatacaaagtttatatattcaaagtccatatatataaagtttacatatatgaagtctcactttatatagaaaagtttccccagaaattgtttgtatagaaaatttccgttaagaatatataaaaaatactatgtataacgaaaaaagaaatatgagaaataaacagaagtgaaggaaagaaatagaaatacctattacagaagaatcacgtaaaagatgcaacggattacataagagaatcacgtaaaagaagggaaaaaatgaaaacggaagaaaatgatgtgtcctcatgtttggcgtgtcccttctgactgattcgccggacacgaaacgttcgttttcgctccaccttcatcttctaataaccaaaaagcctgcattattcggtttgtcacccttcccatttccttcataccagtgatatgttcataccagtacttaccaattttagcgatcttgggcccagcccaccaacaaaagtacttatgatggcccagcagtagcctttttaggcccacacggcgatcgactcgcgtcttcgcctcactccgccgccacgtcaccggatcccccacgcctcgcttcccccaccgcgtatgccgccgccggcgaggagcc

SEQ ID NO: 17324 - DNA, 1328 bp, Oryza sativa
cataattgactagggactcatacgtaaacatggttacgaaggaataagggataaacaataatcaaggcatggcataatcacaagtaggatgttcatcattgcatgcaattttatttataaacaaaataatttcgcaattgggatcaacatgttcaaggaatagtgatgacttgccttgctcaaggtcttgggggtcttggccttcacttggatccgcaactccctcgggctctatagttacgtgcgaaaattgatttggattcgattagaattcaaataaaaatccaaataaatccaaatgaaagtcgaacgtgaaagtcgattcttttatattaactttactattcgcgtactagggcaaacccaatttcgatttatatatcctaaactattttgtgggtataaatattttgttatcataagtttttaatttaatctacccgagcgttatatccatataataggttggaaatttctatcgcaagctaaatatcggacggaatccaaaaattatcttataatattataggatttaattttagtctaggactaaacgactaaatataatatacgtctaaaattcctagtgattaagtccgaatttctaccgtgaatcaattacttatagagattacccaaaataatctataatagtctataagaattcatctaatcgtttagttcttaattacatttaaactactaccgcaaattgatttcttgtagaaattaccaagaataatccataatttatattaaatttcgcaattctacgactataactaatctataactaagttctaattattttaaattttctaaacttccctaatctccctctaatttcctatttatttcccttttctttttcttcccttctttttctttttccttcctttctttttcttttccttttttttctttctctctctcctttcttttcttcttccttctctctcttttccttttcttttctttctctcctccctcccggcttctttctctcttccttggcttctccctttctctctctctcggctccctgctacccggggcggcgacggcgaccgagcaaggggaggaggcggcggcttaccgacggcggtggcggcgacggcggcgcgacgacggcgcacagcgcacgacatggtggcacgaaggcggcggtgtggcggcgcgagagcggcgcgacggcgacggcggcgcaaggcggcgacgcacggcgcggcggctccagggcgacgacgcggcggcttcgaaggtggcggcacggcggcacgacaacggcggcgcatggagaaggggaagagggagaggaagggggagat

SEQ ID NO: 17325 - DNA, 1112 bp, Oryza sativa
gttgctgttgccccggtaagccgtgccgccgccgccttttccccttttccccaactggtcttggtaggtagaaagagggagagaggaagaaggagccgagggagagagggagaaaggggccgggagaaaaagaaaaaaaaaagaggagaggaaaaagaaagaaaagaagagagaaaagagagaaaaagaaaaagaggagagaaaagaaagaaaaaggaaaaagagggaaaataaaagggaaaagttaggggaaagtttaaaatatttaaaaatagtagaattaaattatagtattaataaaaatataattagatgaattcttactaattaaatacctaaaatactagcatttaattataggattaatgagaatatgactagatgaattcttatagattgttatagattatttttagtaaactctataagggattaattcgcggtagtgatctagatgtaattaaggactagataattagataaagtcttagggtatgactttaaatcacaaaatttcttaagaaacacaaaaattttaggtagaggaataattccacttcgcgaataatatacttgatgtagagttcgtctctcgtgctcgtttttcattcggtcattgtttcgattttgtttgaattctaaatgaattcaaattgttttcctcacacgtaattatagagaccgagggagccgcggatccgggtgaaggccaagacccgcaagacctcgagcaaggcaagtcatcactattctttgatcacgttgatcccaattgcgaaatcaatttttatttataaataagattgcatgcaatgatgaacatcctacttgagattatgccatgccttgattattgtttatccttaaatctttgtaaccacgattacgtatgagtccctagtcaactatgacacttgcttagaaatgctactttagaatcttgcatactcatgtttatcaaacgctatatgcttgggcaattacctttgggaaggtaattgagatgcggcatgtggagacatgaacaccacattgccatgataatgatgacatgaaaggaattaaaaacctatgttttagatcggggcggacggtggatttgggtggtatct

SEQ ID NO: 17326 - DNA, 1501 bp, Oryza sativa
acaaaaaaccgggcgaaaaaaccaattctatccgatccagaaaaaaccgggtgaaaaaaaaaacctaaacctgtccgatccaaaaaaaaaggcgaaaaaaggaaaaaaacgaatccgactccgggtaaaaataaggacgaaaaaaatatataaaaaaaaagaatctgtccgattctttatctctaaacgaaaaaaatccaactctaaatccgattccccttaaaaacaaaaaataaaaggcaccactcctctaggcttgtccaagatccgggcaccactccatacggttttaatctataccgtgatatcccatacatcttggtgaaaaaaattgatgtgccagattggagatctgtttgcaaaaatggaacctacatgtcgagagcattctatttttatatgattttaatttttggtatgtaattttgcatttgagtccctgtaatttttatatttacatttaagtccctataatcttgcaataaggtacttgaggtcgtttttttaaaaaaataataaaagggagataacaaaggaagaaaggtgcataaaaagaaaaataaaagccacaaaaaaataaagaaaaaaagaaaaacaacaacaacaacaacaaaagtctgtttcccctatgtggccaaaaaaaaccatagatccgaacaaaaaaaatcctattcctataaaaggcaaacaaaaagtggtaaaaaaaagctagatccaattcctttaaaaacggaaaaaaaagtctgattcctataaaggcgaaaaaaaaatctgaaaaaaacatctaaaaaagttcgtccgattccctaagaaaatggcaaaaaaatggttcgtaaaaaataaaaagctagttcgtatgaattaaaaagtgcacgtgagaaaaaaataaaatgggtgaaacaaaatctgatttctaatcagtatatatctcttctctatctctaatgtactctaacgcgtgagaaaataaaaacagttcaaaaaaacgcgtgagaaaaaagtcagaaaaaagcgcaaaaaaaaaaacactgtaaaaaggttttacatcttccataagaaaaataaaaaaacatgcgagaaaagttatttccatcgtcggtaaattttttttaaaaaaacatgcgaggaaaaaattgccagaaaaacatgccatttctaaaaaatggtttgagaaaacctcgcaagaaaaaaaacaccgtctattaaaaaacaaatcgctctgaaaaactatcagaaaaacgctaaattgatgggcgcttgagtcggatagaatccatcaattttttgccatctactacacggcttttatttcgtcatacattctcctgtattggaaaaaagcaaaaaagaacattcgaaaataaaagcaaaaaaaacgcgtgagaaaataattgtcagaaaaaataggcaaaaaacacacgagaaaaaaaagcaaaaaaagagggagaaaaatatggttttcgtcgtcagtaaaaaaagcaaaaaaaaaacatgctaagaa

SEQ ID NO: 17327 - DNA, 1501 bp, Oryza sativa; identical to SEQ ID NO: 17323

SEQ ID NO: 17328 - DNA, 1374 bp, Oryza sativa
ctgaatcatcgtaggccttgggttaaggcagattcgtgtgggttgacggccctcattaataatctggtatagctctaggatcgtatttacaaaatagctttgagcaactaagtgtcttttaatgctgtttactgcaaatcctaacccttatattataacccccttgtactcccttgcatttattctgcacttatgggtgtgtcttgttgagtacggtggttgtactcagtcttgctcaatttttcccaaacccagaagaggagcccctgaatgatgaaggctttggtgtttagctcgtgcctgccgttaagcgcctgtggtcatcgccctagtcttccgctgtttcccgtttgtctttgtgtatgctgggccttcgccgcccatgtaataaattaattatttacgcttccgcttgttaaactctgaattgtatcaacttttggtgtaccttgcctcctgggacaaggaataatgcacgcacataaggaatgcctgttgggttatttccagtcgtgacatggtggcagcaacagcgtctgatgcctccttggtgacgccctccttcaacgacgtcaccacctagtgatccacgagtggtccgatggcgtccgtcagagggagagcctgcacaatatgaagtcacaacgcgatctcgagaagaaagatgtaaaggaatcatcgagtacactcacgttaatcgcggcggcgcgttcggtcgagtccttctcgcagagtgggacaggaatgtcgtccgcctctgaaggtgcgctgatgtcacaccccgaagttttcctcccaagccaaattgtaatttataaaagaccctaagaaaatgcaggtgaaatcaggagaaaaccctaagaaaataatgcaaataataatcggatttgacatgtggaatttttcttgagttctacatgtcgaaattcattaacaggatttttaatggaattttcagagctctagaaacaattgtaaccaattaaaaatcaccaaagtgcaatttttaattccagggaaaatcctttttcctttttctttttctttttcccctctttttcctccttttttgttaaatgggccgtcggcccatttcccctctctttccccctcctctctgctgggccggccgcaggccgaggcccagcccggcagccgggcgcccgcctccctccctcccggggtcgccgacaggtgggacccacctgtcgggcccgtctccctcctcccgccgatcccggcgcgccgccgcgcccgcaaccgtcgccgcgcccacgtctccgccttccccgggccacgtcgaccacgcccgcgcgtgcgccgcatcccccgcgcccattcccctctctctcccgctcgcgcccgcgcccgaga

SEQ ID NO: 17329 - DNA, 1501 bp, Oryza sativa
atccgggaacctgaggtaagtgagctgcactttgctgatctgagtctaggttgttgcgagatatgagatagtaaaataagagttgctatgatcatgttctaagtttgacttgagttccgtatgttttattttccaaaatgataaatttgaaagttcctcatttgatataaattcctaccaaagccaaaaatattcatattgattaaaccatatacattctggtttcttgtaattccattaaactttgtcaaatccttgtgacttgtgtagatacttttcatgctctgtgatcaagatcatacacccacatatgctaagcttctacactagaagatagcatccgtatcatccaccatatccatgttatcattatccacgaataagctctccatccatgtttcctttccaaagaaaaatcctttgcaaaaaaaaagaaaaaaaaagagggaaatgtatggctatgagaaaaataataaattcatattttggaggaaaagcataagcacaaaggagaaaggagaagcattttctttatccacattttattttccatcatagttttccaccatattattcacacacactttgcacgatcttgatcttgagtatgatttatcatctattttagtcaaagtttttaacttagtaataaatgtgaatacaagtatgccatgtttgatccctaccgagctccatatatcaaccttagagtaggaatcaaaaaggcaaatttggtgaggaatccatattcatacactttgagtgatcgagagaatcatttgaggaacttggctttcttttgcaaaatcatttgaaaacttccggaatgatagttgaataaagattgggtgattagtgctctaattgatgttctgtctcacaaccgctcaagacaaggagaggcagtgtctcatgggaatcaggggtaagggtaagccaccgtgtcaaacttatttgattttagagagagtatacataccttgcatctgtatctttaagatatacagcgttgcaacaactcctatcaacaatcaagtctttattcctttcgtcctttactcgggacgagtaaaggttcaagcttagggggttttgttgacggtcgttatcgaccagtttcaaccatgaatactacccaatatataaagactagctgtgtttgcaatgcattatttcacaaataaaacattctattccactatgtgcttggaaaactaatcatgcaggagaagctatcaaaatggaggagaatcgacagcacaacaatcgatcaatcaaatagacactgtgagaatgagacttatggatggatgggccaagaactcagaaatgagcaatcattttgagccaaaacatggtgtacaataaagtggggcccactttattgtacaccatgtcggcgatggcggttttcgtcgggagtcacaaaaacggaacgagcaagatgcaaggatttcatttttgcaatttaatctacgagatgcaaagaggattgttgagt

SEQ ID NO: 17330 - DNA, 1501 bp, Oryza sativa
atacacatgtcttttgttttaaattttaaatagaactatttggatagatgtcatattgaattttaaacccaaccttttggcaaatagaaaatgcgagaaattcaatatgacaaccatatatgaagatacatttttcatgccgtgcgaatttatttcaggcccattaagaactaatatccgcgttcatacctaatatttgggtatatttggttccagtaatcaaaaatcaagtgtgtatattctatgtataaatatggaaatatagccatagtgcatattttgtacgtctaatagctaaattaatgacgccataaatggaagtatataggtatggatatattaccatatacccagccgtaatatatttccaaatacctagtttcctttttccaaaatgccgctgatcagtatttccatatacttagttcccgtgttgccaaataccgaggatcagtttctagaattagatacttagtttaggataattccttttgtttttccatataattagtttcaattttccaattttcgcactttccatgattcgtacatatattaccatttattcaaaccccaacttcgggcaagtgattttccatattttcgtgatactattcctaattgtatggcattaaaagtttccattttgaactttacacgcaattatggaaattctatcatccgaattgcatgcatgcattgaaacgtattaattcagtgtatttactatctataactacgttcaaatatatggaattcattcactgttaatagctatattcttaacgggtgtataaccattaagctaatataccaaaatgactgcaccgatcatccacgatcctacggctcccgacattggagcccatacttcatggtgccccatccgggcgtcctatatatatatatatatatatatatatatatatatatatatatatatatatatatatatatatatatatatatatatagagagagagagagagagagagagagagagagagagagagagagagagagagagagagagagagagagagagagagagagagagagagagagagagagagagagagagagagagagagagagagagagagagattaatgcttgtataatcactagtattgtacaccatgacattagagaaaaatttgtgcattccactaattcgtgacatgcatctatctgcatctgggattttctgaaaatagcacgctagacatataataaatcctccaaatgtgccaaacaacaggagccatgcatgagaccttcaacgcaagttccaaaagaaaatggtctactcctctaataattaatatgaggtcacaatctcttaaacatttctggccgctaacaaaaatgggaaacacgcatgaatggtaactgatcgatgctaaatttcaataagacgaacaacggacagtgggttctttcttttttctctgcattttaataaaggcaaggaagagcaggacaaggaggaaattaaaga

SEQ ID NO: 17331 - DNA, 1501 bp, Oryza sativa
ttgtgccggttcattcgtcgcaacatctgcaatcatctaggagagttccatgatcctcatagcgtacttgctacggaccccaaattcaagaatctaagagagtgggagaggcaacatgctgtggactaaatggatgtatttgtcgcgagggatgcttgtaataaacactatactttctatgtaatatgatttaatttgatgtttcggctaattttccactaattttccatctattgtcccgtgcgggccacctaatttgaccacacgggaaaatagattatcctgtgcggtcagccttactgcaccacacgggataatagaatatcccgtgcggtccgtataaccaatccgcacgggataatcgattatcccgtgcggtcggcacgcccgcacgcgaaaataaagattttcccagacgatgagctgcaggcgggccgggcgaccgcacgggataatctatccaaccgcccggaaaaatgggtattgtagtagtgtattgttcttgctcttacaaaaaaaagccctttcttttcctagaatgttggaccctctctcttggagtcataagcgaagtggcatgataagatgaagcaattatcattccataaatcttgtgccaaaagcaagcacagaaggtctagataaagctagccatacccacaaatgatgatactacccgttatgatggcagaaaaaatgaacatatggagaccgaagaggaaaattaagagacccatagataagagaagggtgaagagccaatacggtccctgaagtttcgcttcgggctcaggatagtcctcgatgtttcaaatcgtccaaataagtcctccaaattaattatttgggtaaatatagtccttggacccacaaaaaatgccgggtgagcatgcggagtcatcatcgcgtgcagcggtatgaatggaatgaaatgaccattctacccttatataccatatggaaaagaaagaaaatacaaacaaaaaaaataacaggctatcccaggccagcattgttgcggatgggtggccgacaaaggaatttacacgatcaatgcttggctgcagcaatcgtaagtgacaattctaaaatgatcatacatgtgtgaatcatttatcttcttcttttctttcttttctatatggtatataagggtagaatggacatttcattcataccactgcattcaaggatgacctgcgatgctcacatggcactttttgtgggtccaaggactatattaacacaaacgattaacttggaggacttgtttggacaatttgaaacctcaaggactaaactgagcccgaagcgaaacttcataaactgtatttgctatttgcccataaaagaaggcgaaatggcagttgaggtgtggtggaagtgatgcatgcacagaggcttacaccatttgtgggtgagaaaaaaggaaactaatgcagagaaagagaagaaagatgagagctgccaacagtcttaccaactagataaaaagaggctt

SEQ ID NO: 17332 - DNA, 1501 bp, Oryza sativa
aaaaatatcaaatcctattatattatctctatctctactacttaaaaaaaatctctatctctaactctaactctacttatatgatatgagctgtttccgtcctctgtgaaaaaaaatcgggcgaaaaaaaaacggacgaaaaaaagctaatcctattccgtctaaagaaaagggcgaaaaaaaaccaataatcatgaaaaaaaacgggcgaaaaaattcgggtgaaaaaaaaccgtgcaaaaaacaacaacgattccgtgtaaaataggaatcggtaaaaaaaaccgggtgaaaaaaccagacaaaaaaacgaatctgattccgtggacgcggtaaaaagaggggaaaaaaaacgaattatgtctgattaaaaaaagaattatatgtgatgccgtaaaaaaaatttgaatcctattatatgtgacacggtactatatatctctatcttctctatctctatctctactactttaaaaattaaaacgtttccgtcgtccgtaataacgaaaaaagagcaaaaaaaaaacattaagaaaaaaaaaagtccgattcaatttacttccgtcgtccgtgaaaatcttatcttatcttaaaggtccaggccgctcggcgctcatcgccatttgcgagcccgcctagccagaccaccgacgctgtagcacggctttgcaccgccctcgagtgcgcccgctagctggcgaagcaggagccgcttggcggtcgtcaccgcacgcgcgcaccagctcaccaaactgccatcaccaccttcggcgtcgttctgctcgcttgtcgctggagagaaataggatcgggagagagggatgtgggagcttgggttttgcccctctctcccggtcgtcacttcatccagcacggggacgatcggagccatccattagatcggacggctcagatttgcccagcgtcgggccaccgccgccgttgattacgctgcgcccaacgggccgcgaaagtgcatcggaccgtccccacatatgtgtgctgcgtcagctgcttggcctgcgagccgtcgaattgactcaactaaccaaagatgggccagcccaagtttggcccggttgggaagacctgggccaatagcaaatttgatcaaacaatgtggctcagattttttaaattaaagtccgtcagataaactcataagtagattcgaaaaataaatctaaaactaaatcctaaatcctatgctaatttatcaaattagactcggtcctacctatttgttaatatatcaaattagacttgatttttaccgttttgaggttttcaaggtttcccactatcgaacggtgtttttcccgttgcaatgtacgggcactattgctagtaaaaaaaaaaagctgaagcccatgacgccatcttaatcctctgctcgtactgtccaccaactaacaggcacttgacctccgccagtccaatcatacacagccacgtgtcctggcacttcaaaagttagttaatgtgttcaaccaccagcagc

SEQ ID NO: 17333 - DNA, 1501 bp, Oryza sativa
caagagagagagagatagaaagaagccgggagggagcagaaaaaaaaaaggagaggaaaggaggaaggagccgggaggagagaaatagagaaaaagagagagagggagagaaaagagagaaaaagaaagagaggagagaaaaaggagagaaaaagaaagagagggagagaaaagagagaaaaagagagagagggagagaaaagagggaaaatagaaaagaagaaaaggagaaaatagaagggaaattgggggagaaattaggaggatttaggaaataaaaatggtcggggttaatcatagattatttttggaaattcctcgagcgtaatagtatttcggtcgaaattccgagttaattataaaaatatgtttcttgatcagattagattaaaattggtagtaatttagatataattaataactaaacaattagatgaattcttatagactattatagattattttgggtaatctctataagtaattgattcacggtagaaattcggatttaatcactaggaattttagacgtatattatatttagtcgtttagtcctagactaaaatttaatcgtataatattataagataattttaggattccgtccgatatttagcttgcgatagaaatttccaatctattatatggatataatgctcgggtagattaaattaaaaacttatggcaacaaaatatttatacccgcaaaatagtttaaatcgaaactgggtttgccttagttcgcggataataaagttaatataaagaaatcgactttcgcattcgactttcatttgattcatttggatttttatttgaattctaaccgaattcaaatcaattttcgcacgtaactatagagcccgagggagttgcggatccaagcgaagatcaagacccgcaagacattgagcaaggcaagtcatcactattccttgaacatgttgatcctaattgcgaaattgttttgtttacaaataaaattgcatgcagtgatgaacatcctacttgtgattatgccatgccttgattattgtttacccttaaatctttgtaaccatgtttacgtatgagtccctagtcaacaatgacaattgcttagaaatgctattctagaatcatgcatactcatatttatcaaatgctatatggttgggcaattacctttgggaaggtaattgagatgcggcatgtggagacatgagcgccacattgccatgatgttgatgacatgatttgtgaaaggagaaataaaattaaacaactgttttcgactggggcggatggaggatttgggtggtatctggaaaaggctagtaccgtccccagtcaattaaggaccgagccatgaagttaagcatgaaacgacccccgtacaaccgtacttctcgaatgggtatagacctagcggattagatagccgagcggaggcagtatccctgcatagatggttcacccctaagtgaggcaggtgcgctacgatgggacggccgttgaggt

SEQ ID NO: 17334 - DNA, 1501 bp, Oryza sativa
atatatatatatatatatatatatatatatacacacacacatatgcatttgcataacatatatattatgcatgtacttatgtacttatgtactgaaccatatatacatatataatatatatatatatatatatatatatatatatatatatatatatatatatatatatattgaatcatatatatgcatggtttatatatatataaaccatgcagcaacagggccatgaaaaaaaaaaaaggtcagctcgatctttagtcccagttggtaataccaaccgggactaaagatggctcagccacgtggatctttagtcccggttatttcacccgggactaaagatagcgatctttagttccggattggtactcccggtttaaaaaccaggactaaagggggttacaaactgggactacaaagggtttctccaccagtggctggttctagctatagattaatcttggttttgagtatcgcatttgttgtctagtctatgatcaatgtcaatctgtgtgttgccgaaaggaattttttttatctgacttgtttatgttagcagatcgagtctactcccaaaaaaacgcgtggtcacaattcgagtagtaggtcagaaggcaagtcttgttcgcttcctaatttcttgcgccaacagaacaggaaagaccgagattttcttcctgtgattttggtttattccaaaaaaaaaaagaaaaaaaaaagagctgctgcgtgcatatccatgcaaggaaatttcattccagtgctagcttgagtcttcttgtaatttaattagccggttgttccatttgatagccgccacttgttcaaagaaaaaaaaagaaaaaaaaggcaggaggtgcaaaaaaaagagagaaaaagagccgcaccaaaaaaaatcagaaaaggaaaaaaaagaaaaaaaatcagaaaaagaaaaaaaaaagagaaaaaaatcagaaaaagaaagtgtggaatttttttgttggaatcttggagagagttgcttactatagcaagttgtggattgttcgactgtgatcatttgcttgcttaagttaggattgagtctagactacggcagcaattttgactagtactttggactagtattcaatttcgcaaatctgtttgatttttgctattccttgtgatatagttaagcctatcaagatccacatactactaacctttacaggtccggctttgcaattgctccactcatcaagcgtgtcattgtgccacgaaccagccacggtgattgacctgttttgcattctttgagaatattataagaatttggtgtatgcttgagtgttgagtgccttcaaaagctccacatatctatagattgttaggaactgatactttcttgtgagtttcttttgcttgctaacgatgtcaggtacaagttccaatgaaccaacactggagaatgtatcgcataaactgaagggcatggaaagttggtatgaagagttgatgcgtaatagtaaatcataca

SEQ ID NO: 17335 - DNA, 1501 bp, Oryza sativa
aaggccagtgaagatcaacatctttgctagcggttatcaactataagcgaagaaatattttcgctggcggccgtcttaagacagtcgccagcaaaaatatattttcattggcagctgaataaagacagccgcagcgaaaattgtcttcgctagcggctgccttatgagggcagccagtgaaaataatttttgctggtgcttgtgttataccaacagccaatgaaaatgattttccagaaaaaaaaataaatccccagcaggagaatgattttcttgaaaattattatgccaacccaattaagaaaaagcagcaatgcttaggtgttctgcgacattaccagaaactgaaactccgcttctcccactgaccattgcataccactaattaactgaagatatctgttctcctgcatctttcccctcaaaaaaaaaaaaccagctacataagagcaagtttaatagtataatcaactactggttctaatttaactatagccaatttaatactctctccatttcataataatcagcgcataacaaaagtagagatattccgatttgatcagcgtattaacactggtagcatgtgcatgttggatggattaagggcctgtttagatttatttggaatagcaaatggcaaatggcaaaagctttggcattgcaaaagtattagttggtgtttagatgcatattaaagttttgacattctagcactaaagtgagagagagaaagagagagggagtggtcccaaagcactttttagtacaagttgctactatatactagcaaatgctaaatgacaaattgtcaacttttactactagtgtttagatccaaaataacaaaaagtactataaaatggcaaaactagaggatctaaacagggcctaactagttactaccacggagatcgagtaggccatgcgattttcgagctgcatgcagcacggaacatcccttgcatgtgtaatcatgcagcggcagtaatgccgtttcgtttctcaaagccaattaatatggagattaattacaaggattaaatagaaaataggtagtgggcctcttcttggtctcgataccacaacgaaatgatcattatagaatagagggagtagctcattcatacaataattatatactttctccatctaattttgatagtcatatttctaaatttgaaaattttatttttgataggcatatttcaatccaacaacctattctcttaatgattttctcgaatttattgcgtgactctccatttttccacacatgattggctacataggtattgagaaatgtaaatattaatgaatcgcttggttacgaggaatgactagtaccatgtttaaatggatgataagtagaattacttatcctttgtctgtgtgtcaagatgaactatgactatcaaaagtagatggagggagtactatactattaatatctggtcccacctgtcattcacactgcgtctgggagttcatactactgctg

SEQ ID NO: 17336 - DNA, 642 bp, Oryza sativa
tttcacagtcgttgggctgctggcgatcctcccccgtctggaaaaatcacttttggccgcctgcaaaaatactttttctattagtgttgtactccatccgtcccataatatagggggctcctagctggcgcgtgcgcgccagcaacacgcacgcggcccagtaggtgggtttccctttttttcgttgttttttttttcaccgcgtgaatttctctttttttcggattttccttttttccgtgatttttttatcgcgaatgtggcgcgactgattttttcccgtgtttttttccgagtatatctaatgtaactaacacgttatttttagataacgatggtaattaagataagatttttttaagtaacagattgaaaacaaatctatacgtgaagtcaaaatttgaaaacttttaatccagatttaaaaacttttcaactcaaatttgaatttttgaagtcaaaatttgaaaacttttaacttttcatctcaaatttgaaaatctctcaactaaggtttgaaaaactttcaactcaagattttgaaaaattttcaactcggatttgaaaactttcaattgagattttgaaaactttcaactcgagattttgaaaactttcaactcgggattgaaaactttcaac

SEQ ID NO: 17337 - DNA, 1501 bp, Oryza sativa
tagaagtttattttcaatggcggacatgaactttgggagtggagaagcatatggtaggtgttttgcgctgccgccagttggaaatatgtaagttttacggtctctcaacctcaactccttcctgcttgtttgtgttgcatgatgtttcatggtctgcactgttcagtggatgtggtcatatggatagtcaacctctaaatgatactactactcgtactgaagtaagtacttctagcttgtgtggacactaagatctatactattatgtgggtgtggatgttcaaccactaaatgatacttatcatactgatttgtgcaaacattgataatacctctaaactgcacttagttagctgtgattttgagtgccaccacgcaatcatggaagcaatctcagaacaacttgatatggatgcatgatgcatatgtattgagtattttgcatgccactgtttgtctttatttcatattagaattgcatatagtgtagtagttgttcttgctcctactacatttgacctggcagagttgatgcaaagttggatcattctaaaaaaaattaatctggttctaaccttttcatttgtgtgtatgttaagagtgaaaaataattgctgccaatgcttgctatatgtaattgattttgtctgaatttactcaataatttaggtaaaaggtgggaaagtagtgagcaggaagtagaagaataatttacaaattccagtctatgagaggagacgaataattaaatatccagattcaattgtgattgttccaaaagttatgccaaaaaataaatacaattcttaatatgtgcatcattaagggctaaagaattacctgcgtccatcataaacgtagatttagtatcacgttgaaccagaaattgctcactttgaaaaaaataacaaatttgggggcatatattagtgccgagtgagagattgctcagtatccacaccaaattttgggtgcatatgagtcttatttgtgatatgtgatttcagttttttgtataggttgataagatgtttgtattctacttggacatgtaatttcaatagttggattctgtatgtaattcggtatgtaatttctatcattggactgtgtgcaatttttgggccatctaattgttcccgactctatttggcctttgtaatttctgagtcatgtatttgtatcctactaaatttgtgcttcaacccaatcggatggaaaaaaagaaaaccacggtaaaaaaaaccggacatccgaaaaaaaacagggtagaaaaccgcaaaaaaaaaccggatagaaaaaatcaacgaaaaaacggaccaggaaaccgtgaaaaaaccggacggcccagaaaaaccggacagaaaaaacgacgaaaaaaaaccgggttagaaaaccacgaaaaaaccggatggcaaaaaaaccgcgtgtgcgttcaggaaaccgccgacggacgaaaaaacctcacggaagccttacgaatttttttattaggtataga

SEQ ID NO: 17338 - DNA, 1501 bp, Oryza sativa
gtctatgttactctcccaaaatattttgttggatgacttaacccctaaactatttttttctcattttaccattaaactattaaaaattatttattttactgccgagtagcatttctctttgtgcaacttatatagatagaaaaaaaacagaaattttgttacgagtaacatgagtcattttaaatagtttgagggtgtaggttatgtgatcggctaaataattcaaggagtaagataaacaatttttcaacaatgtttagtttacatgaaaaatagggtttcacacaatataagaggaaaaaaaagagttctccattttttttaaaaaaaaagttgcgataaggtgaattttctacatatactattaaagtttaatttcctttcgaaaaaaaaacatatgctggtatttttattctaacaaataaagaaaatgaaaaaaagggagaaaaaaaaacaaacgacccaatgggccaggaggcccaggaacgcgacacgagcgacgcgagggttttatcgctctccgccgccgaccggagtaaggggaagagctcgccgccggtgccccgacactgcggcggagcgggactgcgggagcgaggtggccgcgcgcgagcgaggctttcctctacctccgccgcatccacccctcctcctcttcctcctccacgatcacctcctccccaccctgcccagttcggctggtcctctcccgcccgccttcttcttggttcctcttcaagaaacaatcccggccatcgatcgccgattccttcgaggtatgtatctaccttgcgctttcagttcttggctgaggactcgagattaccgaagaggagacaagtgcgttctgagattgaatataaaaaggaaatttaatcttcggctcagttgcatgatggctcttctacctggacgcttctaaatatgtcgatccagcagattcgtgttgcaatttcttgtgatttttttttaaacctagccctgcttgtttcatcaattgcctcgtaagttccagtttttagtttgtataaatgctgatgttttttattaaattgatttgtggaatataattcgctcgttcctttgaacaagcaattctaagattttacttcgtttagttgtagatcccttatttatcaattgttcctgtaaaccaatatatacatagttgctacatttattcccttctaggtttgcaaagctactctgtgttaactgatttcgagataaattaataggattctgcctttattaatcgttttgtagatgaataaataggtcacatacttgatttatatttgtgaagatcagcaaacgaaccatgaatcgcaaacatgtacaggaaaaagcgaaaagttttatgtttcatcagtatgaatatgctacttgaattttccatcatatattcatgtggttcattatgatttcattaattttaatccagggctctggacacctgctacaccttgaaatacctaagttgctctgctgtatttctcaa

SEQ ID NO: 17339 - DNA, 639 bp, Oryza sativa
gcggtaagatttgatgtcttaggtcctcccggggtggtcctttttataccgcaggtcagttggtctcaagtagaactcggagacatcggaccccacacgatacagtaacgacccagttctgtctgagtaggactccttctatctgtggattccgcatctatctcgtgacgaatttccttaacgtacataggaaatatccgtataggcgcgggtataccgtatcagtatagaacgtgtatccaagggtagagggtatatcttatccataaccctgacacttttcatgataatcactactaaacgatagattttcatggacgttacccccttttatttccatgcagttcttaagtggaactgcacggaaaaataggggaaccggggctgggctgttgcccgtatgggaaaatcgattttctcgtgcggtcctcctaaacggaccgcacgggaaaatgagccgattttcccgtgcgtatctattaagagagccgcacgcgaaaatagtattccctattttccctcccacccatttcaaaatttttcctcatttatctcttttaatttctcctcacatccctcccctcttatctctcttctctctcctcctctctctttcacgcctctcctctcgtctccttt

SEQ ID NO: 17340 - DNA, 1501 bp, Oryza sativa
atgtgtagggttgtccatggaacaaatcaggcacaacgacgtaatatccggctagaccaactttatcagctattttcctgaaattgtcagcaaccttataatcaaacatctgcttttacattgttttcaaatgtaaaattaaaataaagtactggcagataaacagagtttctgcaagccatggagaaatagcttgacgtacaacctggcaatggaagatcacataataagttctgaattaacattgggttcacaatcttacatatattaattgtccctaagcagatgtgcacactatacaatgatgtacaatagtatatgtgtcatgaaaaacatattttagtttaagtaagcacaatatggaattcttatcatggcgcatatactcgcccattttaaattgctgtccaattatatgtgctatctaagtactagttaaagatattaaaccatgattaccacactattaaatggtatatttgaacctcttggtatatttatattactagcaaatatgcccgtgcgttataacgggtgaaaaattctaataacaatatatgctttttgtcgacgggggatacccgtagaccggatatagagggtattggggtacgctgatatgaggatctacgtagtacgacatcaagcaaacaggaaacagggattatattggttcaggccccttgataggtaatagctctaatccagtgatatgggattatataatgaaaatcacatattagaaagggaatagtggaactcaatgataccgacgagatcgtagtcgagttggttcaactaaatcacccggcgacttggctcccgtaggctccggctttgtaggctgtggtggatgtgttggcggtaagatttgatgtcttaggtcctcccggggtggtcctttttataccgcaggtcagttggtctccaagtagaactcggagacatcggaccccacacgatacagtaacgacccagttctgtctgagtaggactccttctatctgtggattccgcatctatctcgtgacgaatttccttaacgtacataggaaatatccgtataggcgcgggtataccgtatcagtatacaacgtgtatccaagggtagagggtatatcttatccataaccctgacacttttcatgataatcactactaaacgatagattttcgtggacgttacccccttttatttccatgcagttcttaagtggaactgcacggaaaaataggggaaccggggctgggctgttgcccgtatgggaaaatcgattttctcgtgcggtcctcctaaacggaccgcacgggaaaatgagccgattttcccgtgcgtatctattaagagagccgcacgcgaaaatagtattccctattttccctcccacccatttcaaaatttttcctcatttatctcttttaatttctcctcacatccctcccctcttatctctcttctctctcctcctctctctttcacgcctctcccctcgtctccttt

SEQ ID NO: 17341 - DNA, 1501 bp, Oryza sativa; identical to SEQ ID NO: 17340

SEQ ID NO: 17342 - DNA, 1501 bp, Oryza sativa
aggaaaaaaccaagtggattaaaaaccaaatcctcaccgcgtgctaaaaaatgtgactaaaaaaatagagacggaaaaaagcggatgaaaaaactggaaaaaggaataaaaacatgcaaaaaataggatgagaaaagcggacggaaaaaaaccgaacaaacaacgtcgaataaaaatggatagaaaaaaaaagggaaaacggcggaaaaaaagaaaaaaaaacgaagaaaaggctggacgaaaaaaaagaaataatggaaaaaaaaggaagaaagagcgaaaaaaatgaccgacgaaaaaactcacggaagccttataaatttttttattaggtatatagagtaatccgacgaaaacaactaccaatttttaagttccaagtacctgactgatagatagtagttcggaacagaactcaacatataataacaaaacgaaaggcgtatatatcctctttcttccgtccgacgcgcctcctccccgcacgcgcgcgccttctcccaaccttaccttccttttatttcttttaaccttcttccatatatagatctaatactctcccgctattttcttttaaccttcttccataatcccggctggtgagagctctcgaccacagctcgccgcatcatcgttgtcacgcgcgtctccatcggtatatctctcccgggcatgaggcggcggtgtaggcggtgcacgcgccgcggccgccatcgatctacaaattagtgggaggggtgagaaattagctacgttcctataagttcttcttttcttttcctattgttgttattaggctagttaccctgcatgttctgctatatccttttatacttgttttttttcataattccttgctcctctaatttggatgggactagaaaaaatgcccgtatgttgcaacgggtaaacacgtttttttagtgatacaaccgcagaaacattagtatatcttctttcagtttttcccaaatcagagcgaatccacaaaactcggaataaaaacgactaggggaagatcgccggctgacgaagattaaatctagtgaattaaatccgaattgaaaggggaaattatagggggacgacgaatgttaaatggagattaaatctagtgaagtaaagccgaattgtaagaggaaatcaaatgatgagggagtagtggggaatcaattagagtaggatacgcacgggagccagatgaatgtggcggcggcgctagggtttggccagggcaactggttgagattaaatcccggcgatagaaaaataccaagtggattaaaaaccgaatcctcaccgcgtgccaaaaaatgtgattaaaagaatagagacggaaaaaaagcagatgaaaaaaactttaaaaggaaaaaaacttgcaaaaaaaaaggaaaaaatgatgaaaaaagcgaacggaaaaaaaccgaagaaacgacgtcgaaaaaaaagtggatggaaaaaaaaaggggaaaacggcagaaaaaaaaaagaaaaaaagcga

SEQ ID NO: 17343 - DNA, 1501 bp, Oryza sativa; identical to SEQ ID NO: 17342

SEQ ID NO: 17344 - DNA, 1501 bp, Oryza sativa
aaaaagttagaagtttggattcaaatacagcctctgtatcagtcactatgctcgtcagtagtccgacagaccgacaggctaggttcgttctgacttcctgagactgagagggagtggcgactagtgtgcatctaatgctgccgttaatgtttatgggtggagatatacggttttctttcttttgtaaaaatagctgatttcccttcgttacaaaacatctatctattatattattaaagaaataaagaaaggagcctccacgttcgctctcatggcctagaaatcctcacattaatcggagaaaaagaaaaggcaaagtccatatagaaatacaatttagaaatagctgaaattcggaattaaaaaataaggaatattagaagagaagactagagtccatatagaaatacaatttagaaatagttgaaattcggaattaaaaaaataaggaatattagaagaggagactagagatagaaataaaattaggaaatcactaaaattcggaattaaaaataataaatattagaagtagagtatagagtccatatagaaatacaattaggaaatagttgaaatttggaattaaaaaataaggaatattagaagtagagtatactgaaattcggaattaaaaataaggaatattagaagtagagtatagagttcatatagaaatacaattaggaaataactgaaattcggaattaaaaataaggaatattagaagtaaagtatagagtccatatagaaatacaattaggaaataactgaaattcgaaattaaaaataagaaatattagaagtagagtatagagtccatatagaatacaattagcaaataatataaatttggaattaaaaataaggaatattagaagtagagtatagagcccatatagaaatagaattaaggaaaaaatagaaattcagaattaaaaaataaggaatattagaagtagagtatagagtccatataggaatttaaaactaactaaaatttggaataaacataataaaattaaaagtatagtttagagtccgtataaaaatacaatttacaaataactaaaattcgaaattaagaaaaacatgggaagaagaggtgaaggtcaatataggaatacaatttagaagtaaatgaaattcgaaattaaaaattaaagaatattgaaagatgagtttagagtccacatagaaatacaattagaaataataaaaattcataaataaaaataaataatattggaagaagagcatagagtctatatagaaatacaatttacagaaaattcagaataaaaaaatatattaaaagacgagtctagagtccatatagaaatatatataatttacaaataactaaaatttgatagtaaaaataattaataaatagcacgtatataaaatataatatgaatattacacattagtagttttgtaaagttattacaaaatttaaaattatgttgtcattttaatatatttgaataatataatg

SEQ ID NO: 17345 - DNA, 1501 bp, Oryza sativa
gtaggaataggaaaatcgtaggaatatgataggaatgtatgtgtaaaacagaggattgaaaaacacaggaattctgtagataggattggtaaacatgtgttcggataggcaaagaaaaaacataggaaatggaaaaaatgaggtaggagtggatggaaattttcctttgtttctctattgattccacatgaaaggaatttttcctctgatttttctttgggtcgattcctatgaaccgaatgtcaggaaaggaaatatttcctatctacagtattcccttgaaaatcctacaaaaatccctcaatccgaagaggccctaaaatgagtagacttcacgccaatacaaaatgcaaaagggaactagtgttactcctacttcatgccaaattggcaatacaaattacaaaagtactgcaaaggtccagcagggtgagaatgaaagcgcgtaccgtaataaactgttacggtaaaacccaggcgtgattcgtgaaagcgcgatagacaagacaaagctagccggcagaaattcctggtagccgctaccgatgtgcaacgcatggacaaagatggccatgcgtcgagagttggcgtgtaccccatacccctgtacccatacgggccacacacgtaccacgccatgatacttaccatcgcaggcaggcaggcaggcaggtccactcgtgatctgcgacccgagagaccgagccctgtgcagatccaccgtcgtcatccggtggattttctgcaatgccgcgctctctccgaagttacgacgttacgtagtaccacgacgtaccgcggccgcgataaaggatcgccggctggttgggcggggagcctttacgagtggccgggccgacgcacgttgcggcggtgcacgctaccggagaattcggcgctcgtttgcgtcccaattgatttggtcggttttccctgcaccgtttttctgtcgtggtaggtgcccgtaccaccggcagccggagcccaatctgttccaggatcagatcgatcgagccccgagtcccgactagcgtgcggtgcggaactgctccgttgtaatgcttgctgcctctgaaacgaaacaagaccatcctgaaatgatgtgaaatgccccgtcaccttttgcgccaactttgtaggcctttttttttaggtttttctgtggaaaaggcagggatttctccggttttcccgacacaaaggtttcttcacttgcaagactacctcctgtctacgcaccggttccagcatactgattctgtctgttccatattgctcactagacaacactactatcagtcgagatggcatatgagcttgttaattaagaagtatacttttgccaaagaaacagaacaccggggtatccttcgacaggggaaaaaaaggaaaagcaaaactcaagtggaacatgatgctgcatctctctggtagttgagatttgagagtcgaattagagcagatacaatagcatgctacaaaccagctgcaaacatatttt

SEQ ID NO: 17346 - DNA, 1501 bp, Oryza sativa
gccgccgtcgccgccctgggtagcagagagccgagagagagagagagagagagggagaaaccgagggagagaaagaagaaggaaggtggagagaaaccgggagggagagggagaaggaaaaagaaaagaaaagggagagagagaaggaaaaagaaaagaaaagagagagagaaagaaaaaaaaaagaaaaagaaaggaaggaaaaagaaaaagaagggaagaaaaagaaaaagggaaatagataggaaattagagggagattagggaagtttagaaaatttaaaataattagcatttagttatagactagttatagacgtagaattgcgaaatttaatataaattatggattattcttggtaatttctacaagaaatcaattcgcggtagtagtttaaatgtaattaagaactaaacgattagatgaattcttatagactattatagattattttgggtaatctctataagtaattgattcacagtagaaattcggatttaatcactaggatttttagacgtatattatatttagtcgtttagtcctagactaaaattaaatcgtataatattataagataattataggattccgtccgatatttagcttgcgatagaaatttccaacctattatatggatataatgctcgggtagattaaattaaaaacttatgataacaaaatatttatacccgcaaaatagtttaggatataaaaatcgaaattgggtttgccctagttcgcgaatagtaaagttaatataaaagaatcgacttacgcgttcgacttccatttggatttatttggatttttatttgaattctaaccgaattcaaatcaattttcgtacgtaactatagagcccgagggagttgcggatccaagtgaaggccaagacccgcaagactttgagcaaggcaagtcatcactattcttgaacatattgatcccaattgcgaaattgttttgtttacaaataaaattgcatgcaatgaggaacatcctacttgcgattatgccatgccttgattattgtttaccccttattcctttgtaaccatgtttacgtatgagtccctagtcaactatgacaaatgcttagaaatgctattctagaatcatgcatactcatatttgtcaaatgctatatgcttggacaattacctttgggaaggtaattgagatgcggcatgtggagacatgagcgccacattgccatgatattgaggacatgatttgtgaaaggagaaataaactaaataactgttttcgactggggcggacggaggatttgggtggtatctggaaaaggctagtaccgtctccggtcaattaaggaccgagccatgaaattaagcatgaaacgaccctcgtacaactgcacttctcgtatgggtatagacctagcggagtagatagccgagcggaggcagtatccctgcatagatggttcacccctgagtgaggcaggtgcgttacggtgggacagccgttgaggta

SEQ ID NO: 17347 - DNA, 1501 bp, Oryza sativa
cgcaactggatccacgcgaggggcggcagccgccgccggatccgtgcgaggggcggacgccgtcaccggatccgtggggggcacagggccgccgccgccggatccgcgcgtggggcggttgccgccgctggatccacgcggggggcggccgttgccatggccgccgccgccgtcatgcagccgaatcctcgtgggggtggccgccgcctccggatccgcgcgtggggtggccaccgctggatcggacgcagccgtcgcgtgccacctcgtcgtcgccgctgcccaccatatcccgtgcttccacggcagatgcgcgctgccgacgctgtcgccgcgcaccaccgcagtcgcctatgcccaccgcacgctgtctcgtcgctgtcgctgagggaggagaggagggaggagtgaggagaggatatgaggcctgacacatcgctgtctgctttaacacgtgacacgtgagagaataaaggagagggagggtaccgaggaaatttcgatgtggataagtgggaaaagaggatattaccgcatgggaaaatctgtttattttcccgtgcggtcctcttgtgcgggaccgcacgggaaaatcgattttctcgtgcaggcgttagcttggcaccggttttcgattttctcgtgcggttttacttaccaatcgcatggaaataaaagggggcagcgtccaggaaaatcaatcgtgtactagtgctaggcatatgcctaagttcagagcatgtgaagacgatgccgtattttcaggtgtgacaatatctgttcacccggaaatatatatattatggtggtggccagatattattatttgtcttagtggtggctacatgtggtggcaaaaagctataaataatctctgatgggtaggatggtgaggatgattatatgtgtgatggtttggttgcacaagccacgattatatgtgtgatggttaggttgtacaagccacaaggcatttaattttgtcaatgaaatatagggcctatttggcacagctccagctcaacctccacctctcctagagttagatgtcagccaaacagtttcagctccacctaaaatgggagtggaactggatggagctctcacaaaattaactagagaggtggagtagggtttgggcagctccacaacttgactccagacctaactcatgtaattaaattttggagttggagctctaccaaacaggcccatagtatagaaacggacgctcaaacaaacacattatcaaataaaagttgcccgtgcgttgcaacgggtaaagacttttttcaatgatatactaagagtcgagtaacaaattgaaggccgtggttagatgctgtaaaaatttggccaatttttttttgacacacatttaaagtattaaacgtagactaataacaaaacaaattacagattccgactgtaaactgcgagacgaattttttgagcccaattaatccgtcatgtgggttactgtagcacttatggctaatca

SEQ ID NO: 17348 - DNA, 1501 bp, Oryza sativa
aagcacagcagaggctggagggcaggccagccctcgctctccatggaaggcgacgccgcaatggcaactccaggaatttctttttgggtgttcctacttcatgttcaaaaattttataacgaatttcttgttgggtgttcctacttcatgttcaaaaattttataacaccgtgagcccacaaaatttgctcggattatgacataataaagcaactagcatggtggcccgcgcagattgtgcggctaacatcattatattttatctcatatagtagcatatatgttttctcattatattactaaaatatattaaattgacaacataactttaaatttcacaataacattacaaaactaccaatactaccaatgtgtaatattgatattgtattttatatacgtgttatttattaattatttttaatatcaaattttagttatttgtaaattatatatattcctatatggactctagactcgtctttaatttttttttaatttcgaattttctgtaaattgtatttctatatagactctaggctctttttccaatattatttatttttatttctaaatttttattatttctaattatatttctatgtggactctaaactcatctttcaatattctttaatttttaattttgaattttagttacttctaaattgtattcctatattgactttaaactcttcttcccatgtttttcttaatttcaaattttagttatttgtaaattgtatttttatacggactctaaactctacttttaattttattatgtttattccgaattttagttagttttaaattcctatatggactctatactctactcctaatattccttatttttaattccgaatttcaactatttcctaattatatttctatataaactctatactctacttttaatattccttatttttaattctaaatttctattatttctaaattgtatttctatatggactctatactctaattctaatattccttatttttaattccgaatttcaattatttccaaattgtatttctatatggactctatactctacttctaatattccttatttttaattccgaatttctattatttcctaattgtatttctatatggattctatactctacttcttatattccttatttttaattccgaatttcagttatttcctaattgtatttctatatggactctaatctcctcttctaatattccttatttttaatttcgaatttcaactatttctaaattgtatttctatatggactctagtctcctcttctaatattccttatttttaattctaaatttctattatttcctaattgtatttctatatgaactctatactctacttctaatattccttatttttatactctacttctaatattccttatttttaattctgaatttcagttattttctaattgtatttctatatggactctagtctcctcttctaatattccttattttttaatt

SEQ ID NO: 17349 - DNA, 1501 bp, Oryza sativa
agagtccatatagaaatacaatttagaaatagttgaaattcggaattaaaaaataaggaatattagaagaggagactagagtccatatagaaatacaattagaaaataactgaaattcagaattaaaaataaggaatattagaagtagagtataaaaataaggaatattagaagtagagtatagagttcatatagaaatacaattaggaaataatagaaatttagaattaaaaataaggaatattagaagaggagactagagtccatatagaaatacaatttagaaatagttgaaattcgaaattaaaaataaggaatattagaagaggagattagagtccatatagaaatacaattaggaaataactgaaattcggaattaaaaataaggaatataagaagtagagtatagaatccatatagaaatacaattaggaaataatagaaattcggaattaaaaataaggaatattagaagtagagtatagagtccatatagaaatacaatttggaaataattgaaattcggaattaaaaataaggaatattagaattagagtatagagtccatatagaaatacaatttagaaataatagaaatttagaattaaaaataaggaatattaaaagtagagtatagagtttatatagaaatataattaggaaatagttgaaattcggaattaaaaataaggaatattaggagtagagtatagagtccatataggaatttaaaactaactaaaattcggaataaacataataaaattaaaagtagagtttagagtccgtataaaaatacaatttacaaataactaaaatttgaaattaagaaaaacatgggaagaagagtttaaagtcaatataggaatacaatttagaagtaactaaaattcaaaattaaaaattaaagaatattgaaagatgagtttagagtccacatagaaatataattagaaataataaaaatttagaaataaaaataaataatattggaaaaagagcctagagtctatatagaaatacaatttacagaaaattcgaaattaaaaaaaaattaaagacgagtctagagtccatataggaatatatataatttacaaataactaaaatttgatattaaaaataattaataaataacacgtatataaaatacaatatcaatattacacattggtagtattggtagttttgtaatgttattgtgaaatttaaagttatgttgtcaatttaatatattttagtaatataatgagaaaacatatatgctactatatgagataaaatataatgatgttagccgcacaatctgcgcgggccaccatgctagttgctttattatgtcataatccgagcaaattttgtgggctcacggtgttataaaatttttgaacatgaagtaggaacacccaacaagaaattcgttataaaatttttgaacatgaagtaggaacacccaaaaagaaattcctggagttgccattgcggcgtcgccttcca

SEQ ID NO: 17350 - DNA, 1501 bp, Oryza sativa
tgctcggccgccgtcgccgcccctggtagcagagagccgagagagagagagagagagagggagaaaccgagggagagaaagaaaaaggaaggaggagagaaaccgggagggagagggagaaggaaaaagaaaagaaaagggagagagagaaggaaaaagaaaagaaaagagagagagaaagaaaaaaaaagaaaaagaaaggaaggaaaaagaaaaagaagggaagaaaaagaaaagggaaatagataggaaattagagggagattagggaagtttagaaaatttaaaataattagcatttagttatagactagttatagacgtagaattgcgaaatttaatataaattatggattattcttggtaatttctacaagaaatcaattcgcggtagtagtttaaatgtaattaagaactaaacgattagatgaattcttatagactattatagattattttgggtaatctctataagtaattgattcacggtagaaattcggatttaatcactaggaattttagacgtatattatatttagtcgtttagtcctatactaaaatttaattgtataatattataagataattttaggattctgtccgatatttagcttgcgatagaaatttccaacctattatatggatataatgctcgggtagattaaattaaaaacttatgataacaaaatatttatacccgcaaaatagtttaggatataaaaatcgaaattgggtttgccctagttcgcgaaaagtaaagttaatataaaagaatcgatttacgcgttcgacttccatttggatttatttggatttttatttgaattctaaccgaattcaaatcaattttcgcacataactatagagcccgagggagttgcggatccaagtgaaggccaagacccgcaagactttgagcaaggcaagtcatcactattccttgaacatgttgatcccaattgcaaaattgttttgtttacaaataaaattgcatgcaatgatgaacatcatacttgtgattatgccatgccttgattattgtttgccccttgttccttcgtaaccatatttacgtatgagtccctagtcgattatgacaattgcttagaaatgctattctagaatcatgcatactcatatttatcaaatgatgcttgggcaattacttttgggaaggtaattgagatacggcatgtggagacatgagcgccacattgccatgatgttgatgacatgatttgtgaaaggagaaataaaattaaacaattattttcgactggggcggacggaggatttgggtggtatctaggaaaggctagtaccgtccccggtcaattaaggaccgagccatgaagttaagcatgaaacgacccccatacaaccgtacttctcgaatgggtatagacctagcggattagatagccgagcggagcagtatccctgcatagatggttcacccctgagtgaggcaggtgcgctacgatgggacagccgttgaggt

SEQ ID NO: 17351 - DNA, 1501 bp, Oryza sativa
ttacctcgaattgcacgcaatgatagtccgactgaagaccatgcattcctccatcccatgtccatttatcgtgtcgactacaggaataattccatcaacatatgcagataaacattgagcggaagatgtaacagccaaaatggacaaacgagatagaggcatagagctctgcaccaatccagcaacctagcttaaaactcgagacaattttgagatcgaattggcaattatatatctaactataactctaactttaatccctatcacatcagatgttttggacattaattttgagtattaaacataaactacttacaaaaattaattatataaataaatgctaattcacgtgataaattttaatttttaagcctaattaatccataattagcacatgtttagcatcacataggctaatcatggattaattaggctcaataaattagtctcgcaaataagtccagaattatgaaatggattttgtcaataatttacgtttaatacttctaattaatgttcaaacatccgatataacagggactaaaaaatttagtcccaaccaaacagtcccataatgaattaagtagggaattactacaacatatttagtttttcctagcacccccactactacatgatagttttacctggacgccaccccttttgtttccatgcggcccataactagaaccgcacgaaaaattgggggggggggaccggcgctggactgtcgcccgcacgggaaaatgcattttcccatgcgggcgtcttaacccgaccgcacaggataatctttattatcccgtgtggtcgacttaagagggctgtacggaaaaaatcgattttcatgtgcagactttttaagtggaccgtaaaaaaaatatctctcttttccctctcacccacttcaaattttccacactctctctctctcttcctttttcgtttttattctctctccccctttactctcctcgatctcctcccatcccctctctcggcctctttttctcctccccacccctctctctctactctctctctctgcgcgctaccgtgtcatgacgactacttcacctgatccacccaaaggcacggatgatcaaggcgacgaaccaatctcacacaatgggcagagaaggaagtctgcgcgggagagacagcctaatagattgtataactcgagtgtgtggacccagtgatgttgggctgggccacggggagtgagagaggcccattagcgcagtgctataagaggccggcagggaacagattgaagcgaacattgtagaaacacttttctgaaactacttcaaatctctccctgttcttgctattcttccccaaattcctcttcctctgctgctctcgttctcatctcaatcccaaaattcctcctcgctaaaccctaattcttagaagtcgtgacaatttggtatcagagccgctaccctggagaagccacgctacacatctcgattgcaactccaagtcgaagcta

SEQ ID NO: 17352 - DNA, 1501 bp, Oryza sativa
aaaaaaagaaaagaaaaaacaaaatagcgataaaaaaagtccgactcggtcaaaaaaaatatcaataaaaataaaaaaaagtccgactcctcgttccctctcagaaaaaaaaaaggtccgactctgatccgagtcccactcctcacgtttgagtccgacatactaggcaccacttctctcggtttcaatttataccgtgatatttcatacatcttggtgaaaaaaaattaatgtgccagattgaagatctgtttgcaaaaacggaacctacatgtcgagagcattccattttaatatgattttaattttttggtttgtacatttgcatttgagtccctgtaatttttatatttacgtttaagtccctataatcttgcaataaggtgcttttggtcttttttttaaaaaaacaataaataaaggggatagaacaaaggcaaaaaggtgcataaaaaaaaagaaaagccacacaaaaaacaacaacaataaaagtctatttcccctaagtggcgaaaaaaaacgtagatgcaaacgggaaaaaaaatccgattcctataaaaggaaaaaaaaaagtggtgaaaaaaacactagatctgattcctttaaaaatagaaaagaagtctgattcctgtataggcgaaaaaaatccgaaaaaaacatctaaaaaagttcgtccgattccctaagaaagtggcaaaaaaatggttcgtaaaaaataaaaagttagttcgtataaaataaaaaatgcacgcaagaaaaaaagtggaaagggcgaaacaaagtccaatttctaatcagtataaatctcttctctatctctaatctaatataactatttaaaaataaaaaatgcacgagaaaataaaaaggtcaaaaaaacgtgtgagaaaaaagtcagaaaaaagcacagaaaacacactgaagaggtttttccatcttcttaaaaaaaataaaaaaacgcgtgagaaaaattatttccattgccggcaaaaactttttaaaaaaacatacgaggaaaaggatgtcagaaaaaatgcgccatttctaaataaaatggtttgaaaaagccacgcaagaaaaaaacactatatatatataaaatcgctctaaaaaaattgtcagaaaaaagctaatttgatggacgcttgagtcggataagatacatcgattttttaccatctactacccggcttttatttcgtcatatattctcatatattggaaaaaagcaaaaaaataacattccgaaaaaacaggcaaaaaaaaaaaaccatgcgagaaagtaattgtcagaaaaaataggcaaaaaacacgtgagaaaagcaaaaaaaaaaggggagaaaaatatggttttcgtcattagtaaaaaaaaggaaaaaaacatgctagaaaaaaaactgttagaaagaaatgcgagaaaatcgtgcaagaaaaaaaaacaccgtttataaaaaaaaaacaagccgctcattaaaatacaaacattgtcattgacatgatt

SEQ ID NO: 17353 - DNA, 1501 bp, Oryza sativa
ctattccgttcggacggtatcccgtacaataatttttctcttttctcaaagcagggggaactacatttatcttcctgcttttgttcccttcttaccgtgtcctcctttttattgggcttaaccatcgcagtattgttactttcttctcaatccacccatccagtcaatccccaattatataggtgtaggccgtgctttattcctaatctgtccaaccaactattctttaattataagggaagggcatgtaccattacaaagcatgatcaagccttaaaaagagattcttcatgttttggtccaagatcatcttttcagcatggcccataagcacggcaaggcccatttcttcaatctcttcgacgtcctcacctcaaacctgcccactccaaccaccaacacggctaggtggccatatggaccgggccgaggcataccggcctgacaagacagcactatagtcggcccaagcacggccactcgtgggttgttccggcacgacccatttagccgtgtcgtgcttggagcgacgcttgagtccatgggctggcacaggatgacacgatttccattgggctagcacgctacggcccaagtacgagcatggtcggaattttttcatttttaaatttatttgtttaatatttacagaaatattatatcggcggattgatttacaaaaatagacccttccgccctccatttgggtggcaagctgacgtggcacacggcgtcgtaacggtgtcgtgtgcgcattttgcatttagactctttgcagccctctgtaaggacggtaaggggctaaatgcaatttttgcgctgccaaaaaagcaattggatggttctttttgcatatgagacctttgccgcccttgcgaattttgcacggaggcctcttgccgcccaaacagagggcggtaagggggccacgcccaaaattcgcagccccctaaaaagaccgtcatgcgtccgtgtgccacgtcagcttgccacccaaatggagagcattagtgtctatttttgtaaatcttttcgccgatataatatttctgtaaatattaaaaaaataaatttaaaaatgaaaaaaatcgcatggtcgatcgccccaccaaattttccccataatttttcatctgttttttccatttttcctatttttaaaatatattttgtctattttctctcattttcccaaattttccatatgttcttttctttttcccactatttttgtcattttttctagtttttccccataattttaggcctgttcactttgatgacattttcaaccttaccaaattttaataaagttgccaaaatagtggatacatttagtttgctaccaaatttggtaactatataagaaatcctgccaaaatttttggcaaattttggtaaggtttttttcatcaaagtaaacaggtcctttctttttttttcttttaattttcctttttatcttatttctcttttttcggcctcgtattcaaattctgtg

SEQ ID NO: 17354 - DNA, 1501 bp, Oryza sativa
  unsure (1)..(1501): unsure at all n locations
cgttgccctcgcgccccccgcgccgcgcgctgatccgcctcccctctgccgacgccgtcgccatcaccgcgcctggccgcccctaaccccgtgctgccgtcgccgtcgtttccgtcgcgtcgccgcgccgccgttccatcgccttgcgccgcgcaccgccgctaccgccgagccgtcgccgtcgtcgcctcgcgccccgtgccgcgccgctcccccgagccccgtgccgccgctgttaccgcgccgcgccacccgttccatcgccgcgcgccatcgccgttcggccgtcgcgtcgccgctgccgcgccatcggcatcgcgcgttgcatcacctgccgcgccgcgccctcgagccccgtgccgtcgctgctgccgcgctgttgcttctcctcgcgccctgcgccctaccgcgccgcgtggtcgtcacatcgccgtgtcgagccctgcgccgcgccaccccgtcgacgccatgaggccaccgcccctctcccctcttccccattatctctctccccctcccttatataagcccccctactcccactcttccctttcatcctcacctcctctcctttaccacgccaccacgccgccgcctccacgccgcctcgccatcgcatagagcctccgcgccgccgccacgaagccgccgcgccgcgccacaccttgcgtngacgtcgccaccgtcgccgtcgccgccgttgccgccaccgccgtcggtaagccgccgcttcctccacttgctcggccgccgtcgccgccccgggtagcagagagccgagagagagagagagagagagagggagaaaccgagggagagaaagtcgaaggaaggaggagagaaaccgggagggagagggagaaggaaaaagaaaagaaaagggagagagagaaggaaaaagaaaagaaaagagagagagaaagaaaaaaaaagaaaaagaaaggaaggaaaaaagaaaaagaagggaagaaaaagaaaagggaaatagataggaaattagagggagattagggaagtttagaaaatttaaaataattagcatttggttatagactagttatagacgtagaattaagaaatttaatataaattatagattattctaggtaatttctacaggaaatcaattcgcggtagtagtttaaatgtaattaagaactaaacgattagatgaattcttatagactattatagattattttgggtaatctctataagtaattgattcacgttagaaattcggatttaatcactagaaattttagacgtatattatatttagtcgtttagtcctagacaaaaattaaatcgtataatattataagataattttaggattccgtccgatatttagcttgcgatagaaatttccaacctattatatggatataatgctcgggtagattaaattaaaaacttatgataacaaaatatttatacccgcaaaatagtttaggatataaaaatcgaaattgggtttgccctagttcgcgaatagtaa

SEQ ID NO: 17355 - DNA, 1501 bp, Oryza sativa
ccgcgtgcgcgttccatcgccgcctcgagccgtgccgctgccgctgccacgccgtgagcccgcgtcgcgccgcgccgtcccatcgttgcggtcacgccgtgccgccgtgtcgccgcccatcgcatcccgccccgagccgcgcgccatcgctgtcgccgttgccatcgacgtcccgtcgccgcgcgcgtcccatcgccactgccgcgccgcgcgccgtctcgtcgcctcgcgccgcgagcccgccgcctcgcgccccgtgccgcgctgctccccgggccccgtgccgccgttgctaccgcgccgcgccgcccgttccatcgcctcgccgcctgtcaccgtcgccatgcgccccgcgccgcgccgcgcgccgccgctgccgctcacccgtcgcgtcgcctcgctccgcgcgcccccacctcgcgccccgcgccgccgtcgcgtctcccctctcccctcttccccttatctctgcccctctcctatataaaccccactattcccactctttccctccatcctcacctcctctcctctacccactccaccacgccgccgcctccacgccgccgcgtcgtcgcatagagccgctgcgacgccgccacgacgccgccgcgccgcgccgcgccttggccgtgccgcgtttcccgccgccgtcgcagtcgccgtgcgccgccgccgtcgccgccaccgtgcgccgccgccattgccgttgccgccggtaagccgtgccaccgccgtctttttcctttcctcagccggtcgcggtaggcaggacgagagagaggaggagaaggagccgaaagagaatacaggaagagaagggaagaaagaaaggagccgggaggagagaagagaaggaaaaaaaggaaagaaaagagaggccggcagagaagagaaagagagggagagaaaaaggagagaaaaagaaagagagggagagaaaaaggggagaaaaagaaagagagggagagaaaagagagaaaaagaaaaaagaggagagaaaaagagggaaaatagaaaagaagaaaaggagaaaaaaagaagggaaattgggggagaaattaggaggaattatgtcacaccctgaaaatcataaatatataaattgttgtttaaatggaattttttttgaaataattttaaaagccttgaagagaagatctaattttaattaataaattccaatataaaatagggccagataaaattttattaaatactttgcttaattctataattcctagatttttctgggatttatttgagctaaggaagtatttttaataaatggaattgcatttaagaaataatttaaattgaaaaatgttttaaaaagtcttcttttggctttgggccgaaagtcggcccaaaacctctcttctctctctccacggcccagtccggcccagtccgccgccgcgcgcgcgcccttgctcgctgacaggtggggtccacctgtcaggttcgtcatccccgagccgccgtcgcctggccgaaaccc

SEQ ID NO: 17356 - DNA, 1344 bp, Oryza sativa
ccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacatatgccatcctgacctacatgtcattgactcatatgggtcctgcatgtcattgagataccgatgatatattttaaactttacaaaattataatggcatggttccaaattaccctaataattaatggacgtctgtaaaatttacaacagagtactgtatatgcatgttccaggcttccagcccttcagttctgcatgagccacaggaaaagtacgcaaaaaataaaaagaaaatggataaatcttctacacacatggtcactcatagggaagaaaatggtcgaaaaacagctcagtcattttttaaccatattattctagaaaataggataaaaagggtcaaatcgaaaatgaaagcggtgtaaaaaatatcaggaaatcagaaatgtcactatacggaggaaaaacagagttatcgcccggaaaccgatataaattctggaaatattaagctgtaaaaataatatatttaacttaatataactatataatataatatgcgaaaacaaattcaagcttacactagcttaaattataaactttctcccttcttatgccatgcactcaacttaggatttgattgaggaattaacgagcctctaaactatgtatcaaaccacacatattagggtatttaaaaatatggtaattatcaatattataaaaaggtaatttcaataggaatatggtaaaatacgaaaacagtcggtataagagaaatatgtttatgtttctatatcttttaccattttcatttcgtttttatcggttactattttcacaggctcagttggcaggaatctaaaaccggtcggtccgaaatttccaagtggaatatggtaaaatacgaaaacagtcggtataagagaaatatgtttatgtttctatatcttttaccatttttatttcgtttttatcggttactattttcacaggctcagttggcgggaatctaaaaccggtcggtccgaaatttccaagtggattcgtttgatactttgatggagtacaacgtttcagatcatagcagtgaattttttgttacaagctagaacaggaaaaatgagccagatatatagtaccctgtagctactaatcttctagattaggagactagcacgaatgtagtacggagtatatatctgatctgatgagatctcactctcagaaatagcttaaattaactttccagatggagcgcatgcatgca

SEQ ID NO: 17357 - DNA, 1501 bp, Oryza sativa
gacgggctaaacataactttgttagtcatctctgtagcccgctgctccacattacgttttggttgcttgatctaaggtcgtttgaaaattttgaattttcattgtgagcaattcaaacgtaactttgttggatagatgatttcaaaagaaaaagttatcgactacaaaattttttaactttttgagatcaacaactatcatttttcccatttctccgtcggaggtcatttgaaaatatgaatttcaaacgcaattttccttgaatagatgagccaaatgaaaaggctgtcatctacaattgtacaacttttcgagatttacaactttcgtttttgtcgcttcttcatctgacatcatttgaaaattttgaatttctaatatgttcaattcaaacctgattttgttggattgatgctttcaaataaaaaagttgtcaattaactacaaaattttctaacctttcaagatcgacaccttttgtctttggtcatttctacatttgaggtcttttgaaaaatttgaatttcaaatgttgggaaatttcaaatgcaaacttccttggatagatgagccaaattaaaatgttgttaactacaaagttgtatgactttttaagatctacagcttttgttttgttcattttctttatccaaggtcatttgaaaattttgaacctcaaatatgagaaattcaaaggtaattcgttggatagattatttgaaagaaaaatttatcaacttgcgttttgggtttttttttccattcaaggtcatttgagaaatttgaatttcaaatatgagcaattcaatggtaattaaattggataaatgatttgaaataaaaattatcaactacaaggttttataacttatcaaaatctttaacttgcgatttggtcggtttcatcatccgaggttgtttgaggaatttgaatttcaaatgtgagaaagttcaaacatacttttccttggatagatgtttccaaatgaaaacattttcaactacaaagtttgacaactttgaatatctgcaacttttgttttgatcgtttcttcatctgcatttgaaaattttgaatttcaaatacgagtaattcaaacataacttctttggatagatgatttcaaatgaaaaagttttgaactataaagtagcataacttttcgacatctacaacttcgattttggttgtttctccatccaaggtccctaccactacacactcaattgtgaccatggagcatttggattcctttggtttaactttgtcgaaaagttgtcaactataaaggtgtagatctcatcgaggatataactatattggtcgagttgtgttttaactatgttgggcctaaataaatttgaactgggacgaaattggaagcctccgagcatctcccaaagtattctaaattctcttcctaaaaatatgggggttttaaaggccccaaaagatagagagaaattaaattgcctatcttccaaaggttcccatattcca

SEQ ID NO: 17358 - DNA, 1501 bp, Oryza sativa
aaacattctcccaagcacctaggccctagcatctctagcagtctcagctagcactagaagaaatcaagaaatcccgttcaccttcagctagcactcgaagaagaaaaaaggtattttcaacctgctagaaaattaaggaaaaaggaaaatagttgttcctttttctctagaaaaaagatagttgtaaaagtttagaaaaaaacttgggacatttgtgctctaccgataaatttaaaatccaaattcacccgcacattgagaaacaaaataaaattttaaaaaatgacattgtattcagacttgtatttatcttatttatttgtcgctctaagacttgaagttggtaaaatgacattttttcctccttttatataattgtttggattgttgtttcgaagtgtcatttggaagaaaaatgtggcattccagacaaactatcaaactgtttccatagacggatctttccacatttgtgctctacggtcaaatgtcgacataaaaaattccagtctttgactgcgattccaattcttccgtgactagattttagtattggatataatcacaccttaagattacttagctaccacaaacttcatgggtactcttggcttcgttcggtagcagcagattgagagaaattcactctttttaacgggcaaagttcccgaattatttaatgatgcctttttttgcaaaaatatttatataaaaactgttcaaaaaatcgcattaatcttttttaaaaaagtttgaaataattaatactcaattaatgttgcactaatcgcacacctcattatcatcattttacgtattttcccaatcttcctcttttctcacctcttaaacatatcttagattccaaattacactactcccttgcacattcccattgttcattagatacaacctaactatacttttgtgtatgattattgcgtgagacatacggggcgaggaatagatcttgctgccataagtgtaagcaaactaagggctgtgtttttttttttgggaaccctgccctttacacacaaaacatgacaattgattaacacataattaattaagtattaactataaaaaacatgaaaaatatattaatatgattttttaaagcaattttcgtataatttttttttaaaaaaaatacaccgtttagctgtttgaaaagcgtacgcacgaaacataaaagtgatgagttggaaagttggggaaagaacttatgggtgcttaccgaatttgagatgatgctgactcaacctgcggcatcctcagtcatgctgactcacaccggtctacagtccagtcaacctcgtattcacgatggctgatcatatgtcatggctcgccttcaccggtcaacattatctccttaatttaacttcgcagatttcattcaacgccaaatctcacaagcaatctatccaaatctcttttatatatactagttttcatcatccttgctgcaaaatttgacaacgcaacgcaaagcagc

SEQ ID NO: 17359 - DNA, 1501 bp, Oryza sativa
cgatttaaatttgaatttgaattcaaattttttatatatagtatttctatacataaatttttctaacttttgtttttaaagaaaattgtgtggtgtactgtagtagaaagagaagaagggaggaggaagggggagaagagggaggagtatagggggggactgatcgctggatcgatcgcccattagaagggccccagtagagtcgcggatctggcagctggtctttgtgccttttatatggaagcaaccaagtaaagattctaaaagatgaggctacttgtacttaaaaacgtgaatattagggaaataactaacctctattattataaaaattgaagatatttttgcccggtgctttggtacatcatccgtgtttgaatcaattttaatctctatatatctctatctaaacttaaaaataagaaatttccaaagtaggaaaaaaagaaaaaaaaagattctgtcgttggtaaaaaaagagaaaaaatagtcctactccaaagaaaaaaaaagtctcgccactaaaaaaaaccaaaaatgtccgtttggtttttttttcaccggcgactttttttcacgtgaaagagttttttttttctgcgcacgcgctattgttttttcttctccggttttttaaatcaccgcacgcctcacgagcgcttttggtttttttgtcaattttttttgtcaccggttttttatcatgcgtgcttttggtttttctcatctggttttttaatcccatctattcgtggcatgtctaccgagttgaactctggcgccacgccggcaccatatcaatcgtgcgttttctctccaatttgagtgcaaaaaaaaaatcgattcccactccctcatcattttctccatgattttgctggctttatttcgtcggatttaatttaccggttgccgatgatgatgacgatcttccccgattgtttttatcccgaattttacactttgattttgggtaaaaaggaaagaggcgagtggataaaaacccttaaccaattttgggtgatcgacaaagattcggccggatttgatgggtcgaagaaaacaggccaaacagagagaggtagtggactggcctagggctgaaaacggcttcactcgtggctgggtcgaagcgagcatgccaaatggagggaggtagcggattggcctagggctgaaaagtaaggaaagctttcgacccaaaacccaataaatattttcattaaatttttttaattataatatatagcgatcccaatattaagattttcattaacaaaagttaattataatgtatagcgatcccaatattttaatttattgttcagctcttaatatatcattgaaaaaacgtttttacccgttgcaagttgcaacgcacgggtattttttctagtatttataaaaaaaaagaagaagggtggggtttcaaacccaggccagctagccctccaacttgtggagcaagtcggaaaaccctgggcgtttctcaagcttcctg

SEQ ID NO: 17360 - DNA, 477 bp, Oryza sativa
  unsure (1)..(477): unsure at all n locations
catctcnatactngaataaacaaaatacgagaaaggaacnancaaaaatcacccccccccncaaaataacacatgtanntnccnnnnnnnnttnnnnaannnncgggnngggggggggggggggggnnnnnnnnnnnnnnnnnnnnnnnnnnnnnnnnnnngnnnngnnnngngggggggggggggggannnncnnnngnnnggggcnnnnnannggngngaannngnngggcgggggngggggggggcccggggggggagaaggggggggagaaaaaaaaaaaaaaaaagaaaaaaaaaaaaaaagaaaaaaagagaaaagaaaaaaaaaggaaaaagaaaaaaaaaaaaaaaaagcagagaaaaggagaaaaaaaaaagacaaaaaaaaaacaaaaaaaaaaaaaaaaaaaagaaaaaaagaaaaaggaaaaacacaagaaagaaaaaacaaaaacaaaagaaagaaagaaaaag

SEQ ID NO: 17361 - DNA, 531 bp, Oryza sativa
tttcttgcgccgttttctaaaaccattttttaagaaacggagcgtttttctaccagttttttttcctcgcatgtcttttttttaaaaaaattaccgacgatggaaatattttttctcgtgtgtttttttattttttttatggaagatggaaaacctttttagcgtgtttttttcgcttttttctgacttttttctcacgcgtttttttaatcgtttttattttctcgtgtattttctctttttaaatagttagattatattagagatagagaagagatatctattgattagaaatcagactttgtttcgttgtttccatttttttctcgtgtacattttttattttgtatgaaccaactttttattttttacgaaccatttttttcgccactttcttagggatcggatgaacttttttaagatgttttttcagtttttttcgcctttataggaatcagactttttttttcccgtttttaaaggaatcgaatctagtgtatttttcaccactttttttttgccttctatagg

SEQ ID NO: 17362 - DNA, 1501 bp, Oryza sativa
tacattaatcggagaaaaagaaaaagtagagtccatatagaaatacaatttagaaatagctgaaattcggaattaaaaaataaggaatattagaatagtagactagagtccatatagaaatacaatttagaaatagttgaaattcggaattaaaaaataaggaatattagaagaggagactagaatccatatagaaatacaattaggaaataactgaaattcggaattaaaaataaggaatattaaaagtagagtatagagtccatatagaaatacaattaggaattaactgaaattcggaattaaaaataaagaatattaaaagtagagtatagagttcggaattaaaaataaggaatattaaaagtagagtatagagttcggaattaaaaataaggaatattaaaagtagagtatagagtccatatagaaatataattaggaaataactgaaatttgtaattaaaaataaggaatattacaagtagagtatagagtccatatagaaatacaattagaaaataatagaaatttagaattaaaagtaaggaatattagaagtagagtatatagttcatatagaaatacaattaagaaaaaaaatagaaattcgtaattaaaaaataaggaatattagaagtagagtatagtgtccatataggaatttaaaactaacgaaaatttggaataaacacaataaaattaaaagtagagtttagagtccgtataaaaatataatttacaaataaataaaattcaaaattaagaaaaatatgggaagaaaagtttaaagtaaatataggaatacaatttagaagtaactgaaattcgaaattaaaaattaaataatactgaaagatgagtttagagtccacatagaaatacaattagaaataataaaaattcagaaataaaaataaataatattggaaaaagagcatagagtctatatagaaatacaatattaagaaaattcggaattaaaaaaatattaaaagacgagtaatataggaatatatatatatatatatatatatatatatatatatatatatatatatatatatatatatataatttacaaataactaaaatttgatattaaaaataattaataactaacatgtatataaaatacaatatgaatattacacattagtagttttgtaaagttattgcaaaatttaaaattatgttgtcattttaatatatttgaataatataatgagaaaacatatatgctattatatgagagaaaatataatgacgctaccatgctagtttcttatattgtatttattatccgttatttaaaagtaaatgtaaaaaacaaaactacgatgaaaaaccctcgaaatcaactctaaagtcaattaccaaaaatcaaattttggttacgaccggtaagaaaacaagagttctcaaactgaatttattcaaactttttcttctccttgtatctcgaataatttccaggtttccactcttgcttcgatgcagt

SEQ ID NO: 17363 - DNA, 1120 bp, Oryza sativa
ttgaatcggacggccatatttaggtgtttttcgcaaatttttaatttgtccgccacattttatcagccttatacaggaaccgtaccctttttaggggaaactgatctacggtttattttctgttttttcgccacttttgaatcggacatttttttagttgtttttttcgctattttttctcagactttttgttttttttcctttttaagtgatcggatttttttgccaggggaatcggacttttatttttattttttttcgttttttattttaacggtattttttctcggacttttttggttttcctttttaagtgataggatatttttttccaaggggaatcggaccttctttttttcgctttttttatttaaacggatgaaggaaatgtttctattttttaagtagtagggaagagatagagatttcggattttatttttttatttcgaatattaattaatctcacttttttggttttcctttttaagtgatcagatctttttttttccaaggggaatcagactttcttttttttcacttttttcatttaaacggatgaaggaaatatttctattttttaagtagtagagaagggatagagatttcggattttatttttttatttcgaatattaattaatctcacattgggttattatatggactcttctttcaatattgcttaattttaattccgaattttagttatttttaaattgtatttctacttggactctctttttctttttctccgattaatatgggaatttctagcccccacagcgaatgtggtgcctcctttcaaagctgttttaataatataatagatagatagatatccttgggaaaatactatgcatccgataattgattacgatatttgtaagatctagcgccgtgccattcagctaggagtggaatatgtttttttatcggacaggaacatgcagccattaacagagacgtttgatcgtaaaactatcgtaagcaaaacatcgtgtgtgtatagcagttctcgttatggttgaccatggtaattaatacacactatatatactggtttggtggcaattaagcatgttggatgagtgattaattaacactttctctcatggaagc

SEQ ID NO: 17364 - DNA, 1501 bp, Oryza sativa
gagggatcacagacgtgactacacagctagtggtagctgatttgtctaaactaactaccactccatctataagagatcctatccacctatacttcaaataaaattttctcttaaactactcatccgatctacgatccgattacaccgttgtgttcgtaacaattaaatatttataacaagatcttacatgattatattttgatgaaaaattataaattacttttagatttcactaaattacttcttagacatataaaagtaaattcaatatagcctaaaattaatttacatatattaagtaacttataaaaaaagaaagtaactttaatgcatgcctttttttcattagccgtgactacacaactagtggtagttggtttgtactccatctagtgtctcctttcatattatttttaagatctatttgtatcattgtacttcactcaaaatatgtgacaaaacgagattcatattgaatatattctaacattttattaatttaaaagtaatttattacatgttatagaaagtaacttccaagttatcaggaagtagctattacatcttatacatggttaattctcattatttattccatcaatgttatttgcaatccatcaaaggttttatcttcttttctcattctacacgaaaaacaaaaatgaaaggagaaaaacaattggtaattaaacagatttatagagagttacttctgaaccatgcaaaagttccttccaattaacattgaagttacttttaaaaattgttaaacttatgtgtgttaatctgtgctgattaaatttaatttctagataaagtcatatttttatccctacaacgaatttacttctaatgtcgtgacaaagttacttccgttttgttttaagatacttttataatatatgtaaattacttttagactttattgaatttacttttatatgtcgaagaagtaatttagtgaaatctaaaagtaacttacgtatataataaaaataatttataaatataaacatttgttcatcgtaatataattatgtaagatattgttttgaagatttaattctaacgaacacaatagtgtaatcggattgtagatcggataagtaatttgagagaaaactttataagaagggaaaagagaggttactttttttcatttttcccttaaaaaataggctttcttggaaataggaatcatggaataatcctgaattctaatgtttatttctatagtataagaaaaactaattgaatcaaattcatggatttaccacgacctcggctgtgaccccatagataaaaatgcaaaatttctatcttcgagaccattgaaaaaagacattgaacgagaaaaaatcgtcggaaaaaaaaagacatgcatgtctacattgaaaaaaagcatgcacgtgtagtagtactttttctcacaactagatggtcgctgattaacactaaatcaagaggcttctcggtttagattttgccgggggatcaccca

SEQ ID NO: 17365 - DNA, 1501 bp, Oryza sativa
gtcgaaaacagttgttttcgctttattttcctttcacaaatcatgttatcaatttcatggcaatgtggcgctcatgtctccacatgccgcatctcaattaccttcccaaaggtaattgcccaagcatttagcatttgataaatatgagtatgcatgatcctagaatagcatttctaagcaattgtcataattgactagggactcatacgtaaacatggttacgaaggaataacggataaacaataatcaaggcatggcataatcacaagtaggatgttcatcattgcatgcaattttatttataaacaaaataatttcgcaattaggatcaacatgttcaaggaatagtgatgacttgccttgctcaaggtcttgggggtcttggccttcacttggatctgcaactccctcgggctcaaggtcgattcttttatattaactttactattcgcgtactagggcaaacccaatttcgatttatatatcctaaactattttgtgggtataaatattttgttatcataagtttttaatttaatctacccgatcgttatatccatataataggttggaaatttctatcgcaagctaaatatcggacggaatccaaaaattatcttataatattatacgatttaattttagtctaggactaaacgactaaatataatatacgtctaaaattcctagtgattaagtctgaatttctaccgtgaatcaattacttatagagattacccaaaataatctataacagtctataagaattcatctaatcgtttagttcttaattacatttaaactactaccgcgaattgatttcttgtagaaattaccaagaataatccataatttatattaaatttcacaattctacgactataactaatctataactaaattctaattattttaaattttctaaacttccctaatctccctctaatttcctatttatttcccttttctttttcttcccttctttttctttttccttcctttctttttcttttcttttttttttctttctctctctcctttattttctttttccttctctctctcccttttcttttctttttccttctctctctccctcccagtttctctcctccttccttctttctctccctcggcttctcccttcctccctctctctcggctctctctctacccggcggcacagcgacaaacagggggggaaggtagcggctcaccgacggcggcggcgacgacgacggcgcacggcgcggcacacacggcggcttcgtggcggcggcgcggcggctcgaagacggcggcgcggcggcacgacgacggcgacgcgtggagaaggggagggaaaagggagaggaggaggggatggagtggggagaggggagaatgttgggcttttataggggaaagagaggataagggggagagggaagagaagggaagggcggtggaggggggtgaggcgacggcggcgatgtgacggcgcgcggcgcgcgggcggaga

SEQ ID NO: 17366 - DNA, 971 bp, Oryza sativa
ggtaaaaaaaaaagccgaccgtaaataaaataaataaatcgccgactgcaaaaaaaaaaaaagccatccggaaaaacagatttggtatatgtccgtctcttttatccttcttttttttcccatttttctttttttccatctgctttttttcgttcttttttccatccatctttttttcgccgttctttccggttattttgccatcgcctttttatttttattcttttttcccgtccctattttttattcatattttttttggcacgcggaagggtgtgcgcacttgcttagaattcttttttttcatctactcggttttccatcggtgggccgaaccctaacaccacccgcacatcgatcaaccttctcatgctttccgtcctccaatttattataaaaatcaattctccactacccatcatcattttccacatattttttcttttcagctccgctttaattcaccatattcatattcaatctctatttagaagtcaccgtttatatcccacagttttgtggattcgctccaattttgataaaaatgaaaagaggagatcgagtgatccaaaagccctcaaccaattttaggagatcaagaaagatttgaccggatttgataggaggatcggtcctagcatcatactacacggactgtattccggaggttgaagatggcattcaactatgcgagctaggcctacattctacttgtagagtaggttcaagagaagcaggctaagcacagggaggcggtgggctagaccgagactgaaaaggaaggagcaacttgtgtttttgaccgaaaataaagagtataatgtttttctagtcgaattaaaaattcaaaagcttcgagttcgaggcctctacgtgggcctgcggcccaaccaggcccgtcgtccatcccctctccatcagtcattccaaggtcaacccaaaccctacctggtccgcgagtgcggtggcga

SEQ ID NO: 17367 - DNA, 1501 bp, Oryza sativa
aatcaattcttgcaatttttttcaaaaattgatttttgcatttttaggtgtcaaaataaacaaaacccatcctagtggatttgtgtggtaaggaaaaacgggtaatctattccttaaaaaaaatcttggagattatgtaatgcttactctcaaactttttgtttatacagtagtgatattctttgtttccctctttatctttggattcttatctaatgatccaggacgtaatcctgggcgtgacgagtaaaaatccaaaattttttcttacaaattggatttgtttcatacatttatctacgagaaaatccgggggtcagaattccttccaattcgaaagtcccaaacgatccgagggggcggaaagagagggattcgaaccctcggtacaaaaaaattgtacaacggattagcaatccgccgctttagtccactcagccatctctccccgttccaaatcgaaaggtttccgtgatatgacagaggcaagaaataacgattgcaaaaaatccttcctttttctttcaaaagttcaaaaaaattatattgccaattccattttagttatattcttttttcttaatgttaataaaaaaaagaagaaaattcttcttttttctttctaattctaaaattggatattggctaaaagacaatcagatagattttctcttcagcaggcatttccatataggacttgttataataaaacaagcaggttatagaaaaaaactctttttttattatttatcaacaaagcaaaaaggggtcttatcaaaccaacccaccccataaaattggaaagaaagataaagtaagtggacctgactccttgaatgaggcctctatccgctattctgatatataaattcgatgtagatgaaattgtataagtggatttttttgtatttccttagacttagaccacgcaaggcaagaatttctcgctatttactatttcatattcttgttactagatgttctataggaataagaagaaatcgcaacccctttccgctacacataaaaatggatttcgaaagtcaatttttcttttcaatatctttactttttttcagaatcctatttttgttcttatacccatgcaatagagagcgagtgggaaaagagaggttactttttttcatttttcccttaaaaaataggctttcttggaaataggaatcatggaataatcctgaattccaatgtttatttctatagtataagaaaaactaattgaatcaaattcatggatttaccacgacctcggctgtgaccccatagataaaaatgcaaaatttctatcttcgagaccattgaaaaaaggcattgaacgagaaaaaatcgtccacagataatctatcgtatgccttggaagtgatataaggtgctcggaaatggttgaagtaattgaataggaggatcactatgactatagcccttggtagagttactaaagaagaaaatgatttgtttgatattatggacgactggttac

SEQ ID NO: 17368 - DNA, 1501 bp, Oryza sativa
tctttacctattataaaagtttaagatgtttttgtccagaaaatttcgtacgtcactcgcctgatttttctccctcgcgcgttccgtccaatttttttttcacacgtggtttttttctccggtttttttccgcccgatcttttttggtcgtgacttttagatccgttttttccatcgcctgttgcacacgttttttttcttttttttttcaatccgaatatcttagatccgtttttttcctttttttccatcgttgctttttttttgtcaatttggatatcttttctgccacggtttttctattgcgcatgtgtaaggcttccgagcttttatccacctggtttatttttttttgtcatctggcagaaccctagcatagtcccacatcaatctgccccaccacgtcaatatgcctttttccccttctgccttatcatttttgccatgattttcagttccaagtaggctttaattcgtcagatttagtctccatttaacaattactgatgatggctggccaacgagttttccaagctgttttaaaaccctcaatcaattctgatggctccagaatgtggagtacaggccatcttacgaaggttaaagatcacatttgattgtgtgagccaagtttgggaggtcgacaaagactcggctgtatttgatgggtaggatgccttcggcatctataggcatgataccgtctttcggaggttgaagattgcatttgattgtgcgagctgggtttacagctacacttataagctaggccaaagagaggctggccgagcggaaagagacaacaaccagagctaaaactgaaaaggaagaaagggatggattttcggcccagaaccaacgaagaagtataatgcacagtgataaaaacgtctttaattacccgttgcaacgcacgggcattttttttctagtatagataaaatgaaaaactaattgcacggttaagggggaaatcgcgagacgaatcttttgagcctaattagtccatgattagccataagtgctaccgtaacccacctgtgctaatgatggattaattaggctcaaaagattcgtctcgtggtttccaggcaagttatgaaattagttttttttattcgtgttcgaaaataccttccaacatccggtcaaacatccgacgttttcgcaaactacacaggctattaggagattgacttcgcatgatctgacggctatgaagcgaccagcactgcgatgcggccacaaccccccgtcccactcccatagcccgagtcggaccctcgagtccggctcgaccgaaactgcagcgagactccgacccggaccccctccactcttcttcttgcgcaataagaagaagccgccgtcgcgtgcgtctattttctatttttggtttattttgcctccccaaccaagcacaaacacaagcctcgccgtattctctcggagcaaagcgaacgcgaaaccccacccgcggcggcgagaaatccggcgacga

SEQ ID NO: 17369 - DNA, 1501 bp, Oryza sativa
tgataataaatattttttatttgtaccattaagctacttctccttctagttggttaatgatgtctattacatatgagtaaataaagacaatagatatataaatcctagagattgtttctttaaaatacctagtcaagatgagtcctaaaatttgaatttaaaatcaacaaatataacttttaaaccaactacacactgctaccttagtgtagcttatatatcacaaatactatgtgaagaaactcataactgctatactcctacctttattctccaacgtgagcccctttgtatttggccatggtttactttccctgcttgcttgcttctgcagttgttattagcttttcatttgtttcatcttatttctcctgttacctcaccttcacacatagtctcgcccttggacactccaggagatcttgcgatatgaatcaagagtaaacaccctatatacccctgaaaactcactcaatcccttttataaccctgaatactcactcataactataatagtcttatgcgacaaacttttacattttgaataatgtaattcatgaatttctatgttcatccaaagtgtaaaatgatcatctttatagaaattagacggtcactaacggtcaactgacggaaggggtatttatggaagggattaaaattaaattttgggttatacaaaaagtaagcaaattaaatttaggggcatagaaaagattaactaaaataaattttagaggtacagaagcgattttctcgtaaatcaaaagagcaactgctcacgggggagagaagataatatatatttaaggtcagcgaagctaaccaagctggtctccttccaaccaaagattaatcaatttgaaaaccacatacaacctaggtgctaatgctggtgtttgagtctcgtgaatatgagtagagatgagatttccacaacaatgcaaccagccatgtcagctatggtgacaaggaaatagatttactggtagagaaaaagaggaactctaggtgattttgtgaacaacgtacactactaggaaaaaaacatttttccgtgcggtcaaaataattttcccatgtggaggatttgcccgtctgcacccaagcgtatggaaaaatcaatattttcgcgtgtggacgtcacaaccacacgggataatcattttcccatgcggtcgggttaagtggaccgcacgggataatcgattatcccgtgcggtcaaattataccgcccatacggaacaaaaaaaaaaccaaaaatataaaaaaaaagcgaaaatcgccgcccgcccgccggcccgcacgcaaccagccgctgcggcgagtctttcctcgccaccggcaggtcggcggcaaggtcaccgccgccgtggtgcacgacgtcatcgacgtcctacagctggtcctgccccatgcgctccgcagccgcgcagtcccgctccagccgatagccgcagccgcaaccgctgccaccaccacctcctcctcctcctccct

SEQ ID NO: 17370 - DNA, 1501 bp, Oryza sativa
ggtgaaccatctatgcagggatactgcctccacttggctatctaatctgctaggtctatacccattcgagaagtacggttgtacggggggtcgtttcatgcttaacttcatggctcggtccttaattgactagggacggtactagccttttccagataccacccaaatcctccgtccgccccagtcgaaaacagttgttttaattttatttctcctttcacaaatcatgtcatcaacatcatggcaatgtggcgctcatgtctccacatgccgcatctcaattaccttcccgaaggtaattgcccaagcatatagcatttgataaatatgagtatgcatgattctacaatagcatttctaagcaattgtcatagttgactagggactcatacgtaagcatggttacaaagatttaagggtaaacaataatcaaggcatggcataatcacaagtaggatgttcattatttcatgcaatttttatttgtaaacaaaacaatttcgtaattaggatcaacatgttcgaggaatagtgatgacttgccttgctcagagtcttgcaggtctcggccttcgcttggatccgcaactccctcgggctctatagttacgtgcaaaaattgatttgaattcggttagaattcaaataaaaatccaaataaatccaaatgaaagtcgaatgtgaaagtcgattcctttttattaactttactatctgcgaactacggcaaacccaattcgacttaaactattttgcgggcataaatattttgttgtcataagtttttaatttactcttcccgagcattatatccatataatagggtagaaatttctattaagagctaaatatcggaggaaatcctagaaatattatacaatttaatttattctatgactaaacgattaaatataatatgcggctaagattcttagtaattaaattcgaatttctaccgtgaaccgatgacttatagagattaccaaaaataatctataataatctataagaattcatctaattgtttagttattaattatatctaaattactaccaattttaatctaatctgatcaagaaacatattttataattaactcggaatttcgatcgaaatactattacgctcgaggaatttccaaaaataatctatgattaaccccgaccatttttatttcctaaatcctcctaatttctcccccaatttcccttctattttctccttttcttcttttctattttcccaatttttctctcctctttttctttttctctcttttctctccctctctttctttttctctcttttctctccctctctttctttttctctgccggcctctcttttctttttcttttctttttttttccttctcttctctcctcccggctcctttctttcttcccttctcttcctctatcctctttcggctccttctcctcctctctctcgtcctgcctaccgcgaccggctgaggaaaggaaaaaggcggcggcggca

SEQ ID NO: 17371 - DNA, 1501 bp, Oryza sativa
ctgcaggcgctgttcatcgtcgtcatagcacgtcgctctccgaacgctgactatagcaggccaaacgggcggcccggcccagcacggcacggcatgccgacggcacggcccactagggcacagcccgttaggcacggctcctgtagcgggccgtgccgtgccggcccacgtgccaaggccacggcccaagcacggcccaagaaggtgctgggccgtgccgggccggcacggctactgtagtggcacgtgggctggtagccggcccactagtacatgtggcccataaaaattgaaatttgaggggaaaaaaagaaaaaaggcagaaaaaacataatataaaggaaaaaatgataaatataggataaatgtgaggaaaatttaggaaatatatcataaaatatatggtacaaataggataaaatgtggaaaaaaaataaaaaatatgagaaatatatgggaaaaattagaaaatcgtaggaaaaataaatgggccggtgggccgtgccatgcctgggccgtgccgtgccggcatgctacagtaaacgtgccgtgccgtgccagcccacgggctgaggcatcggcccaaacacggcacgggataacgggccgtgccggcacggcccacaggctggcgtgccgtgccgggcatgggccggctacagtactgccgtgctcgggccggcccggcttggcacggcccatttggccaggtctaacgctgacgtataacgaattgatcgatctcctagaaaaattgatcaatcaaagaagtgtacaggacatcaacgcaaattaattgacttttttttaaaaaaaacgaaggaatgcggtgtgtgttatactctagttagtcatatgatccagattacggcataaacgttttcttggaagcaagctaatcctgccattgcattaaaaaaaatcctgagaatacaaatcaaagaaactcggggttgaccaaaagaaagaaggaacaacagtgaggagaaatggtatatgctcaatttattctatatactcagaatatataactttgacaattactattatatacatgctccttacaatcataaataaatatctggtgcttaggataggaaatttggtcaaacttgggaagttccaaccatcaataatcacaaatatttagttcttctgaaaaaaatagttatatgatttatctcgaaagtattatcataatatgtcataaagttgttgcaaataaaattgattgtcgaaattttttaattttgacttaatcttttcataagcgtcaaatatttataactagaaagtattacgctgttttttttctgaagtaaagcatcattattagtagtagtacggtagtactagtgtttatccttagctcgcaaataaactcacgtacaaccgcaacgatggccacggcagctacgacgacgacgggcggcgatgtccagataccgattggacagcaggccaccgtcgccgccaccgccactgccacgagcgatgggat

SEQ ID NO: 17372 - DNA, 1501 bp, Oryza sativa
tttgaagaaatatttgtggctaatagggaattaatttggaagagaggaataaaataaaaatctattcttcttagcacaagagaaatcattctgatatttataatactgttattcttgaaccgaggaggaaattaagccacataaattaaattggcgactagataaaaaggaggaatttggataaggataggtttagaatcaaaggatgggtcaacaattaattcaaaattggaattggaggattttcttggaccataattcataaaagtagaaagggttttcaaactaaatttcaataaaagaattttagtcgaaagaaggtttaatgtaggattccatcaagaaatacctcaatttaaccaaatatatttctctactgcttaaaaaaaataagagatgctttcttcatcgtcgaaacaaaaataatagcgaaaaaaaataaaaaaagtccgactcccgtcaaaacaaaaacaatagcgaaaaataaaaaataaaaaagtccgactcctatatccattcccttttagaaacgaaaaaaagtccgactctggattggtgaaaaaaattgatgagccgaactgaaaatctgtttaaaaaatagaacctacaggtcgagatcatttcatttttatatgattttaatttttgggtttgtacttttgcatttgagtctctataatttttatatttacatttgagtccctataatcttgcaataaggtatttgaggtcgtttttgttaaaaaaataataaaagagagaaaataaaggcagaaaggtgcataaaaagaaaaagaaaagccgcacaaaaaagaaaataaagaaaaacaacgataacaaaagtttttttcccctaagtggccaaaaaaactgtagatccaaataaaaaaaaatctgattcatataaaaggcaaaaaaaagtggtgaaaaaaaaggctagaaccgattcctttaaaaacaggaaaaaaaagtctaattcctataaaggcgaaaaaaatccgaaaaaacatctaaaaaagttcgtccgattccctaagaaagtggcgaaaaaaatggttcttaaaaaataaaaaactggttcatataaaataaaaaatgcacgcgaaaaaaaatttggaaagggcggaaaaaatcctatttctaacaagtatatatctcttctctatctctaatctaatctaactattaaaaaaagagaaaatacacgagaaaaaaaggttaaaaaaacgcgtgaggcaaaagtcagaaaaagctcaaaaaaacacgctaaaaaggttttccatcttcaataaaaaaataaaaaaacacgcgagaaaaattatttccatcgtcggtaaaaaaattttaaaaaaacatgcgaggaaaaactgtcagaaaaaacatgccatttctaaaaaatggttttaaaaaaccacgcaagaaaaaataccgtctattaaaaaataaatcgctctaaaaaaactatcagaaaaaagctaaattgatggacacttgagtcgga

SEQ ID NO: 17373 - DNA, 1501 bp, Oryza sativa
atctcggtgctggatttatcgagaagctcgcaacccaaaattccataggagatctgttttacaaggcattaggatgggaatcggaaccactgcaccttcttccatctgcagacttaattgtcaacgtaagcccttcaccggacttcaaatatgctcatggcatcagccagtggtggcagcctgagctgaacttgcagtgcagtaaatatcggtactctgtaggtgcatgacattggaaaaaatgtcttaggagacccttcttacactttcgtttattcattgtggttcgttccactctattgtagctgtcaatatgctgtaatagatgtttcttgaacctctgattctgttgacatgaaaaaaacttgtaatttcgtggagcaacgatctgtcagtctttacacatatgttcgtgttcatgtagctcttcgttatttgatcattttctggtgttgggtgagcatacctctctcttatgctcataaattgtttttttttcctacttggtttgaaccatattaactgttttaaatatataatgtcattaatgtagaactcgcggctaagcttttctttaaaagccaaagctacttttgaattttaaagttgatttttaagaataatcctaagtagattttttacatggtctgataacaatcatgaaaaaagggtaggcaattgaagtggcgaagagaatctactatagttaattctaaattcaaaatcagtgcagcttctaacagtatattggaaatctccttataggaagcttcatgaaatattatccctatatttcctttgctttccaagagaaagaaaattaaagaagtggaaggggtcggagcttcttatatttggtattcggggaggatgggagaagtaggttcgagatggtttttttaagagtaaattttagaaaactgcaactttagtgacaaaactatcagtttgctgtaacattagcgacatgtttaagtttgttgcaataatagcgtgagaaattatcataaaactataacttttacattatatgctactacagtacatataggtgacaactgtagcagcatataacgtaaaagttgcagttttttgataattttccacgctattgttgtagtaaactaaaatataccgctaatgttacagcaaactaatagtttgtcactaaagttatagttttctaaaatttactcttttttttaatggatcttgttaaaaatgcagaagggagaaaagggaaaaaagaagggagaaaaagaataatatggaaaaaaaaagttgttaaaaatgacgaaaaatagggaaaatagaaaaaacacatgagattttttttctggggggatcggaaaagcatatggaaaatttgggaaaaacaggaataacaggggtaaaaaaaaaggaaaactacggtgaaaaaaaaaggtgggctggtctgcctgggctatgccaaacggaccttgcaggcacggtccacacgccgacgtgccgtgtttgggcc

SEQ ID NO: 17374 - DNA, 1501 bp, Oryza sativa
cctccttcttgcgcccaatcccatcgccgcctcctcccgatccctctttttttcgtttttcttcccgtcgccgatcccttcccctcctcccgatccccctcttttttcatttttcttcccgtcgccgccgcctcctgatcccttctcccgatccctctttttttttctttttttcttttcttttttcttttttcttttttttttctattctctccctcccgatccctcttttttcgtttttcttttttgttttttttctcttctctccctttgctgcaccttggaaagaaaactaataattaaaatgacaaacaagatttgaacccatgatcccatgtttcatagcaatctctcctagccaatttttcctatgacactgtgattaaaaataattgtttgcttgctttgtatgaatgtccaaattttatgataacaaattatttagttatgttattgcaagaatcatacctttttactatgatttggcagtaacattacaatagaaggataataacacgatacgttactgcaaaatttataggttgtttggcactaacaacatggcgaattttgtagtaacagaagaatatggagtaaagtgtattggcagtccttaatcttaatcttgtagggttgtgttatataagtccctaaactctcaaaatacatatccagatcccagaacttgtcaaagtgtatcatctaggtcctaaatcgacacatcccctctaggatcctgcgtggcgctgatgtggcataccacatggacgtgacgtgtccttttctttttttcttcttttatttttctttttcttttccgttttcttctcattcttcttttttttcctttctttgctcagttcacatagaaaggagaatgaagaggaaaaagagaaaaaaaggaaaaaaaaataaatgggttccatttgtcagtcaaaataataccacgtcatatccatgtggcataccacatcaacgccaagtaggatcctgaaggggttatggtgaattgggacctaaatgacacactatgacatgttttgggacttggatatgcattttgagagtttaaagacctagatgacacactcctgcaagtttatggaccgccggtatactttactcgaagaatatgcatagtaacagtggtactatactatagtttgtaaagctaaaatattttaaatctaaatctttagagagtagtaacgtatacgtcatgtcttatttttctaacctatttgcatcatggcgttcgtaaaaaaaaatgcttaacgaaactagaactatcataactacttttcaacgtcattactgcagaaagcagtcgtgttactacacattggccgttgcgttactacgacgttccagtgagacaaggactaaaaagagataaatctcaatctttagagagcaatatctctcacatcatatcttgtttttctaatccgtttgcaccatgacgttcataaaaaaacgcttaacaaaactatatccatca

SEQ ID NO: 17375 - DNA, 1501 bp, Oryza sativa
tcctagaatgacttatattgtgaaacggagggagtaaaatttaaatttttaaccttaaatttgaagctgattttgaggtcttttcatcgaagtttattttttagcttttacttttagattgctaagaacacggatataaaagttttacttataaattacatttcgttcacaaatataccgtttcgcttatgatggctccgctacttcctttcaaccacctcccggttgctctcattccccaatggcctccctctctaatctcgatcctgtggccggcgatcctgcgagcagttgtttgatgcaatgcaacgagaaccaaatagattcaggcttggttcactgtgagatgttgggctcaccgatctgcccagattgatgaacactatgcaggtattcaggaagcgactgtcatgtacatgggctgggctggctctaggcccaaccaaacagcaaggaggagtataaaaccaagccacactgcagttcttgggggtattgatgaacagatattcaacttgtggctttgccatggctctcttcctcctccaactctacctcctctgattctatttctctaattccaatctcatgcttctgccttccctatattactcttcccaatccctgattctactctcttgattgtattcctgagcacttgtattcttgagtggatttgcaacatatcggtggcacttgtgtgagaaatttggtgtgattgtgttggttcgtgatagcgacctagaagtgcacttgctgagttttcatatatgagcaatcagaagttagatctattttttcctctcgctctctcttttttttttcaagtgaaacacgacgatacgatgtaaattgaacaaccttagcacatatggcttacaatgtttactccaaacacaaatataaccagagtgccccggtcgtgttaaacttcaacacattcttcaaagaaaaacagaacaaggcttgcattgaaatttcccctgaactcacgagtggtcgctactggtacatggcagaaagctcgggcggattaccggcgcattgtgctcaccgaggtaggggtgaaaacggtatggaaatatccaagaattccggctaccgtttccggtttgcaccgaccgtttcagtcggtatcggaaattgtcggtgtcggaaatgaaaacggtaatctcttccggaaatgttagcggaaatgatatgggcttttttccgaccgttttgtcggtaaccgttttttatcggtaatttccgtcaaatttccgacaaaattccgaagaaggaagccgtgttctcgaagactcaaatctatatctaaaaaaagtcggacaatattagttatgctgtaatcctatcatgtaacccacattgtatgctttagccacattgatgttgaagtatcgttgaactttgtttatattgtttgtcgaccttattgtcaacttattaatcatcatataacggtgttgtggggtgtggcagcgtgatcatgcaaaggtga

SEQ ID NO: 17376 - DNA, 1501 bp, Oryza sativa
taagagcatctccaagggtgtgttcgctccctagtacgtaaaacgaaacaacatttagtacctaattaattaattattagctaaaataaattttaaaaagattaatatgattttttaaagtaactttcatatagaaagttttcgttaaaaaaaacactgtttagtagtttgaaatacatgtacacagaaaacgagggaggtgagttgggaaagtagagataaaaactcggtccaagagtcttttcaaatcttactctccatttgcttcctaaaaaaaatcctttttttttttactccaacaatcccttcatatcccactctccaaattatataggctctactccctccgtccaaaaataaaccaatcttgtacgggatatgacacattctagtacaacgactctagacataagggcatctaaatttatcgtactaggatgcaccatatctgaggttaatttattttaggatagaggagtacatgtcagtgtcttcctcctttttctctctctttaggcccatgtataatagttacaagcaagagagatgggagaaagatagacagaggatgcgggacccacgtttgacaagtggaggaggcgggctatattcggaaatatcggaaaaccagaaataggctatacagacataaacatattggtattgatcgaaagccgataataaatatcggaaacattggattgtaaaatcgcacaattaattttgcataactataatataacaaattcaaggttacactatgtataagttataagttgtcttcttttaaccttgaactatagttagggatttggttgagaagttgatgggctctaaactatgaatcaaataaagaaataggccataaatattagtgtatttagaaatacgataattatcataatataaaaaaggtaaaatcatttccatttccatgtgtttttttaccattttcatttctgttttcatcggtaatcatttccatgttgctcggctggtaaaaatcggaaatgaagcatcggtcgatcaagaattttcattaccatttttacccctaagcgtggctacgtggggattggtttggctagccgaatggcttggccatctggatagcaagtcctttagtggttttttttttggggtcaaattttaacatggagagctaaatagtcactcttttggagttgctctaacccctgaactccgttagtaaggtaaaatcctactcacaaccttaattcatgttggctcgtcatgcccttgcagtttgatcttcatcagatcatcgtgccacatgcatcacttgaggtctgtatcggacgtggaaattttcctgatttatgtaagaaattttcctgaaactcttacgcaaatttctgtaaaattcttgcatttaaaatgggatccaagtcctgttaacaaagcatcaatcatgtacaaagtaccaagtatttttacacaacaattggtccaattcaattaggaaattaccggcctcgga

SEQ ID NO: 17377 - DNA, 1501 bp, Oryza sativa
aactaattgcacagtttacacgtaaatcacgagacgaatcttttgaacctaattaggccatgattagccataagtgctacagtaacccacatgtactaacgacggctaaattaggctcaaaagattcgtgtcgtggtttctaggcgagttatgaaattaatttttttcattcgtgtccgaaaatctcttccgatatccgatcaaacgtccgatgtgacacccaaaaattttcatttcaccagctaaggccttgtttagttaccgaatttttttcccaaaaacgtcacatcaaatctttggacacatgcatggagtattaaatatagataaaataaaaaaaactaattgcacaatttgcatggaaatcacgagacgaatcttttgagcttaattagtccataattagccataagtgctacagtaacccacatgtgctaatgacgaattaattaggcttaataaattcgtctcgctgtttccaggcgagtcatgaaattagtattttaattcgtgtccgaaaacctcttccgacatccggtcaaacatccgatgtaacacccaatttttttttcgcaaactgaaaaaaaggcctaaacaggccctcaaatgaatcaacgagaaggcgagaaggcaacgtgcattcaagaatagtagtgtgaaggcaacgcgagtgttttacccctatgctgttaagaaattaagaaagttgctgcttacctgtgtgccataaaaaaatttggagttacttgtatgccatgagcccaactttcgttgacccgtgtgccattttggatggatggagacataatagatgtgttaggggctgtgtaaagacagctttggccttgtatacaataatgggtttaaaaaaatcaaaaaagtgaaaaataatttagaaaaggcgttaaaaatcaaaaaatggaaaataatttttttaaaaggtaaaaatcagaaaaagtgagaataaattttaaaattttttaaaaatccaggaaaaattaggaaaatgtgggaaaaattaggaaaatgtgggaaaaaaatagaaaatggtggaaaaaaaggaaaaatcagaaataaaatttaaaaaaaggaaaaaacaggtgcatgaacattacatactgacaaataacgacatatcacatagacaaaacaaatgcataaccattgcaccatagcaacaagtgcatatcaaaccatacaagtgcatatcaaaccatacatgaccgttcatccatagtaacaagttcatatcaaactaacaagtttatagcaacaagttcactagttttcatcacactaagtccacacataaaaagtactagttcactagttttcatcacaccaaaccatatatgtcttaaattacatcaaaagtagtagttcctccacataatttattcaagctgaagtttcttcttgcttctagtattagaagctaggctggatgggttggccactttaattggagccctccttggtgtacacttcttgacggcttact

SEQ ID NO: 17378 - DNA, 1197 bp, Oryza sativa
cagtgaagcaggacgggcggcgccggagcggacgacggccggcgactagagcaagctagcggcaagaagggcggcggagcaagctagcggccaggagccactctcctcctccttgtcggccgcgggcggggagatgttggtggcggcctcgacgaggagccgctctagttgacggtggccgcgaacggggagatgtcgatggcggcctcaatggggagccgctctggctgatgatggctgcgggcggggagggagatgtcggcggcgacctccgcgattgtggtcttccctcgccggatcttccgggacggcagcgacagtggcatgcgccatcgcagaggaggcgacgatggagatgaggaggcggatcttccgcccgccgcacgctgctccactccagccgcctgccgactgccgcccgtcgcccgctggtcctctcccgttgtcttccgcccaccgcacgccgcacgccggtccacttcggctgcctgccgctcctctcctgccgcccgccgcacgccgcttctctcacgccggcgtcattgaaggagaaataagtagagagggtgaggttgaagaagtgggacccactgacatgtgggccctttttctttttttaccgatatgtgggtcccacatattttgtttaatttttttattttcatttttgctgcctttatttttttatttaattgccacctaagcaccacgtcaatgacacgtaagccaaaggattagtcaaaggagccatgtaggcccccctttaggcaaaccggggcccaatccctctagggataaaatggaagggaaatttttctcccctttttggaaaaaaaggaaaaagaacaccccttgggaggggaaatttttggaaattttgggacggaaaaaaaaacgggatttttttccccggaaaaaaaaacaaattgggataaaggtttccgtgggaaacggataaatatttcggatatccccaaagccatgagacataccccatttcttttaattctagaaccttcaatatacatttatatatatttaatagtagtttatctcttaacactagtccatactattaatattatttaaattttaaaaaatatttataaattatacttcattttatataaaatgagctaattatatatgttggtatttgtttctattagaagttgagttggttttcgtgttccgaga

SEQ ID NO: 17379 - DNA, 1501 bp, Oryza sativa
aaaatcaagatccaacaaaaccagcactaaaccctcaaaataggaagacacctaaatcccacctctcagccctcaatcctagtgaatttgctaattagcgcgtacgcattggcagcacggacactgtcaacagtcacggcgctagtcctccccccttttttttttgggaaataggcactagtttctcttttttttcttggaaatcactcccttttttctccacacacacatgcaattttctttgcgatattttgtaaattgaatctttcaccttcaatatcagttgagagatttgaatttgagttgaaagtttttaaatttaagttgcatgttttaaatttggtatgaaagttttcaaatttaaatcgaatgttttgaattttgatgtgagagtttttaaatttgagttaaaagtttggtagcgctattccacgcgctacagcgcggaataataattcgagcgccgcacaccggcttcttctttcgggtttccccttttttaccaccccacctgtccttcgcatcccactttttctcgggttgtttttttcggtttttaccaccccaccttccgggtttcttttttctctttaccgtcttatctgtgcttcatcaatgggcccggtaaaatattaactatccagatttttctgttattcattccttctctaaagtttttctgttttcgcgttttagtaaaatatttactgtctaatttttctttccaagttttccgtttttctaatatctccgcacgtttcaaaagtaacgaatttactcatggagtttttcatttactcccagcctcccacatctgcttattctaaagtaacaaatttattcgcatgaatgtctctacatcgtatgatgccatacgtaaatggtcgtaaaagaattactaccagcttacaactctagtacttcttttaccaatattatttagatttcgtggtctgcgagtaaaacaattaccatcttcctctcgatatagccatgatctcatagccactgtgtagtaatatgtttactgatgtattcaatatatagtattagtgtaaaaactgatactaagagtattgttgatctgtatcacaaaatagtcgtatgaatgaaaaaattataggctcaatcacacacaagcgataaaattactcacaggtgaatcaaactagaaaagaaaaaaaatgattcagccaaaaatccatcatggaaggatgtagcggtgtagtatagagatgagcttgacgttgcgcaatagcagccatccatcatctaacaagcacaaaaaaatgcaaaaacattctcgttcatgtcaatacagatgacgagcaaaagaaaaatagcaaacaatctccatcaccggtggactccaccctatcctctacggccagccacatggagcacgatgtgcaaatgtaggacttgtgcaacccatcaattgagatcaggtgatattggagattgcatgttaatttgatttgcaaaaaaaattagggcttca

SEQ ID NO: 17380 - DNA, 1501 bp, Oryza sativa
cagtggaacgcataactatgctctatgttagtagtggaacgcataactatgctatatgttagtatgtccttgtttattttctttgattgaaactagaattgtgaccatggacattatattgtggactaatcatggacattatattgtggactgtttattttctttgattgaaactagaattgtaatcatggacattatattgtggactctattgttattgtgggctctattcattcacctacatgtgaatgtccttattctttcaaatttgagattgttgattgttgttgttgaattattatgctatgaattgttgaattgatttcaagtccataatatagaaaaggtcatgctgaatttttctattgtataaccacaagttttcaggtatcttatatatatatatatatatatattaaatttgtttggtgctccatggtgcccgggctccatgattcaaattgagtatatactcaattcaaatgagtttgaatttttcaaaaatgtttaggtattaacattaattactttactaactagttcaaaacaagtttaaactgaatttaaacatgtttttattagaatttgattctaggtatatagtatccaaatatataattagttaggtatgtaatattggactgtgaaataaagttaaatttgagttattttgttgctaggtataggtatgaatcgaatacttataactaggtatatactcacaatttgaaaattttgaaaaatttggatgaatttgtgtatttcataccatggtgcccgggcaccatggtgccccatataagtgtctctctgtgtgtgtatatatatatatatattgttattatccccaaattctacacacatcctgcattttctttttgcattttcttcactttgttcttctagctaatatctcgcggtaaccattcatataccgcggtaaccgcggccaaagagtgaaatttgaattcaaatgtttgaaaacaaattttgtgcggattttcgcggtaaccatcttcccgtgtggtgttggtatatacctggccaaatgggccgtgtcaagccgggccggcccgagcacggcagtactgtagccggcccaggcccggcacggcacgccagcctgtgggccgtgccggcacggcccgttatcccgtgccgtgtttgggccgatgcctcagcccgtgggctggcacggcacggcacgtttactgtagcgtgccggcacggcacggcccaggcatggcacggcccaccggcccatttatttttcctacgattttctaatttttcccatatatttctcatattttttattttttttccacattttatcctatttgtaccatatattttatgatatatttcctaaattttcctcacatttatcctatatttatcattttttcctttatattatgttttttctgcctttttttctttttttcccctcaaatttcaatttttatgggccacatgtactagtgggccggctactagc

SEQ ID NO: 17381 - DNA, 1501 bp, Oryza sativa
tgctcctgcgtggtcgtcgccgctgctgcatcgaagatcgctggccaccgccgccgaacctcctcttctcccggctcgccccgtcgacttcctccccaaccgccggctagcctgcctaccagatgaggagaaaactgatagaagaggaagggatagatgacgtggcatcctaacatgtggggctcacgtgggtcccacgcagactcggccaccatgtcggacaaaactggggttaaaactacgagggacctaaagcgaacgattttgttactcgagggatgcccggtatctggttttgcaattgggggacgattttgtatcttgatgacaagttgagggatcttggatgtactttttccgaaggaaaaagggccggctcggctacaggctgaggaaataaatgggctgaaaatggcccagagagaaagtatggttttcatttagattttcatttaaataaaaactgaaatgatgtctgtatggttaaaattagtaatggagctcagaaaattccgaaaaataaaatcagataatgtaattaatcatggagaatttaataaaaattagttccaatatttggaaaattttattacccatatttaccttgattttcatgatactttattttcttcaacatcgtatacatgtataattgcgatttcatatgtaatgggaatgaaataaaaataggaatataaatatatcttctttatatgaaggatggtgaaatttgtattttaattaattacataatgtaaatctttctcaactttttcttaatgttctcgtgttttatttccgttgtaacgcacggtttttttttttgtctagtaagctaaaagatcggttaaaagcctaaaataaagaggatctaaatgattacttctggtaactggtggtaccatcttaaagcatggtaagttaggcccatacatggtgatgcaggagtaggccaagcccaacgaccagagaggcaggcccaatagagtaatgtaggagtagtacagtacagtgccatccaatggcatggcggtttcaagttttgaaatttgaatgcattcctttcttcttcactctcctttctccttaatcatcctcgaatcgaatccttccttcctaccataccaataccaataccatgggttgcgctgcctccgcgttcgtggacgacgacgacgacgatgaccgccgccggcgcatcatcggcgtctccgcctcccacatcgtctccctcacctcctccacctacggcatcctcgacaacattctagtatcatcagctcaatcccaatcccaatcccaatcccctactaggattcctcctccgcccacgccgcctccccgacccaccaccaccaccaacccaccatgtgcagccccgccggagaagcatctgaagaagcagggcgaggcggaggtcatcaactcgtgggagctcatggccggtctcctcgaccccgccaccccacagaaaccacggaggcccacgcaccactctcct

SEQ ID NO: 17382 - DNA, 1501 bp, Oryza sativa
ttgaggcaatctttggtaatgtttagattgttgctttgccacatttcggtaagacaaaacttagtagagttaattttagaaataaaatgaacaaccgttcagtatcggaagcatcaatgttatttatcatcacatagtttggtaacagctatacagtggcataataaatgatatcttaagaaggccaaatgaacaaccctgcctaccaaggatatagtcccagtattagcatagcccattatggtacatactggtaggcacggtaaccgtgcaatgttggcccatgaaaattttggaaaagaaatatgaaaaatttatagggaacaaattaaaaaacatgggaaaaccgtttgtgtcagaaaaataaagaaaatagggaatatgaatatcgaatggaaaaataaagaaaaatagtgaaaatataggaaaatttcataaaatacatttatcgaatgttaaatagcaattccattaaacaaaagccctttgcatatttttaccccgtccagcctgcatggatcttaaagtccatccgaaaattcaacataatttctcctaagttttatgtcgaatattaatttgcaattccattaagcaaatgcatgcattctcgtatgcgtgtatatgcatgcacagacaactggcactagcttgataaacgacaataacttgtatagccgtgcttgtaactaagctgcgaatggaactttccaaaaaaaaaatagagatttttcttaaatgcagattattcacatcgccaatatgtgctcagatttttttcttttttttcattctatctttccattacgaaatttctttctttgtgaagattaagaaagaacccaaatggcttgaaataaattataattgttccgatgtaaccttctacatggtataagcataaccttaatgaattaactaacttctttgcgatctttgcgatctaaggtcaaaaatctagtttaaaatgaaaaattgcatagcacgcattcatcttccatatgacatcgaaaagatattcaccagctggctattaaacaagtagcactgctagaagagatgccatggctatttttaggcgggaaaactgaaacggaaatggattaacggaccctccacgcttcgcgcgcaaaagctgcgtgcgtccaaaatagcggccttcaaaaattcccaatcctttttttttttttttgataggaaaaaattcccaatccttcatcactcctcgcatgcatgcatgcatgcatgccctaatcctacgcgaccaagaaattattggcaaatcgatcaccgttgccatccaccattgccgtccccctctcctcctcctcctcgccttcctcttcctctctttgatctagcttagctccgcttgcttcaccagttcatcatcttcttcttcttcttctttgtctccctcgtttggtttgatctttcttggttgatccatccaatcccaccggcgagcgcggcggtgagctctaggcggcgcgggaggcca

SEQ ID NO: 17383 - DNA, 1501 bp, Oryza sativa
tctttaattgaggaatatttgaacttacaaaaagcttttttctagaaaaataatagcgcacacactcactccaacaagcgcacacatgcaaatcttgaagaattaaagtaagagaatttggattttaatttgatctatgaaattgagcttaaatttgaatttgagggaattttgcgagggcatttggaaaagattttgaactttaaattgggtttgacctatgtctttggagattgactcaaaagagttaaattggtgatatccggaccaaaacttggacaaacctaggacagagataagcctttcttttcaagagagaagattaagatttactcttgagaagatccgtggataatacaaaaagtcaaatatactccctgtcccataaaaaccaacctagtattgaatgtgccttgattcgttgtattaaaatatatcacatctagttttagattcactttttttttatggagggagtacgtaggtagtgccaagataaagggtttaattttagcatgcataacatgtatgcttgtatcaggaaatcatggtctcattatcaggaattttttcctcgcaggctataccaacaggtgcatcgcatcacatggtgttagttgaacaaaatgctttcaattaaccaaaatagatgcacagaacaacccactacgccaccataacagcaaaccaaaaccacacacaaattcctgtacttagaccgaaagatgctaccagtaaggaggtaagtttgtgatgggggaattttagtggaagcttgaatttgaagggtgcgtggtccaaggttaatcgagtgagagctcatttgggagccaagggaaaaagaccttgggaaaaattttggaaaacatgctatgggaaattttccatgtagccaaaaaacaaaaaaataaaaatcacataaaatctcgaaaaataagaaaaatcgcagaaaaaataaaaagggaaaatctagataaattgaaaaaaaacagcagaaaatctagaataaaaataaaaataaaaatattcaacaagaatatagaaaatacagtcatatgaaaatgatgtactttttacaagatcataaaagaaattgatctaaaaacatactgagatcgattcaaaaaaaaaaaacatactgagatcatgagatcacgagatcacgagctcatgatgagctttatgatgtaacaacactatatatcatcaaagtcgaagaagtatcaatgacatccatgcatcaacacatgcaaatactatagtatttcatacaaggttataatgtctagaacaagaacgaatgatgagtaatcaaataaatagggctgaagtctacagaccagactatagagaacccatgctagctagcgtttgcttatatcacgattggataaaagtatgtacaaaatctgccaaatgttctccaggtacaaaaacttgatgaaatgcatgtgtgccaaccatatccaataaggcatcttgaatctcccaatcatcctct

SEQ ID NO: 17384 - DNA, 1501 bp, Oryza sativa
aaatatagctagtcccatttagaaaagaaaaggagttagcaatatagtgccctttttcctataaaatatagctagtcccatttagaaaagaaaaggagttagcaatatagtgccctttttcctataaaatatagctagctagtcccaaatatagtgccctttttcctataaaatatagctagctagtcccatttagaatttagaaaagaaaaggagttggcaatatagtgtcatggctactcttcgtgggttcggagagagataccttatataccctcaatcccccgaaccctgccaacacccgtgtcccatttagaaaagaaaaggagttagcaatatagtgccctttttcctataaaatatagctagctagtcccatttagaatttagaaaagaaaagaaaagacccgtgtcctatttagaaaagaaaaggagttagcaatatagtgccctttttcctataaaatatagctagctagtcccatttagaatttagaaaagaaaagaaaagaaaagaaaaggagttggcaatatagtgccatggcttctatctctttgtgggttcggagagagataccttatatataccacacccgccccgtgtcctatttagaaaagaaaaggagttagcaatatagtgccctttttcctataaaatatagctagctagtcccatttagaatttagaaaagaaaagaaaagaaaagaaaaggagttggcaatatagtgccatggcttctatctttttatgggttcggagagaaataccttatatataccacacccatggcatctatctctttgtggattcggagagagataccttatatataccacacccgccccatgcagtgccatggcttctatcgtgggttaggagagagatatcttctataccgtcaatcccccaaaccctgccaactcctgccccctgcagctggggtgacaagctcacgccaccgagctcagtgggagcataatggtctaagactacgtagatttcccgtgtggtaccaaatttctcctgtgcgtaagacttgggttgcgcgtcttatatgggcttaaacacaggcttggcctgcaccacccaggcggtgtcgtgccgtgcttgggctgggccctgcttggcacggcccatttgcccagctatacaccatacgcacgtacagttccccgggcgacggcacagcacaatcgtgcgaggctcgcctaaaaaaaaaaggaaagaaaaaagaaaaccgtgcggcgccgctcgtccgcccgccgctagcgccgacgtcacctctctcggccactggtgctccggtgcgagctgctctgcgcggcgccgccacctgaatcggatcggaggggaggagatctcggccgagcagaagcggcggcggcggtgctcgcggaggagggagtagcagcagcagcagcatcgcaagagggggaggaacagccatggatcccgacgcggtgaagtcgacgctctccaacctggccttcggcaacgtca

SEQ ID NO: 17385 - DNA, 1501 bp, Oryza sativa
tatattcttatgatagttttatataataagacgttttgggattatcctatatagttggaatggagtatatcgttctctaaagtatttcttataatcaatacttcctaaaaatacgtttctagaagttgatttattatgggatgaagtgtgtactcagctaagtttttcatggacagtatactctttgcctaaaacagtacttcctttgtaaaaaaaaactcaatacaacgaatctaaagaatattttattcaaattcgttgtactaggataggagggtggcattctttctctttttaagttagatttttttattatgtactccctctatttcacaatataaatcattctagcatttcccacattcatattaatgttaatgaatctagatatatatatatcaatctagattcattaacatcaatataaatatgggaaatggtagaatgacttacattgtgaaatggagaaaatacttcatccatattttaatgtatgacgccgttgactttttaagcaacatttgaccattcgttttattcaaaatttttatgcaaatatgaaaatatttatgtcatacttaaaaaacatttcatatcaatcaagtcataataaaatatattataattatataaattttttaaataagacggatagtcaaacgttggaaaaaagtcaacggcgtcatatattttaatgtaaaaaaaaaaaaacttacttgctcctccttgtatagcaggccaaacgggcggcccggcccagcacggcacggcacgccgacggcacggcccactagggcacggcccgttaggcacggctcctgtagcgggccgtgccgtgccggcccacgtgccaaggccacggcccaagcacggcccaagaaggtgctgggccgtgccgggccggcacggctactgtagtggcacgtgggctggtagccggcccactagtacatgtggcccataaaaattgaaatttgaagggaaaaaaagaaaaaaggcagaaaaaacataatataaaggaaaaaaatgataaatataggataaatgtgaggaaaatttaggaaatatatcataaaatatatggtacaaataggataaaatgtggaaaaaaataaaaaatatgagaaatatatgggaaaaattagaaaatcgtaggaaaaataaatgggccggtgggccgtgccatgcctgggccgtgccgtgccggcacgctacagtaaacgtgccgtgccgtgccagcccacgggctgaggcatcggcccaaacacggcacaggataacgggccgtgccggcacggcccacaggctggcgtgccgtgccgggcctgggccggctacagtactgccgtgctcgggccggcccgtcttggcacggcccatttggccaggtctacctccttgcttctccttgcttcagagagccagagaggcagtagtgattagtgaacacccagaccagaaaggcggcgatttttgttggatgcaaaccgcaaatgaggag

SEQ ID NO: 17386 - DNA, 1501 bp, Oryza sativa
gaccgaggtagtcagttcacctcaaagttctggcagaagctgcaggaagaattggggacccgtttaaacttcagcacggcctatcacccgcaaactgatggtcagaccgagcgtgtcaatcaaatcttggaggatatgttgagagcttgcgctcttgattttggtggagcttgggacaaaagcttaccatatgcggaattctcgtacaacaacagctaccaggccagtctacagatggcaccgtttgaagctctatacggccggaagtgccgcacaccgcttttctgggatcagacaggcgaacgtcaactgttcggaacagaagtattagcggaagcagaagagaaagtcagaatcatcagggaaaggttgaggattgctcagtctcgacagaagagctacgcggataaccgccgaagggagctcacttttgaggcaggagattacgtgtatcttcgtgtcaccccgctccggggagtacaccgctttcagacaaaaggcaagttggcaccacgcttcgtgggaccatacaaaattttggaacgaagaggagaagttgcctatcaactagaacttccgtccaacatgatcggcatccatgacgtgttccacgtatcccaattaaagaagtgtttaagggtacctgaagaacaggctgattcggaacacattgatatccaggaggacctaacatatgtggagaagccggttcgtatacttgacactagcgaaaggagaaccagaaataaggtcaccaggttttgccgtgttcagtggagccatcattcagaagaggaagcaacctgggaaagggaagatgagttgaaagccgcccatccgcacctcttcaccagctcctccgaatctcggggccgagattccgtttaaggggggtaggtttgtcacaccccgaagttttcctccctagtcaaaattgcaatttataattgaccccaagaaaatgcagaggaaatcaggataaaaccctaagaaaacaatgcaaataataatcggatttgacatgtggaatttttcttgaattctacatgtcgaaattcattaacaggatttttagtggaattttcagagccctagaaataattttaaccaattaaaaatcactaaagtgcaattgttaattccagggaaaatcctttttctttttctttttcctttttccccttttttccctcctttttgtccaatgggccgtcggcccatttctctttttcctccccctcctctctgttgggccggcgcaggccgaggcccagcccgacagccggccgcccgcccgcctcctctcggggtcgccgacaggtggggcccacctgtcggacccgtctccctcctcccgccgatcccgctcgtgccgccgccgccgcaaccgacgccgcgcccacgtctccgccttccccgggccacgtcgaccacgcccgcgcgtgcgccgcattccccgcgcccgttcccctctctctcccactcgcgcccgcgcccgaga

SEQ ID NO: 17387 - DNA, 660 bp, Oryza sativa
tgtatcctttgcctcccctcagcctcaagccagcccaatcaacatagctcacttgacaggcccaggcccatgacattcctccctccatgaatttcggcttgtccccaagccgatacaacacagccaccaggatcccaagtcacccgcaccagtgatgttgtatacaatgccagtttatacctggccaaatgggtcgtgccaagccgggccggcccgagcacggaagtactgtagccggcccaggcccggcacggcacgccagcctgtgggccgtgccggcacggcccgttatcccgtgccgtgtttgggccgatgcctcagcccgtgggctagcacggcacggcacgtttactgtagcgtgccggcacggcacggcccaggcatggcacggcccaccggcccatttatttttcctacgattttctaatttttcccatatatttctcatattttttattttttttccacattttatcctatttgtaccatatattttatgatatatttcctaaattttcctcacatttatcctatatttatcattttttcctttatattatgttttttctgccttttttcttttttttccctcaaatttcaatttttatgggccacatgtactagtgggccggctaccagcccacgtgccactacagtagc

SEQ ID NO: 17388 - DNA, 747 bp, Oryza sativa
caaggggaatgggccggcggcccatccgaaaagaaaaaggaggaaaaagggagggaaaagaaaaagaaaaaggaaaaggattttccctggaattaaaaattgcactttagtgatttttaattggttaaaattatttctagagctctgaaaattccactaaaaatcctgttaatgaatttcgacatgtagaattcaagaaaaattccacatgtcaaatccgattattatttgcattgttttcttagggttttatcctgatttcctctgcattttcttggggtcatttgtaatttacaatttggcttgggaggaaaacttcggggtgtgacattatctccgccacttctcagtctggtgccccgcaatgaaccatgctatacaaaagataaagccgttgcccatgctggcttgtggttggcacgattaatgtttcacaatcgaaactcgtgaaccggtccttaattgtcatgagcacgaccatcaaaaccatgtgctcacaacccaccattatcaggttttagttggcacattaattaattaactaatcacgattgaccatcgtgaactatcattaagccatcattaaataatagtgagtcataagttatcccaatagtgagctaatgtttctaagcagggctaagcaattatatctaatatctagttgaaccaatataaataaagctcaactagtcaaattataacccaaggtatcaaggaataaagtaatcaagaacaaaagggcta

SEQ ID NO: 17389 - DNA, 1501 bp, Oryza sativa
gagtgagtttagtgtacgttcgtacgtcttttatgcgattgagtgaaaaagaaataccgtagagggcagactaatatcaagttactaccttgcaagcttgcatccgacgtgcaaaattgattttgtgataatattttgaaaattcaaacaaatgaattgactaatataaagttaaaaagttattttagaattactgttctgagaaacttatgtacagagaatttttacaaaaatcgcatagcttattatttggaaagtgtgggtgataatctacgagagaaaaagaacgggaagatggtccatcccacctaggggtgaaaacggtacggaaatttccgagaattccggctaccgtttccggtttgcaccgaccgtttcaatcggtatcggtaattgtcggtatcggaaatggaaacggtaatctttttcggaaatggtagcggaaataatatggggttttttccgaccgttttgtcggtaaccgttttttatcggtaatttccgtcaaatttccgacaaaattccgaagaaggaagtcggctgggcctggctagcaggaggaggagcccattaggcattaaggagcagcccattccgaataaagaagccaactaggcctgaccgcatcgtcgtcttcatcggcgctggggcaccgccgcgccgtgttgggcgccgccaccaggtcgccgacgccggccgcaacttccttcgccccgacggcctccgtcgcagccggccacctttccctcccccatgctccaccgccggcttccgtgccaccaagccaagcgccgagcgccgccgcaccgccccagcctcctcctccccaccgatgccgcccctttctcctctctccttccccccaccgccgccctgcgccaggccgccatctccggcgcctctctcctctcgggcgcgcgtgaaggagccaaaggcagagaagagaacaagagagaaaacagagaagaaatcgagagagcaggaaaaggaaccgagagaagggaaggataagagagagagaaaataaaagaaagagaggaaaagaaaggctgtgggatccaccggcgggccccaccatcttgactcctctctgtgatcgacctggaaataccaaaaagtctagtttagcatgaaacttaattacaacggtagttatacagtgtcaacataaaagttcttatgcaatgtgccactgtaggacgacgatatagctatgtcaattgatgatgaaataatgaatgatatttgacaaggagctgatcagctgaagccatgccagcttgtgagcttggtgttctcgaagacttcaaatctatatcctaaaaaaagtcggacaatattagttatgctgtaatcctatcatgtaagccacattgtatgctttagccacattgatgttgaagtatcattgaactttatttatattatttgtcaatcttattgtcaacttattaatcatcatataaaggtgttgtgtggcagcataatgatgcaagggtga

SEQ ID NO: 17390 - DNA, 1501 bp, Oryza sativa
gtcaccttgtggccgtgaagagaattcttagatatttagtgcacacacctaaccatggtctttggtatcctaagggagcgaggcttgatctcattggctataccgatgcggattatgccgggtgcaaagtggatagtaaaagcatatcgggtacttgccaattcttgggtaggtctgttgtttcttggtcttccaagaagcaaaactctgtcgccctatccaccacggaagcggaatatgtttcggcgggggagttgttgtgctcaacttctttgggtgaagcaaaccttgagagactatggcctcaatgtatccaaaatcccactcctatgtgacaatgagagcgccattaagatagccaacaaccccgtccaacactcccgaaccaaacatatcgatattcgccaccatttcttgagagatcattccacaagaggcgacatagatatccaacatgtgagaaccgataaacaattggcggatatcttcaccaagcctctagatgaagctaggttttgtgagttgagaagtgaactaaatatcttggattctcggaatgtggcttgatctattgcatgcatgtttgcttggtagaataggtttgcatactactttgtgacaaaatggtcattcaactcatggatggacactagtcacttttgtggagaacttgaatctatgtgtattgggatctcatttttcaacaaattttggtcgtagcacaacttgaaatagattcacacattccctctctcgagggtgaattatcttgtctcatggtaattccctctcttttgatccctcggattgtccatttgacttgtggctattgttttgtgtgattgattgtgtgctagtcacaagttcaaatggaccctctagagctcgaccatccctcctttcctaatcctatcaaaaatctttgtgaaatgtgtttttgaaaaaaatttcccggtgcttgtcccctacaaaattcctttcaaatgtttgcaaaatagtttcatcaaaattcccggcgaaatccccttgcaaaactgtgttttccaggaattttcggactttccgaaaaattttcggaccttccgaaaatttcccatcctgtcgctcttctattcatgctattccaggatttttcggactttccgaaaaattttcggatatatccgaaaatcatcaaaaccgtgtgcttcccctctagatccgttcggacttatccgaaaattttcggaaatgtccgaaaatttcggggctcatatattttgacccgtggactcctctctctctctctcttcctcactttttcccaacgggtttgactccctcctccactccgcaccggcgaccccattctccggcgacctcccgcggctcccctcctctccaacattgtgggagcgcgtttggggcacttattgggacttgcgttgtcgatcatcaccgcgttcttcaagtgttcttcgtgttcttgaggtatccgccctaaaatcaaatcctttgattc

SEQ ID NO: 17391 - DNA, 1501 bp, Oryza sativa
acctcgatagtccaggggtgtaattcgtactttttccaacaaatattaaacgaagataatatcctaatgaataggacacatacagaaccaaaagatactatgccatatcgttcgtattctccattgatagctttgttatcaacatatcgtattgactgggcataaaaaatgatcatgttaaaaaaaattgctactatcagcatggagcaagatatacttagttgttgccacttaccagtatagcaggccaaacgggcggcccggcccagcacgacacggcacgccgacggcacagcccactagggcacggcccgttaggcacggctcctgtagcgggccgtgccgtgccggcccacgtgccaaggccacggcccaagcacggcccaagaaggtgctgggccgtgccgggccggcacggctactgtagtggcacgtgggctggtagccggcccactagaacatgtggcccataaaaattgaaatttgaggggaaaaaaagaaaaaaggcagaaaaaacataatataaaggaaaaaatgataaatataggataaatgtgaggaaaatttaggaaatatatcataaaatatatggtacaaataggataaaatgtggaaaaaaataaaaaatatgagaaatatatgggaaaaattagaaaatcgtaggaaaaataaatgggccggtgggccgtgccatgcctgggccgtgccgtgccggcacgctacagtaaacgtgccgtgccgtgccgtgccagcccacgggctgaggcatcggcccaaacacggcacgggataacgggccgtgccggcacggcccacaggctggcgtgccgtgccgggcctgggccggctacagtactgccgtgctcgggccggcccggcttggcacggcccatttggccaggtatacttaccagtgcatgcctcctgaagtgaaactattcctaccgcttcacctctgttttaaaataaaactattttttcatctatctttttatctcaatcaattataactattcttcgttcgtttcttcacctacttctacttttcagccaattatgttttttcttcattattttcacatatgttataactatcggtatccaacttcagaaatacttatttgaatctgttcgcacatttttttaagctcgatctactgatctacactcttgtataagtaagatttaccttccttaactctgttaccagacgttttatacttatgaactctttaaaccagatgtgctaagcacgtattaccattctataccaattttcatttcatcatatcagtatttgattgatcctttcaagcttcctcgccaagtcaatcgagatcatgactgtgatacgatcaagtaaataaagtagtataaaacgattcatacgacgatttttcaagcgtaaactaacagttaaacacccctataaaacaggcgccccgaagtagccagcacagtacgaggtggccgtcgtcgagcacctcgatcgctcgcgcca

SEQ ID NO: 17392 - DNA, 1501 bp, Oryza sativa
ccttgtatatgtttaggctgcatgtcattacattgagctttgtcaaattattgtgatccgtgtgagatgcttttcatactttcatgatcaagatcgcacgcacactccacatacacacattatgctaaacttctacactggaagttagcatctctcatctatcatttattttatccattatccataaaataaatactccatgtcatttatgcctcttcctccgaaattctttcaaagaaaaaaaaagagagagagaaaggcatggttatgaaaaatagggaaaaaaataaagtcttgctcatacaaatatggagcattgataaaaatgagagaagaaaaaaaatattgctcatacaaagtacgaggcatgataaaaagaagaaagaaaaagaaaaaaaaaagagatagccatgcactctctcaagtttccaaagagagaaaattagaggaggtatatcaaaggagttgtcatcttttattttcctttttctacccacaaaacaaccatacacatatcacacacatgcacattcttgatcagagagtatgacttgctatctccttggatccggtattttggctttgcaatatatgtgatgcatgtatgccctgattgatccctaccgagctccacctatacagcctttagaatagggacaattcggcaaacatgccttggtgaggatcaacaaataaaaccacatgagtgatttgagagaaggtcatttgaggagtatagctactttgcgaaaatatatgaaaaccctaaaagattgacaggaggaataaggaggacttgagtcacgaccgttccattcatcaattgcccaatatggtaagttagacacttcaaaagttcacaggtacaggtatggcttagaatgattggtgtacttgtattatatcttggacaattttattccacattaatccgtaacctttactcgggacgagtaaagagctaagtgtgggggtttgttgacggctgttaagtaccaaattaacgccgtcaatatctgcataaacaataaatataaaacatccaacatagtggtggggtttatttctaacgattttcatgagtgttggtgtatattcgtatgcaggtgataaactaccaaggttgagaggaaatatacatgaaggaggatgagaatcaaactcgtatccgaacttaaggagttttggacccataaacccaattaaaaacctccaaatgggccaaactgtcgtaggctctccggaccttccattataattgagagatgaaatgaataattcaagtcatcaaacaagcataatgaaatatccgacgcctcgagagaggaatattggagacattgctgggcctttagcctgccggtcaacttcagcctgagatatgcccgtcaaaccactcaaaggtggcgaccagatgtgttacacattcaggagatttgacaaaaatggcaaaagatctacaacatctcaaatattcctaactcatactcatgtgaatcta

SEQ ID NO: 17393 - DNA, 1501 bp, Oryza sativa
gattattaagtccccggtttttcttaattaacgtagtacatttcttttaatgatgtgtttcttgtaaaacgtttttaaatataaaagttgctttgaatataaaatagatctatttttaagtatgtaataactaaatactataaaattaattatgggctaatggttgaatacgctaactttatttttattttgatctatctaaaacaccacctaaaagagctaccgtgggttgggctgttgaagttaaaatgccgtaaggtttgtaattgctctttttctctaaagagaaaaaattaacagatcaagtggataaaaaggatactctttacaatcatgacttggtctagcaatgattcggtggcaatcaatcatctagcaccttgattgatttatcatctgctcgatggcacacaacataacaaacatatctctttttaaaagacagattaagtcgttaacatcttttctcataggttcatagcatgtgatccatccgttttatattataagttgttttaatttttaagtcaaatttattaatagtttgactatgtttaataaaaatataacaataattatagcatcaaattaacggtagcgctaaaatattagttcgagcaccgcacaacgctttcttcttctgcttttctcttgtttaccacaccaccattcatctgcatctcacctttcctccgtccgtttttcttttcttttttaccacctcaccttccgtgtttattttttctcttttccatatgcttttctccctttttaccacaccaccattcctccgcatcacaccttccctccgtccgtttttcttttctttttttaccacatcacctcgtgtttattttttctattttccatcttatccatgcttcatcaaaaggcccggtaaaatattaaccatctagatttttccccttctcattccttctctccagtttctgttttttgcattttagtaccgtctagtttttctttccgagtttttgtattttagtatcttcccgcgtttcaaaagtaacgaatttactatgtggagttttccatttactcccagctttccacatctactcattcaaaagtaacaaatttactcgcataaatgctcccttcaaaagtaacaaatttacttgcatgaatgcccccatatcgtactgcataattcctaaatggtcgtaaaggaattactaccagcttataacgctactaattcttttactagtgttatgaatattgttcagactttgtgatctgcgagtaaaacaattaccaccttcctctcgatatagcccacgatattgtagccaccgtgtagtaatatgtttactgtttactgatatgttcaatacacaatataagagtaaaaattgatactaagagtattgttaatctgtattataaaatggtcatacgaatgaaaaaaaatgcaggctcaatcacacacgagtgataaaattactcacaagtgaatcaaactagaaaagaaaaaaaa

SEQ ID NO: 17394 - DNA, 1422 bp, Oryza sativa
attatttaggtctacaaattttattttggttatttctccatccgagtttaattgacctatataaaatttgaatttcaaaatatgacaacttcaaacaaaattttcaaatactaaacgatttcaactgaaaaagtcatcatgaacaaaattgtataaatcatcaatatctacaacttttgtgttgatcatttttctatatgactctatttcaataatttgaatttgaatttcaaattatgtcaaattcaaacaacattttcaaataataaatgatttcaacagaaaaagtcatcaacaacaaagttatataaatcatcaatatctacaacttttattttggtcattttgctatatgactctgtttcaataatttgaattttaatttaaaattatgacaacttcaaacaacatttccaaatactaaatgatttcaactggaaggtcatcaatatcaaagttgtataactcatcaagatctataacttttgttttggtcattttgctatatgactctgcttcaataatttgaatttgaatttcaaattatgacaatttcaaacaatattttcaaatactaaatgatttcaactaaaaaagtcatcaacaacaaagttgtataaatcatcagtatctacaacttttgttttggtcattttggtatattactctgtttcaataatttgaatttgaatttcaaattatgacaacctgcaaacaacattttcaaccgaacttttattttagtcatttcttcaaccgataaagtgatagtaacattgttcacaaaatttacatttctcttatatggttttgaagtatttaaatcgtgacgaaattgctataacgtcacaggttgtgggccggtttatgacgaaatcgataaactatcacggtattatgggccttgtatccatagttgcatatccgtgacgatttatgaaaacatcatggaaatttcgtcaaatttcatcacagattaaatagattcttgtagtgtccgtatgatgccaaaaccgatcattccaatcaaatccggtcgaatcctactcatcaaatctggttgaatgaatcattctcatcaaattcggtcgaattattctcgatgttttaaaattggttgatctccttttatacacttgatctcctttttctgtttttatcaaaatcggagcgaatttgcaaaactcaggataaaaacgatggcttttaaatggagattaaatttgatgaattaaagtggaattagaagggaaaattatgggggaaaatggcaagggagctgtggggaatcgatttttacaatcaattggagggaacgcatggggacacgctaggctttggccgcgcaagaaaaaacatggcatataaaaaaaacaaatccttaccccacgcatacccttctgcgtgcgaaaaaaaaaagga

SEQ ID NO: 17395 - DNA, 1269 bp, Oryza sativa
tgtggccagatcaataacgatcaagacagacgaaaaaattgacggaagtgctaaaaatgggaacagggtgaactttggatgctattaaagtgaaccggtaactttcggtgctataaaaccaaaaacgtgaactttcgatgctatataaccaattttttcaaataaaaaaaacgaatgacataaaaacccatatgaaagatataatatatttgcaaatatgaaatattattaaaatattttcatgtaatgtataaaacattaagttattacatctgaaacattataaaatacaaattggaacattgaaaaaacaatatgtgcaacatttacagatgtattagtgaaacatagcgtactagtactagttgacacatttaaaagaataaaaaatattttttcatcagaatatagtcatgtgtgattttgttctaaagatttaattgcaacaagtttaatagtgtaatcggattgtaaattggagaagtgatttaagaaaaaagatcatttaaatataaaaatgtatacgtgcatcggtgatctggtaaagtgctctacatagagcaagggagtagtaaagtgctttgcatggaggcaaggcagtggatagaagcatacatgtgatgagataatgttatgtccgatatttcgctggagcgtcggacagccgacgcgaagcattttcccttttttatcttcggcttttttcggttttttccatctgctggttttttactctctttttccagtttttttatcctcttttttttcgttgccatccttttttttttcgcacgcagaagggtatgcgtggggtaaggatttgttttttttatatgccatgttttttcttgcgcggccaaagcctagcgtgtccccatgcgttccctccaattgattgtaaaaatcgattccccacagctcccttgccattttcccccataattttcccttctaattccactttaattcatcaaatttaatctccatttaaaagccatcgtttttatcctgagttttgcaaattcgctccgattttgataaaaacagaaaaaggagatcaagtgtataaaaggagatcaaccaattttaaaacatcgagaataattcgaccgaatttgatgagaatgattcattcaaccagatttgatgagtaggattcgaccggatttgattggaatgatcggttttggcatcatacggacactacaagaatctatttaatctgtgatgaaatttgacgaaatttccatgatgttttcataaatcgtc

SEQ ID NO: 17396 - DNA, 979 bp, Oryza sativa
tgaactttttttttaaaatttttttaccctcttccttttatttttgaaccttttaaattttttttattataagttcaaaatgcttatttcaccttcttatttttccttttttaaagttcaaaatggatattttaccctcttctttttcctttttgaacttttttttttaaaaagtcatcacaagttcaaaatgtctgtttcaccttcttattttcccttttatattaaaaactaaaatggttattttaccctcttccatttatttttgaaccttttaaaatttttttatcataagttcaaaatgcttatttcaccttcttatttttcctttttaaaagttcaaaatggatattttaccctcttctttttcctttttgaactttttttttaaaaaaagtcatcacaagttcaaaatgtttgtttcactttcccttttttaaattcaaaatggttatttaccctcttcttttcctttctaaacctttttttttttacaaaaagtcatcacaagttaaaaatgtttgttttaccctcttatcttttatttccaagttcaaaatgcttatttttaacctcttattttccctttttttaaaagttcaagatgcttatttcaccctcctatttcaccttttctaaaattcaaaatggttattttacccttatcttttcctttttgaacttttctttaaaaaatatcataagttctaaatgtttgttttaccctcttttttttttcctattatcaagttcaaaatgcttattttaccctcttttttttcattttttttcaagttcaaaatgttttccttttttttagaattttgtaatgcttattttaccttcttgttttcccttttttctaagtccaaaatattaccagccttccctctcaagcaccgtcaacacagtctcacttctttggggagcgtctgtgtcatggccgtttggatctagccttcctactagtggatctagg

SEQ ID NO: 17397 - DNA, 1357 bp, Oryza sativa
gatagagccgagaggaagagagaaaaagaaagagaggaaagaaaagaaaaggaaaagagagaaaaagagaaaaagaaaagaaaaaggaaagggggaaaaaggaaaaggaaaaataaatagaaaaatttggaagaaaattaggaaggttaatagtttagaaaatttaaaataattaaaatttaattatagaataatcatggtcccagaattgcaaaatttaattattcttggtaatttctaaaagaaatcaattcgcagtagtaatttagatataattaacaattagatgaatctttatagactactatagatcatttttggataatctctataagtaatcgattcacggtagaaattcggacttaatcgctaggaattttagacgtatattatatttaatcgtttagtcatagactaaattaaaacgtataatattataagataattttaggattccgtccgacatttagctcgcgatagaaatttctaacctattatatggatataatgctcgggtagattaaattgaaaacttatgacaacaaaatatttatacccgcaaaatagtttaaatcgaaattgggtttgccgtagttcgcggatagtgaagttaataaaaaggaaacgactttcgcattcgactgtcatttggatttattcggattcttatttgaattctaaccgaattcaaatcaattttcgcacgtaactatagagcccgagggagttgcggatccaagcgaaggccaagacccgcaagactttgagcaaggcaagtcatcactattccttgaacatgttgatcccaattgcgaaattgttttgtttacaaataaaattgcatgcaatgatgaacatcccacttgtgattatgccatgccttgattattgtttacccttaaatctttgtaaccatgtttacgtatgagtccctagtcaactatgacaattgcttagaaatgctattctagaattatgcataatcatatttatcaaatgctatatgcttgggcaattacctttgggaaggtaattgagatgcggcatgtggagacatgagcgccacattgccatgatgttgatgacatgatttgtgaaaggaaaaataaaattaaacaactgttttcgactggggcggacggaggatttgggtggtatctggaaaaggctagtaccgtccccggtcaattaaggaccgagccatgaagttaagcatgaaacgacccccgtacatccgcacttctcgtatgggtatagaactagcggattagatagccgagcagaggcagtatccctgcatagatggttcacccctgagtgaggcaggtgcgctacggtgggacagctgttgaggtag

SEQ ID NO: 17398 - DNA, 1501 bp, Oryza sativa
acctcgatagtccaggggtgtaattcgtactttttccaacaaatattaaacgaagataatatcctaatgaataggacacatacagaaccaaaagatactatgccatatcgttcgtattctccattgatagctttgttatcaacatatcgtattgactgggcataaaaaatgatcatgttaaaaaaaattgctactatcagcatggagcaagatatacttagttgttgccacttaccagtatagcaggccaaacgggcggcccggcccagcacgacacggcacgccgacggcacagcccactagggcacggcccgttaggcacggctcctgtagcgggccgtgccgtgccggcccacgtgccaaggccacggcccaagcacggcccaagaaggtgctgggccgtgccgggccggcacggctactgtagtggcacgtgggctggtagccggcccactagtacatgtggcccataaaaattgaaatttgaggggaaaaaaagaaaaaaggcagaaaaaacataatataaaggaaaaaatgataaatataggataaatgtgaggaaaatttaggaaatatatcataaaatatatggtacaaataggataaaatgtggaaaaaaataaaaaatatgagaaatatatgggaaaaattagaaaatcgtaggaaaaataaatgggccggtgggccgtgccatgcctgggccgtgccgtgccggcacgctacagtaaacgtgccgtgccgtgccgtgccagcccacgggctgaggcatcggcccaaacacggcacgggataacgggccgtgccggcacggcccacaggctggcgtgccgtgccgggcctgggccggctacagtactgccgtgctcgggccggcccggcttggcacggcccatttggccaggtatacttaccagtgcatgcctcctgaagtgaaactattcctaccgcttcacctctgttttaaaataaaactattttttcatctatctttttatctcaatcaattataactattcttcgttcgtttcttcacctacttctacttttcagccaattatgttttttcttcattattttcacatatgttataactatcggtatccaacttcagaaatacttatttgaatctgttcgcacatttttttaagctcgatctactgatctacactcttgtataagtaagatttaccttccttaactctgttaccagacgttttatacttatgaactctttaaaccagatgtgctaagcacgtattaccattctataccaattttcatttcatcatatcagtatttgattgatcctttcaagcttcctcgccaagtcaatcgagatcatgactgtgatacgatcaagtaaataaagtagtataaaacgattcatacgacgatttttcaagcgtaaactaacagttaaacacccctataaaacaggcgccccgaagtagccagcacagtacgaggtggccgtcgtcgagcacctcgatcgctcgcgcca

SEQ ID NO: 17399 - DNA, 1501 bp, Oryza sativa
tatatacgtatatatatatatatacgtatacatatacatatacgtatatatacgtatatgtatatattatacgtatacgtatatgtatacgtatacgtatatgtatatgtatacgtatacgtatatgtatatgtatacgtatacgtatatgtatatgtatacatacatatatacatatatgtatacgtatatgtatacatacatatatatatatgtatgtatacatatatatatatacatacatatatatatatatatgtatatatatatgtatatatatatatacatgtatatatatgtatacatatatatacatgtatatatatgtatacatatatatacgtatatgtatatatatatacatatatatatgtacatatatatatatgtatatatatgtatatatgtatatatatatatatgtatatatatatgtatacatatgtatatatatatatatatctgtgtgtaaactataagagaaatgtaaattttgtgaagaatattactatcactttgtcagatgaagaagtgaccaaaataaaagttgtatgtcttggtgagttctaaaacttttatgttcatgactttttcagctgaaattatttactacttcaaaatattatttgaagttttgaaattcaaatttttaattgataaaacaaagtcacaagagaaaatagccaaaataatagcagtaagaacacaataacatgatagaggatgattttaaaaacatttaggaaaaaaatcatccaatttggagttcatatgagtgagataaactagtttcaaattttattttcgcttacggctgcttaagacgactgtatggaaaaatcgattttctcataggggctcttaagtgatccacatgcaaaaatgagctcattttttacatgcggacatcttaagaggcttgcatgaataggaaaatcgatttttccagaagccgtatgcgaaaaagctgcttgatttttcatgcggtaagttatggtccgtttgcaaaaattatgagggtctcgtacacaaaaatcgtttatgtagcagtgggtgattgattagtactactgctgcatctgcactgcatggccatgcccacacacttggcctgcattgctagccattgctatactatgggcctgtttggggagctttagattctaagaagcagctatttggtagccagcttttgagaatctggaaaagctctaaaacctagcttctccagcttctgacttattagttcatttttcagaatatgtaactccatattctcagaagctgtggactgtttaggatagcttctagcaaaagcagctttttccaaaagctgccgctgagacaagcttcccaaaacagggcctatatatgctgctggtttcctggtttggtggtctcatgctcatgcatgcacacgtccatctgtgtgaattctgaagctgcaagaacctctcgccgtgctgcatgggccatccaccggcgacctcctcaccggccg

SEQ ID NO: 17400 - DNA, 1501 bp, Oryza sativa
agtattttttatatatggcggttctttctcgtgtgaattcggatggttttttcgatcctttttcagcaatgttttttctgatggtttatttcggagcggttttttatctagtcgggtggttttttcgaatcggtttcttttataaacgggattttttataatctgtgttttttcggttttttatctagtcgggtggttttttcgaatcgatttcttttataaacgggattttttataatatgtgttttttctcgattttgagtaggacatgtttttttcctttatttatgggagtaggatgtcagaagttattttttcctttctatgggagttggactttttttttcgttttctttactggcgatatttttttcttttttttaaggaatcggatgtattttatgggggagattctttttttctgttataatgagtcggacgttgtttttactacgaaatatttttttcctatttttactgacgagagaatcttttttctcgcatgttgagtccgacttattttttttcttttttatgacgatggaaatattttgaactttaagtagtaaaataatataggtagattcctatatagactgttttttttctccgattaatgtgagaatttttaggccatgagagcgaacatgagacttcataagttaataatagataataaggagactggagaggcagtcaagcagagcaggaagcgaagcatgcatgaacacgtataaatgaagcagtgatcgatatataggaggcgcgtacgtacatgagacgaggatgatgatccagatgtggaagaagcgcatgtaggggatgccggggttgagcgccttgctgcgctccacggcgcaggcggggcagccctcatggtattggtacgccatctccagcaatggcgtcgcagcgtcgcctgcagccatctccgcttcttcctcctcttgctttgctgttcctgagctcctgactccagggtgagatgatgagatgtctcggttcacaaccaacctgatttattatgtcggtcgatagcgaactgacgttggctcgattcgccattaattactattgcgatctttagcctgcgtagcattgctgttagtctcacactcgagctcaattaatctccatctcctccgagtctgacgaaaaaatcaatgtagtgcacaacactcagcgtatcaatggcgactgttattgaatgtgagagattggcagatggtgatggactgatggctatggttatgtctctgttgctgtttaatttgctgatgtctctgccatggcaccatggcaagatgcacatatgcaatttgggcctagtttagcttcaaaagtttacaggcctcgtgagaaaggcccatcctaacctcccctctctgttgtcgtcgtccctcttcctttcctttcctttccttgccggccggccaggccatggtctacggctttctctgccttaactcttgagttgaccgttgtccgttgatcgagttgt

SEQ ID NO: 17401 - DNA, 1501 bp, Oryza sativa
atgcccgtgcgttgcaactggtgaatgctattttaatcttattatacattaactgtgagaattcgcttggatatatatttttctagaaaatcatgtcaggttagtatgcaagtttttcttttcaagagattaaatcatgttaagttagcatgcgagtttttttcaagagattttttatacgactccttatgtattttcaaaagcgaacgaaattaaaacctagctcaaatatagatctggatttctaaaagcgaacgaactgtatttttcaatacggttaaaaaccaacacatacacggatgacgtaccagagtaccggtaaaattatcttcaatttttataatagtagaaaagttttggtgattttggtgtcagcaatctctactacttcaaaattttcaaaacgtttccttcgtccgtcaaaataaaaaaatagtgaaaaagcaaaaaaaaaaagtccgactaccctaaaaagtggaaaaaaaaccgtagatccgattccccctaaaaaaggaaaaaatagcgaaaaacaactaaaaaaatccggttccacaaagtggcaaaaaaaccataggtccgaacgtgaaaaaatccgattcctataaaggtgaaaaaaagtgaaaaaaagctagatccgattcccataaaaatagaaaaatgtctgattcctataaaagacgaaaaataaaaaaaatctaaaaaacatgtaaaaaaaagttcatccgatttcctaagaaagtggtgaaaaaatggctcgtataaataaaaaaacacgcatgaaaaaaaataaaaagagcggaaaaaaagcatggaaaagaagtccgatttctgttcgttttagtagacagtatatatctcttctctaattctaatctaatataactacttaaaaagagaagttttcattctacaactaaaaaaacatgagaaaataaaaacgattaaaaatgcgtgagaaaaaagtcagaaaaagcgttaaaataatgttttctgtcttttgtaaaaaataaaaaatgcgtgagaaaaaatgtatttccatcgtccgtaaaaaaattaaataaaaacatgcgagattacattgaagatgttccaattttcttattgtcttagctacaaacgatccatacaaatattgttattgacatggttattcgtgaaaaacgtatgttatgattaaatatttttttcacccgttataacgcacgagtattttcactagtaaaaaataataattaaagaaaacaacactaagtatatatgtgtatctcaacccactgtaatttttcagcggaattcaattcaatgaatagcatatctaggtcgtagatttcattttagtataagaaaacagaagctggtacagtactttactgagaaaatatcgtgaatgtttctaatcaaagaaccttatctctatccaccctctctcgtttactctctctctctttccccatctctctcctgtcaccagccacacatcctctcctctcctctctagttc

SEQ ID NO: 17402 - DNA, 1501 bp, Oryza sativa
gaattgaattccgctgaaaaattacagtgggttgagatacacatatatacttagtgttgttttctttaattattattttttactagtgaaaatactcgtgcgttataacgggtgaaaaaaatatttaatcataacatacgtttttcacgaataaccatgtcaataacaatatttgtatggatcgtttgtagctaagacaataagaaaattggaacatcttcaatgtaatctcgcatgtttttatttaatttttttacggacgatggaaatacattttttctcacgcattttttattttttacaaaagacagaaaacattattttaacgctttttctgacttttttctcacgcatttttaatcgtttttattttctcatgtttttttagttgtagaatgaaaacttctctttttaagtagttatattagattagaattagagaagagatatatactgtctactaaaacgaacagaaatcggacttcttttccatgctttttttccgctctttttattttttttcatgcgtgtttttttatttatacgagccattttttcaccactttcttaggaaatcggatgaacttttttttacatgttttttagattttttttatttttcgtcttttataggaatcagacatttttctatttttatgggaatcggatctagctttttttcactttttttcacctttataggaatcggattttttcacgttcggacctatggtttttttgccactttgtggaaccggatttttttagttgtttttcgctattttttccttttttagggggaatcggatctacggttttttttccactttttagggtagtcggactttttttttttgctttttcactatttttttattttgacggacgaaggaaacgttttgaaaattttgaagtagtagagattgctgacaccaaaatcaccaaaacttttctactattataaaaattgaagataattttaccggtactctggtacgtcatccgtgtatgtgttggtttttaaccgtattgaaaaatacagttcgttcgcttttagaaatccagatctatatttgagctaggttttaatttcgttcgcttttgaaaatacataaggagtcgtataaaaaatctcttgaaaaaaactcgcatgctaacttaacatgatttaatctcttgaaaagaaaaacttgcatactaacctgacatgattttctagaaaaatatatatccaagcgaattctcacagttaatgtataataagattaaaatagcattcaccagttgcaacgcacgggcatttatatatatatatatatatatatatatatatatatatatatatatatatatatatgatgtgcgccgcgttgtgtttcgctttttggcagttcgatcgatcttatctcgtttttcttctccgaatcatcttccacaatgcatgttggaccagacgcgccaagtcgatgaacgaacaactagcctgctagatcggtatata

SEQ ID NO: 17403 - DNA, 1501 bp, Oryza sativa
tgacgtcgacgatgacgtcaccaccggcggcggcggctcggcggctcggacggcgcacgctcaccggcgaacggcggcgctttggcacgaactgaggacaccaacgggtagcggacggcacggcgaactcaccggcgaccaaagcgacggcggaagaccaacggacggcgacggcgacgaggttgaaacggcggcgctcttcggcatgacgacggcgacgatgctccggcggtctccgacggtggcgaagcggcggacgaggacggcgacgacttggcgagcacgacggcggtcttcccgagcgacgacgatgactggaacggcggcggcgcacggctggagcgacggcggcgacggcggcgctagggcacacggcgctagagcgctacgggcgacgagaggcgaaggcgagggtggcggccggtagaggagacaccgggggtccttttaaaggggctaggaggcgacggcgaaggcccacggcgaccggcgacgcgaaggaaacttcgggttcgggagagaggaaagtcgatccgatttgacttcaaatctatcgatttccaaaccgatttagccgatgattccaaaagagaaaaggttgaggagatctcgaggatcatttgccctcttttgattcggccggagaaggaaaggggcggccggatttggaaaggaacggcggcggcgcgaaactagggtttcgggcggcggcggccggaggttgacgacgaccctgacaggtggggcccacctgtcagcgggagagagagaggagagcggcggcttggactgggccggctgggctgaagagagagagagagcggttttgggccgactttcggcccaaagccaaaagagactttttaaaacctttttcaatttaaattatttatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggctcttaaaataaattctaaaaattccatttaaacaacaatttatatattttgaattttcagggtgtgacaggaaaggaggagcgggccggcccaggaaggggcgccgagcgcggggagagagacgggccgacggcccatctagagaaaaaagaaggaaaagaaaaagaaaaagaaaaagaagaaaggatttttcctgggatttaaaattgcactttggtgatttttaattgattaaaattatttccaaggctctgaaaattccactaaaaatcttgttaatgcattggaaaatggggaactcaagaaaaattccaccacgctatttccgattattaattgcatttattaactagggatttagctctaggttaattaagataatttcttcgggcaatttatttaaccaatttttaaagcaagaaaaagggggggatacttcagggtgtgacac

SEQ ID NO: 17404 - DNA, 1501 bp, Oryza sativa
atatgaaggttgttatgtcctcgatgtgttgtaatgtgatgcataccccgttgaatgcgacgtcacgatgcaatatggcaatgatcaaatggtatattgtatcttttaccttgcattgagtcataggaaagtcgtactattaagggggatgatgcatagacatataaggactaatgcaagtgctcaaaatctatttttcttggaagcattgccctcttgggtgtgttccggaaattttcggaagttctttcggaagtattttcagaaggtacgaaaatacacataaccgattttaagcttttggaaattttcggaaggaaaatacacagaatcgattttaagcttctggaaattttcagaagttccgaaaatacatagaactgattttaagcttctggaaattttcggaagtattttcggaagttccgaaaatgtctgcgagccaaatatgcttctggatcgaaagtactttcggaattatgtttggaagttccgaaaagtgcgttgacttcgattttttcagatctggaatttttcggatgttccgaaaatcagaattattgtgttccaacgggcagatttggagctgtgggtataaatatcccactcccctcacttgtgaaggctgctgctctcattacaaacttgtgcacccttggcgtgcttctctctctagtcatttgagccatttctttctcgattcctctctccacccgggtttgattcggatttggtgtgtgtgtgagagtgtggattcgagtttgtgtgggggcttcttgtggtcttcgtgaagatttgtgagcacttgcatcatctccgggagttctttgcattatgttttactcttggaggttgaggattcctagacggctaggtgtcgctcccgagccaccgatctatgtgtggttggccggaagaagtttgtgaaggccggatctcgcctccgcaaggaaagagatacctcttagtggaaggaggagtgcttagtgcaacctcttgaggaaatggttagctaagaccctgctcttagtgagctcatcaacggagagtagaatctactcaaggatttgaacttcgggaacaactttgcgagctttatcttggtgatatttctttatccctctccactagctccgcttgcttgtgccgctattggtctagttactgtttgttccttgtttatcctgttgtagacttctagatctagagttatcatcttgagttcgactgcactgagtattttcggaagttccgaaaatctctgcttagttctgaaaattcctgattccgctttacttaagtttttaaattagcctattcaccccccctctaggcctaattgaccatttcaattggtatcagagcctaatctcctaattaggcttaatcgtttggagagatcatatcgggtcaaacgggggatggcaagaaaggtgataagggagctaagatcccttattactatccacctacatctacatcttacgtgagcacctatagc

SEQ ID NO: 17405 - DNA, 1501 bp, Oryza sativa
gcctacattgtctgacaaatgttgtcatgataatatttgcaacctctgaggcataaagcactgtcattggtttttctttttgttcttctagaataaagaatgtaattcattgtctttctttacctatgatgagttgcgaaatttattgcctgcattgtttgattaaacctgtgagaaaatttgcaacatctgaggataaaaagttactccttttacttgattttctgctggttgttttttctttttttttttcttctagaaaatatgagtgcaattcattgtttttctttacctatgatgagttgtgaaatttattgcctacattgtttgactaacctgtgagaaaatttgcaacatctgaggataaaaagttacccctttacttgattttctgctggttggtttatcttttattactttagaaaagaagagggcaattcattgccttttttttaacctatgatgagttgcaaaatttattgcctacattgtttgactaacctgtgagaaacaattgcaacatctgaggataaaaagatgtagttcacttggctttctggtggatttttcttaatatatcgagagttttttttgttggcgcccgttagtacaagttgtgacccttgtttaggtgccagtggattgatgtattattgtcatccaaatcatgccatttctcgttattgcttcgtcaagccaaatattgactgctggttttgtttaccctccgcagtgtggttcttcaagatctgttgctcctatcaaggctggattcgttgcccaagttggtcgtcggaaggctggaacctaagttaaacgtccaccctgctcagagcctcggatacactccccaatcatcgctacaaaaacctaatttgccgatttacaacaattattgtccagttttcactgtgtctacaccgttttgtgtatttgtgaccgtaactctgcttccaactctgctgtgaatttcagttttatccgagaccatgaggatcaatgtttgcggccaatcccgtctccttttcgcttattcaccctgtcactttgctagatcattaggatctagggctgatgttcatttgcgagttccggtaaccatcaacgtgtagttgccgaacaccatgggcggcctatcatcggaaatcccgcgagcccatacataaccgtgcatggtgacgagtcgggataaggggataagccgacgtgtcacctttttccggccttcgggcctccttcccaacccaacccaagcctatcttacaaacccgcgcgctatcccttttccccctttccctttcacaccgcgagctcgcgtaggacacgaacgagatgaggccagcgtcgtcccccgtgccggccgtcctcacggccccggctaccgctgccactgccgccatcgccgtaaagccaacgccgcctcaacgcgcgcttcaagccaacaagcgcgagttggtggtggcggcggcggcggtggcgctgtggccgtgcggaggagcgg

SEQ ID NO: 17406 - DNA, 825 bp, Oryza sativa
  unsure (1)..(825): unsure at all n locations
cctctagccttntgtgttggggttgtttgggtttttgtggttgggggggtgcggctntgggggggtgtggtttgtggttaggcggtgcgttnggtttnntttntttctnttnntttntcgggggggggggaactaaggntgtaggcccggctcgcatagccgactgtcgtctttaacaatagataaaaacattttcgatcactatacattatagcaactcatatagccgactgctgtcgtcaaagctcgaaagagtgtgatgctagaactgatcctccccatcaaagcccggaagagtgtgatgctagaactgatctcctatcaaatcgcatcgaatctttattgatcttctaaaattggttaagggtttgtgatgcacttattctactcttctgtttttatcaaaatctgagcgaatccataaaactcttaaatagagattagatctggtaaattaaagcggaattgaaaggaaaaattatgggaaaaataatgagggagtccggtaaattaaagcggcattgaaaggaaaaattatggagaaaataataagagagtagtgaggaatcgatttttactatcaattaaaggagagaatgcggagaccgatcgacatggcggtggagatgacgagaacaaacggcgaaaaagaaaaaaaaacagaacgttaaaagagaaaaaaacaacgggtgaaaaaaaaggaaaaaagaagcgaagaaaaaaaatggaggaacggttaaaaggaaaaaaaaagatgaaaataaaaaaaaagtgacggacaaaaaaacagaaaccttacgtattttaacaatatactagaaaaaa

SEQ ID NO: 17407 - DNA, 1501 bp, Oryza sativa
ggataaaaaaacgaaaaaagagggaaaatgtaaaaaaaatggaaggaaaaaatagacggacggagagaaacggaaaaaaaagcaggcagagaaaaaaaaggaaaaaaggggcgagaacaaatgggaaaaaaagtagacggaaggaaaggaaaaaacggaaaaccaaaaaaaaaaggggaaaacgaaaagcaaacggatcggaaaaaaagaggaaaacggtgaaaaaggaaaggacggatgaaattttttttaccggaagctttgcttattttttaattaggtatagaaatacgtgcacagggagagggaaacatacatatttcttttctcgaagataagaactaatagtgaaaactaataatttaatggtcaaaaatgtttggtctaatttgaatttaaataatataattaaaaaaggagggtggacaccggccaaggaacatggggaagaggacgtactatatgtacgtgtataggacaatgatttagttttattttctaaaaacatattataaataattgtgatttccatctaactaaaatagcataaaaataggagagaaaatgaacaaaggggagggcgtacacccggtcaaaaaaaaaaggggggagggcgtacacggagacgtacataagcgacacgggaggggatgtgatttttttttttttgaaaaatggatctaatgacatataatgtcgggtccaccatataagtgtaaatctaatagatgaaaatctaaaatagtaggtccactggttaattagagtgccacatggctgttttggagtacttttaaaagtccacgtggcggtataggagcatttgtagaaagttttatggacttatagtatataagagatagtatataagagatagatataacaatttctttacctacatttctattcccaatcacccacaaaacttgtaccatttaaattctacactattcgcaaccaattataacattcttatatttaatttcacgatttttcttaatatccatattccagcttaaaaccattttacgttctaaggatgaaggcaatatcgttcttcccagcactaatggcccattgttagagtataccgaatgtacgacgtgatgattgcagtatgttatggcaggaggtgacgcagaaccacataacgtggcaccaaaactagccatggaactcatctacccctgccccttgtcctgtcccgtactcccgtgtatgctacgcgatggtctctcgattccgttaggtgcagctgcgcaggtgacgagcacgagataattttcagattttgcaccctataaatcgagcccgatttcgtgcgtgtactccgcgagcccatcccatctcatctcgccctcttcttggtttttctcgttctgctagctagcttcatcgacgaaatggtctgtgattacacaagcaatgcaatgtttgctcgatcgatcggcgtcaatggcggcagcaactaatgaattacaatttgtgtgggtgcaactgc

SEQ ID NO: 17408 - DNA, 1501 bp, Oryza sativa
ttgtgtcattccaagtcgaactttggaagcatgaatatatttcgcatctttaggggcttaagatgcatttttcaagtctatagatgtagatgcatgacacctatgcacaagttttaggaccgtcaatggctacttaataaaaacataacaatcatatataaaactaaatattatttaggaaaaactaaagatcagatggctatgatgggttctggaggcaatccaatggtagggtgttcttcaggccacagttaattaattagctaggttatgacttttcttgataatggaaaagctaggttatggctagctaaccacaaactagcaaatcttgtgatatgagaaaagaagccttctatagcatgcatatcgtttaactaagacatgtgcatacctttgagccttttaccacttgtcatatatagctaatatttttctattaaactttgtaggaattcttatgtgctggccatcgtcatatatatatcaagagatggaattaataccctctgtttattgttagctccttgttcgtaaggaaacaaagttattgcaccaatcacttcttgcgaagaataacattctattccaacgttgaatcattctttcacgtcaagtcatgcactaactttatgaagagaaaaatagcaactatgtttgtttgaagctattattgtggttatttgtttagttctatatattaaaattataacaccggaaaatatttcatttcatatgtatgaagttaaaagtttggcataaaaaacacattgttgtcctcaaattttgacttgtttaaattgaaattttaactttgagaatatagcctgattcccaaagaccacacaaagagccatttgatgcaagtaataaaaaaaggattaatatgagaaaatttagaaaagtaaatgtctaaatgatgtggatgtgcacatatatttaatcgacgcatgcaagttcctacacatcagagaatgtcaagtgtgcctcgttaattgcatatggaaaagttaatttgctacatatattcacctgtacgtacgcactaatattacatatattagtaatattttatcggtagcgctaatccacgcgctacagcacggaatattagttcgagcgccgcacaaccccctctctgtccggttttcccgttttttaccacctacctttcctttgcatcccaccttttcttggttcgtttttttttattttatctccccatctttcgtgtttcttttttatcttttacatctcatctgcgcttcatcaataggccgggtaaaatattaacaatccagatttttctgtttttcttccatgtttcttttttctcttttacatctcatccgtgcttcatcaataggcccggtaaaatattaaccatccagatttttctgtttttcattctttctctgtagttattctatttttgtgttttagtaaaatatttaccgtctagtttttctttccgagtttttcatttttctggtatctcgcc

SEQ ID NO: 17409 - DNA, 1501 bp, Oryza sativa
taattttgtgagtaattttatcgcttgtgtgtgattgagccagtaatttttttcatttatacgattattttgtgatacagatcaacaatactcttagttttagatttttactcttatactgtatattgaacatatcagtaaaaatattactacactgtggctatgagatcatggctatatcgagaggaatgtggtaattgttttactcgcatagtcgcataccaggaaatctcggtttttactcttatattgtgtattgaacacatcagtaaatatattactatagggtggctacgagatcatgggctatatcgaaaggaaggtagtaattgttttactcacagaccatgaaatctaaacaatatttataatattggtaaaagaattactagcgttgtaagctggtagtaattcttttacgaccatctaggtattgcgtatggaggcattcatgcgagtaaatttgttacttttaaatgagcggatgtgggaggctcggagtaaatgaaaaactccacggagtaaatggagtaaatttgttacttttgaaacgtgcggagatactagaaaaacggaaaactcggaaagaaaaactagacagtaaatagtttactaaaacgcgaaaatagaaaaactacaaataaggaacgaaaaaaaaaatctagatggttaatattttactgggcccatggatgaagcacggatgagatggaaaagagaaaaaagaaacacggaaagtggagtggtaaagaaacgaaaaaaaacaaaccgaggaaatgtgggatgcggaggaaaagtggtgtggtaaaaaacaggaaaaccagaaggagagggcgttgtgcagtgctcaaactaatattccgcgctgtagagcaactttcatatagaaagttttcgtatgaaacgcaccgtttagcagtttgaaaaacgtaccacgagtattgaaatgtgtatctagaagggatgtgacacttgtctaattcgttgtatgacctctcctgggttaagtttttttttaaggacgggagagtacatcagtacaatattgctgcaaacaagaggggtcattaggttgcatgcaaatgtgtatagagtaggagtagcgtgaggaaacaacaaccagcgaataggaggcatgtaggaagccgcagaaaaggcgaagtatgatccattttccatcataacatcgtaatttagagcatatacacatttttttttgttcataggacaaaatttcagaaatcagggcatggcaatatcagaaaatgagttactccaacgattgatgcttatctattccttttgtttgatctcttgtatggattagtatttaattttttaagagttacttactccctccgtttcacaatgtaagtcattctaacatttcccacattcatattgatgttaatgaatctagatagatatcaatatgaatatgggaaatgctagaatgacttacattgtgaaacggaggaagtaccagattagacattttata

SEQ ID NO: 17410 - DNA, 1501 bp, Oryza sativa
caggaaaatcatagcaagagaatttttgctcaacagctaacttccaatctagataaacagaaggctcaaacttaccattaaaagaaggcatagtaaattttaccttagataaaggatcatctttgtccctaactcgacattgtcttttatttccaacactctcgtcttcctcctcatcatcagcaacagattgctcttcgtcttcatcgtcatatctttggtgtcgatgagcagtggcacctgcaccttcttcacctgcagcctcaagtaaaccaatgcgtcacacaatattttcatgtccaatattcatattctgaatgttttcagttaattgtttatgggattgattcattttctcaatttgatccactacttttaccaggctttcacttaaggtttttaaatgtttatctgtgctttccttgtatgatttactattacgcatcaactcttcataccaattttccatgcccttcagtttatgcgctagattctccagtgttggttcgtcggaacttgtacctgacatcgttatcaagcaaaagaaactcacaagaaagtgtcagttcctaacaatctatagatatgtggagcttttgaaggcactcaacacttaagcatataccaaattattataatatcctcaaagaatgcaaaacaggtcaatcaccgtggctggttcgtggcacaatgacatgcttgatgagtggagcgattgcaaggccggacctgtaaaggttagtaatatgtggatcttggtaggtttaactatatcacaaggaatagaaaaaatcaaacagatttgtgaaattgaataatagtccaaagtactggtcaacgttgctggccttgcctagactcaatcctagctcaagcaaacaaatgcttaacactcggactagaaacaactgattttatcacacaactctctcaaaaaaaaaaccaaagaaaatgccacactgttttctttttctgatatttttctctttttttttgatttttttctttcttttctattttttttggtgcggccttttttttctgtttttgcaccacgctggctttttctttttttttatctctctttttctttatcaaacagtggctaacagacgaaaaaaaaaactgggtaaaaaaaaagattaccgataccaactaactcaacggaacctgctaggctgcatgcgcacacaggaaattttcacggaaaattaaagtggcccgcgatctgcatgcgcaaggaatcagcaagtcgtggatggaaattacaccattacacatgcatatgcatgcgcaataaaattggaggtcaatctttgacttaaataggaaactcggatactttttttttcttttctcaaactctacaaacacaaccgagatgaccgcaacaaaactaaccgatgagacaaccagatgcaaacccaaaccaagatgaaactagggctaagaccagatcttgatacgacagtggaccaaaactcaataaagcaaaattgaa

SEQ ID NO: 17411 - DNA, 1501 bp, Oryza sativa; identical to SEQ ID NO: 17409

SEQ ID NO: 17412 - DNA, 304 bp, Oryza sativa
cttttcttttttttttttctttttttttttttttttttttttttttttttttttttttttttctttttttttctttttgtttttttttttttttttccgctttttctttctttcttttgtttttgttttttctttcttgtgtttttcctttttctttttttcttttttttttttttttttttgttttttttttgtcttttttttttctccttttctctgctttttttttttttttttctttttcctttttttttcttttctctttttttctttttttttttttttctttttttttttttttttc

SEQ ID NO: 17413 - DNA, 995 bp, Oryza sativa
gatccttccctcccgatctgcctctctccccctcttttttcgtttttctctccctcctctcctgccttttttttcttttcctcctgatccttctctcctccctcccgatctgcctctctccccctcttttttcgtttttctctccctcctctcctgcctttttttcttttcctcccgatccttctctcccccctcttttttcgtttttctctccctcctctcctgcctttttttcttttcctcccgatccttctctcctctctattttttcgttttctttttctttctcttctctccctttgcttcaccttgaaagaaaattaaaaattaaagacaaaccaagacttgaacccatgatctcatgtttcatagcaaactcttctagccaattttccttatgatactatgtgatttgatcattgtttgcttgctttgtatgtatgtccaaattttatgagaacaaattagctagttatgttactgtaataatcatacattgttattatgattcggcagtaacattaccatgtaagggtagtaacatgatatgttactacaaaatttatatcttgttactggcagtaacaacatgacgaaatttgtagtaacaaagaacctgcatagtaacagcggccgccctatagtagtaatgttttttagatctagagtattttaaatctcaatctttatagagtactaatgtacacgtcatgtcttatttttctaacccatttacatcatggcgttcgtaaaagaaaagtgcttaacgaaactagaactatcataactattttttaacgttgttactgcgaaaagcagaagtgttactgcatattggccatcgtgttattacgctattccagtgagacgaggactaaaaaaagaggtaaatctcaatctttagagagcaatatctctcacatcatatcttgtatttccaatctgtttgcaccatgaagtttataaaaaaacgcttaacaaaactagatccatca

SEQ ID NO: 17414 - DNA, 1501 bp, Oryza sativa
tctacctcgacgacgatggcttccacggcggagcacttcaccaccacccacatcagagcagtgagaccagtgacaggggtcgcgctgccacgataccacatccgttgctgccatgaccgcagcactgccgccacaacgatgaccaccatcaccacgggcttttggaggaaggcaacagttgcttgagaagcctagttgcgattgtaaattgatgtgaatgcggcaattggatgtcttctttactgattccagactgattaatttgtccaattgagaatgttctattatgcaatttgagatcagtacatacaaacttggcatatatgcatagagacttgcatactacttgcttttgcttgcaaaatggcaaaagatagctgtttgtactccacccgcacctgagccagactggacgggacaacgagcgaccgccggccgatggccacgaggaattaggagagatccaagattttgctggcaaattaaggaaacgagctctttcttctaacggaccgtgctatttcgctgatttgggccgagcacaagccagttttgctggctcactccgtgcgttcgtccaatgcggaatggacgacgtagacgtccatctgacgtcacgagtgatctggatccaaattatactggatgtatatttgagggactcaaaatggacttattctgccaacatgtactgtcaacacaaaaggtccattttgcctcttgtaggtagggatgaaaacggtacggaaacggacggaaaccatctttatcgttttcgttttcatatttttttcggaatcgaaaagcccggatacgaaaatggaatcgaatattatcgaaaccgaaaacggagcgaaaacgaagtggcacaaatacggtaacgaaaatttatcggaatacagaaacccctcaaactgataaatccaattctcaagtctcaacggtcaacaattcatcgtaaaacacaatcatataaatccaattgttaagtctaaacaatatatcacaaaacacaatctatgaaataaattatctatgtttaagagagtaatgttgttgataaatcccaacgcagaaaaaaaatattcttatgtaacttcatatttacataacaaatatttttttaaaaaaaataaaagccaaacaccatcgtattcagtacttaaaaaaagaattcaaagtatttcagtcacaaaatttccggaaattccgagaaaatttctagaaagtttctaactgattccggaaactacccttatcattttcgattccgtttccgagaaaatatttccgaatttgttctatttccgaaaaattccgaccgataaattccattttcgaaaataggtccaaaatacggaaagtttccgtaccgttttcgccactactcgtggcatgttagagaacaagctccatctccacttttcccctctagtactgatgttgttgctgacctgatggctattttttttcttctattttatctctcccatgggagcgg

SEQ ID NO: 17415 - DNA, 1501 bp, Oryza sativa
cgcatgggcgcacggcttggctggcttggctggctgcttgaccagcaggcgtcctagccggcctggcttggctgtgggctgctagctgtgctgggctcggccagaaggtggcgacctggcctttttgtggttgccccgactggtattttaagaataactagcaatagtgccattgcgttgcaacggcaaaaacaccgtttgatagtgttgcaccttgaaaaccttaaatctgtaaaaatcaagtctaatttgatacattaataaataggtagaaccgagtctaatttgatcaattagcataggatttaggatttagttctagatttatttttctagactacttaagagtttatccaacggactttaatttgaaaaatgtgagccacattgtttgatcaattttgctttcggcctaggtcttcccaagccggcctaaacttgagctggcccatcttcagcgagttagagtcaattcgacggcccgcaagctgagcagctgagcgcggccgacgtatgcggggacggtccgatgcacttccgcggtccattgggcgcagcgtaatcaacggcagcaacggcctgacgctgggcgaatctgagtcgtccgatttaatggacggctccaatcgtccccgcaccggatgaagcgccgaccggggagaggggcaaaaccctagctcccaaatccctctctcttgatcacatttcctctccggcgacgagcgagcggaacgacggagcgagcggaggatgtttttttttctttttcatagtacaagttttttttctctttttttgttttttctcacctttatttttctccaccgaggagtcggatttttttagagtcggacattttttttgtcgatggaagttttttttctcttcgttttttgttttttctctctctttttttccaccggaggagttggacttttttttttctgatcttttgcttttatcgctttttttccggtctttttttcacctgtttttttttgcgcttgttttttagaatcggaaagattccctttttatttcttttcgcccttttttttttactgcggaatcggattcatttttcttttctttttttcgcgatttggtttctcttttcttttttttcgcccggttttttcggccgttttgttttggatcggacagattctttttgcccgttttttttttgacagtagagaatagtggtaaaactaaattttaagaagaaatagtggtaaaattaaattttaaaaataaacagtgcctcagcactatacttgatggcgccgagccgaggttgaacatcttagctttcaggtgttatattgaataaaatctggtggcaaggctgtgattataatcgatgtggtgtttgatgaacttgctcgagctaaccgatccttattaggaccaagcgctcagatgaaattcaagaagtgttgtgagtttttctctgtggttttattccagttggtataaaatatactcatacgtcccataa

SEQ ID NO: 17416 - DNA, 1501 bp, Oryza sativa
ccgtttcctcgccgtcgcgggtgaagggggaggaggcggcgcactcgatagccatcctccggcggccgccgccgccgacgcgactgcccggggcgcgcgcggccggagcggcgcaggcgaggcagtgcatcccaggttccgagcaagcaatccagagccccgcggggtctcgaatgggaggagtggtgggggtgcgtgcgtgtgtggcttgcgagcgaccaccgtgaagcgagatgatttgaaacctcacaccaattctggggcgtgacggactgacggtatcgtgggggatggccggatgggagaggtgtacgggcatacggcccagaccatctcagcccaattaaacaggccacacgatgctgtttttgacagagccccctctttccaaatagcccctatttttgtacttttttttcagaaaggtccccatgtatttgcactcagtccccttaaggccttgctcggtttaaagagtgttgaagaggattggaggggtttgtggggattaatcgaatatagcctaagggttgaaaacagtatggattcggatactcgaatggataccaaattattttagcggattgggatttggtgtggatgtagcgttgaaaatgatatagagtcgaagataacacggcctataaacgaatcaaaaatatcggatgttgcatacatatacaacgtaatacaataataacaagaattagaaacacttaacatcacaccacacaataaagctaattagacttacaaactagatagagagcttatatctactattataaaaatttaagatgtttttatcggtactttgatacgtcatccgtgtttgaatcggttttaattttattttcagttttaatctctgtatctctatctctacttaaaaagaataagaaatttccaaagtcggtaaaaaagaaaaagaagtccgactaaaaaggtaaaagaaaagtccgactaaaaaaaggataaaaaagcttctatcgttgtaagaaagaaaatcgtccgactcaaggaaaaaaagggggaaaaagtctcgccagtaaaaaaacaaaaaaaaaagtccgtttgtgtttttttactggcgatttttttttcacgctaaagagtttttttcctgcgcacgcgttattggtttttttttctggttttttcaatcacaccgcgcctcccgggcgcttttgttttttttttgtcaatttttttcaccggttttttatcccatgcgattttggtttttctcatctggttttttttaatccgatctattcgcggcacgtgtaccaagttgaaccctggcgacgcgctagcgccatatcgatcgtgcgttttccctccaatttgattgcaaataaaaaaatcgattcctactcctccctcatcattctctctatgattttcctcgctttattttgtcggatttaatctaacggttgccgatgatgacggcgatctttcccgattatttttatcccgagttttatgctctgatttt

SEQ ID NO: 17417 - DNA, 1501 bp, Oryza sativa
aaagtccgattgtaattaaaaaaagcccggggcgaaaaaaaaagtgcggcaaaaaaaaactgaccgattcctatccttacttaaaaaagcggaacaaaaaggtgcggcaaaaaacgattgtaaaaaggaagcccggcacggccaaaaaaaaaatttgtccgtttcctttttttttccttttccaattttattttattttcaccgcttttttctttcaccgtttttccgggctttttcgtccgttttctttttttttcgttttattttctttgcgccgttttttctttcaccgtttttctggtttcgctattttttttctgtttttccattgggccgaatcctagcgccgccaccatatcgatttgcatttttatgtgtttcctcatccaattgattgcaaaaaccgattctccactactctcttatcattttccccttgaatttctcttccagttcgtcattttttttccaagttttacggattgctttgattttggtaaaaaacgaaaaagggaatcgagtggatcaaaatctctcaacaattttggagatcgagaaagattcgaccgcatttgacggagaggatcgactccaccatcgtacagacacggtactatgcgagctcgaccagattaccggatttgatgggtggatcggctccgtcatggtacgggcacgagttgacggagaggatcgaatccaccatcgtacggacacggtactatgcgagctcgaccagattactggatttgatgggtggattggctccgtcatggcacgggcatgagactgttcgagctaggcctacagttgcacttgtgggctaagccgaagagaggtaggccaggcacaggactgttcgagctagggctacagctccacttgtgggctgagccgaagagagataggccgagcatatagatgtagtggactactctaggactagagctgaaaaggaaggaaggaatgaatgtccggtccaaaaacaaagaagcatccggtccaaaaccaagggagtataatgtatcggcttgtttggtaactcaagggaaggggattgggagtttacacgagggaattgatgatgagattaagatgggaatttgatttttaatctcaatatcttgtttggtagaggtgatggaaattgatagggagtttagttggagattagttcattaataaaaacggatggctgagattcgcttagacaaactaaaggaggaattcccttccaattaccttcccctacccaggtattgaaaaggagggagttccttactcaattccccatcccaccaaaattctcatatctcccaaccaaataaaacacttaatagcctcatccctctaaactctcaatccctcataaaaactccttccaactaaacgagccatataggataaaaaaatgtttttacccgtagcaacgcacggatattttttcgtgtgtgtgtctatatatatatatatatatacacacacacatatgtataaactt

SEQ ID NO: 17418 - DNA, 1501 bp, Oryza sativa
gtttcgatttttcttcccttttttccttttttttatcggacagatttgttttttttcgctgcatttttttacgcccggtcgatttttttaccgtgtcacatataattcggaattggataatttttttcgccctttttttactgtctcttttcgtttttttttgccccgtattttttggagcggacatttttttctcccgtttttttcctccgaattttttggattggactttttttcaccgggtttttttcgctcgtttttttcgcatgtttttttcgcccggttcgtaatttttgggtcggacagtttttttttcgctccgtttttgatcggacattgttttctcccgattttttattcactccgtttttttatcggacttttttcgcttggttttttcgctcggttttttttacggacgatggaagcaccacttattttttaagtagtagagattagtaatggatgaatgattttgctagtgatttggcctccggctggattcaacaatggattgtgctgggcattcttttagaactttggtaacctttccagggaaaaatattttatttgcattttattcgttggatcttctttttttgaaggtgttgccttggtactatctactgtcaacaatgcgagttgcttcacatctcatttctcaagagagtctgttgcttcagagactagccatgtttgacatagattgtcgagcaaattattattgtggattatcaatttgattatataaataaatttaatattaaaattaataaattagtaaatagtttaaaacaagtgatctaataaaaaaagttctgtgagaaaaaaaaattgttgtagaggtgtttcaataatcgggcaaataagttgaaaagcacagaactagaagctttaacaacttttcattgtgtagctgtcgtactaagttgctactagtaattaatgttctccatggtgagtggtgacactattcgtttaggctagttcgctagttatatctgcttgtttgtctttatttttttttatttattttgattgaaataagcatttcagctgatcacagtgtaatgatcgagtagtgcatcctaatttggtatagagttttttattaacataatgaaaatggattagtaggggttgtttggttgcaggtcacaatttgccacacctaaagtgagtcatgccaaaatttcttagtcactcgtttggttgatgactcaactatggctagccacaccttttctctatatggccccacatgtcatacacttgtatgtttggctaactttagctaaattgtggctagcattttgctagccacacattttgtggcagccacaccttacctaatatgtggtttggcaaagttagtaagcaaccaaacatcccctacatctctggtctctgtccgtggacacacaacaaaaaaaattagtatagagtttgagatttacttctattacttattaaaataactattgagaggttgatcctgtcg

SEQ ID NO: 17419 - DNA, 1501 bp, Oryza sativa
aacatcgggccacgagagagagcgtcatcagttggtatcagagcatcggttgcctggtgaggattttagttttatagatttattttccctacccattatctacaaattgctgcatcactttttccttcaccaaacattagttttgaaccttgcaattttcattcaattttgctttattgagttttggtctactgtcgtgtcaagatctggtcttagccctagtttcatcttggtttgggtatgcatctggttgtctcatcggttagttttgttgcggtcatcccggtagagtttgtagattggtttgagaaaagaaaaaaaaagtatccgagtttcctgtttaagtcaaagattgatctcctactttattgcgcatgcatgcatgtgtaccggtgtaatttccatccacgacttgctgattccttgtgcatgcggatcgcgggccactttaatttccgtgaaaatttcctgtgcgcatgcagcctagcaggttccgttgagttagttggtatcggtaatttttttttacccagtttttttccgtccgttagccactgtttgataaagaaaaagagagataaaaaaaaggaaaaagccagcgaggtgcaaaaacagaaaaaaaaaggccgcaccaaaaaatagaaaagaaagaaaaaaattagaaaaaaggaacaaaaagaaaaatatcagaaaaagaaaacagtgtggcattttctttggctttcttggagagagttgtgtgataaaaccagttgtttctagtccgagtgttaatcatttgtttgcttgagctaggattgagtctaggcaaggctagcaacgttgagcagtactttggactattattcaatttcgcaaatctatttgatttttgctattccttttgatatagttaagtctaccaagatccacatactactaacctttacaggtccggctttgcaatcgctccactcatcaagcgtgtcattgtgccacgaaccagccacagtgattgacctgtgtttgcattctttgagaacatcataagaatttggtatatgcttgagtattgagtgccttcaaaagctccacatattatagattgttaagaactaacactttcttgtgagtttcttttgcttgctaatgatgtcaggtacaagttccgacgaaccaacactggagaatctagcgcataaattgaagggcatggaaaattggtatgaagagttaatgtgtaatagtaaatcatacaaggaaagcacatataaacatttaaaaaccttaagtgaaagcctggtgaaagtagtggatcaaattgagcaaatgaatcaatcacataaataattaactgaaaacattcagaatatgaatattggacatgaaaatattgtgcgacgcattggtttacttgagactgcaggtgaataaggtgcaggtgccactgctcatcgacaccaaagatatgacgatgaaaacgaagagcaatttgttgctgacgatgaggaggaagacaaga

SEQ ID NO: 17420 - DNA, 1501 bp, Oryza sativa
aagatcgagaaagattcgactggatttgatgtgggggatttgaccagatttgatggggagaatcggggacctacagctccacttgacaaggaaggaaagaaatgagtttttgtccaaaaccaaataggaaaatatatagcaatctaaaaatgtttttacccgttgcaacgcacgggcattttttctagtatattgttaaaatacgtaaggtttctgtttttttgtccgtcactttttttttattttcatcttttttttcctttttaccgttcctccattttttttcttcgcttcttttttccttttttttcacccgttgtttttttctcttttaacgttctgtttttttttctttttcgccgtttgttctcgtcatctccaccgccatgtcgatcggtctccgcattctctccttcaattgatagtaaaaatcgattcctcactactctcttattattttctccataatttttcctttcaatgccgctttaatttaccggactccctcattatttttcccataatttttcctttcaattccgctttaatttaccagatctaatctctatttaagagttttatggattcgctcagattttgataaaaacagaagagtagaataagtgcatcacaaacccttaaccaattttagaagatcaataaagattcgatgcgatttgataggagatcagttctagcatcacactcttccgggctttgatggggaggatcagttctagcatcacactctttcgagctttgacgacagcagtcggctatatgagttgctataatgtatagtgatcgaaaatgtttttatctattgttaaagacgacagtcggctatgcgagccgggcctacagctttactcgtgggctaggtcaaagagacgcacgccaagctgagagaggtagcgggctaggctgggataaaaatagaacgaagaaataatcttttggcccaaaaagagtataatgtatacgattcaaaaatgtttttatccgttgcaacacacagatattttttctagtttacatatatataatcatgtaactaattaggtaattaaccaaagtaatagcgtattaggttatctccaagactcttgggtggtctctcttatgttagaaaaccttactcggcagcagagaaacatgcttaattaaatgatcaacttttaaggtatagccaacttgaaaatacatgaagcggccgacacgtacggatctaaggacgagacttcatcagaccatgaccaccatacgcagaacccctatcgcacttgccaaaccgtcgcgatctccacaaatcgagccaaaaacattctgcactgtacacgaccaatttgtatctgcctagctagccaccctggcacgctgcagatacaactagcttttgctcgctcacttagtttcaactagagcttttgctcgctcgctcactactatcttcaatttatttatagctaaactaatagccaattcatacaatagttgctta

SEQ ID NO: 17421 - DNA, 692 bp, Oryza sativa
ggtttttctctcgcgttgagtcggacggttttctcgaaccacttgtagaaacaacggctttttctcgcattgaatccgattgttttttagatttggcttcgttataaacagtgtttttttctaatagttttttcagagtggctttttttcaataaacggtgtttttttcttgcgcaattttctcaaaccattttcacaaacgttgcatttctttctgaaatttctttcctagcacgtttgtttttctgttttttacagacgatgaaaaccgtatttttctcgtgttttttttgccttcttttctcgtgtgttcttttgcctgttttttctgacatttttttctcgcgcatttttcttgcttgttttttctcgagtgttttttttttgcttttttctaatataggagcataaatgacgaaataaaagtcgtgtaggagatggaaaaaaaattgaaggattctatccgacccaagcgtccatcaatttagttttttttttgacatttttttagagcagcttgtttttttataaacgtttttttcctgcacagttttttcttacaattttttcctcgcatgcatttttttattttttacggacgatggaaatatttttcctcgcgtgtttttttattttttaggacgacggaatcctttctttgcgcttttttctaacttattttctcacgcgtt

SEQ ID NO: 17422 - DNA, 1501 bp, Oryza sativa
agaatcaaaacgattccgactccgttgacgcgataaaaaagggcgaaaaaattgtctgtttctaaagaaaaaggaattatacgtgatgcggtaaaaaaaatcgaatcctattatatctagaaaggtttgacactatgtgaaagtggtgaaaaaaacccttcgtaaaagaaatgcacgagaaaaaaaattaaaaggacggaaaaaagcgcggaggaaaaaagtcaaatttatattcgtcgttttttagtccatttatatatcttctttatctctaatctaatctaatctaactataaaaagagaagtttctacagtatattaaaaaaggaaaaaatgcgcgagaaaataaaaacggtttaaaaaaacacgtgagggaaaaatgtcagaaaaaagcacaaaagaaaacgcgctagaaaataaagtttcgtagttctaattttctgattgttatcgacatggttatgcatgaaaaacgtatattatcattacgttttttcacccgttgcaacgcacgggcatatttgctagtgaaaataataatttcataactcgcctggaatgcactagacgaatattttgagtctaattaatctgtcgttagcacatatggattattgtagcacttaggctaatcatggactaattaggctcaaaagattcgtctcgcgatttccccctaactgtgcaattagttttttcatttatctatatttaatgcttcacgcatgtgtccaaagattcaatgtgatgtttttgagaaaaaaaatttggaactaaacggggcctacaccgttaagtaccctcgaacatctcaaaataaaatataatcttaacctatacttttatatatttatgctacatttttaaataagatgaatagccaaacgttatgtgaaaagttaacggtgtgatacattttaaaacagagagaatatatggtgagtgagttgataaaatgtactgattgtataggaagtagtttgtttctagacctttataattaaatttatctagttatatttaaaggtcgtatattgaattttgatcgctttttcatgttggcaccctaacacgagttgaaaaccaataggaaacgaatatgaaagggctttatttcgtaacttaagaagaagcacctcaagtttgtgatgtctttgcgtgcatataacttgtctgtgtgttccgtaatactacctctatattttgatgtatgacgctgttgactttttatctatcgtttgaccatttgtcttatttaaaaaatttatttaattatcatttattttattgtgacttgatttatcatcaaatgtttttaagcataacataaatatttttatatttgcacaaaaattttgaataaaacgaatggtcaaacattggttaaaaagtcaacggtgtcatacattgaaatatggaggagtagtagctaaacatgtgaaacacaactagtattggacctctctagctaatcatttcacttaaaagtaataactcatta

SEQ ID NO: 17423 - DNA, 1501 bp, Oryza sativa
agattttcccttattttcaagcatggcatggtgctcctgaaaatagctgctcttgccttgacacgcttccggtggtaatggttttctggggctcctgaaagacaaccaccaggatatgtcacctgagatatctttagcggtaaacacaaagcaaacaacaacaaatttgtttgaaactagagagatgttcatcatgccgaaagtaaaaaaatgttatgtgacgcagaccattgtgttgttttttttctcccttcgtttggtggggctatgatacggtaaatacggaaacgatcggtataacagcaaaaccatttccattttcatttccatattttttaccatttttatttttgtttcggtcgattaccatttccatatagctcggccggtagaaagtcgaaaacgaacgccggtcggccggtaattatcgttaccgttttcacccctagggctatcactatgtctattggaatccactatctctactacttaaaaaaataagaggtgcttccatcgtccgtcaaaaaaaccgggcgaaaaaaccaaatttgtccgatcaaaaaaactaggtgaaaaaacgtgcggaagaaaagaaaagaaaaaccaaatctgcccaatccagaaaaaagaggcgaaaaaaccggcaaaaaaacccaaaattgtccgatctaaaaaaaccggtgaaagaaaacgtccagaaaaaataggcgaaaaaaaaccaaaattgtctggtccataaaaaccgggcgaaaaaaacgtgcgaataaaagaaaagaaaaaccaaatctgcaaatatgtccgatccgaaaaaagggcggaaaaagaccggacgaaaaaaaaccaaaattatccgatccaaaaaaaccgagcgaaagaaaacgtgtgaaaaaaagaaaagaaaaaccaaatctgacgcggtaaaagaaaaatcgggggaaaaaacgaatatgtcttattcccaaaaataattgtccgatctctactattataaaaattaaagatgcttccgccattcgtcattcgtgtttgagtaggttataaaaattaaagatatttccacgatttgtcatccatgtttgagtctgttttgcaaaaaaaaaaaagcaaaaaaaagtctgtctcccctacgaaagcggcgaaaaaaaagaaaaataataaacgtagattcaattccaaaaggggaaaaactagacaacgaaaagtcgggaaaaaaaagcacggcctttactaccagtccaaataaaaaacaacctagaaaaaaagagagtccgattaaaaagtcagaaaaaagagcacggcaaaaagaaccaattttaatttgttttagtagtatgtatatatctattctctatctctaatataaacaaaaaaaaagaacgagaacaaaaaagggtttccttcatccgtaaaaaagcaaaaaaaaaaacctgcaggggaaaaactatcagaaaaacacaccatttcataaaaaatagtttgaaaaaatcatgcaaaaaaaata

SEQ ID NO: 17424 - DNA, 1501 bp, Oryza sativa
gcgtgtgttgtggtgtgagtgtggtgtatgtgagtgtgcgttctgagctgtaccccttcttaaaaaaagtttagggcctaatttgtcgttatatatgacatccaggtcgttattcacagtatcatcgtttaaatcaagtaaattagttactcctattaacacttctttgccattaaatttaagatatttttatcggtattttggtacgtcatacatatatgagtcaatttttaaattcgtttgcttttcgaaatacatatccatatttgagtcggtttttaaaatcgttcacttctcttctctatctctactattataaaaattgatgttgtttttgctggtaatttgatacgtcatccgagtttgaatcggttttaattttatatttcggtattaacctctatgtctactactgaaaaagaacgagaaatttccttggtctgtaaaaatggtaaaagaaaaaaagaaaaagtccgactgtaaaaaaaagtccgactaaaaaggtaaaataaaaaagaaaaagtccgactaaaaagcgaaaaaaaaaagcttctgtcgtagtaaaaagacattttgtcgtaataaaaattgtccgactccggaaaaaaaaggaaaaaatctctcaccagtaaaaaaacaaaaagtccgtttggttttttttaccggttttttcccgactttttttttcacgcgaaagagttttttttcccacgcgctaaccttttggtttttttcgtctggtttttttattccgatctctgttcactgcacacctcccgagcacttttggtttttccgtcagttttttctgtcaccattttttctcccgtgcgcttttttttacttatccagttttttaatccgatccgttcgccgcatgcctcctgctgccgccatatcgatactgtgttttctcctccaatttgattgcaaaaatcgtttccccacccctccctcatcattctctccttgattttccctttcgattcacctttaatttgttggatttaatctccgtttaacatttgccgatgataaaggccatcttccccggtcgtttttatcccgagtttcacgctctgattttggaaaaaaaaggaaatagtagatcgagtggatcaaaaatcctcaaccaattttaggtgacaggccaccgtactagtacgggattatcttcgggaggttgaagatggtagtagacggtgcgagctgggcttacggctccctttgttctaggtcgaagggaagtaggccaaacgaagggaggtagtggactgacctaggctaaaaaggaaggaaggctttcgaccaacgcacgggtattttttctagtttagtaatacataagaaatcatataaaagaatctatttaacaaaactcgcatgctaaagagacgatcgaactcctaactacagctcatgattttctaaaaatatatatatatccaaacgaactctcatagtaaatttcattttaactaaaccatataacaataataat

SEQ ID NO: 17425 - DNA, 1501 bp, Oryza sativa
actaagagccgggtcttagctaaccctttcctcaagaggttgcactaagcacttctcctttcactaagaggtatctcttctcttgcggaggcgagatccggccttcacaaacttctcccggccaaccacaagtagatcgatggctcgggagtgacacctagccgtctaggagtcctcaacctccaagagtaaaagatgatgcaaagaactcccggagatgatgcaagtgctcacaaatcttcacaaagaccacaagaagcacccacacaagctcaaatccacactctcacacacacaccaaatccaaatcaaacacgggtggagagatgaatcgaggaagcaaggctcaaatgaatgagagagagagagagagagcaagccaagggcacaaataattggaatggaaccagcagccctcacaagatctgcccgttggagtgcaataaaagggattttcggaacttccgaaacaattttcggaacttccgaaaattccagatctgagaaaaatcgaagtcaacgcccattttcggaacttccgaaaatacttccgaaagtacttccgaaaatttccagaacgcttctgtgtattttcgaaacttccaaaaatcattttcggaacttctgaaaatttccagaaagctctcaaacggttctgtgtattttcggaacttccgaaaatgatttttggaacttccgaaaatttccagaacgctcaaacacggttctgtgtattttcggaacttccgaaaactattttcgaaacttctgaaaatttctagaacactcaaacacaattctgtgtattttcggaacttccgaaaactattttcggaacttccgaaaactattttcggaccttccaaaaatttccagaacactccaaaagagaaatgcttcgaagaaaaattgattttgagcacacgcatcactccttatatgtctatgcatcatcccccttaatagtacggctttcctacgacacaatgcgaggaaaaagatacaatataccatttgatcattgccgcattgcatcgcgatgtcgcattcacgggatatgcattgtattacaacatgttgaggacttaacaaccttcacatttgcttgaataaaaatgttagtcctctctaatcgcattgtaatcaatcatcaaaatcattaggggcctagatgcactttcaattagtatagccactggtctaatttgacaaaattgcttcctagaaagcatctaaaaaagacagaaatgtttgtataggttatttaattacatcgagtccagttataagagttgctatcctgttgcatgtaacttacttccaaactgtactggcttacttcaaaacatataaatgttactccctctaaaacatgcaagtaattttctataccacagatgtaattgtctgacaaaattactcctctgaaaaaaataaaagctttactttcatgtgatgtgcaagttacttctccccccaattactgaattacctcaatgaa

SEQ ID NO: 17426 - DNA, 1501 bp, Oryza sativa
ctaagagccgggtcttagctaaccctttcctcaagaggttgcactaagcacttctcctttcactaagaggtatctcttctcttgcggaggcgagatccggccttcacaaacttctcccggccaaccacaagtagatcgatggctcgggagtgacacctagccgtctaggagtcctcaacctccaagagtaaaagatgatgcaaagaactcccggagatgatgcaagtgctcacaaatcttcacaaagaccacaagaagcacccacacaagctcgaatccacactctcacacacacaccaaatccaaatcaaacacgggtggagagatgaatcgaggaagcaaggctcaaatgaatgagagagagagagagagagcaagccaagggcacaaataattggaatggaaccagcagccctcacaagatctgcccgttggagtgcaataaaagggattttcggaacttccgaaacaattttcggaacttccgaaaattccagatctgagaaaaatcgaagtcaacgcccattttcggaacttccgaaaatacttccgaaagtacttccgaaaatttccagaacgcttctgtgtattttcgaaacttccaaaaatcattttcggaacttctgaaaatttccagaaagctctcaaacggttctgtgtattttcggaacttccgaaaatgatttttggaacttccgaaaatttccagaacgctcaaacacggttctgtgtattttcggaacttccgaaaactattttcgaaacttctgaaaatttctagaacactcaaacacaattctgtgtattttcggaacttccgaaaactattttcggaacttccgaaaactattttcggaccttccaaaaatttccagaacactccaaaagagaaatgcttcgaagaaaaattgattttgagcacacgcatcactccttatatgtctatgcatcatcccccttaatagtacggctttcctacgacacaatgcgaggaaaaagatacaatataccatttgatcattgccgcattgcatcgcgatgtcgcattcacgggatatgcattgtattacaacatgttgaggacttaacaaccttcacatttgcttgaataaaaatgttagtcctctctaatcgcattgtaatcaatcatcaaaatcattaggggcctagatgcactttcaattagtatagccactggtctcaatttgacaaaattgcttcctagaaagcatctaaaaaagacagaaatgtttgtataggttatttaattacatcgagtccagttataagagttgctatcctgttgcatgtaacttacttccaaactgtactggcttacttcaaaacatataaatgttactccctctaaaacatgcaagtaattttctataccacagatgtaattgtctgacaaaattactcctctgaaaaaaataaaagctttactttcatgtgatgtgcaagttacttctccccccaattactgaattacctcaatgaa

SEQ ID NO: 17427 - DNA, 1501 bp, Oryza sativa
ggagggatgtctgttatagactatttcttaaaatattattttactctattatgaacttttttgtcctcgacagttggtggtggtgcggacaaatcgacggtggggagggaggtctgttatagactatttcttaaaatactctctccatctactttttatagtcatatttccgaatctgaaaaatttatttttgataggcatatttttcaatccaacaacttatcatctaatgactttctcggatttaatgcgtgactctccattcttccacatatgattggctacatgggcatcgagaaatataaatattaatgaatcgcttttttacgaggaatgactagtagcatgtttaaatagatgataaacagaattacttatcattggtctgtgtgccaagatgaaatatgactatcaaaagtagatggagggagtattattttactctattatgaactttttctgtccttgaaggtcggtggtggtgcggacaaatcgacggtgggttttggaggcgcctgtctgttgtggcgtggagacggcggtgtggccccagaggtagagacgcagaaccacccccgaggtagagacatggagtagatcagcgatgcgcatggcgatggtagtgggcagctctggtcggcagttgcctatatcggtgatgcttgggcagcggtcgcgcggaggagatcggcaaggtcgttggcttcggcggtcctcgacatggaggcgcggagtagcaccatggagacgacggtgtggcctccgaggtagagacgcggaactgcccccgaggtagagacgcggagtagatcagcgatgcgcgtggcgatggtagggggcagctctggtcggcagttgcctatattcgtgatgcttgggcagcggccgcgcggaggagatcagcgaggtcgttggcttcgacggtcctcgacatggaggcgcggagtagcaccggatgtgggtggcgtgggaaagaatatgggagggggtacaccgctactagacagagaataaaggttgcatgtcggagtaatcggaagcgttagatccaaatacgacgataatcctgaccttgtatgaagtatgtaggatgtaagactattgttggtgaaatatagataaaaacaaaaagcttaaaaatgaaaaaagaaataatgaatgaaaaaatagaaaaaaaatacggggaaaatttcggaaaagtaggaaataaaatgaggaaatatacaagaaaaaaaaggaaaaataataggggcaataagaaaaaaaaatgaggaatatgtagggaatattagaaaaaaaatctatatctatatatataactaataaaaaaataagtactgcttccccgtatattttcgtctattttctttttctcgcctttttttttattttttccagtatttttcatcttttttaattattttttacctcaaaataagtaacgtttgatatattttcattcgtattcttatttttgcctttttttgttttttttccgctt

SEQ ID NO: 17428 - DNA, 657 bp, Oryza sativa
taatttactcatgatagggacaacaaaacatccggattagttccacacctcttgactagtggattgattcccggtctcttattgtctctatcatgagtaaattggctcccggcccggaataattcccggtctctcattgtatctatcataaatttcttactgtacttgtcattcccggcccggattgaatccgggcgtaaccggacaaggccctagtgattatgcgcacaaccaggtggtgcggactgcggagagtaaatcattgatgcctttttttatcatcatcaaaccacaataagtaatcttaatttttcttagaaatattacgattgatttttccagctagtagttccacacaataaaatggcgagattcgcaattggacatgattcggtactagaaccctagtttcctcaaattcgccacgaagagtcgggtaatcgaccccctcgcccctctacgccccaaggtcgaaaaacaccgagatcaaactagcgcatcgcgcacgcaacagcgaatcccgcgcacctcgcgcaaatgttacactcgcaatacccaaggcacggggagaggagggatccctcacctgctggggaggaggcaggtcgcggcgcgacctcatgctcatcgacgacctcatgctcagggaccgcgaca

SEQ ID NO: 17429 - DNA, 193 bp, Oryza sativa
aaattttagttaagcaaccggagggtaaatctgtctagtcaaccattttggggaaaacttctgcatgattgacctctgagatgcattctggtcgtctgatgcacacagcttcaactttcagttggatactttggagttttaactttccagcttctgtttctctaatctgcaattctgcaagcaggcaaaatgt

SEQ ID NO: 17430 - DNA, 1390 bp, Oryza sativa
cgtaattaggctcaaaagattcgtactcacaatttacatggaaactgtacaattggtattttttttatccatgtgtccaaatatttgatgtgacggaatatttggaagtttgaagggaactaagcacagccacaatgcatcttccaacattcaaaacaagtgcaaacaaaattcctcagcttcccaattttagctgacatagcgtttatatggctcctttctacaaagaatgagaaaaatacatccattttctttcgttcagtttcaggcccaaagaaaaaagacgtcatggtactttaatactacatgaaacgtattaaataaatgagtgtaattgcaagttagaattacataaacacgaatcttaatgcaaaatcctataaacaaaatataaaaaaagaagccccaaaacctgtcacaagtaaaatagcaaaacctatctgtatggagaataatatagctaccaacataaataatcactacttaaaaataattttcctggacgaccacatcaatagattgcaggtggaccaagtatctgtgtctgtaaaaatcgactcacatttttacagacgatcctgttaagcagccgcaaaaaaaaataaggttatttttctagatggacatcttaagaggccaaacgggaaaaatatattttcgcagacggccatcttaaacgtccgcccagtagtttaaattatctcctcttttccctcatagcacttctattttttttcaagccatcctcatcttctcttctctctctcacctcctcttctccacatactactctctcactctctcaaactcccgtacacaaaaatagctattttcgtagacattttagtacgtgtgggttgtcctaccgtacgcgaaaatttctcttgagccatgagaaaaatcacttttgtcctagtggtagccctattggcaaaaaatcatctgcccaacatggtattgcagtgtcgttagggacagacacgagcagcacgttctgacaaatctgcatatatatcttcatcctgaatattctttatagaattatagtctacaaattcaaaactaatcaccaagcagatcatgagcatgtcatttcttctcttaaaagtgccttacagatcaatcgttacatgttatcatttctttcgccgggcaaatcatcatatattgtcagaatcgaataacaaaaaataaactgtgatcttaatccaaaatcaagtttaatttccatctacatgtccgcacatttagtctatggcatgcagtatataacccacacgcttctctacgtttcgacacagccaaagcttcaaaacaaaacatctcatcagtcgagtacggagctgtgctcagagcaatggctgacttccttcctctcgcgatcctgttc

SEQ ID NO: 17431 - DNA, 205 bp, Oryza sativa
acaggcaccgatccccccttcctatttaaaactctactctcctcttcccttcctcctcctcacctttttttttctctgtctaggtacattccatagcttcgtttcgtgagatcaatcgattgagctagatgttagctgcaggagaaaggtttctaggttgtagaggagtagcgtgagggtgaggaggttgtggatgaggtaggca

SEQ ID NO: 17432 - DNA, 266 bp, Oryza sativa
atgtatagacaaggatcggatgggatgtttttatttcttatatgtatgggcttcatataaggatgtattgaggattctatggatgtaaggaatgatgttgggattgatggagggatgtatgttttgtatggttctcaggatatagcactgcctgtaatttctgtcatttgatgtttgcctgtgttgtgtgcaaagttttgctgaagttttagcagggctggcacgtcagcgccatgctaaatggcgctgacatgtccaaactcagc

SEQ ID NO: 17433 - DNA, 1501 bp, Oryza sativa
cggtgtattttttataaaaagtttctatacgaaagttgtttaaaaaaatcatattaattcatttttgaaaaaaaaaataactaatacttaattaattatatgttaatagtctgctccgtttttcgtgcagaggatatcggatccaattcgggaaaccgagatgggggcggcatgtgggagcgccggtcccacacatctggcatgcgggagcgttgccgcgctcaccacgcccgcgggaccggcgtggtaccgcatccccggcctgcgggaccggctgctcgtcctcgctcccgcgcaaccgttccgtggattgggtctattcttgtaaattagtcacagccaggtatataaatgcaatatatgaaaaaataaagtatattttcaaatttctttcgagaaacgaagggggtggattcaacggggtgattatgcacaggatccacacatatggcctccccacgtacaactgtacagccgcaaaaaggggatcgggatggtttggttgacgggttggaccggtttgtgcgtaaaccatgaaggtattcgcattacgatggctagcttggtgcttggagatggtgtgttttccatttgcaccgttcagttggcaccatcggccgccgtacgtagcccgtaagtgcgcacgcgcgcgcggggtgaggtctgaaaggcggcgacgacaaaaccatcaatcacattaattactttttgaattccagagaaactatcgctgtgtttagttactaaaaaaagttaaaagtttgggaaaagttggaagctttatgtgtgttagaaagttttggatgtgatgtgatgtaatggaaagttggaagttaggggtagttggaggagaactaaacacagcctattatgaaatcggattcagagtcgtcaacagaaacaattctacggttcttgaagaggtaccatcaggtatcaaaaatttagtgtaaaatttaatatctcatagtacctttgatacctcatagtacctaggtactaagaggtaccaaatttacaatagaaaaagtggtacttcatggtaccttctcaaagaccgtaaaattgctcgttcaataaaggtttatgtctaggagaaaagggtcgggggagatcatcgggtctagaggaatggcattggaaacgaggaaatagccaagccaatcctttagccaaactaaatattgattattaaaatttaagcaaactaatttatttgattttttttcaaagcaacttctataaaagaaagttttcgcagcagatgaaaaaatgctaatgaaaatcgaggaaatagctaagccaatcctagtttagaacatgcctatttaggggagcttctggcaactgcagcttctcgtagaatctccagctgctagaaactccctcaaacagtttatattttcacccagattctgagaatccgtagttgtagaattcagaaaataaaatagaagtcagaagctatgtttcctagcttctctagatatgttttcttgct

SEQ ID NO: 17434 - DNA, 548 bp, Oryza sativa
tttgtagttgtttttgacatatttgatagtagtagtatataccttttgaacatgattcaaaaccatttacacacatgccggacttggtgtgcttaattcagtgtctctgaaatctgaatgatgctactctcatggacactttgcagttttgagtgtctgaataacgtcttcatgcatttgcactatagcttattattctgaaaacagaaggaaaaaaaaccatgtattgatacgtgcagaacatgatggcccaatctaattaattcaaattagctatgcatgttgaggagctgtaacaattaaggaacagtactgagtagggctatcagtacgtacaatttggccatagatttttcccccatctgaagggcatcaggacagtggaggagacattgcaaggacatttccaagaagacaatgatcaattatattaattttagacagctcacttgacaaatatacatgtatgtccccttacttaattaaccccggtcttaagagctaattaatccatcgacattagtttaactcacactaacctccgtcga

SEQ ID NO: 17435 - DNA, 1501 bp, Oryza sativa
aggaaaaaatcaggcagctgaagaatgaactgaatgtttgctgaatttacagacgtttcggatattgaaattcagtttactcattcagaaaaagtatatggcactgtacacgcttgaggttgtaagatgtagcagcaccaataaataactttgcttgttctaacaatctgtctcgagagtgcacctgaatttaggaatctgtcgctggtaattgcatcataatcgtgattcatgagcctcggttctgaatctgaaaatggttttaattatatatctgttcctgtaatccagtcttgtcaagtccacttttaatacctagtttaaatacttttaagacggcatgattataacataaagcagaattcaggcttaattaacctaactaacgaacaaaacgacgttcttttcatttcaaacaaccccatctaataaaactgtttcagtgagacagaaaatgatgtgagcgatcgatgcataagtcctaacgcccataaggacatgatgaaccaagccgtgctgatcgattgatgcatatatgctctgttcaggagagcacgagattttaagaagttgcatgagtagccagctgtggtaaaaattttaaaaaaaagaagctaactttttaaacctctaacttctaattttttttaattataaaagtattaccaaactgtttaaaaagctcgagattttttagaagaaattttagatgtcagaagctcaaagaaaaaattgtgaattttctttgctcgtcaactgaataatttcgctgcgtgaccggtgacggtttgcgacagtggcctgtgttttcgcatggcacaccattcaatttttcagagaccgaaaggagcaattcaacgacaaaaccacgtggaaataaagaaaccaatggatcgatcgatcgatcggccacactctctctccgttgcagactatgccaaatacagtgatggaataccagttctattatctttttaaaaaactgagaaataagcactgcttttcaccttttaaagaggctaccacacttttctaccgttaatttaggataaaattaagctttgtcataggcgtagaggcgattggtcttgtatattcccagcagtgtgtgcaggtgctattggcgcatgattgtaagctcggaggtgagcttgctgagttttttttacaggtttttttagtttctttctaattgtagtttttagggttttagtcttgtgttttcttctgctatatattgtaacatcgcacaaaattatgagtaataaatctcgacattcttctaaaatcgaggtacgaggcactgcgaacaattttttttttaaaaaaatcccctacataatactttcaccggttaaaaatatttgatgcatgggatataattcaatcaaaatatttaaaaaattgttcatcaactgtacattaaaataaattgtgaaatctaataggtttaaaacactattccttatcaagacaaatatgctcatgccgcattgttttt

SEQ ID NO: 17436 - DNA, 1501 bp, Oryza sativa
actcgccggcaagacacacgagacacggcgatgtatacaggttcgggccgctgcgaagcgtaataccctactcctgtgtttttgtgaatttgtgtatgaatgagctacaaagtgtccgcccccttctcccctgttctaagctcttaatctggaaaagaatcaaccctctactctgtgggcaaggtcctccttttatacttcaaggggataccacatgcaccctttcctttccaaactggacttttcttctctttatgaacagagactggtatggttgccgtccgaatcacacttcgatgggacagcccacacctacctccactcccggcggagacgggcgcaacgtgagatcgtggctgcccgttactgacgcgaccagtgtcagaccggtcattcttgtccaccacgcgtcagattaacaacgtgcatgtttgcccttcttcgtgtaacaccttgcctgtaatggttaggatgaagcctggtattcatctaaccagggctaacgtgccatctctaagaggtaacacgctagcttcggttggagacgtgtgcctagaggcactcgtcttgacgggacggggcgaggcgtgcgtcagaccgccagtcgccacctaaccgttgatctgaccggtctgtgactggtcacagaccggataaaagagcgtgctgtactgcgttgcacgcagcgtgacacgcttgaccagactgcaataaatgctgttaggtgagcacagctgtgctcacttatcccatatatgtggcgcagacttctttaaggggtcggggtgcctcggccctcggggccggggcaagcgcaacccgaccccccctcgggggaaatcacgaggagggcggacacctcaccctcgggcccgacgtccccgaaggtgccaggccacgtgggcgattgcgtctgcctcaagcctctggtcatgatactcccggtcccatatcaccgacagatggtctgtcgattcatccttgaaaaattccaacttcgaatgcatcgcagttaaatctaaaattgaacattttacagtattatgaatctagataagctcttatatttagaacgaagggagtatgttctttttttaaaaaagaaaaatgagtgtgtgtaaaagggtatacttttgtgactgtgtgcgcgtataataggtatctgtggtgttgtatattttccgtgtaacagggaaaatcattacgtttcgttcgtctacagttgattataagactatagggtgtgttcggatgccatttttctcatctcatctctctcgtttttatatgcacgtttttcaaactgctaaatggtgtgtttttttgcaaaaagtttatatacgaaagttgcttaaaaaatcaaattaatctatttttttaaaaaaaatagcaaatacttaattaattacgtgctaataggccgccccgttttccgtacgcactatgcaaagttcccatccctggtagcgaacacattatcaagaaaagaacttatgtgtac

SEQ ID NO: 17437 - DNA, 746 bp, Oryza sativa
gaccccccctcgggggaaatcacgaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatctcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctatttaagactgccacatcacttgagcagcgcgcgaatctgggtgagcagatttgtctcgctcggatatacggtaacgccgcttcggtcggcgagcgtaattaacgcgcgcacgatacaatccgtttcgattgccacaaccgcatatccacttcacgcgccgtaaacgggcgaatgggattagtggaagcgtgggcgcgggatacgagggagcgagatagcgagatacgagggagcgaagtagtgggcgcgagaaacgaggagccaggcccagcgatggcaagggtataaaagcatcgagaaaaggatttgctcccttcctttcgccattgttcctcttgccttcgctgcctaagctctaactctttctctgctacgccctactttcgccacacacgctcgttcccaatcatctcttcctccaccacca

SEQ ID NO: 17438 - DNA, 1501 bp, Oryza sativa
gcagtttgaaaaacgtgcatataaaaacgagagagatgagatgagaaaaatggcatccgaacacaccctatagtcttataatcaactgtagacgaacgaaacgtaatgattttccctgttacacggaaaatatacaacaccacagatacctattatacgcgcacacagtcacaaaagtatacccttttacacacactcatttttcttttttaaaaaaagaacatactcccttcgttctaaatataagagcttatctagattcataatactgtaaaatgttcaattttagatttaactgcgatgcattcgaagttggaatttttcaaggatgaatcgacagaccatctgtcggtgatatgggaccgggagtatcatgaccagaggcttgaggcagacgcaatcgcccacgtggcctggcaccttcggggacgtcgggcccgagggtgaggtgtccgccctcctcgtgatttcccccgagggggggtcgggttgcgcttgccccggccccgagggccgaggcaccccgaccccttaaagaagtctgcgccacatatatgggataagtgagcacagctgtgctcacctaacagcatttattgcagtctggtcaagcgtgtcacgctgcgtgcaacgcagtacagcacgctcttttatccggtctgtgaccagtcacagaccggtcagatcaacggttaggtggcgactggcggtctgacgcacgcctcgccccgtcccgtcaagacgagtgcctctaggcacacgtctccaaccgaagctagcgtgttacctcttagagatggcacgttagccctggttagatgaataccaggcttcatcctaaccattacaggcaaggtgttacacgaagaagggcaaacatgcacgttgttaatctgacgcgtggtggacaagaatgaccggtctgacactggtcgcgtcagtaacgggcagccacgatctcacgttgcgcccgtctccgccgggagtggaggtaggtgtgggctgtcccatcgaagtgtgattcggacggcaaccataccagtctctgttcataaagagaagaaaagtccagtttggaaaggaaagggtgcatgtggtatccccttgaagtataaaaggaggaccttgcccacagagtagagggttgattcttttccagattaagagcttagaacaggggagaagggggcggacactttgtagctcattcatacacaaattcacaaaaacacaggagtagggtattacgcttcgcagcggcccgaacctgtatacatcgccgtgtctcgtgtgtcttgccggcgagtaatctttccacatacagagagagcttgagattgcaccctaagcccccggccgaaccggcaaaggggggcctgcgcggtctcccggtgaggagccacgagctccgtcatctggcgcgccaggtagggggctcagcgtgtgctttctgagctctcgcactcttccgtgtgcgccaagtttcccttgttctgcctaa

SEQ ID NO: 17439 - DNA, 1501 bp, Oryza sativa
cttggggggtttaatttggtttgttttgaatttttaaggttccggatgggctgagccggcatgtagtctcctccaagaaagcgcaggctaattggtgcgtaattcaattcctcctacttatgttttcttcctccttgtttcgagctggaaatggatcagagccgatgagctttgtcgtaatcgcgagggattgggcgtgtgaaaattttgaaagcgacgtgttcaagaggaaaataactcttcttttttttttgaaaaaacaaagttcatttctttcttttggaaaagagaatttcctttctttttcaagcaagaagaaacaaaatatatcattcgctgattttggtgacggaattgtggttcagtacgtcgaggggtatcgagagataactttactaaactgaaccgcaataattgagtgaagcttaatcaggcagtggagaattcggtaaattaaatcagtcataaatgcttgcagtaattgtcattagccagtaggcacggtaggatttcctcaaaccgctgccatgatactagcagggtttactaaatcgtttgggatcaggattatcgtcacctcatggtttagcggtaaccgtgtgtttaccgtgtttaccgtggttttaaaaactgaaaagattattagacgcgataaatcgcgtgataatcgcatgattttgtaagccctggacactagtagtctagtactactgtgataaaatttcctggtgctgtaggtacaagaagctgatagtgacatggaagaaagccaggccgacgccgaggacgccggaggaagccgcgcggctcgtcgtcaccacgctgaagaatcatcagaaagcagacgtcgaggtatatctcaaagattcaaacttccaatgtcatcatactcatattctaggcgcttgaattctgaaagtctgaacaatcgatgcatgcctgtttatgcttgtccagggattcttggttttctatggccttccaattccaaatgcagcagcaagtacccctgcgcctcacactgcacacgtcccaaaacctcaaggttgcaagtttgagctgcacactctcccggtgagactgattattactttctaatctctgaattttcctcgcaaaaaaaacaaatatcatctgaatttttcatgccaagaaaggctcttggactgacaagtgcacctgctagtttcttaggtcgatgcaaaggccgtggccgacggcgacacgatcaccgtgtacattgacacggccgatcctcgggagtccggcaatgttccccgtgaaattcagaaagcggcggcggaacggacaagggcgcgcgcggccagggattatcagaaggccgacgggttgcagaagatgatagctgatgcaggatataggtcatcagcttgcacttcacatcgatcaatcagttttttgttaaattttcagagatggttaatggttcaggctgtgtgacaattctgaagttttcaatgcaggcaagttcctaatgcga

SEQ ID NO: 17440 - DNA, 191 bp, Oryza sativa
cattatgattctaaaaatcaaacatacctattattgaaattcatttttttattttctagaagtcctgtcaaccgtcgcgggctctgcaactatactcttatacaccctgcccgctgcttctcctttttattgtcactgagattttaaaaatcgaatatgatgatcaatgtgttttttttttactttataga

SEQ ID NO: 17441 - DNA, 387 bp, Oryza sativa
ttctcaatatccttgtctacttgagtgacacaacagtggcgatgtgaaaaagaagatttgaaattcgtttttgttcctaacacactgcgaaccttttttttttaggaaagccattcggctggaatttggcaaatgggcaccaacatgcaactgttggaataagtctacttgccatccctcaactttacgtcgagtttgtttgaaatccctaattctcaataccggaaatattgaccgcttaagtattcaaaaccatgcaacttaggtcccatagcaatataaatcctactttaccttgtttttgctggcataacagatctccgggcctacttgtcaggcatggtgcccctcatcccagccccgcatcgcctccaccactgcggcctt

SEQ ID NO: 17442 - DNA, 1501 bp, Oryza sativa
caggagaacccggcgagcaggccggccatgtcggcggtgaacgtgatgctgagcagcggcacggtgtcgctcaaggcaccgtccaggccggcgttctacatccggaagggcggcggcgacgacggcggcggcacggggtcgtactcggggtcgttcgtcggcaccttgccgtcgtccggcaggtcggcgcccatgtcgcccaacgaggtgtccatcactgagctcgagccgagataaggaagaaaaatgtagcagagccatgtcatgtcacaggagtgaagggctccggggatgcctaatttgtgattttgtgtgctgtgatggtgtcctcaagatgctacaatgtatagaaacaggcagtaatcgttggcaagaacaaaatgccagcaaaacagtatagcactttagtgttgtcttttaactcttatggcgaattatgctgagataattgcatgatttgcaggtgttcattacaaatatattaccctcgtttcatattataagtagtcttgacatttttcttactttaactttttcaaatttaactaagtttataaaacaaaattaacatctacaacaacaaatcagttttattaacatgtaatatatttttgtagtatgtttgttttatgttgaaaatattgttatatttttctataaatttaatcaaactaaaaaatgttgattagttaaaaaggtcaacttatataatattgaaatgaatagagtagtgtactcactggtacatgatttatgtggttgaacatattcgagcccacatgtctacgtatgccaaatgctcaactcaacaggtaaatcaagatacataggaggaggtaaataaatcatagtgcactggaggaggatctaccttgcaggacattgccagatattcctagggggaatgggaataggtgttatgtggatgctgcttgggtgaatggtttagcacaatatttttccacatgccaaactctcataatgcgctctttataaaagctagtactatcttgatagctcaatcttctttgtaggcagaattactggctctgatggcaatggagatcgcaaaatttcttgactttgcaggtaccatctttaacaataagaaacttcgatgctgaaccatgacattggagtctcagacggtcagaccctgaaagtttgatgcaagtcaaatggattatcaacagacaacagggtagccgacaagatagccaaggatggtagacatgaacaatcttctgatacggttcatattttgtcaaaatatgttgcatatttaaagtttttttttttttaaaaaaagaggccacatgtctacagtgaacagtgcgtcagactggcagtgcagatagcaattacctttctttaatcctcctgttaatcacagattctatagttttaatccatcgcccatttgacatcagatcatccctgtgctgtgtgctcgatccagatctcccgccggtagccaccgcgcgtggtcgccgcggcggca

SEQ ID NO: 17443 - DNA, 533 bp, Oryza sativa
  unsure (1)..(533): unsure at all n locations
tatatattctagtgtaaattggtaactcgtttttagacactttctattaaaaaataaatacaaagcagagaacggtatgaaatgtatacaatggtgccatagctttgatatacacgcactaattaaactcagctctacctagctacatctaatcggaaaaaaaagcctcccttatctacataatagcttcccttcatccacaataagttcaaatgcgctacaaaacaatctgcaataaaaatatcatttaaatgatctccaataaataacttctgtcgtatcaccagtaatgaaaaccacaagccctttagtgttgtactgttgttgtatactccatccgtttcgaaatgtttgatgccgttgactntntannacatgtnttgttctttgttttatttaaaatatttaantaattattaattctttttctatcatttgatttaatactcaaaatatttttatgtaagcatataacatcacatatttcacaacagactttgaataaaacaaacgttaaacatttgctcaaaagg

SEQ ID NO: 17444 - DNA, 599 bp, Oryza sativa
caaggcaatttgctgataagtagcaagacttactccctctgccaaaaaaaaaaatctggacaaagaatctagacaaaagacagtctagattcatagtcctaggctacgttcggatgccccttttcctaacacctctctcgttttccgcgcgcacgctttccaaactgctaaacaatgtatttttttacaaaatatttctataagaaagttgcttaaaaatcatattaatccacttttttaaaaaaattagcaaatacttaattaatcgcgcgttaatggactgctccgttttccgtgcgtaggagatttgttcctatcctcccctagcgatgtagcgaacacagctttgtgagaggttacatccctttcttggttgggttgagtttcttttaaggatgaagggtgcttcctaggttgagttcttttaggacgaagggtataattctcagctttgctctcctagttacaaaaaagtatttattataggttaactaattgccgttgtcgaggggttgccgtggtctacggctttgaaaagaagggataagggaggcagtttagtgggaactggctcagagatagaacatactcagcagagt

SEQ ID NO: 17445 - DNA, 232 bp, Oryza sativa
aataagagtttgtatagcttggctgggtgttattattgtatttcagaactataatttatgccattatctgcccacattttcagcggtgatttgtgtgggaagggtaaattaatattctatagttgctataaattagttcttggcaccttttgttatctaaaagacggttttatcgggtgcaggtaaaaagagaaaacagaaacagcctgggatgttgctgggatcctcaagc

SEQ ID NO: 17446 - DNA, 413 bp, Oryza sativa
ataatagccccgatagcacaagccatcgagacgggttacctcttgtcgagataactcactgaaaagaacaaaaagggtggtgatgcgccgaagttgtattggattgtctcccgtattaaagtggtatggggttcatatttataccccgaggacaaaattgggtccattatggacacgacttaaactttcccaaagataaaataaaacaagaccatacggcggtctattaccaatctctatcaaacctactcaaatatcctaattaatcgatacaattgtcataatcgagctctatctctaattggcgatgacagttattccaacccaggctcatgccaagcccaactcatagcatatcggcacaatcagccacttgcgttatcggcttgaccaaactcaactttgtttctagc

SEQ ID NO: 17447 - DNA, 628 bp, Oryza sativa
ccttttatgcaggtgtaacagttaaaaggttgagctttcattgctgactgctaaactatataacaaaaggtttacactgatcatagaaaaagtttgttctataatgtgcacacatagtcatttgttactttggtagtcatactatttataataagaaaaaatgttcaagagttccctgttggagtccaactagttgcatccccaaaacaaagtactctatttgtttcataatatagtaacctagtatcactattgtccagatttataatactaaaatgtgtccctttttatatgggtctcttttgtactaatttttatttggccaccatatgcacaaacctgagaaatactcctactagacagctagtatatgaaagcctagataacgtgctagctggatggtttgctgccacctttcctgacatgactctagaccgtttcttcagagcagcatcgatcctggcttcccttgcaatattaaggatgactattgcttgcttctcacttctcatgtgtagcatccaggaacattaacatcatcaactcacgaggctgcattctcctttgcctccctggcacagggctgcacctttaccatttgtccctgcacatatgccagagccagaca

SEQ ID NO: 17448 - DNA, 166 bp, Oryza sativa
tgggcaagaattaagataagataatatcatatttcttctctactagtataaaagtttaacatgtttttgtcaaaaaaagattctcaaggccagtctaaaatctattactgttcacttatcaaaaatctctactcttcgcttgttctactcttcgcttgttccaaga

SEQ ID NO: 17449 - DNA, 440 bp, Oryza sativa
aacagaggtagtagaaagcattaggatagggagaatagccaatatgatccctaaagtttcgctcctggatcattttagttcttaatctttcatattgtacaaacaagttctttaaatttgtcatgtgggctgatatagtctttggtcccaccaaaatcgccacatggacatgccacgtcaccttcctatgtaaaatctatatgatttatccaatttaccctcacatgtatcataggaaaataaaaacaaaagaaaaagttaaaaaaatatggtatatgtaagagcaaaaatatacttcaaaagggtgaaaaaaagaagtatttttttcctatgttatgtctaattcacacctatatttatttttctatgatatacgtaagggtaaattggacaattcattatcgattttgcatgaatgatgacatggcatatccatatga

SEQ ID NO: 17450 - DNA, 1501 bp, Oryza sativa
atcgcctaggatattaaccttcaaattgatgtcatggtcgtgtagaggattagctagccttccgcttttccacattagaggcgaaatcttccatcagtcaaccgtggtcggcgagggattctctgacggcagcaggagccggcggcgttaggaagggcagtggcaggatcaggagtgatttgatccgtgcatatgttaaaaaaaagcaaaacaaagcgtcggtaacaattatgggcccatccaatcctatatggtcaaccaactaatttttgggattatatttttaggtggagatgaaatagatttttaggtctaaaattttttagaatagtcccaatccaaggaagtaacttttgggcctgaatcggagatgctctaaggctgtgttccgtacggaaaacagagcggttcattagcgcgtaattaattaaatattagctatttttttcaaaaatggattaatttaatttttttaagcaactttcatatagaaacattttgcaaaaaacgcaccgtttagcggtttgaaaagcgtacgtatggaagagggagaggggttgggaagagggggtgccgaacacaccataaggctatggtgcttcgaatatgaagctgcatatttaggccgtcaaaataattcttcaaattttcaacttttccatcacatcaaaacttttctacacacacaaacttccaacttttctgttatattgtttcaatttcaactaaattttcaattgtggtgtgaactaaacacagccttagctctacattgtttgcttttatgctcttccatgctaacctgaaagaggtctacagcggattaattgcaaacttgcagtaacatatatgctactcactggcagcatttgcacggagcttttttttttcagcatttggtcatttcaaaatttacgctgctatggtacattttgtatggagttgcaaagtgcgcatcctgccaatcaagaccaaaaactttaggcagagagcctacgcaaactaaaaaaatgaatctaacacatgatgggtgagactaaattaaacaaatattattcctagtaagagattatcataaaaagttaaaatccggtgtaatatgtaaaccaaaacacttttccccgcaaagcaaacaatcaagctttttctagtcggaaaacccgttttatgaaatatttggtaagtttacatggaatatcataaaaatagccctatcttgaaaataaaaaaaatgaatagaatgaagaaagcattagggtgagtttgagaagagaggaaaagagaagatatataaaacgaggtgagccattagcgcatgattaattgagtataaactattttaaacttaaaaaatggattaatatgattttttaaagcaactttcatatagaaatttttttgcaaaacacacactgtttaatagtttgggaagtgtgcatacggaaaacaaaacaaattatctcacaatgttaccctattgaatgcagccttagtgatgtga

SEQ ID NO: 17451 - DNA, 1501 bp, Oryza sativa
acaatttattactcaacgtttttcaaacttctaatagtgaggaacctattacatttaggcactgtttcgcgaaaagaaaattttttagatatcacatcggacgtttgaccggatgtcggaaaaagttttcagacacggatgaaaaaactaatttcataactcgcctggaaaccgcgagacaaatttattaagcccaattaatcattcattagcacatgtggtttactgtagcacttatgactaatcatggactaattaggctctaaagattcgtctcgcgatttccatgtaaactgtgcaagtaatttttctttttatctatgtttaatactctgtgcatgtgttcaaagattcgatgtgacgtttttgggaaaataaattagaaaataaacaaggccttacaacatagtatggacaccgcgtaagatatctatttccaactatttaccctatattaattaggagtataaaattactcgataattatgcaagtagaccctagtaatttttcttctcaattcaccactgacttctgtcaacccttcatctccaatgtagtaaaacttggatgcaggtcatctgctgtaatactagagaatactatttgcacagtgatcgagtcttgtgctatagtgatttgcattagatatatactgtagccaaccgtgtctgattttactatcgacctcctttttattgtagcacgctggtttacaccgttggatgaagatctaacgcatcagaacatgagctaatgcagcacctctgcgttttctccttcagtgcagaggatcccatctgtaaaactcttgatttgcaacatgtacggttaaccaaattcagtgtttagctagtagtgctaaattgtaatgacttatcttgcatggtcacgttcctcatacaatgatttatagaaagtttgtatattttgttctcgtaagtcgtaactagataagtttaaaactatcagagtaagaaaatagtaatgggattgtagatctttcatagttaaaaactttcgaccattattcttcttattaataaatgatgcgcagatgtcatgcacgtatgaagaaagaaaacttttggtcatttttcaaaatcttgataaaatctaatctctcatcactccgcaatcacttatttattagataaaggttaaataaatagttgttctaacctagatatgaaataaatttacaacatatagacatttacaatttaaatgtaaaattacccaagataaattaataccatttatactaataaaattaacaatagaagtaactaagttatatgttatgtagcacattgtattttagacttagtggtgtacaattttagatgacaaaaaaaaggcatttgcgcatttgaccctattttgaaagctaactaccaatttgaccctcttttatcaactttacttatttgaccattcttttcaaaattgaagatacagtacgaccctattctgttaagggcttctaacggtgttaactgg

SEQ ID NO: 17452 - DNA, 361 bp, Oryza sativa
ttggatggccatggcgactgaccttagcagtagcccagagctgctgctacaacgacagtatctaatctactaatagcaatgatctgcaaccggagtattcagaaataaaacaaattaaggtgcagcaatacataaaaccggtatatgcatatatatgatctttagagtcgtcatataataccatgatcatgaattggctcctttaacaaattgtacatactaaataaatttcaatgttgttgaatagggacagtataaatctgaagaagaaacaaatccaaataaatgtcagtcgtgttgaatagggacggtagaaatctgaagtgacaaatccaaataaatttcaatcctattgaatagg

SEQ ID NO: 17453 - DNA, 1501 bp, Oryza sativa
aaaatgtaccatagcagcgtaaattttgaaatgaccaaatgctgaaaaaaaaaagctccgtgcaaatgctgccagtgagtagcatatatgttactgcaagtttgcaattaatccgctgtagacctctttcaggttagcatggaagagcataaaagcaaacaatgtagagctaaggctgtgtttagttcacaccacaattgaaaatttagttgaaattgaaacaatataacagaaaagttggaagtttgtgtgtgtagaaaagttttgatgtgatggaaaagttgaaaatttgaagaattattttgacggcctaaatatgcagcttcatattcgaagcaccatagccttatggtgtgttcggcaccccctcttcccaacccctctccctcttccatacgtacgcttttcaaaccgctaaacggtgcgttttttgcaaaatgtttctatatgaaagttgcttaaaaaaattaaattaatccatttttgaaaaaaatagctaatatttaattaattacgcgctaatgaaccgctctgttttccgtacggaacacagccttagagcatctccgattcaggcccaaaagttacttccttggattgggactattctaaaaaattttagacctaaaaatctatttcatctccacctaaaaatataatcccaaaaattagttggttgaccatataggattggatgggcccataattgttaccgacgctttgttttgcttttttttaacatatgcacggatcaaatcactcctgatcctgccactgcccttcctaacgccgccggctcctgctgccgtcagagaatccctcgccgaccacggttgactgatggaagatttcgcctctaatgtggaaaagcggaaggctagctaatcctctacacgaccatgacatcaatttgaaggttaatatcctaggcgatcctcatgttaggattttctctattaatcacgttctttttttttaatttgatctgataatatcgctaggggagaaagtttctgttggtgatgaataatggtttggcagttaatttgatctgtgatgaatcatacttactcttgtttcaagggcttgtgcatgaatcatcgtccgatgatgacgatgatttttttgggtcgcagcacaaatcatgcatagctattggtactctgtcaatacatcaaaacatggtgggtatgtcatgggacatgaagtggttgatcgcaacagagaaacatgacacttgaaattttaccaagattactttttcgataatcctacctatgacctagttttattcaagcacaggtttgtattgagccaattttatttgatttatctttgttatatgcatagatatgtatgtctcattagtaatgactacgcaggaatagaatgagcagacccctgtttctttgcataattaatgcaatagaggatcaagatgactattttgtgcagaagataaatgcaatcagtatacttgggttaagttgtcatcaagaga

SEQ ID NO: 17454 - DNA, 216 bp, Oryza sativa
gtgtatccttgaattaattttcttatattatatggttatgcgaaataaaatgtgtgattttagatatttgttattgatttttgtcgataccaatgcattttcgttcatattgttctgtttttggtttccgatattattatactgtttttattttcgaatttaccgttttcgtttccaagactaatttattttgtcatgtatttttgtttctgcagg

SEQ ID NO: 17455 - DNA, 273 bp, Oryza sativa
tgctgaacagaccaacatagatacttcgaactaccctaaggacttatttgcctgctctttagtttatttattgtttaactaccacactctcggtccaaagtagatggcatttgaatgtgaccacctttgtagctttttcttgaggatttcaatactttcatttgttgacaccagtatcagtttttatgtgctaattttttcttaatgtttcagtgttatgtttttcatcactataaagtccaataaagtgaagagtgactctgcatagccaga

SEQ ID NO: 17456 - DNA, 243 bp, Oryza sativa
tagggtcgcatcgattgataggaattctagaaagtgaaaaagagcgctccaatagtctagttcgatttttatcatccagatgccgatacagagtagagacgacactggataggtccgacaggagggtggcggcatttcacggctcttttagtccttattaagatggcatccgtcgagacaccacaatgtaaacagtataagatccgatttttaaaggcatctaggatgatgtcatagaaatta

SEQ ID NO: 17457 - DNA, 352 bp, Oryza sativa
caatcaactgaccaaaaatacgcttgaggactctaccctatccattcaatccctaaattttattactacttcagaaacaggcacatgatttatgcaatttgctacactgattgtttttgaaagatctaacctaacagaaattattaggacaagctatatgcgagatatattgatggaatgatgggtcataaaccggagaacttaattactgaactttggaagccatagtcaacgtgggcccatatttgaagtgactttaaaaaggagacaacagtgcattaccccagttaatttattttggaaaaaatacaaattaccccccgaactatcgcgcctgtccgaattaccccca

SEQ ID NO: 17458 - DNA, 234 bp, Oryza sativa
cccgtcacaggcttggatgtgttctaatgcaagagggcagagtggtcgcttatgcctcgaggcagttgcgcccacatgaaggaaactatccaacacatgacttggaattggtagcggtggttcatgctttgaaaatctggaggcattatctgattggcaaccgctgcgaagtatatacggatcacaagagtttgaaatatatcttcacccaacctgatctaaatctccgacagc

SEQ ID NO: 17459 - DNA, 242 bp, Oryza sativa
taaaatttcattaaatgctttgcttaattctataattcctagatttttctgggatttatttgagctaaggaagtatttttaataaatggaattgcatttaagaaataatttaaattgaaaaaggttttaaaagtctttttggctttgggccgaaagtcggcccaaaacctcccttctctctctcctcggcccaatccggcccagtccgccgccgcgcgcgcgcgcctttgctcgctgacagg

SEQ ID NO: 17460 - DNA, 211 bp, Oryza sativa
taatacccccgctccgggttggtgaattaaaattaactaaattgtgcgctgtgggtgcatggttttgatggtcgcgcccatggcatttaaggaccggttcgcgggatgccctggaagaacttatcatacttaccacaagccagcgtgggcaacggctgggcttgtagtgtacctttcctctagttgacgcatcaggcaagggtgagcgtga

SEQ ID NO: 17461 - DNA, 1501 bp, Oryza sativa
tctgaccacatctctactattgcttgccattgctcacggtcatactcttcagcgatgatgttgttctcacttcgttttctggtgtaccatcaaagaaaatattcttcaacttgtacctcatttgtcattgtctagacttgagcaaatcagcacatgcatctttgaccgtctgattattttcatctttggcaaattggccctaatcaagagcatggataaaagaaaattagcattaaaatagaataacatacaacatgataaacctaatgacaggtgaataaaaaaataagtaaaaatctgcataaaatagcaagcaaaatgaacgacatagacaagaataaagttatacaacaagtagcatgtgttcaacttgggagcaaataaagcaatatgaaagaaaaacaaatagcttctaagacttagttgcggatgttcaacttctccatttaaaattcagattagaattgtatagatccaacatgggcatagaaatgaggatgcaaaattaatcagagcccacacaataatttgtagaaactaggacataattcatcttatacatttgcagatactcacataaagcaacccatgaacatactgcaatacagtgaacaattaaaatttaagagtgttgctctattaggaaagaattgatctacttacaaccactttatccatatagtttttaagttgagacttgccattcttatactccttccagtgagtaaagattggtatgtgctgcctaagtacaaccccccactctgatgcttgctttgcaaactacattggtgcttctggccttctcttcccttcaacaatgcgcaccatcttaagggtgtgtttggttgctcgtatctatcaagcctggctcatctccgtcatccaggttgagttcgtcctagttaaggcgatacatatgcagtcgtttggttgtttgcattagtctggcctggctactacgagatactgtttggttgtctgcacgggggatacggttcagatgagaatttgtttggttggttgtatgaaccgtatgtatgaggatattttttcttgggtgagattaccgcttataaatttccactatattagagttcaggtaacctgaatttatttttttcattatcaatcttcttttgttagtaaaacaactcatcaattgaactaatgtagtggagtacgtaactacacagtaaatcgtatattagtgactaattacgggattagagaacggggatagtagaaaaaggaaaaagaagaaaaaagaaaaagtgctctcgcatctcctcacactcctcgctgttggtattttttaacgacattacaagaaatataattcccagcaatggcgcaaatactcctggtatattatggttacagagttcatccgcaagcgcacggatataccattgtagcatttcacccgagagtattccaagggtatcgtatttattttatctcgtgggaagatcatgtagagagaacttgactaataatt

SEQ ID NO: 17462 - DNA, 548 bp, Oryza sativa
tatcaatttggattctttatcaatgcatgtttgagtttccaaaaaactacatttagatttgagttttgaggaaattacttcaaatgattttttcagagcaaaacaaaataattttcaacaaaaatttgctatgccacgaccatactggccattgggttccaacggtcgaaagtggggccagttgggcccaccaggggttcggttgaaccggccagggcaacggtcgggtgcctctttctttgaggcaacaactagtgggtcccaacggtcggttatgaccgttgtgggcagcctatttaagccaactggccagttgaggaaaatccatcccatttcaactcattttcatctcctctccgaactttgctctcaaaattcattcacgctttgcaagtttacctcaaatttaagccattagttgcattcacaagtttccttagtgaagctaaccggtgggtaaatatctcgctattctaacccccgcccgagttagtccattcttattcatttgtgcagaatgaagagacgattgtcccgctagttcaata

SEQ ID NO: 17463 - DNA, 275 bp, Oryza sativa
tatgaccgttgtgggcagcctatttaagccaactggccagttgaggaaaatccatcccatttcaactcattttcatctcctctccgaactttgctctcaaaattcattcacgctttgcaagtttacctcaaatttaagccattagttgcattcacaagtttccttagtgaagctaaccggtgggtaaatatctcgctattctaacccccgcccgagttagtccattcttattcatttgtgcagaatgaagagacgattgtcccgctagttcaata

SEQ ID NO: 17464 - DNA, 338 bp, Oryza sativa
ctatctatctatcttacacctttctatctatctatctatcttacatctttctatctatctgtctgtctgtctatctagacctatactacttggatacattctacgagctcaaatgttaacaaaaaaaaatctggccattgaatagatgcattacaatatcgtgaccgtagattaatatcataaccatacatagacgcacaaccaatgttgctctttggccataaaaattgtgcacgtacaggtgttggtcaagggctcaaggctttgatccatgaatccacaaattcgtttgcacccagaaatatccactctcggccaccatatctgtaattaaatca

SEQ ID NO: 17465 - DNA, 198 bp, Oryza sativa
ggtgttggttaattaaaattaactaaatggtgagctatgggtgcatggttttgatggtcgtgcccatggcatttaaggaccggttcgcgggatgccctggaagaacttatcgtacttaccacaagccagcgtgggcaacgactgggcttgtagtgtagctttcctctagttgacgcatctaggcaagggtgggcgtga

SEQ ID NO: 17466 - DNA, 430 bp, Oryza sativa
ttcaataaaagcttttattatctgaaaactgtaaccacacacctaactgacaactagcttcctcaaaatatttgattgtctgactgattgcacccactagttaccactactagaaaaattatttttcccaacgttatgatttttttttctggcagactataaaatcaccgtttataaaaaatagctaaagatactataaatctagtgtcacctgcaaaaattagctttcgcaggtggatctagaggtccgtctgtaaaaataagggtatttttgtagggtaattgtaaaaggttcgcctgcaaaaatttatacctcataaaaatcaccacctacccatgcaaatttcacacagcctaagtctctttttcctcccacctttcccctcccctcccatttacccggcgcgggttccctcccctcccttccaga

SEQ ID NO: 17467 - DNA, 180 bp, Oryza sativa
  unsure (1)..(180): unsure at all n locations
agagttgcaatcctctttcataatatactattttgatgacttcaacataccgctgtagaaataccctcccaaaactatattttctttcttaacatggaaaacatacaacacctaatgcataattttctggtgaactgtttttttcctctaaagtgctttgtatgtngaatgtaggtaaga

SEQ ID NO: 17468 - DNA, 374 bp, Oryza sativa
ctttttttctcagctccaaacttcaacttcctcacttttcgttcgtacgtttttcaaaccgttaaacggtacttacgtttttacgtttttagtaaaaagtttttatgtagaagtacttataaaaattaaataattttttttaattttataatagttaatatttaattaattatgtagtaatgagttttctcattttacgtgtgttaaaattattcctcgaactcccaaaaatgaaaaaagaaaatattcctccaactggtgccaccgaatggagacttagtgttctggaaccagtcaaccagattggtgataacaagagctgacttctttgatttttactgatcatcgtttgagcgtcacagcatacgcacaca

SEQ ID NO: 17469 - DNA, 632 bp, Oryza sativa
caaactttcaatttttttcatgacatcaaaactttcctacacacaaactttcaactttttcatcacatcgttctaatttcaatcaaactttcaattttgacgtgaactaaacacaccctaagacatgtgtcatcgactactaaatttatatggttgtttgagttagcaacttagcatacgggcaatatactaatacctcagacccacaaatacttgtactggtagaaatgaagttttttgaatggagggtaattaattaccgacggagaaaaaaagagaatggcttggctcgactatgatcacacttttcaaaccagaaaagtatatgaattcccgcaaaaaaaagaaaagtatatgaattcttgtccaagtatatgaatttgactatccaaaccagaaatttcatccaaatatagcttgccaatcaagtcaaacaaagaaaaatcgccctcttcaggcaaactgctgagttcaagtgcagactaatctcatacgatttgggggggccttagctccataaatacacttcgtctccttcggtccttcctcctcaacaccaaccagacagaacagaggacaccgctcacaagcaaatacagagtcgagagtgagacttgaggcagaggccatgg

SEQ ID NO: 17470 - DNA, 298 bp, Oryza sativa
gccgactattcctagacactgagccttgtatgccgaagaggccgagcattctccatgattcgagagcttccagacgatgtggtctgactcattttggtttagtatgatgtcctgggttgcgctccatagggacacaagttggctgatcaggtccactgtaaaagtagtgttcctatttagctccaggtcatcgatccaggtgtcattttcaatgccttcatgtagtgatttacttcttttcaatatgctttcgtttaattttttagaccaggttagcggatcacatgtttcaatacat

SEQ ID NO: 17471 - DNA, 320 bp, Oryza sativa
aaattaggggattaaagtttgtgccgactattcctagacactgagccttgtatgccgaagaggccgagcattctccatgattcgagagcttccagacgatgtggtctgactcattttggtttagtatgatgtcctgggttgcgctccatagggacacaagttggctgatcaggtccactgtaaaagtagtgttcctatttagctccaggtcatcgatccaggtgtcattttcaatgccttcatgtagtgatttacttcttttcaatatgctttcgtttaattttttagaccaggttagcggatcacatgtttcaatacat

SEQ ID NO: 17472 - DNA, 184 bp, Oryza sativa
gttggtatcagagccagcttgaccctagacgaagccttagatcccaagccttagcaatattttcaaaataaaaatcctttcttatttgtgaaaatcctctagtctctctctgtcctgctgcttcatttatcgtcaaaatctgacctttaaaatgttgcttttctcttttgtttttgtttgtaga

SEQ ID NO: 17473 - DNA, 1315 bp, Oryza sativa
ttatctcttagtacctccagtaaggaatggaaatttgcacagtactacctctcaaggaccgtaaaatttctcttttctctaagtgcatatcaaatttagcgtatatgactcgtgtcatcataatttatcctataaaaatctttgatttttctatcaacatttaatctgcatggaaataattaatgtatatatgcattactacctctccttcgtaacttcaggaatggatggtatgtatgtctcaatctttattggcccctgtattttagttggtgatgagagtgtatgatggcaaactcatcgtcaccaacaccaactgcctcttttaaataaaaaaattgatgtagcagagacttttttttctcattatcatatattgtatatgatgtttggacaaatgattttaagcctgcaatggcgaactatatcatttctcacatgccgtttaaatagttataataaaattgaaacaaaataggcaacatacggatgtaaaatgcagatgttattctgaaaaagaaaacataaggggggcaataaagagtgatgctaagtgttcttttgaatggtagtgtgcagttgttattttttcaacatgtatatgtttttgtacaatggagttgcacatgtttcatggaaattaaatgtgcatatttggaaatgtatgttttaatgggaatgtgtttacaatattatttgaatttttttcatggaaatgaccagatgtatttcattgaaaatgcaaaaaaaaaaatcaatacaacattgttgccacaatcaaatgttccatgcaacattgtttttgtgggtgaaaaatgggcaatgtacatatgtttttcgtttgaatgaaaatgtgcacatatggtcttctttgtatgaaaatgcttaaaatggtagcatttcaaataattaatcagatcaaacattagtgtcaccacgcctttttttttcagttgtaagtatgcaccatcctcttgctaggtgtggtggaatgattaggtcatgtaggtagggtccagtagggggctctcatgtattccacatcagaaaaaaaaaacccacccctacaatggttagttgactttacattaatacatactagttaaattgtcacaccccaatctgataccgccgtacaacggcacctgacaggagcgtgtcgtagggaaaacggcgcaaaccacttcctacgaaactgcgatctcagtaccagtcccaggacatagtgctggcacccacggtgacaaatatgaatcatagcaatccttaaaataaatggaggacttatttaccttaacataggttgcagcttaga

SEQ ID NO: 17474 - DNA, 173 bp, Oryza sativa
actttcacagagaattctgatttggatagaattgtttgagatttagggtttggattccaattcaaatttgatattcgggctcgagggtttagggatgtatcaagggaaactcaggagaagtcatggaaaagattcaaaaggaatacttgggtatttgttctcgggaacatagg

SEQ ID NO: 17475 - DNA, 1299 bp, Oryza sativa
  unsure (1)..(1299): unsure at all n locations
tagttggttcaagtctctaaatttttctaaaattgagatctacatgttaaaaatatccacatgtactgttcatgcttgtttatgtgctgttttggtgattttgctcttttcttcttagattccgtcgttaccggagagtccgtttttgcagaagaagaatttgaagagttccaaggccagcaaggcaagtcacacagatcccaaacaaccctttgagcatgttgatcctatttaaagctattgtttctattcaattattgcatttattttcgaatgtcattgggtggaattaacctattctttgttatagcccttttgttcttgattactttattccttgataccttggggtaatataacttgactagttgaactttatatatattggttcagctagatattagatatgattgcttagccatgcttagaaatattagcacactattgggataacttatgactcactattacttaacgatggcttaatgatagttcacgatgttctatcatgattggttaattaattaatgtgccaactaaaacctgataatggtgggttgtgagcacatggttttgatggtcgtgctcatgacaattaaggactggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtctatgccttgntataagggggtgattatctccaggaaaggtgcgctgcagtggattgtgttgtacgagaggtattgtcacaactcctttccgaggtaccggggtggtattgaggcacatggtgacatgatgtggggttgtgtcttgtgggtacagtggtacacctctgatcagagtaaaactattcgaatagccgtgcccgcggttatgggcgggtctaacaatatctttcgtgattagtctcacccttctcaccataataaaaggtgctttaattggtaataatttgattagctcctggtttggagatagaactgtgcagccgggatggttgttcagaatggttgggcctatacaacagggtatgttgtatagcgttggattaatattgtttaatacttaactgttttattaaattctgaaatgtttgctaaatgctgcttttgcaaatgaaaccctactatgccatcctttggtatccttgtgcacttgcatatttgctgcgtgacttgctgagtatgtcatatactcaccttgcaatcattcatca

SEQ ID NO: 17476 - DNA, 1045 bp, Oryza sativa
accagcgataaaggagggtggggttggagagagatccaaacttgcgaatcctagctcagagcagatctcgccggcggcggagcttttcctatcaccggggccaggtgcgctttcctcttctctccgcctcccgcgaaacagttacgctaggtgttttggttgaggagagagggcgctcatatttgagttccgcctcggttggcacccaaagtaggtccttagtatgggtactctgttggaccctgtttttttccgctacagtagcctggagcacgcattttgggtttggttgtcgctatgcctaggctgttggagatagtctaacgactgcgtttatgcaaagcaagggcagtgaaagttgcaatctggatggattgtcagcatctcaaaacttacagggtgatggagaatagtattgcatagtagtggtgggcaagaaaaatggaaaactcaattcatgctttaaggggatatcccctcatttttacatgttacttaaaatgtcataaaaaattgaaaaaatttagtaggatagatcaatatgtgatatgtcactttacaaacatgcatattaaaattcaacttatacaagtagaaacaaaaataataaatttgactacgaatagaacgtgtaattcacagtcaaatttgttatttttgtttcgaattatataattcgaattttagctcgcatgtttgcgaaaagatatatcatatatttatctatattgataaaattttcaaatttttttataactttctgaatgctatgcataaaacgagtggatatcctcttgagggacaaaaatccacttccaagaaaaatcaatgaagtatattcaaaacaaattggtcactggctgaatagtttctacatcagttaaccctgcaggcagaggcaaatctctctctctctatatatatatacaccacctatcatagcttcgtacctccaaaagacaaggagcccaacaaaacaaaagccaaaagctccaatccttgggacgtactactgcttaggcctcagagcgttggatagccatgg

SEQ ID NO: 17477 - DNA, 1189 bp, Oryza sativa
tatattattttacacggttttcagagacatatttggggctttccaaagccctagttcaagaaaaaattattccatatcatattcctaacgaatatgaacttagcaacacatgaaagcataatacttagcatatatatgtttagtatgattatgagtccaaaagttatcgagtttgatttttctttaaaaaagagggcgccctataatttgggacggcatattatatatttttttctaaatcaaacttacgtttgactcagattaaatttagtaactttataacaccaaattagttttatcgaatgtaacattgattatatattttgatagtatgtttgtgtggtgttgaaaatgttactatatttgtttataaacttaattaaatttaaagaagtttcactaagtaaagaataaaaatgatttataatatgaaatagagagtgttaatttatttgttattaaagtaaagtagtaggttaggtcaatcatggaccatatcctatgcatacaagctttccattcacaccaactagcaaatatcataaaaaattctagaagaaaatggacacatactttaaattgtattacacttatatgtgaaaccttatctttaaataaattatattttagccataacaaaagagaaaattctgatagatttttattcttaaaaatattagatttttcttttttatggttaaaatataataaatttgaatatcagacgttgcaaagatgtgtaatattattaggagcacaaatccaatttttttcaagaactttccatgataattgttagttggtgtgcacggacagtacacgggaagtttgtgtgccagaatatgcttttgcgcaatcaagtggctagcatctatataaatttatgatgtaattgtgcggctagcatcaatataattttatattatgatgtaaattcatttgtattttctacacattaatatatataaaatttcttaagtagtcaactgtcacaccccaatctggcaccgccgtacaacggcacctgacaggagcgtgtcgtgggaaaaacggcgcgaactgcttcctacgaaaccacgatctcagtaccagtcctaggacatagcgctggtacccacggtgacaaatatgaatcattgcaatccttaaaataaatagaggacttatttaccttaacttaggttgcagc

SEQ ID NO: 17478 - DNA, 167 bp, Oryza sativa
agtcaggacctgtcctggatttggtacgttacttataagactctgtgggacatggtgatcacgttcggtagtgttgccgttttgtgattggattcaacgaccctattatatttgatccattggagatcttgtcgaacgtaactagctagtattaaagcatgcatgca

SEQ ID NO: 17479 - DNA, 1501 bp, Oryza sativa
taccctactcctgtgttttggtggatctgtgtatgaagaagctacaaagtgcgagccagcccccgattgttctaggatcgttctttttcttcttttttcctctctaagtgggcaaggtcctccttttatatctcaaggggataccacatgcaccatctctccctctctttcttttgtgtggggactcatcctctcttccctccaacttgacttctcttcattaatggacggagatttgtatggctgccgtccgaatgaccttctgatgggacggcccatacctacctccacttccgccggaagcaggcgcgacgtgggaacatggctgtctgctgacgacatgaccattgttagaccggtcacaaatcggtcattcttgtccaccacgtgtcagtttaacaatctgcatgttcgcccttcttcatacaatatcttgcctgtaatggttaggatgaagcctggcatatatctgaccggaaccaacgtgccatctccaggagctaacacgccggctccggctagggacgagtgcttggaggctctcgtcctgacgggatggggcaaggcgtgcgtcagaccgcctgtcgccacctaacccacgatctgaccggtctgtgactggtcactgaccggataaacgagcgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgacccccccgagggtgccaggccacgtgggcgattgtgtctgcctcaagcctctagccatgatactcccggtcccatgtcaccgacacaacggatgaaagttattttaatcgtattattgttagaatttttttcctaaaaagtatatgaaatttttaatttaatagtattggtatctaattcggaacctttattgggatgatgccagcatcttgtatgttgctttcttatggcttggcgagaattctgaagtaattaggagtccgactctcatcctaagttagcatgtgaattttttaaaaaggttcattatataacttcttatgtatttccaaagggactatctaaaaactgctgcaagttttttaggaaaaaaaattaaatataactatagtataattgtattataattccattgtaactataatataacatgtatataagtattagaataatatatgtgtcgacgtttgatatcacgactacggtattttgcatagtatgcagatcgttggtaccagggtatgtgcgagattgaagtaaaagagatggagacaaggatttttatacaagttcgtgaatctgacaggtattaacctactcctgttggccgaagctagtgttgctcatttattcatctgaatcacacaagt

SEQ ID NO: 17480 - DNA, 1501 bp, Oryza sativa
gagtcgtaggttactaggaaagttgtttgcaaccgagaaaaacattactcccaccgttcaaaaatactacgagtatttttagattttgacacagttttcaaaatgttactataaccaacaatatatataaaaataaaatattttaaataaaaagagctgtatattatgttagtttgtttaatgacaaatctagtaacatctattttacatgattgatgttttttattttttctattataatagtcaaagttaaaaatgtttgacttgacactatgctagaattgcttatgttttgggacagagggagtactaatttcgttacaaattattgatacatgatactcccttcgttctataatatagcaacctactaccggatatgacactttatagtgcaacgaatttagacatgtttcctaccagattcattgtactgtaaagtgtcacatccgatactaggttgctatattatgggacggagggagtatcatttatatgtgcagatggtttaataataaacttcacggaaagttgttaatatcgttcataattttattcaggtcgtgtattgcaacgtgacggagcgtggggctcctcaccgggagaccgcgctggcccccctttgccggttcggccggggaccctgggtgagactctaagctcccaatctgtggaaggttcgcgagacaggaagcacacaagacgccggcgatgtatacaggttcgggccgctgagaagcgtaataccctactcctgtgttttggtggatctgtgtatgaagaagctacaaagtgcgagccagcccccgattgttctaggatcgttctttttcttcttttttcctctctaagtgggcaaggtcctccttttatatctcaaggggataccacatgcaccatctctccctctctttcttttgtgtggggactcatcctctcttccctccaacttgacttctcttcattaatggacggagatttgtatggctgccgtccgaatgaccttctgatgggacggcccatacctacctccacttccgccggaagcaggcgcgacgtgggaacatggctgtctgctgacgacatgaccattgttagaccggtcacaaatcggtcattcttgtccaccacgtgtcagtttaacaatctgcatgttcgcccttcttcatacaatatcttgcctgtaatggttaggatgaagcctggcatatatctgaccggaaccaacgtgccatctccaggagctaacacgccggctccggctagggacgagtgcttggaggctctcgtcctgacgggatggggcaaggcgtgcgtcagaccgcctgtcgccacctaacccacgatctgaccggtctgtgactggtcactgaccggataaacgagcgcgctgcactgcgttacatgcggcgtgacgcgctcgtccaaaccgcaataaatgtggttaggtgagccccgctatgctcacctaccccatatacgcggcgcaaaacccacaagg

SEQ ID NO: 17481 - DNA, 1501 bp, Oryza sativa
ccacggcgtgagctttcaacctcagctatatagaagtagtactccagtaattgacattgtgttgcttcctccgcaatcgcttcaaacagttgttgccacagacctactccctacgtctcataaaaaactaacttagtgttgtccagattcgttgtactattatgtatcacacgatcatctccaattctagattcttttttttttggacggaggaagtacggcggttgaaaccgatctttatcatttctctcctttcaaatcacccacgtggtcagtgtatgtgatgcggtgtcaaatcctattagagcaagtttaacagtatagccaactactagctccaactcatctatagccaatctaatagctcatttatacaatagttatatactacagtattaatacatgggcccatcatcatacacacattgcttcttggagtccgtgttacagctggctataaatctgtagcccgctgctcttctctctccttatttatctccttaaaatatgtctgcagctggcttatagcctgctattgtacctgctcttagagcaagtttaatagaatagcccactgctagctccaaatcatctatagccaatgtaatagtcaattcatacaataggtgcttaccatactattaatatatggtcctacctatcatacgcacgttacgtcttagagtccgtactgcagctggctacgatctgtagcccgctgctattgtacctactctaatgaaccacctccttttacgtgtttggagggagagttcactctccctaccgaggacagccttaaaacaaaagcaaaccaaacaaatttacctcacattaatccctggaatttctatttctactttaaatccagccatcacatcgatccgcactaagagcaagtttaatagtgtagctaactgttggctccaaatcatctatagctaatctaatagcccatttatacaatagttagctataaaaatatactataccattaatactcggttccacctctcatacacatataacgtcttggagtccgtgttacagccggctacaaatctgtaacccgctttcttctccctcttctctttttttctcaatatgtggttatagctggcttactgttgtactatacctttgctttgtgaattgtgaggtgcggccgcgccgatggaaacgtgtgtgtccgtctcgagcccctcgaggcctcgatgtcggggtaccttcacggcttcacccagaactcaggactttggttagtaaaacgccatggcacaagaaactctggacgccttggtaagttggtcccgactctgattggtacacacgttaacttgtagcacgtcttgaggtatatggttgcggtaatcatatatcgcaaggggaaggatttccatacatggatggaatcaaattgttgttcgatcgatcggaagttcggaactaatcacggaatcgaatataaaaccggctaaatagaccctaattttcttggact

SEQ ID NO: 17482 - DNA, 634 bp, Oryza sativa
ccgatgtagtagttccagccgatagtgataatagctgatgccgatgccagcagatagcgatagggtttaagcaatcggttatatgtccaatgtagataatgatataaaggcaatcggctgatgatgatgtaataaaataacaatataatccagtataaaccaatcggctagtaataatatgataaataagcatcgatccgaaggttaaagtacacatcggctggaggtctgatgtcatgaaatccacaatattagattaaacagtaaaacctttgttgcgataagctaaatccaatatgtatgcaatccttataagccgatgcaacatccagataactcatcggctgaaaccccgatgaaacccttattggcaatcaaaaagtaggctagagattatggttctaaacacgacttagtagatcaaacttaactgatgcagcactaagtatgaaaagaaacataatatctagacaatcaagccgttgactgagttttcagggtggtagatgtctaagctaatctaatctagcaacacgatttagccgataccggcagaaaccctaaagcgagaagcagccgatagaggtaaattgatatgctaagactagattaacagagacatatgataaatagg

SEQ ID NO: 17483 - DNA, 393 bp, Oryza sativa
cacagccaactgctacaatattgcagctattatcactacgacataggcagcaacacaactactgtagtatgggagccgaacaagcccatagatgctgggatttcctatctagtaccactcaggcaggactaatgaccttggataattggtgtggttccacagcaaacacctttgaggcacacatgtggcaaaaaaagtctcaaattctcaatgcatgcatcggctcgattccaaccgatgcattgagttgctccccgtaaccccaaaaaaaaatcgaacaaaaaaaacttatgtacaagctgaatcacaaattaaaaaaataagacctgttgtacattctaagtcatgactaaataacaaatccaacaaaaaaactcatcgtcatcgaaggga

SEQ ID NO: 17484 - DNA, 243 bp, Oryza sativa
tctactcatggtaccactagtatgattttaggtagatgcttcgcttgttaattaggcaacattaggtggttttacaactctagactttggaaatactcttatcacctggacactatggaatagttggattattgtggaattggattcacacctccccctctattcaaaaccctcaaaatggttttaggctgggctcggggtgcatggttttgacagtagcacctcggccatataaggaccggt

SEQ ID NO: 17485 - DNA, 846 bp, Oryza sativa
tcaatatcttctcaaccgtatgaccgtttgactccgttcaacttccaaaattcctcaaatctcgagatctatctaatggtacgcttagaggttaataatagggctttattttcgccgtttgttgagttgtcccgtttcacgtgtagtttcggagcccgaagacccgcagtgcgtggatttcgaggatcaagctcaagatctcgagcaaggcaagccacctttcaacatattgagcctatatttgaacttaattatattgcttgcaaaatattatgcattgataggattgccccgtctgcaaggcagaccgatgggcctacctagcttattgcatctgatccttcctttgttaatcgttatatcatgttcccttgtaaccacctagttgagcctcggtaatcgtgcactctgcacgagtatcaacggtcgccttcaaacttaaaaactgagaaacaccttgggtaaaacttgggttttacaaaagacatggaaaacccgacacgtgggtcggtgcttacgaactaaatgaatttccaaaatcgcggaccggggaatgtaccgggtgtacggtttcccgctcttgcacttaaggaccgtttccttggaatttcatccgaacataagacaagtgcaaccacatgggtggaatgggacacccctggctgagtaactagctaaacggggggagccatgatgccaagagacatgtggattcaacggggtggtgtcggggagaacccccgggtttcctggcacagtatggtctgggacctaatctggtgttggtctgggacccctctcgttggcatatggtgaacctgtgtcggctttcgaaatgccttgtca

SEQ ID NO: 17486 - DNA, 220 bp, Oryza sativa
gggggaggagaatcggtccatccaaaaaaaactcagggaggtaaagtagacttttacagagaaaactgatttggatagaattggagatttagggtttggattcgaattcaaatttgatattcaaactcgagggtttagggatgtatcaggggaaactcaaggagaagtcatggaaaagattcaaaaggaatacttgggtatttgttctcgggaacatagg

SEQ ID NO: 17487 - DNA, 359 bp, Oryza sativa
ccagaaattccaattaaacttccaaaattcatatctctcaatccgtagctctgattgactccgttcaacttccagtatttccataaaattgagatctattcaatggaactactaattagtctaaataggatctttattttggtcttttgtttaggttttcaattgtttgcgtatagttgcggttaccggattttcgtcgatcgcgggttttctcgaagattcgtgaagcttcgtgaagaccttgagcaaggcaagtcaccctttgaccaattgctcctataattggaaaatcattattattttgtttgcaacttgcattagtagaatcacacacttaacttgcttggcctcggtttgcg

SEQ ID NO: 17488 - DNA, 243 bp, Oryza sativa
agtataagaaacgcaagtctacccatcagggaaattcttcccgaggggaacctcgccctcgctttggacaacccatgcaatatcaccagtcagtcactcaggctaaccgccagccaagctatgcccctcgtcctcagatgaatcgtctggcacctcagccgcagcagcgtgccccaagtggcaataccgcgccaaacagtgttacctctttcaagtcaccgccaggactatcagcagttcagt

SEQ ID NO: 17489 - DNA, 1501 bp, Oryza sativa
ttcatcgagaccaaaaatggattatttatttacactacccataatatataataagttcatgggacagaaaatttggttaaggaatgaagagagaactaaagggcctcaccgggggattatcatcacccaatgactgcattagatgcctcttgaaggtttccaactgaatcaagataaccataaaaagaagaaattcgttatctcagtgtaaaggaaatttgtgcaaatgtgcagctgcagctcagcaactgtgtgatcatctcaggctctcagctcagctctcaccttggcgagatccctggccagtttcttggacgtgtgcgcgagcgagtctctctccttggcaagcttagccttcacaaaaaaccacgcaagaagaattaagcagagctcagagaagagatcgatgatcgagcaacagaagaaattacaccccaaactctgcacacgatcgagccgagccgagctcaacgtacattgtcgtcgagggcggcgcggaggcgggcgtcggagtcacggagcgcctgctcgagcgacgcggccctgtcggcgagctccgcggcgaggcggtccttgtcggccagcttctggcggagccgcgcggcctccagctcgaggcgcgacgcccgggccgccacggccaccgccgtgatcttgcgcgccacctccagctgctcgtacgggtccgccggcagcgcgaccgcgatggcgtcgggcagccctgcctccgacaccgccaccgccggcgccggcgcggccgcagcgggggtgggagtctgcgtcatcgatctcggcctcgggccgggctaccgcgcgcggcggaggctggtggcgagatccgaagcggggagcagaaggctctcggggctcgcacggggaaggaaggaaggaatgtggattgtggagtggagtgggctttgctttgctgagcatgtggcatgcaggtagaattcagttccaagcgaacaaggattttctacacctaattaccgtggcaactattatttgcatgcgactcaaatagttatagaaaaaattaaaaaaatttagtaacatcgtttgggatgatacaagtctatacacaaacatgcaggactaaatttgatctacaactagagaaacaaaaataataaaatcagacagtgaatagtacccatacagtgcagataaaatttattatttttgtttcttcatatatcgatcaaatttagacttgcatgtttacatagtgtcttgtattatcatgtactatcttatcaaattttatgaaatatttatataactatttaaattgtatgcatacacctaggtgcacctaggtgtaaaaaatacttcttcttctaatgcgcgaggtgttgggaacggggcagctgcacgtgtggcgaatggattctgatcatcttcttgattttttttatgtaaatttgatgttccttttattatggcagagtcatgaactagcacacaatatatcagtcgttttgtgcatgtcatttaaaaa

SEQ ID NO: 17490 - DNA, 190 bp, Oryza sativa
atagagggcggcaagggttttcctgcaaaaaaccctccctccgtcaccgcccgtccctcccccgtttgctacgtcagcttgccgcccaagtggtgggcggcagggtctatttttgtaatttttttggccgatagattatttctgtaaatatttaaaaaaaaatctaaaaataaaaaatttcgtgagggca

SEQ ID NO: 17491 - DNA, 1501 bp, Oryza sativa
gcgtgggacccggggggcagagcggctggtctttgacttccggtgagcgtgtttaacgtggagagtattttcgggggatcgaacagtgcttaggttgagattattatctgcgagtgaaaatgattgggcagtggtattgccgactgtcgagctgagctgagttgacgaaagggcaaaacaagcgaactgcgtccacattgtcattgcgtacctgagcctacgacctggtaaaacaacattttatattgagtttggtgcatgactagttctccgaaatcttaaactgataataaacggtgggcattgttctctggcaaaggcggacatggtattctttgtcagttagggtgaatggattcatgctcttgcctctcgagatcccttgaaagctcacattggttctttcacttgaaaaaaagcgctcaatttggtgaaactcaaataatctcttaaggagatatcttctcattttgcatgttacataaaaagtcatcaaaattttttaaagaatttagtatgatagatcaatatgtgatatgtcacttcacaaacatgcaaattcatattcaacttatacaagtagaaacaaaataaacaaatttgactatgaatagaacgcgtaattcacggtcaaatttattatttttgtttcgaattgtataagtcgaattttaactcacatgtttaaaaaagatatgtcatatattgatctatcttgacaaaaaaaatttaaattttttataactttttaaatgacatgcacaaaacgactgatatattgtgtgctagttcatgactctgccataataaaaggaacatcaaatttacataaaaaaaatcaagaagatgatcagaatccattcgccacacgtgcagctgccccgttcccaacacctcgcgcattagaagaagaagtattttttacacctaggtgcacctaggtgtatgcatacaatttaaatagttatataaatatttcataaaatttgataagatagtacatgataatacaagacactatgtaaacatgcaagtctaaatttgatcgatatatgaagaaacaaaaataataaattttatctgcactgtatgggtactattcactgtctgattttattatttttgtttctctagttgtagatcaaatttagtcctgcatgtttgtgtatagacttgtatcatcccaaacgatgttactaaatttttttaattttttctataactatttgagtcgcatgcaaataatagttgccacggtaattaggtgtagaaaatccttgttcgcttggaactgaattctacctgcatgccacatgctcagcaaagcaaagcccactccactccacaatccacattccttccttccttccccgtgcgagccccgagagccttctgctccccgcttcggatctcgccaccagcctccgccgcgcgcggtagcccggcccgaggccgagatcgatgacgcagactcccacccccgctgcggccgcgccggcgc

SEQ ID NO: 17492 - DNA, 206 bp, Oryza sativa
cattatgtggttgtttaaatccacgtagccatcacgcatgaagcttactggttaccctccatcagacaaacatatatattcgatctttctccggtcaagttctagcacaacaaaacacaagccaaaacaccatttaaccacctccaagcttcgcattccaagagaccgagcgactgttcagccagagattaatcagagaatggctg

SEQ ID NO: 17493 - DNA, 274 bp, Oryza sativa
tattgatttatctgcacatgttttgactaaagttactgatcgcatgtttttgaatacatctgaacactgaaaagagctttcgacgtgttaaagagtagttgtggaaacccctatttcaattgtgcaatcaagcatcactcgtgacgcactactagtcttctatagcatatacaaatattcacggttcgtgttgtgctccgatcaagtgctagctagctagcaaaagacaactcaagccaaaaccatctcagagcttcagagaggaagacaatgg

SEQ ID NO: 17494 - DNA, 227 bp, Oryza sativa
ctaaggcttccttttttgctttctttattttcaatagtttattgctaaaatggttacttatctttcctctccctttcaaaattgtagatggcagtgaacgccagcttcagttcccacggttttggtgagggtcaccacgtcgctcagcttcgtgacctcgcccgcttccttggcttctcgtgtcctgagtacacggggtactctgtggaccgtgttccctctcgtta

SEQ ID NO: 17495 - DNA, 219 bp, Oryza sativa
tcttttgcaggaggataattttccagaactgctaagcggcggtttcctcaacccaaatgatatttcactcgagttcatccaagtttctatttctttttcctcttgtttgggcaaaagaagtctaacttccggccttcgcaccaattctcttccataccaatttgaatggagcttatgtatcgagcacaacgataatccgctacaacttcgttgcatagg

SEQ ID NO: 17496 - DNA, 1501 bp, Oryza sativa
cccagagccttttctctaaaaaatttagaacttgtaaactttgtaactatctattattcttaataaaatttggtcggccgacctggcaaaatcatgaatcaagtcaaactgcactctgataacagcagcatttgattcttcagtagatgacatattgacaagtaccctgttcttttctccaacaagagttggataaagattatgattttcgtggcacacttttcacactgctaaacggtgtgtttcgtgcgaaaactttatatatgaaagttgctctaaaatatcatattaatctatttttcaagtttgtaataattaaaactcaatcaatcatatgttaataccacctcgttttgcgtaaaaaacttaatctgcatctttatcttcaggagaaaagaacaccaaaagaagtgtgtgtgtatatatatatagagagaggctctattatacacccttctcttagaataactattctacacccccctcccaccttccatccgtccccacctccctcccgcgctccctctccctctccctctcgcgcctccccccaatctctccttttcttcttttttttcttctctccctccttctatcttttttagaaaaaataaatttgcgtaaaaaacttaatctgcatctttatcttcaggagaaaagaacaccaaaagaagtgtgtgtgtatatatatagagagagagagaggctctattatacactcttctcttagaataactattctacacccccctcccaccttccatccgggcccacctccctcccgcgctcgctctccctctcgcgcctccccccaatctctccttttcttctttttttcttctctccctccttctatcttttttagaaaaaataggaataaattggtggattcaagacttgatcccatgatctcatggtttatggtgagcacttctaaccaaatcaccatatgatgatttgtgaacaaatcagttatgtacctataacaatcataccttgttactatgattcggctgtaacattatcccagaagggtagtaacattatatgttactgcaaaaatgtataggttgttactgcactttttacagtaacaatatgatgaaatttgcagtaacagagaacatgcatagtaacagtggccctatagtagtaatgttttttagatctagagtattttaaatctcaatctttagagagtactaacgtacatgtgtcatgtcttatttttctaacccatttgcatcatggcgttcgtaaaaaaaagtgcttaatgaaactagaaccataataactattttttaacgttgttactgtgaaaagcagacgtgttactgcatattagccgtcgtgttaatacgctgttccagtgagacgaggactaaaaaataggtaaatctcaatctttagagagcaatatctctcacattatatcttgtatttccaaatcgtttgcaccatgaagatcataaaaaaacgcttaacgaaactagatccatca

SEQ ID NO: 17497 - DNA, 1501 bp, Oryza sativa
accttctttatgattgtattgcacaactacattcttcttgtgagcattcatttatccaattctcaagaagtcaaccaggctcctgttttttaatttatttctacatatctgtgtatttatgaataattgttccaattcttatttggttaccactgcttcaatctttttcaattttaaaaatgatttgactaaggtaagggcactgagattttggaaaacaatatcatcgagaatgacatgaaatctggtttgttcttacacatggtttgggcatgattatcaattttcggctgtactgatatttggttttgaatttaatttgtgtcactacaatcggtatttgttaaatgcagctatggtaatgtacagttctaatttgaagttggaagattatatcactcccatttattgaatgtttttcaaatgaatactctattgtgctattttaattaagtatatgcatgtcaaggggtaatgcacgtgcaatgtgtcactgtatcaactgaataaacatgaacgtgtaaggacattagagctgtataaccaaattgttttctatatccaatgtggtgaaagttaattatataaagcaaggattacatgatgtcaatgtaattgtatatttagttacatagactccctccatccactaaagttacacctattacttttatcaccatgaccaagaagaacttaattaatcatgcatataacaaaaattaaggagcgtatacacgtatgcagctactgaatattaatattgctccttgggttctaatcaaagatttaatttacctctctatttcagttttcttgcatagaaactacaaataggaacaaattatttagaaaaactaaaatatgaaatatggctaactcttgggatggagtgagtatatctatctattatatattaaaaatctattaaacttcctacaaatgctcataagttaccatgtgacacttctacaaacactactaggtcgccatgtggcactaggaattctataaaacaaacatctagccattgattttcatttaatctggtagagccattatttttaaccattagatctatctgataataggctatagtattactctgcaatgcaattctacaaatgagaaaaatgagatgctagcagatcactttttttccagttagagatgctagcaatctcacataagtagtgagcatagtgactctcagacaaagatacttcaaagttgtttctgtttttatattagtgaaatatttctgtgtagttatctttttgtcctcgggagcattcctagagtgacaatataagatgcaatgcaccatccgtctttattaacagaaattccaaagctccatatggtctatgaaactcaatttttacgtgaagaatttatatggagtgttgcataaaaaagtagcatttattattctacttctgtgtatataatgtcaaaacgtgccttacacgtgcacgataactagttatctaaaaaaagagca

SEQ ID NO: 17498 - DNA, 545 bp, Oryza sativa
tattaacgtatgattgattgagttttaattattacaaacttaaaaaatagattaatatgatattttagagcaactttcatatagaaagttttctcacgaaatgcaccgtttagcagtttgaaaaacgtgccacaaaaatctttatcttcatccaactcttaaaagaaatgaacggaacgatagtcaatgtccctttgacaggattgttttgcttcctttatacagtttccccttgtttgatggagaccaggcagtaatcaagaacggccgatcagtttgagtcctgaatcttcacatattcctaaccacgcaagtcaaccaagattagtactaattcgttataaaataagtaatatggtttaacaagcaaaattgggattcttatgggactccaaagatcagtactaatcctattctagtaattattaatgcagtaattttgttaagtacatcccttcgtctctttgctccgtgctgtccgccctaaacctatacacaagagcatcgacaagctcgccatcaaaacattgtcctgcctgccatgt

SEQ ID NO: 17499 - DNA, 1501 bp, Oryza sativa
agctgcccctctcttatggaagaactggtcgttatgcttgcacttccgcctagtcatgcttagtgttcgtgtgctctttttttagataactagttatcgtgcacgtgtaaggcacgttttgacattatatacacagaagtagaataataaatgctacttttttatgcaacactccatataaattcttcacgtaaaaattgagtttcatagaccatatggagctttggaatttctgttaataaagacggatggtgcattgcatcttatattgtcactctaggaatgctcccgaggacaaaaagataactacacagaaatatttcactaatataaaaacagaaacaactttgaagtatctttgtctgagagtcactatgctcactacttatgtgagattgctagcatctctaactggaaaaaaagtgatctgctagcatctcatttttctcatttgtagaattgcattgcagagtaatactatagcctattatcagatagatctaatggttaaaaataatggctctaccagattaaatgaaaatcaatggctagatgtttgttttatagaattcctagtgccacatggcgacctagtagtgtttgtagaagtgtcacatggtaacttatgagcatttgtaggaagtttaatagatttttaatatataatagatagatatactcactccatcccaagagttagccatatttcatattttagtttttctaaataatttgttcctatttgtagtttctatgcaagaaaactgaaatagagaggtaaattaaatctttgattagaacccaaggagcaatattaatattcagtagctgcatacgtgtatacgctccttaatttttgttatatgcatgattaattaagttcttcttggtcatggtgataaaagtaataggtgtaactttagtggatggagggagtctatgtaactaaatatacaattacattgacatcatgtaatccttgctttatataattaactttcaccacattggatatagaaaacaatttggttatacagctctaatgtccttacacgttcatgtttattcagttgatacagtgacacattgcacgtgcattaccccttgacatgcatatacttaattaaaatagcacaatagagtattcatttgaaaaacattcaataaatgggagtgatataatcttccaacttcaaattagaactgtacattaccatagctgcatttaacaaataccgattgtagtgacacaaattaaattcaaaaccaaatatcagtacagccgaaaattgataatcatgcccaaaccatgtgtaagaacaaaccagatttcatgtcattctcgatgatattgttttccaaaatctcagtgcccttaccttagtcaaatcatttttaaaattgaaaaagattgaagcagtggtaaccaaataagaattggaacaattattcataaatacacagatatgtagaaataaattaaaaaacaggagcctggttg

SEQ ID NO: 17500 - DNA, 656 bp, Oryza sativa
caaggacattggtggattctgcactgctgttctatggacttaacttcagtatagaatatatttgcccttttgcttgacttcatatggtgttatatttctcattttagatggacattcgtctaatttatctgtaccgtgatctttttctgaaaatattctctgcaaagagaggtcatctgaagcattgttaaaaaacagtaagtagcaaaaaaaaatcatggtacaggcgtcaatggtacgcagtagtgaaaacatagttaggagttgcatgttatgttgatttgctattccaaaacgtgtttgaactgtagcaggatgttcctatttaaactagagcttttagccatgtattaccttttgtagcttccctgctgattacgttcgaagaaaacaaaaataatccttattgaaatatgcacattgtaaaacagtaaggggttcttatactgttttctttaattccacaatacagtaaaaagagtgagatcatatggcaacattctttgtgaaagcaacacatccatatctggatgtagtggttgccataatggagacaaggagctgttgaatgcagtattgcttgatgttaaaagtgggtcacaatttccagtgttggaatctaattcagtacatggcaatgaaatttcattgacctc

SEQ ID NO: 17501 - DNA, 1501 bp, Oryza sativa
gaaagttttgaaattagagttgaaagtattaaattttcagtagaaatttcattctaatttcatttttttcatacactgtgtatataaatgatgtgaacttaatcacgtgaaagatagagaagagatgctaactgcacctgctagaaaagttaatcatcgtgggtcgggtgatgctaattgacgcgtacacatgctagtatcccgtcaaacacgttgctacacttgcgaaaattttttgaaaaaatactattcatcgatctttctttcataaatataccggatgtggtttgattagcataaatataccatcgaaatcgcgtttagaaagcgcgataccgaggttcgctacgggaaagcgcgatatcgccacggtatcgcattaccaatgcgcgagagcgtgacggtctcgcgcatcgaatgggcgaggagatttaagctggcggtgtcgctggttggttatgcgatatcgacgcggtatcgcatttccacggagcgagagcgccacgttgtaccgatttgggtgcgacgcaggtggagtgacgccatcggtctcgcttattggcagcgctggcccgcggtctcgcacccccgaatcgcgagagcggcatcggtatcgctctttcagagcacgatagcggttgtggagtgggccccacggaatttttttgctgggagatcaggcagccgtggtatcgcaaaggcggttgtggagtgggccccacggaatttttttgctgggagatcaggcagctgtggtatcgcaaagtgggagtgcgatgttgcgcatgggggcccgcagtctcgcacgttggttttgtgagaccgaaggcaatgtgacgtatcggtgctagagcctacggtgtcgcacaaacaatgtgcgagaccgcacggcatggctgccacagggccagtgattaatgtgttaatcaccttgattagcaactaattgatcattaataatcattaaataatcactaattatggtaattaatcactaattaccgctctcgtgttcctgtagcgtgagactgcttgggttgcagtcgccggccccagggctctcgcatctctcttgcgtgagaccagcgctctcgctttcctctcgtgcgagatcgcgcatcgcagcagttccgggacccaccgacttgctctcgcacttttagggtgcgttcgttcctgggggattgggtgagaaagcccatcgtattccgcgcgcatgcttcccaaactactcaacggtgcatttttttaaaaaaattctattagaaagttgctttaaaaaattatattaatctatttttaaaattttaaataattaatactcaattaatcatgcgctaatggctcacctcgttttgcgtatcttcctaatcttcttaatcttcttctcctcaaactcacccttagagtgcgacaccgtgcgctctccctaattagcaaagcgatattatatgaccgcctaggccatcgtgtgcgctccgtcctcgcagaccgaacgagc

SEQ ID NO: 17502 - DNA, 1501 bp, Oryza sativa
gccaactggattgaccagaatggttggccacccaagcttagcctcacgtggcttcaattagcttggtggccggccggtcacttcttgagtaactagctaggtcctcttgcctagtcgatcggtaccaaatgtgttcaaaagttttggattttactttattttattgatacctagaaaatagctaagacacgacataaactagtggaaatatattgaccttgtttagatgggattaaaactttttttagtccctatcacatcggatatttggacactaattataaatattaaacgtagactattaataaaacccattctataaccctggactaattcgcgagacgaatctattgagcctaattaatccatgattagcttatgtgatgctacagtaaacatgcgctaattatggattaattagtcttaaaaaatttgtcacgcgaattagctctcatttatataatgagttttataagtaggctatgtttaatactccaaatttatccgatatgacagggactaaagttcagtctctggatccaaacacccccttactctaattcaaatcgatgcagtgaaggttattttacccattttttttggttgaaagacggtggtcgaaatggggttataaaaaaaacaaattgactttaaagaaactaatcatttcttccgacggcccaacctttttcctcctttttcttgaaacaaactacggtactcaacgaggaagctactagggcaaccaagtgggcctgacgccctgagtccctgaccagtctcccttagccatcgcccgccgctatataaaaggacccccgtgtcgtgtgtgagtgtgtccttctgcgcgagtgtctttagccttcggaccaacttaatctggcggcggcgcagggtacttcgggcaacctcaccatggcggtggagatcccgaggctagccctgggtggaggaggagggggagcgggaggagagcggctaccggcggccggggaggattcggcgccggcggccaccaacgcggggaagcgcccggtggtcgggctcgggttcgggtcctccttggcggccatggcggcggcggcggcggcggggatccagcccgacgcgttcgccctaggtggcccggcggagtaccccgccggcgacggggagcgggacgttctgatggtgagcttcctgcgttccatcgcggcgttcctggccgacgggacgtgccagatgcaggtcaacgacgggctgagctgcgtcgtcgacctcgccggcggggacgccgacggcggcggcgtcggcgaggggaggtcggcgcagcggctggcgtccgcgttcgccgaggcgctcgcgctgcgcttcatcctgccgtgcgacggggtgtgccgctcgctccacctcacgcgggccccgccgccgccggccgtctccgccgcgcgccaggggttccgcgcgatgtgcccgttcgtccgcctcgccgccgccgcggccaacctgtccatcgccgagg

SEQ ID NO: 17503 - DNA, 1501 bp, Oryza sativa
ccatcaacatcgtagctgatttttgttaatcatagtataatcatcaccatgttttcatagccccaacctaatatgtatcattcaaagttttggcatccaactctaaatattactatatgattcttcttagaacaattaaactggtgttggataaattcttacttaaatttgatagattcttacttaaatttggcattaaggaactaggaatatatatctagagtgtgcttccagctagattagttatatatgcaagcacgtagtatatatgtttatctgatctatttttttgaatgaaattatctagtctaattaattagaaagtctttagaacaagagcaaatgtaaccaagttcaatgctatatagtcatatgtatatgggaacagtgtgttgcatagcttgcagctaatttttgaaaaaataacggaccaaattaaagtccaaaagttaccatgagagaacatataagccttataagcctgtaaaattaataatgatattagatactaaattaattttgctgaagtcataattataaacatttataattctgcaaaacattccgctgctaattaaattacactactatatcaaacaaactaaaaaaacttagcgtatagaattaataagaacaaaacaagcttaattcaatggaagctatctcggaaattttgactcctacctaattctctagaaaacaaaaatataactatattctaaatgtgtcttcatcaattgcagtagcgcgcttaattaaaacaacaatcatacatatgttatattaagcctactttgctaacattgtatgcaagtctgttcattctctcccaatgagaacaagtcagataaaccaaaaacacctagcatatcctgttgatctagaacatgaatgtgatgttgatctgccatgagcatgatcaaagtgtacacctcaaggatctcagatctcacaaattagtgcctcatattatgatgtatatgcaagacttcatacttttatatgaaatacatgcgctaaataattacaattcagaaatttagtgttttttttataatgggtagcaattaatccagtctctcttatatatcgatccacatgtgggtatacacagcaattcagaaatttagttacctaagcaaatgcatatcacactgtttgaaatatctgccaatgtgcatacatatactagatatatagatcaatatggtcctggttatttttttgacgcgagaagatagagccgactctaccagcttatagagccattacattgatagaaatgaagaggtacaaagtttttaaggttacaaaatgaaagaggaaaagtataaaaagagagagggagggaaggatttaaaggttacaaagtgaaagaggaaaagtataaaaagagagagaggggaagggagaagaaggtaaggaggtgaggaaatatacaagggagatatatacagtagtctgaggcgggtctcatccccacctcggaggagtgaacagc

SEQ ID NO: 17504 - DNA, 1501 bp, Oryza sativa
tatacaagcagtactaattttgctgatgtccagcaccagctgggtgtattctctcgattgaaaagagaaggaactccgtgccataaagttctcgaaggaaaaaagacaagccatatctatctctgtgttgtcaacacactagctagtacattaaattttgatatgattatctagggtccaaatgctgatatcaaaccatagctcagcctgaaatgtactataattcaaagatttgtcatcattctataccttaaatattactagtatatattctttcaggaaaaattggactggtgctgacacaattattactcaaacctggcactataaatttggaactaaaacccaagaactggagtgttctacttcttgaattgtatgtgtaatgtttatttggagtaattagaaagtctcagaataagagctgtacctattatatgaacattgggttgcacataattttgtaaaaaaaaaaaaacaacgaccaaactaattaaagaccagaactatcatgagggcatataagcctgtataatgatcctagaaccactaaactaatttgtctaaattgatagaagaacatacataattctgcaaaaataaattgctgctaaatttccctgcaaaaaaatcttgctgatgaattacgcagcacatcaatcaaaaaacacatgtgagcacatcttgcattcaattcctagaccatgaaatggttgatttcctaagaatcatgaacgatcaaaaccaacagtgattcattttttgtttctcatatgatgtatatataaatgcatgctaaacatactacggtctgcaaatccagaaatttacacctgaacaaaatgcagataattgtttgtcgatgtgcatacatataataatacttgtgctgcttatggttaaatttttctagcaattctcatggccctgtatctagggaccgacaatctagcacatatatactcctaacagattcagtggcaccaactgcaaacaaaaacataaatcagcaactctatgctaagtgaagtctcagatcaatcgaacttttctggtttataattaaaaacctgcctattctattgttcttcgcgtatttatttgcagagccctctcttatttgtaattatcttttttagttcagaaagaaattaaacagagaataatatatatacaacggtagaatttttttttatagggagcgcagagatcatttgagcctataaaaggataaaaatatcactacaaccagaaacagggtaaaaatatcaagggattttagatgcaaaaaacaacgaaatatcatatgcaaattaaaagaagatcaacacacaccttataataagtaccactaattcatctctaccagagtttttttcccatgtacaagcagtagtactttagcatatgcccagcaccagctagctggtgtataattctctacattgaaaagatcgaaggtactctgcagtgtagctctcgaaggggaaaaaaagatcca

SEQ ID NO: 17505 - DNA, 1377 bp, Oryza sativa
gcggcgacggcgagcttgtcggcggcaatgtggtgggtcggatgaggtgatcatctgacgcatggattgatgcatgattcctgatgtgtgtcttcgtgtgtgattggcctcatactattgtgtgaaggaaggggggattcggcatcatcgtgatcctatgtgatctctggattaaaaactttcatttttgattaaaaactttagtagtgatttatcgttcatgttgatcaactcaactagttattatccttgtgctactgtcatttgagtttttatcagtatgcatgcactcagactttaattttctgttgatcgaacaagtagttgaaacaatgtttttttttatgatgtggtgtgctatactgccatgagattttgtggttttgcattttactttatttgattgatacatgcaaaatagctaaggcacgacaaaactagtggaaatatattagtctaattcaaatcaatgcattgaacgttgttttacccaatttttttcatagaaagatgatggtcaaaatggggttttacataaaacaaattgacttgaaagaaagtactttgaattatttcctctattacttgaaacaaacttgtagtcaacaaggaagtggtcttactgaccggtttcccttagcaatcggcatatataaaaggactgtgtgtgtctttagcttcctcgttttttcggacctaacaaatctggctgcgcagggctccggcaaggtcaccatggcggcggagatcccgaggcttgccctaggaggaggagggggagggggagagcgactaccggtgccaccgatggctgcagcggaggaggattcaccggcggccacgagcacaaggaagcgcttggtggtcaatgagtcctagaaaaggacaaaaggaaaaagataggaggaaaaccgagagaagagagaaaaagatgagggaaacactgaccttttacgtgggttctctcttatcaattgggttgataatgtattttaatgcgtccactgtctaccagtaaagaccacactttttgagtatcctgtagcaaatttttttcacaacaaaaataccttgtagacacattttcttaataggcataggcatttgcctcataagtgccttttgaccaatagtgcccgtcccacacccacatgcgcgagcgcccacacacacacacacaaatgcctaccattttctaaaaggccaatagtgggttttacaaaaaaaaacaaattgagttgaaataaactaatcatttcctctaacggtccaacctagattgttcctcctttttccttgaaacaaactggagtagtagtcaacgaggaagctagggaaacaaagtgggccttaccgaccagtcttccttagccatcg

SEQ ID NO: 17506 - DNA, 1501 bp, Oryza sativa
cgaagaggtttcttctatagggtccttagcataaacacttgtctagaacaaacgtgcaggaatacttaaggaaaattacttcatattaaacagataagcttacatacggttttccctttcgggaaacccgaaggtaggtacaagcaagctgttcttacctcacacagcgttataacagaactccttgcttcaatatactatgcaaggtaggctaaagtcactactactaaaaacggtggaatggagggtgagagtgcgcttggaagctttgctctgaatggtgtcttcgttgttgttcttccctcagctgggcaggcccctccttttatagaggtcaggggtggcgtcgcttgtgcctcctgcttatctcttcgctactgtggattcacgagagcaggctaaagttgatgcctttcctgcctaaagttttattcttcacagggatatgtcattcaccgccgaaagttgctgaaaattatattcttcacagggatatgtcattcaccgcaccctatattgttcctttatgctttatagggtgtccttctggattccttcttctggattccttcttgagtagtcttctgaaatcttcgtttattcttcttccacgcccaaattgttgatattctattatcaatatatattgaaaaacatatttagcttaaagaattctattcatctggttgcccatgaccaccaagatccatagtgtccagatcagaaaaagaaacttctaatttctcatttactgccttttttatttgttcaaatttctgatccatttcttgttttaattctttaagtatttcttcctttaattccttctttaattgtggggaggcttctacaaatttttctattattttccaatcaatatattccccatctaatggatccactccttttgttaggcattccttgtatgtgggttttttagaatacccttcttcttttatagtcgttttaatgggtaattctttgatatagtcactgttttgtaatatcttattctgccttatcttatattcctctagctcttttggcactgaatttaatttattactgacaagcaaatattgttcttcagattgcttttgttctttaaacaaatcttcaatccttcgctctaaatcttcctgctttttatcccaatttatataaaaattatatatcagatcaacaattaaatttaattgactattgttagagtgccaactatggtcttcaatgtgatttagtgtacaccttatattcagattatctttggtagtaattacctttccaatattagcttctgaatttgatttctctatgatgactggctctgataccacttatacttcagaagactaacatttcgagatgacaacaagctactgtggattcacgagaacaggggaatactctgggtttattatattaattttgccttttttatttgttctgaatttaagttgacagctcaagttctgaatttaacgaaaatacagaacttaga

SEQ ID NO: 17507 - DNA, 1501 bp, Oryza sativa
cagatgcttctgtttctaagtcatctgtggttctgggtttgtaatttataaatctaatgctggtatttcctttactgttttgataacttatataattttcaggctgattcaaagttttgctttcaattaaatcactaattttccattcttctcctgccctttcttcagaacttatttttaaagggctcatgaaagttattcccttagagtgcatattttcaatcacgtcatttacatttattttgtatttggaggcacttctattagttaatcttcctataaattctatgcttactagcaaatttgttcctttaaattcttcgtatccctttgtttgaaaaccaaaactcattttatctataaattcttttataggcatcattagatctggggctatatatgttatcaacatattctcattcatatcactttctaaaaatcctaatgctgctttatctattgtgtcccaccttttatctaacagagttattaaaactttagctcctaatttctttcttgtcatacctgtgattcctattatatacataccttggtgaatatatttataccctgaatactttaatccattttcaaattccttggctacaatttttaactcaactggctttgttaaaacgcttaactctacttctgtagatattctgtataacccatttttattctcaaaaaatcccatgcaatatatttgttgaggtcttattgccctcagagtatctctttgatatctttcgagctgtttgtctacttctgaatatcttcaagctcatctatgtcttcaattttacctttttgtttatcaatacaacttaaagatttatcgtctctgcttgctattcttctaaacaaactcctagataggtccatttttctgaattaatagcttgagacgaggtaattatgcatgttgaagccaaaactatctcttttcctttactagaatttattatttctagtaattctttgatatagtcactgttttgtaatatcttattctgccttatcttatattcctctagctcttttagcactgaatttaatttattactgacaagcaaatattgttcttcagattgcttttgttctttaaacaaatcttcaatccttcgctctaaatcttcctgctttttatcccaatttatataaaaattatatatcagatcaacaattaaatttaattgactattgttagagtgccaactatggtcttcaatgtgatttagtctacaccttatattcagattatctttggtagtaattacctttccaatattagcttctgaatttgatttctctatgatgactagctctgataccacttatacttcagacaatatacactgttcaaaaacactatttattcggctgatttttattcggctgattactattcagtttactgtttattcggctgattactgttcaaattattgttcaatactgttcacttcgagagatattttaactttaggatctttgcagg

SEQ ID NO: 17508 - DNA, 1501 bp, Oryza sativa
catagcgagtgataggcattatgacgggtgggctacggttgcctaggaaacaatatggcgggggcactattggccttttagaaaatggtagtaggcatttgtgtgtgtgtgggggcgcgcgcgtgtgggtgtggggcgggcattattggtcaaaaggcacttatgaggcaaatgcctatgcctattaagaaaatgtgtctacaaggtatttttgttgtgaaaaaaaattgctacaggatactcaaaaagtatagtctttactggtagacatcacaaaaacgtgaatttgtccgaggacactggacgcattaaaatacattatcgagccaattgatgagagataatccacgtaaaaggtcagtgtttccctcatcttcttctctcgtctctcggtcttcctcttatctttttccttttgtccttttctaggactcattgaccaccaggcgcttccttgtgctcgtggccgccggcgaatcctcctccgctgcagccatcggtggcaccggtagtcgctctccccctccccctcctcctcctagggcaagcctcgggacctccgccaccatggtgaccttgccggagccctgcgcagccagatttgttaggtccgaaaaaacgagaaagctaaagacacacacacagtccttttatatatgccgattgctaagggaaaccggtcagtaagaccacttccttgttgactacaagtttgtttcaagtaatagaggaaataattcaaagtactttctttcaagtcaatttgttttatgtaaaaccccattttgaccatcatctttcaacgaaaaaaattgggtaaaacaacgttcaatgcattgatttgaattagactaatatatttccactagttttgtcgtgccttagctattttgcatgtatcaatcaaataaattaaaatgcaaaaccacaaaatctcaaatggcagtataacacaccacatcataaaaaaaacattgtttcaacttcttgttcgatcaacagaaaattaaagtctgagtgcatactgataaaaactcaaatgacagtagcacaaggataataactagttgagttgatcaacatgaacgataaatcactactaaagtttttaatccagagatcacatacggtcatgatgatgccgaatccccttccttcacacaatagtatgaggccaagaacacacgaagacacacatcaggaatcatcaatccatgcgtcagatgatcacctcatccgacccaccacattgcctccgacgagctcgccgtcgccgccgtagcgtgagcccgatgcgctagcaccaccagcaccagccgccgccgacggccacagcggtggcgccggtgcaaggaccctcctagtggtccaccccgtcgcacagaaggatgaaccgcagtgcgagcgcctcggtgaaggcggatgccagctgctgcgcagacctccccccaccgacgccgccggcgaggtcgacgatgcaactcagcccatcgttgacctg

SEQ ID NO: 17509 - DNA, 1501 bp, Oryza sativa
gataatagaatatcaacaatttgggcgtggaagaagaataaacgaagatttcagaagactactcaagaaggaatccagaagaaggaatccagaaggacaccctataaagcataaaggaacaatatagggtgcggtgaatgacatatccctgtgaagaatataattttcagcaactttcggcggtgaatgacatatccctgtgaagaataaaactttaggcaggaaaggcatcaactttagcctgctctcgtgaatccacagtagcgaagagataagcaggaggcacaagcgacgccacccctgacctctataaaaggaggggcctgcccagctgagggaagaacaacaacgaagacaccattcagagcaaagcttccaagcgcactctcaccctccattccaccgtttttagtagtagtgactttagcctaccttgcatagtatattgaagcaaggagttctgttataacgctgtgtgaggtaagaacagcttgcttgtacctaccttcgggtttcccgaaagggaaaaccgtatgtaagcttatctgtttaatatgaagtaattttccttaagtattcctgcacgtttgttctagacaagtgtttatgctaaggaccctatagaagaaacctcttcggtttgttctcgtttttagcctgcatcttgcataggcgtttggagaatcggtatccgtagagaagtgttcccttcgggtggaactgcttagggagacgataaactcttagctagaacaagtgtgatttggaatatctttttaagttgcttttaaaaagacagataggtgaggcatacggtgagtaccgagtaggactttacatcatctgaaacaagcttctgaggctgtctaagtaggattcgccaccctgcaaagatcctaaagttaaaatatctctcgaagtgaacagtattgaacaataatttgaacagtaatcagccgaataaacagtaaactgaatagtaatcagccgaataaaaatcagccgaataaatagtgtttttgaacagtgtatattgtctgaagtataagtggtatcagagctagtcatcatagagaaatcaaattcagaagctaatattggaaaggtaattactaccaaagataatctgaatataaggtgtagactaaatcacattgaagaccatagttggcactctaacaatagtcaattaaatttaattgttgatctgatatataatttttatataaattgggataaaaagcaggaagatttagagcgaaggattgaagatttgtttaaagaacaaaagcaatctgaagaacaatatttgcttgtcagtaataaattaaattcagtgctaaaagagctagaggaatataagataaggcagaataagatattacaaaacagtgactatatcaaagaattactagaaataataaattctagtaaaggaaaagagatagttttggcttcaacatgcataattacctcgtctcaagctattaattcagaaaaa

SEQ ID NO: 17510 - DNA, 1375 bp, Oryza sativa
ataacattaaaagacagtaatactgctaaaataattcaactaagagaggccataactaattttggaaataaatatatagtaagattgcctttcaaagaaatattaggtataagaatccctgttaaaataaaattgacaccaaaagtatcttataaaatattagcactagtagacaccgggtgtacaaagaatattattcatgacaaatatttcataagatgtcctgaaatagttcacacaattgacgacaataaggcagaagtttccacagacatgtccggaataaagaaaattcataatcagttagcttataatatggaggtttacattaatgcaactaaatatataatagatgagattacaataagagatttgtcaatgattaatgatgacatgataattggcctaaggttccttcaacaatcagtacaaaccacagtaatacatgagcaaggaattacttttatcccatatcaaaataatgttccatatatctcagaggtacgaaagtttttttctttaagtgtaacatacacttaaaaaaacactatattggtatataaatatatgtaacatattatgcttctgaatttgatttctgaatttgattatataagtgttacgtaacatatattggtaacatatattggtaattagtgtataccacacttatgcttcaaataagtgtctcaccctccaatatacatatacatatacatatatatatgtatatatatatatatgtatatatatatatatatatatgtatatatatatacatatatatatatatacatatatatgtatatgtatatatatatacatatatatgtatatatatatacatatatatgtatatatatatagatatatatgtatatatatatatatatatatatatatatatatatatatatatatagtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagtttttttgttgataagtataggtatgaatcaaattattataactaggtatatactcacaatttgaaaattttgaaaaatttgagtaattttgtgcattagataccatggtgcccgggcaccatggtgccccatatgagtgtcctatatatatatatatatatatgtatatatatatatatgtgtgtgtgtatatatatatata

SEQ ID NO: 17511 - DNA, 657 bp, Oryza sativa
tagcctacaccttatattcagattatctttggtagtaattacctttccaatattagcttctgaatttgatttctctatgatgactggctctgataccacttatacttcggacaatatacttgttcaaaaacactatttattcggctgattactattcaataaacgaagatttcagaagactactcaagaaggaatccagaagaaggaatccagaaggacaccctatgaagcataaaggaataatatagggtgcggtgaatgacatatccctgtgaagaataaaactttcggcaggaaaggcctcaactttagcctgctctcgtgaatccacagtagtgaagagataagcaggaggcacaggcgacgccacccctgacctctataaaaggaggggcctgcccagctgaggggagaaaaaaacaacaacaacaaagacaccattcagagcaaagcttccaagcacgctctcaccctccattccaccgttcttagtagtagtgactttagcttaccttgcatagtatattgaagcaaggagttgtgttataacgctgtgtaaggtaagaacagcttgcttgtacctaccttcgggtttatatatatatatacacacacacatatatatatatatacatatatatatatatatatatagga

SEQ ID NO: 17512 - DNA, 1501 bp, Oryza sativa
tatatatatatatatgtatatatatatatatatatatgtatatatatatatatatatgtatatatatgtatgtatatatatgtatatatatatatatgtatgtatatatatgtatatatatatatatgtatgtatatatatgtatgtatatatatatgtatatatatatgtatgtatatatatatgtatatatatatgtatatatatatgtatatatatatgtatgtatatatgtatgtatatatatatactatatacatatacactgtggacactgtagtggtgaaactgtattggtaattagtgtaattatacaagcaatataaatagaatacactaattagcatacactgtccacactatacactaacactaacactatataaataattagtgtatatacaatatacactaattatttttaagcgtaattatttaaatagcattgctgtatttagacgaggtaattagtgtatagcttcagacaatatacactgtccacacttatgcttcagatagtatacactgttcaaaaacactatttattcggctgaatactattcagtttactattcaaaaacactattcagtttactgtttaaattactgttcaatactgttcacttcgagagatattttaactttaggatctttgcagggtggcgaatcctatttagacagcctcagaagcttgcttcagatgatgtaaagtcctactcggtactcaccgtatgcctcacctatctgtctttttagaagcaacttaaaaagatattccaagccacacttgttctagctaagagtttatcgtctccctaggcagttccacccgaagggaacacttctctacgtataccgattctccagacgcctatgcaagatgcaggctaaaaacgagaacaaaccgaagaggtttctcctatagggtccttagcataaacacttgtctagaacaaacgtgcaggaatacttaaggaaaattacttcatattaaacagataagcttacatacggttttcactttcgggaaacccgaaggtaggtacaagcaagctgttcttaccttacacagcgttataacacacctccttgcttcaatatactatgcaaggtaggctaaagtcactactactaagaacggtggaatggagggtgagagcacgcttggaagctttgctctgaatggtgtcttcgttgttcttctcagctgagcaaacccctccttttataggagctcgggaggctcgactgtgcttcaagcttatcttctagatactgtattttcacgagctggctcgcaccatggagatgcttatcttctttttggcttactttgtccttgaattggccaaggtggagacacctctgtacctgcgcctttcttttccgccgaaagtaatattctccacagtatttttaacagtcaaatgtcattcactgtccttgcattttggattgattcaaattcaattcatactttggtcattcgcaaatatagtct

SEQ ID NO: 17513 - DNA, 1501 bp, Oryza sativa
tatgaattttctttattccggacatgtctgtggaaacttctgccttattgtcgtcaattgtgtgaactatttcaggacatcttatgaaatatttgtcatgaataatattctttgtacacccggtgtctactagtgctaatattttataagatacttttggtgtcaattttattttaacagggattcttatacctaatatttctttgaaaggcaatcttactatatatttatttccaaaattagttatggcctctcttagttgaattattttagcagtattactgtcttttaatgttatcaattgctctttaaattcggtgttttgtatgtccttattctctggtagtgccttaatatcgcaattattttttaggttctctaattctacttctagtttatttagtctattttctaacactcgtactctactagatagtcttttcatctgattctaattctatttcttttctccatttttgtttatttgcttttatacattcagcacaagcttgttttagacatatactacaagtcactctattttcttgacttgggtaatatatgcaaaaagcacatttgatattatagtcaccctttcctctaatccaatcatgttcacaatttaattgatccatcatttcaacctttagacctgctaattcgtcaattaaatctaactcttcatcggatgattcatattcttcgttgatagtttcaacttcgtctgtttctatgatagaatatattgattcgtcatcttttatttcatcatcacatactaatatgttttcgtttacgctatctataattagaaccctctcttgttcttcatatttactagaatatctcttttgatctttatttgggcatgttctacttaaatgatctggcgagttgcatataaaacatctgcatattttgtcataggttttctttggattatatcttcttacatttcttttatgtaagaagggtgctctattatctgatcttcttaagaaataccttttctttgttctaatattattgttgtttctattttgatgtttataaatccttttacttctaggcttgtcttctccatatgacaagggtatttgaactattttattgcagaaattgtaatccgagtgtttcatagatctttgggcttggatacccgtgcatatttttcttagttgcttaaacacaaaagttatggcttgagagatgttgatttcagctccttcagtttcctttttatattcttcaaatatcatacttcctagtgggtcaggtaatttattgaaataacgttcaactatacccctgttatatccttgtttagcagttgtagcattatataaataatgttgggagaattcttttatgcctttccaacttgttaacgttaatttttctcatgtctgacactatacactattgtatagtgttttttacacactatacactgtccataaatattaaactatacactatacataagtgtgtatattatata

SEQ ID NO: 17514 - DNA, 988 bp, Oryza sativa
tcccgtccaacaaaaagtacctcgaggtaccggtaccaaatcgtttaagatcgttggatttgtaagttagatccaacgaacgaaaacaatttggtatcgtgagataccgatacctcgaagtactttttgttgaaccagagcaaatctcttatttggtatacgaggaaataaatgaagggtgaaacttcgccatgcttcttaacatgtgaatatttttattatctaactatatattacctatccacagcacatcgcactactcgtgctctttctcccatcaccacattctgatgagtttttccatgttggtaccacatggtggccttgcgctcttcactcatcctatcttcctatatagttggtacccactaaagagcatttactcctataaagcaaaacatgcaagaagccacatcgtcaataattttaagccatcagatcatatatatactttctatatagttggtacccactaacaattattagaagctaaagctcaacatgcaagcatgccacattatcacccactagcaattactattctagcccatttaaaatcccatgcaagtgtgacatcccggcccagggcttaataggattgatagaatactcatatcaacaagttgcaacttcttttccggaagccgatctcgaaagaactatgaggttaagcgtgcttggcctggaccgaccgggaaattcttcccgggtgcgcacgagtgaggacaaagtgtgcagaaaaggctagtgttggtctgtgagggtagtctatgtcctaggatagctgccagatgtaagagcgaccgggaaattcttcccgggtacacacgagtgaggacaaagtgtgcagaaaagactagtgttgatctgtgagggtagtctatgccctaggatagctgccagatgtaagagggctcggcctcgaagagtgtggggcgttacagatggtatcagagccgacccttgcagctatacgtatatatgaaca

SEQ ID NO: 17515 - DNA, 213 bp, Oryza sativa
cgttctgctcgccattaattgcgcggcgcctcatttctcttgcctcaccgcccgttctcggctctcaagtaaaggttgcagtactcgcgtgcatgcttgcctgctcccttcctctccgcagcacgctctcgcctcccttcgtctcctccagcacgctcatcgccagcatttagggttcacgcacctgcctcgccacccggcacgcttgcgcta

SEQ ID NO: 17516 - DNA, 1501 bp, Oryza sativa
tttgggaagggagttgtagtgaccacttaagctatttggcaaaattttgaaccaagaaacagtaaactagttggcaccctgcgtctttgtcacgtgttttctagttttatcgtcaaacaaaattatagttttaaatggttaggtgcaactctctctctatataaaatatataataatgtggatttatatatgccttatgttattacaatacaattcatgctttatttttccaagtgtcagtgtgtattgctataatatatgaatattattttcatgtacaatatgggtatcgttgtagttagacagtttgcatctctctacttcactgaagttttttctgaaaatagattcaggtaacgatatctaataattatatgctatcttatcatgtataataaaaacaaaacacacatattaaacaaaaattgagttgtatttggaaaacatggtgttatgcacaaaatatgtaacagtgctatgtgtgactatgaggtggagcaaaggaggtgaatggataactaataaatgattgaattggatgaataagtagtttcttgatccaacaatttttatctttgtactccctccatactcgtaaaatatgtcgtttaggataggattgtgcttaccaaggagtgattaactaggaggtattttccctgtctacccctattaaataggattgtgggtgcatttcatacgagaaagaactaaagctcagttggctcttggagcgagccatgtgttgcgagtacctgggttcaattcccggtggccacttttattttgctggttgcttcattttacatgggaatgtttgggccctacatggcgcgcctgtgctcgcgttttcgcatcggctgggcgtagcgcgcgcttggacatgttttggcgcgccatttttcattcgtttttgattggcacgtgatttttgcaatggcgccgtatttttagcgcgcaacgtttcaccgtgcctatttaaatgggggtgtttcccccggcctcttctctttccattaccgtgctccatctcttcactttccctctcttctctttccatgtatcgcatgtaattgctgacaacggctttgatctaaacgttcgcttagaagataatgacaatggctttgatctgaacattgccttagaagatgacgagaatggtaatgtgattccttgtttgagtttgttatttccttcaaattccatcctttcttagtttgttgtttactttttggactggaatcgatttgaactttccattagatcaatatggagcggttgattttcacttcgtacaaaacctacctggtaaacctgcatgccgtttctactattttcatacaacatctaccgtgcatgcttttttttaacatgcgccgtgtgcatgctgtatatactatttgtattgtaagccgtggctaacaaatgattcttttttttgttttactagaacatgttgatcccattgaagcaaaccatcaaagaaaatacatgacag

SEQ ID NO: 17517 - DNA, 1501 bp, Oryza sativa
acggagcagccggccggggcgcgaagcgagccagtgaagcgaagcagggagaagggcggcaaccgctccactcctctctctcccttcccctttcagcatgtgggcggcagagggcgcagagcggcagcggccagagtaggccagtggagtggagcggggcgagcggcggccgacagcaggtagggtgaagcatcggcaggcgatagagagatgggcgcggcgaggccaatgggcgaaggaaggatgacgagttgtgggccttccccttctcctttccctccctagccacggctgccagcggtgaatccttgtgcgcatggaggaggaagaagaagggatcaggtcttcaccgctgcgccgcctggtcacggggtccactgcacgccgcatgaccaccatcgtcacgggagtcgtcttctcactatcctcctcatcgtcgtccccttcggcgccgtcctcccactcggcatcgcgggcccaatctggcgaggtggtggtgagaggactgggcgaaggggtggaagaaaatgtggttgtcgaggaaggcgtggaaagagtcatcgggaagcgtgcaatgggcatagaaggcgaggaggtggtaggcaatgaagccgatgagcgcgtgggagagggcagtgatgggccacgaaggctatagggaggagcaggccgaggatgtggtcggttatgacggcgggcgatggcaatccaccaactccacttcatccccgccaacatccaaatccgccatcccgagctcctggcgttgggatcctctttggcatcctctgcggtccgttcagtgccgcctccatgtacctcgtgtggtccatcatcgccggggctggcgccgcaaggtagaggaggtgaggggacatgtgggtcccactattttatcttcttgactacttcctccttttcacaatgtaagtcattctagcatttcccacattcatattgatattaatgaatctagatatatataacatcaatatgaatatgggaaatgctagaatatcttacattgtgaaacggatgaagtacctgtatattttgttttaatttttaattttaccacttttatttttggatcaaattgccacgctagcgctatgtcaatatcacgtaggacaaagacctagtaaaaggagccacgtaggcgccacgtcatccaaaaccagggaacaatactgccgagggaccttatttacacggttttgtaagttgggagatacgttatatccgtttttgcgttcagggatgaatttcggactcggcgacacattgagggacctaaaatgaacttattcctagaaaatatagatttgcccatgaagttgggctccaaccggcccatcaacccatctcgctgggccagatgggccggacttgtcagggctagtcctaccagcccggaccagcgaggcttcgtccacgtcgccattcacctctccgcacgcacccacccacccaccaaccgagcaaggaggaatggcgatgg

SEQ ID NO: 17518 - DNA, 1501 bp, Oryza sativa
catgaaattttgaattaagtgagggtaaacacaagaaaccatatttttcttatagtttgaaataagatggaagcataaggcgtctgtggtttgttgaaggagaaattagatgaaaactaacccagagcacaaagcaatacagaaattcatagtcattcgaacttttccagtaatgacatgagtacatgaatttccttcacaagtgactactccgccaagcatctcaactacctgcgacatgattcacaacttacttcatcttaaagaagagaaattgcattgcagtaacaaaaaaggaagggaaagaataatgcattttattcaatgcatcaaagtttgcctagttgtgcaatgagtgcatcctcatgattcatattcccttaacattagacatggcgcttatattttctcaaagatgaagattgtcacagaaattacctctataagttgtgtcttctttgtttcatcggcaatattcatgagcataacagaaggacttccattggaactgatattggcctttgcatctcctgatattttgcttttaacatgacctaccatgcttggattagaaagttcgttgggcatcagatgcactgaattttcatgtatgggggtgttgcttatagaaaggggtttgccacagatctcattttgattcatgtcttggtgatggtcagaatgttgggaacatcttactctttttgactttagtgaagatgatgaggtttcatgtgtacgtttattttcttgttggtcagaaaatgaacatcctccggtaccatggaaatcttcatttttttccactgctgcagtcttgctgaccttgtggcatgcaactgtctgcggaagcaatttttcacaggagggagttgaagtaccggtatcacttggagagatgcctgaaaaagaccacaaaaaatcactccagataaattgaacttattttgtgcaaatgcacaagtgctcataccattaagctaaatgtaagtagattgctctcaacattgaatggataaagcatatttggctagcagtttctgtaatttaggcttgtaatgtgccttaaatactccccctgcttgttagaatttcaatggttactcttattgagaacaggatggcactcgagatggggcaattttctggttttcttcattcacaaacacaaaagccatgccttcccgagggaggttggatacatatatatagccataggtggctggatggctgctagctaattgctgcccacactagtctaaaatttgaacgcgatgctgtcctagagagcatccaaactgaataaagcataaaggagatgctagatgctgtcctagggatgctaaaagcaaaactgaaagatgctaaaagcaaaactgaaaggatgctgtcctaaaaggggaaaaacaacctaaaagcaagagaaggaccacaaggaccaaagaccacaaggcttattccatcattctccccctaagtcttgtgtgtcgtcttgtgggaa

SEQ ID NO: 17519 - DNA, 450 bp, Oryza sativa
  unsure (1)..(450): unsure at all n locations
cgggccaattttggnctttgtnanccctgannnnnnnnnnnnnnnnnnnnnnnnnnnnnnnnnnnnnnnnnnnnnnnnnnnntctgcattagttgtgtcttagctgcattagttatgatctacttttgtgttgaactatcaacttgtttgatgtgatgtgacgtaatgaacatgtgatgtgtggacctatttaaaccttcccttcttttcttcttgaagtttggtcatattatatttatgatgtgctttctttctatgcatatgtcactcctgcaggatggtgaaagcagtggtgatgaagatatctctgatgaagatagcagtgatgatgagattgatcttatcatttatattttgaagaaaagagaaatggacaggagaagagcatgtatgcttgccgccatgattggtacgtattacttggaactttactctaataaggctccaaga

SEQ ID NO: 17520 - DNA, 1501 bp, Oryza sativa
ttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccagaagatttattactcgggagcatgttacatgcgtcatcctttaaagggtgtcgaaggcatattttttggcctaagcctaatatgtctgcaacccatgttttcaggtgtggcctgtcacgttcttttagggacttaggcactttttgcttaggccaaagtgcgcgtgatcaagtgcccaataccccaataccttaaaatccttttataccgcagttacttaactttttaggagttggtacaatgcatcttaaaaggtgtcaaacagtaaagctttatatagctggcccgctgactttttaatatagtcatggtgcttgttggttttttaagcaattggttagatacaatatctgtgcttttttgcacggtagtgtgcattttaatgaccaatattatggcttaggctgattatataatgggggcatttttcaagcgggtggtaaatcctttatgagtttatttactcggattttataccacatatgccatatatttccaggggtggtggaaccatgttgtttttagggacttaagcacatttattaaaacagtgtgggcatggcgtatgaccaatactttggaaatttctttattcacaacatacaagcttttttatagctgttttgctatgtgaattttcaataatgtagccaactttaggttacactcatcatattttacaaagcagttggtatatcactcggatcatgttattcagggatttacaccgcatatgctacatattaatatcaagtcgcttggttaactataattatcgaagccactcggttggttggattatttattccttgactatatgcttagtttgttcacttaaccgcatagtcgagggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccacacggcatggttatccgactagttataggggataacttatatatatgaaatatgtaacatatcatgacttgggtattacgtttccctgtatattatggaacggcctaaagtcctggtttgataagattgtaaagtagatttaggaaaccgataccgtattggttatggtttctatcttgtaaccctgccccccaacctatataaggagggcagggaggccctctagggggca

SEQ ID NO: 17521 - DNA, 1501 bp, Oryza sativa
attggcaagtgccgccaccagtcacacttaatggctacctacaagcgacccaagtaatgtcaaccgtgggcaactaaatttccctttttgtagcattttagttcattatttgttagtggactattagtcttattaacagatatatcctactttatcagcacagataatcaattaagacttggaagtctatgctaactagatgcttggtctttgcttgtgagtcaattgcagggttttgaatctgttggagaggtagatactaaaggcaagatttgcagaattccagtaagggccgatatcaagagggcattatgctttccaggtggttcaatgcttatggtttcacatctgaaggatttgccagctcctcaaaagagtttactttcatctcagcaaacatatcagtttcacacgtttgcaccagatagtaagtctaagtgaattcatattgctaattttcttttgggttctggtatctcaaacccgctatttcctggaactaattgtctaggcaactataattgtgatatgacatagattacatgcaatttagcaattatatgcttatatattatacaggcttcctgtagttctgagccacttttgtgacctattacttggttgcaattttattataatcacatgaatacaattaatctaagtaaataaaaaatgtaaagaagatcgtagtagcctaatatgcctcacatggtagaccagtatccatttatgactcttcatttgtcttattaattttgactctcaccaatcaagctttaaccagcaatatttttaggatgtctaataacatagcataaagtttgtatggctagatttgtaatcaaagttagttaatttaaattttgtatatttagagatattttcttttgtgatgtttaaaaattaaccgtcaaagttatatctgtcagcgccaaaattgggctgtaaatgtgagcagtgatggaataagccttgtggtctttggtccttgtggtccttcttttgcttttaggttgtttttccccttttaggacagcatcctttcagttttgcttttagcatctttcggttttgcttttagcatccctaggacagcatctagcatctcctttatgctttattcagtttggatgctctctaggacagcatcgcgttcaaattttagactagtgtgggcagcaattagctagcagccatccagccaactatagctatatatatgtatccaacctccctcgggaaggcatggcttttgtgtttgtgaatgaagaaaaccagaaaattgcctcatctcgagtgccatcctcttctcaatgagagtaaccattgaaattctaacatctggtatcagagccacactttcctgtaggctaaacatctcctgttccaccccttcccaagctcggttgagcactcagccagtagcagcagcagcaccagctgctcctccttcccctttcccttacccctctccacacagtagccccccggaggcgcgcca

SEQ ID NO: 17522 - DNA, 619 bp, Oryza sativa
gcgccaccgggactaaggatcccggtgatctttagccccggttggtgctaccacccggaccaaaagtcccacccctatatatatgtcttcttcctcctccagctgcccgagcaagcttcaaaatttcttcaaaaaagagtggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtaga

SEQ ID NO: 17523 - DNA, 1501 bp, Oryza sativa
gatggttatcgtttttaaaatttagtttttttaatttctatcggcgtggcattgaagttgacactaaatagatgaattcatgaatatgaaaatttttcgcccgtttctgcttgttttttaaaaaataataaaataatgatgccgtttccgaccatttccaaccactttcatccctagacttgggagagaggaacgaacaggagactgggagaggcggaagtaggtgagcactatttgtcatggaccttattcttatgaacatggtgggctgctgggccaactcaatagtcaatattcattataataagttcactttaggtctctcttattgactatgagtttagattgtgtccttcaaccaatttgcaaaatcggtgtaaccgaggtcacatgatagtataacatccagttttaactaatgtgacgagttgactattatcaatctggttgagtcagcgtgagacccacatgggtcttatatgttagcagccaactctctctaccgagtccctttacctaatatctatctacccatcccttttccccatctctctcccgacaggaactggagcagctgctggaaaagccatcatgctcaagaaccccgtagtgaccttggccacgtagcttgtgttgccatcggggtaagccgagggggcaacatgatgttacgcaatcgaggtcgatgctgggttcctgagggtgagggttgctcgagcagccgcgtggcaagctcaaggtcttctagtccactggttgtcacccctctcccattggccgctatccttcttcccgctgctcaccgcccttctggccttctccaccggtggagagaaattggcaagagggatgggtagagagaaggggcgatgaaggaaaaaaagagttgaccgctgatatatggggctcatgtgggtctcacgcttactcgatcattatgatcatagttggctaatcatgtcagttaaaatggggtgttatactgttttagaatctcgggtacaccgatattataaattaactgacatattatactggtattgtggataaggacgcaattcaaactcagcatttaaatgtcgaaagtgaacttatttcatattcacttattaattcctgtcgggccttgatcaggtcgtaagcagctacgcagtaataacgcagtgcaaagaggtgatgcgcaatagtaaaaggcacaaaggcaaaattagtgttgacatgttgcccagttttctactactagtacatagattaatggtgcaaaattaccatggttaaattagtaggagtatacagtactataatagttgcaaggtgggtggggggggtgtcaagtcaaaaccttgagcgcagatacccatcaacgcacacttgctcttgctcagctcgccaacgccaagatgcgcctcgtcaatctctcccaccgagcaatcgcgagacctgcattctagccgtgcgaattccggcgggcttccgccgtagatccccaagaaacccccgg

SEQ ID NO: 17524 - DNA, 344 bp, Oryza sativa
tgtgacttgccttgctcagagagaacggccttccgaacctacggcgacgaccacgaaccacgcttcgggaacctccggaacgacagaagctacgcgaagcacacaagcaaagctacaagcctataaagaagcaataacaatacataaaaagaaagcacagggttctttaggttataacaaacattaggagacttgaacgggtcgattcggagttcgtatgaccaaaatatgatcatccgaggtttaatgctgttatatggagatttgcggattattaagctttgcaattataaaacatgtgtaagcgctagcctggaaaagacaggaaggctgcgccgttgaca

SEQ ID NO: 17525 - DNA, 441 bp, Oryza sativa
  unsure (1)..(441): unsure at all n locations
gatctagatattcctatcaccntataagggacctcacacaaaaatgtaatattgtcatgatttccttatggagtattatttcaatttccatgttttccattccacagtttgctgcatcaattaaacatatatcataatgtcttatagattatccatcttagttttccaaattcagatgcattgcatcttaagcgcagctcctttcatataattgaaagaacttttggttgcatgcatccttttaggtagtaatcaggccaccaaaatatggtgtatggtgccataagaaccaattggttttcattatggaattatagcctacaattatcactcagctcattcttttcatgtatatttacctatttggtgtttagttcatgcacacatgatataacactaagtatgattcttattggcagggctatatttttgaagagaaaa

SEQ ID NO: 17526 - DNA, 326 bp, Oryza sativa
cccaaattccccaatcaccacggacgcctctccgccgatcgcggcctcgccggcggcggctccccgggccccttcctctgcagccaaccatacacgaccggccgccgcgcccatctccccgttctccggagcttcctccccgcgacagggcgacacacacgcgcgcgcgcgtaggaacaggtgctcttgcaaattgattggttactctgtgtgattgcaatgcgaattgatttactcctgatgataacaagaaacgcagggattctgaatcttgtccatgaaattttgctaacactgaaaccttaatcatcttaattttttgcagg

SEQ ID NO: 17527 - DNA, 1501 bp, Oryza sativa
cgactgaaccccaatcctttccagaagattatctcattatgcggaggtactatctagttgagtctggtggtggcctgttgatggtgacacggtatgttggcattgtgctccctcttgcagagcccaactccttcaaacattcgcgtactctttcattcaaggtctttgaagcggacttgaccaccggctctcgcatgtggagaagggttacatctttggggggtcgagcactatttgtcggcacacattgttcctagtctctccctgctgcagaatgtggtgtacctcaggaggattgcatctacttcatgtgtgattattggaggccttatgctggtgatcctctttgtgactctggcgtctacaacatgagaaacggggtgatcacgccgttgttgcaggatgccacagcgccgaggctgcatcctacaggccggggggatcctgcatggttcttccctgctgatgttgctacgtaatctgaatgtaatccgtcgtactgtgtggcatgcggctgttgatgtattttgaagtatcctatatggacatattacatgtagataggctgatggatgatgcttaaataatgttagtactccctccgtattttaatgtataacgccgttgactttttagcaatgtttgactattcgttttattttttttgtgaaaatatgaaaatgtttatgtcatgcttaaataacatttgatgataaatcaagtcacaataaaataaatgataattacataaattttttgaataagacgaatggtcaaacgttggacaaaaggtcaacggcgtcatacattaaaatatagaggtggtacttgttaatcactctgttctgatgaaatgtttggctgtcgcttcagaaagtgtagagttcatcatcttattccgtgtatatgcttgatacccggggtctgtcctttgttttgtttgctgagatcgaatttatcgttggaattcagtgggacattgctagtctactccatgtttctttgtacctgagaattgtggtagctccatgtcatgatgtgctacattgatcaatcaactggtaaggtatacggcaagagacatgccaaccaacagtcacaggtctaagcctaatttggaattttgaacataggacatgtatttgccctgaatcatgtataaattgaactgagtttgtaaacattaaagaagacctaagctaaaaaaaaaaagagagaggagaaattctaagaaaatgagacgtttgcactaccggcccacactgcacggccgctcttccaagcccatatgaaaatcaacaaatgggccgtgaataattccgcaaatccaccctctctctctataaaaaataaaaagaaaaaagaaaaagaaaaagaaaaaaaaacccaaaccccaattccccaattcgatcgctcgccggcgacgtgtactctgcgggtggcctccgccgctgcagcatctcctccaccggcgcgatggccgcacagcgaccatgcaatg

SEQ ID NO: 17528 - DNA, 200 bp, Oryza sativa
ccgcccaaattaaagattgagttcggaatattccttgtcaagaaaccattcattctgttcaatggaccctaccgtaatgcagcaaattaaatggatttaaatatatatacatatatgtatatatatatgtcggatatatgagacagtattcggtttctgtacaacatgaggccaaattctgagcacccccattaggagca

SEQ ID NO: 17529 - DNA, 1501 bp, Oryza sativa
gtaccattgacatgagcatatgtaactatgaaatagcatagtacctattgttttctttgtctgtgcttgggttttgattatgtcctttttaccccttgtttcgtagatgaagtcagtccgattagttggtttgtatgttcttcctgtaggacctgtaagcctcttcctgctttgattgctctggttacttctgtcctgttaggtaataaagtgcacgttagtattatgataagttgtagtaacgttagcgagagaaataaaattctgtttaccttcgtttcacaagtcatgtttacattttggtttatataggtctcttcgttatgatttgatacatgctccctgggatcaatttgttcttgttcaacatcctgcaaaagcatcaacctttttttagcggtgttatgtaagtaataatgattaacagtgtagcatatgatctttacctcaaacacatgcgtactatcttttcgatctgggcattttgaaccattttccatgcaatctagtatcaatgatcgcatacgtggccaaaaatcctttgtgaaatcgttgaaattatcttgtaaagtttggatgctttcttgtaacctttcttgtaaagtgatgtcggctgattgttcagtggatgttatagagtgtacctgcatagcacaagtgagaaaatgatgtcgaacatttttttgttaaatagagttcgtattaaaaccccataatatatacctcttcagaagtgccttcaaaatcttcattgctacgtgtttctgagtcattgtcctgcgctttttcttcggggatttcattgcaatgtatagttcccctaatgtcgttgacaacctatttttagtgaaaaaggtgtattagagattttacagacagttgatataattagtacatagtattaaaaatgagatagttaccttcccttgtccaaaaaggtaagaaattcgctttttttctttttttttatcccagtactgaattagtggcctttgacggctagaatgatatattgtcgcagccaatttatctattcgcactttttcccaataccaaatctgcaagcatttgaacattagataatgagtattgctatgaaaatatgttcatgacaattttgtaaacatactaaattttgaaacgaacctgtaagaggcatacgttcccctcaatgtttgttgtcttctctctaaattttattatgcctttcagtaactgattcagtgttagactagaccagtttagttccctcattttgtcaacgtcgtcgacgagattgagatattctgagcgcacatatctttgagttgtaggacatatgaatgatccaattgagaaaagaataaatcttcgaatgaagtggtcatcgtagctcgaggagttgattattgcttcccgtaatgcttgtaaagtaattgttgtttggccttcctttttgtacaggttgaacaattctggtttattgatttttggtgcctcaaatatgtcatctccttttgat

SEQ ID NO: 17530 - DNA, 1445 bp, Oryza sativa
tttctccatggaatcaactgaaccgatgcgttctcaaaaaaaagaaaagaaaaaaactgatgcctaatttttcaaaaaagaaaaaaactgtaaaggaggccttgtgggctgtggcttgtgccaccaggcaccagcccaccctgcagtggcaacaaatggcccaaaaaattcatctcctcgcttcacaaattccccaaaaccttcccatcaattttttatttaaaaaaaacacgaaacctcaattcccaattcgaccactcgctccgcctcctgaaccgctcgccggcgatgcccctcgccggaggcggcgaatccccagcgaactgacgcgctcctcctcctcatccccctccccggagatctgcctcgcccccgcctacttcggaggctgctactccgcgccgcttcctcttctccgccgcgcgctaccccctactagtcccatctcctccagctctcggcgaccggcggcaagtaggcgatcacgagtaagccccgcaggtacacccctttactcgagcggttgctacactttcctttccggaagggaccggattggtgcttagttcataccttaacctagccaaattagtgttcgcttttggttgatctaagatggcatggagcatttgatgtgtaagagaaccacggattttttttaatgcgcggtaccgatgatcatgagcatatccccttgtttcagtgtttttgtcatatgaaatcatatagtgcgcatcgtttctgaatattggacttagtataccatcagtgcatcgtctaattcactactccctccgtcccaaaaagacaaaccctggtttccatgtccaactcgtttgaccgttcgtcttatttgaaaaaattatgaaaaaaattaaaaagacaagtcacacataaaatattaatcatgttttatcatctaacaataatgaaaatacgaattataaaaaaatttcatataagacagacagtcaaaattggacacggaaacccagggtttgccttttttttgggacggagggagtacgtcattacccgtttaggttgctgctgatgataatagttagttgaaagaatcattgtttatgtttactcatttaccttgagatttcgacaaaagcttagttgagttgcatttgccttgtgaaaaaaagtatacagtgctctttgcatacatgatgtcagtttttacctaatcagaatctgaacaccttgtcacttcttgttagacttgcagtcttgcatgatgtcaggtcatccattttatttagtcatgcaccttgagtttttttttagcaaatgactaagtacaattccttttgccatgttaaatagtatgacactacctggtgaagtggtgttgtaatgtttagtgtccttttttttttgtaaaattctgaaccctttgtcttttttggttgggttagtttcgaagtcttgcatga

SEQ ID NO: 17531 - DNA, 1490 bp, Oryza sativa
  unsure (1)..(1490): unsure at all n locations
gctgtgnaacggttagagctgtnnnnnnnnnnnnnnnnnnnnnnnnnnnnnnnnnnnnatatatatatatatatatatatatatatatatatatatatatatatatatatatatatatatatatatatatatatgtatgttacacctgggattagcttgttacgaaaaaatagaagatcaatatgatatacagttattagctattgtaaatccgcggctacgagaaacataaatttcggcagggaaaaataacagataattcggtttaaaaaagaacagataattcggcataaaaacatctgagcaaaattctgcaggaaaaaaaacagataattatgcatgaaaaaaattcagttagagtacggaaattctgttatacttctactacctaatctcagccgagttcggtagtattagttttaaaaacctcgtgagtttaaaacggaataaaaagatatcgttaatataacacaggataagttccgacaattttttatagttgtgcaaaataatccgttccgctatattatacgagcgatcgaccggaaatccatgtttttaaaaaaagcgaccgtccggacggtgcgatttaattttttatttgtccaaatttaatccgtgccgctataatatacgagctatcgaccagaaatccatgtttttaaaaaagcgaccctccggacggtgctacttaatccgttccgctatattatacgagctatcgaccggaaatatttgttttattaaaaatcgaccgtcccggacgtaatagttattttgtccgaattaatccgttccgctatattatacgagcgatcgactggaaatccatgtttttaaaaaagcgaaccggtccggacggtgcgacttaatcttttatgtgtccaaaattatcagttgcgctttaatacactagctatcgaccggaaatgcatgtttttaaaaaagcgaaccggtacggacgtgtaacaccctgaaaattcgaccggcaaaatcaaaactctaaaaatacggattttcaaaaactttttaaattaattgcatcatgccgatcttattcgtctattttatctggatttgatctcaaagattattaatcgtgagtaaagaatagttaattaggaataaaccttaaaaacaaattggtaaaataaatacaaaataaagattaggtgggatagaaataaataaaatattatcgcgaccatatttggatcaattaaatttaaatacgatggaataagaattaaccctaattaaaactcaaataaattacataaaaataaaatatgagtaatattaatctagggtgaattcattagttgagataatacacatattgagtaaacttcatttatgcaagatttagaaattatagaatcaaatttatatagaaaataaactaaaattgggaaaaataggaaaaaggcactattcattagcctctaggtgttcgacgaggctccctagccccttcccctcccctgcca

SEQ ID NO: 17532 - DNA, 1197 bp, Oryza sativa
aagtcttagttgaacatagtctggggtaccaattcaggttcagacaagagacttgtaatcaggagccagatcatggcaagaacgcaagattacttgtgccattaatactgaaaactttttttgtttggggagggggggggggtattcttctagttacaccctcctctgaatccatttcaatttcgtttgctgactgtttcctatttctaccagttcagtggctccaatcttagcaataggtgaagaacagactccttttctatagccatcaagactgcatgcatgggaacagatcattttgctgtgtgcatcaggtaaaatctcttctgaaagttaggcgtgcgtttccatatgtgcagaaacattgcagcagtttttaatcagatcttgtaagttataaggtacaatacaactgcatatggctgctggacttgggaagctttttaatcactagtagtttggtcaggaaacctttttcctgtgatgattatagaacgatctgctaactacttcctccaatgtgagcctatggcagtagtaaggctttgcaatcatacaaacttgtgagcagtgataagtttggatttataggcttactttatggtgtgtcaacatcttggttttatttattttttctgtcacatcaacttttcagattgaagtaatagtactgtcatgttcctaaatatccaagattacattagtactgtcatgttcctaaatatccaagattacatgaacagagtgtccacatgttgtatgaactatgaatgcctcagaaaagtgaagtgctccactaaggcctcgaacctagttgtcagttccaaaacttcagacgaattaaattttaaaaaaatcaccgacaattcttgaaacagtttatgggtgataataataaacatcaaatgtcttgttgcgacaagaaagggattttcagttcctgcaaaagaccattattcatcttctagccatctacatttccctgtcaggaatagcatgtaatttggcaagatctaatctcattagcttgacattccagtattgaacaccttagccttcataatttaggtttatctttaatttgatttgattgcaaagtctcctaaactttattaaattttgacaaagtgccatgttctgaattctgattactcttctgctgcccatcctatcgcggtttgcgtagcatgatataga

SEQ ID NO: 17533 - DNA, 1501 bp, Oryza sativa
attcaccagtggccaattctagcataacgaggcccaagctccagatatcactcatataaccatgtttttgcccactgattctttctggctgtcaagaacagaatttccctttggttcaacaagacaaacaaaatagatagcatttcatgcaataatcagagatacatttcatgacacagaaacttttacgcaccgccatgtagttatatgtcccagtaaatgtatctcgttgtgccgaggaactagcaatgatggcactaacaccaaagtcggatatttttacttcacccatatgatttattaatatatttgacggcttcagatctcggtgtatgatgtgcttctcatgatgtaagtacatcagtccttttagcacctgcgcaggaaagatttatttatttttattataaagtccatgtggtgcttaagtaacatttgcaaagcaaagaaattgtgtgatagcttctaccacatgtcactggcctgcttacagattgcagcaaggtagggctctggaatggttttaactgtcttcaggaaatctgagagagagccactgtccatatactccaaaacaattgaaatgacaccattaacgtaaaaacactgacagcatgcaacaacatattggcactgtgttgacaagctgattttcaattcctgcgcaatctgtctgcgtatattctcctggatattgagttgtattacctgtaaacgcaataatatatcaatggaggtaaagaactaaagatcctttgcaagtgttaggcaaaagaccacatgaaaaaacactggactcacatgaagctataactattgggaacactaaaaagattgtagttaaaactggtaaggggagagtggaagaaatcataaaaagcaaagaatgtactttcatataataccttcagagcaaaaaactggccagtccatttgtggcgaaccaactgcacgattccactactacctttaccgataactttgattgcgtctagatcatctagactcaactgattatgatctaaaggttctataggaggggcctgcaacaattttagcatgccaatagagagaaggtgagtacacaaaataaaagaacatattaaatgaatggagagtacaaaaagtaatgatagtattaaagaacattctcacactataagtgagcaccaggaacagagctaccagatgcagcatatatgctttcagtaatttattgcatatgcagataccactagttagtgtctagacactccacatgagaaaccactatataagtatgacgctcatcgaaacaatgaagataaaaaggcatgctgtttcctatcctagttcgctgtggattagaaaatgtgaattaaactatttcaggatttcttcactaccatataaaaatggttgcaaattattggcacattttaatgtagaaaattagcgtatgcatctgccctattaccaaacaggcaaacagcaccctgattgccaaacgcatgacattcca

SEQ ID NO: 17534 - DNA, 1501 bp, Oryza sativa
tctttaaattttctatcgatgtttcgccactgcgaaccatgggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccatcaacttctcctggatcgtctcgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaagaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgattttcttcaaatccaacatactgagcaaagtccggaatattgtcatcttcttccatttcaacaccttctctccgtgggatgtccaacaattatagcttggcatgaaccctgactcaaacaagtggaaatgaatagtcctggatgcagaatactccttctgattcttacacttattgcatggacaacaaataaaacccctttgcctgttagtttcggccactctcaaaaaatagtgcacgccgtcaataaactctttggaccgccggtcagcatacatccattgccgatccatctacatgagtcaaaaaaaatcgtacacaaataattattcttacaataatgacagtcataaaataattataagatatctttattaatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttctttcccacacacattttctctctcatcaacttacaactaaattttggagacaaaaaaagtgtgcaaaacataggtgcaaatgtagtatgacaaaaaaaaaacattggacgatgaagttgcaaaccttttaggcacctccgatttgtatgtaatcaccaaaataaattcaataaaaattttggcatgacctcccctcttttttgaagaaattttgaagcttgctcgggcagctggaggaggaagaagac

SEQ ID NO: 17535 - DNA, 1501 bp, Oryza sativa
atcaatggtgatgaatcactgaatatgcacagttgcagtttgcattgatcatgcaagatgagatacagatttgcgtataagtttgttgttataccttgggattgaggagaggtgacgaggtcgtagaggggcgtgtagatgtcgaacacggcgatcttgaggtcggagtaggtcttcgaaagcgagtcgacggtgacgttcatcttgccgttgaagttctgggcgtcgctgttgagcctcgagacgcacccgctgctgccgtagccgaacagcgtgatcgccgccggtaggcagcccaacggcggcagcgacgtcacgccgatgcgccgtgctcccatgctgtacagttgctacaagaagcaaaggtcccaaagaaattttcacatcatctcaacaatccgtgttcagaaactatatctctaattatactatgagtctagtctatgactatctatgtcgatgaggaagctggttagttgcttactgccacggtgtttttgaagatgccgacgaggcggtcggagaactggtcggcggtctgggtcttgtagaggaaaggattgatgtagtaattctggacgaaatcgctggcaccggcgctgatgatgtacaatgagccgttgatgattgactgggcctggctgcttccggccacggctgccagcttagattggtactccttgaagtactccaattgttgggacaaaggaatagcatgctgcattacacagttttgtccaagttagttaagagatcatttacaccgccacatggatttgcaggtacaccgacgtccgaaaaatagcaatgatagagttcataatttatgaggcatgcatggaggatgtaactatgtattaacacgcagctgaaatatttcaattcagagcttctcttctccttttcaaggttattggtgatacttacatacagaagtgcagtgtggtcatagtagccagatcctgcagatgcaaagttggctccaatcagaaggttcttccctgacgcatctgggctgagatacgcaggtgcgtagctttcaaaccccaacgtctcggctgcaaccacaggaagtagcagaacaggatctctattagaaaatgcaactgcaactcacatatacattggaaagtaacaacatttagcaagagtgagaatgtgaccagtgatatcagtagccagcttgccgttgcagaacctccccgtgggtacctggttcttgaagtcccttccgtagggagggaagtttgccttgatgatggttttgaggtagtcattgttacctacgtccaccgatgagtcaccgaacgtcatgacggccggcacgagcggctgcgcttcaccaccatgtgttcctagcagaaggaagagagccaggagcagcaagcacttcacctccattggagctatccttggagtcttcttaggagtgtggctcgaaagagaagcgtgttctggtaagacagaacgctgtgagcttgtttatataagtgtgcctgca

SEQ ID NO: 17536 - DNA, 1501 bp, Oryza sativa
ttatccatctgtcacaaggtaggggttgagagaggaagcctacaaggaaagaatagaccagagcttgggacaagaccttaaaggaactaactctttttgttgatgtgttgtttgttttgcttattctgcaagttgattaaacaaacaacctagcatggtcacatcacaacccaccgatgcaaaccatgcgctacacacacaagcaaggaaacacactacaaacgaaacactagagggtggcttaggttctgcgacgggttctccaagatcttcactcctgcttcacagctggcttcactgcttcctccacttcactagcagatcctgcagtcttctggagcttcggcaaacaactgacgatgtcctcttcttcactgacctgaccatctagtactagttgaaaatccgaagaaggaagaacggagtaaaccttttgcaaacagcattaggggaaggagaaaaatgaactttcgcaaataatttttatttataaaatatgtccttgggttttatccacttggcttatcctacagtcaacctggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcacttcaggcctgacaagcaaaaataaacagcagcggactagcggcctacggctccatcttcacaggcgctcaactggggtataagccaggactccacctaagacatcttctccaaagcttctcttactgaaggggggaaagattgagcaagaatgagtacaaccacagtactcagcaagccacaccggggatgcataattaatgcaagggaggtacaagggaataataatatagggattaagttttgcagtaaacagcatttaaaagccacttagttacccaaagccattttgtaaagacgatcctagagctacacagtattattaaacaaggccgtgaaccctcacgaacctgccttaacccaaggcctgcgatgattcggaccgaactggcaacccgacctgggtcccagctcctcccaagccaacccaggccaaccattccatattttagttgttgagcaaattttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacatagttcccaacccatcctagccttagacaagagtaccgacccaatcccacctacggccgggatacccgggacaggcaggcagaactgagcccctagcagcagggcaccaaccctctgccgtatgacatctcgactaccgggccgcagctcgtgtagccttcatttgccctggag

SEQ ID NO: 17537 - DNA, 1501 bp, Oryza sativa
cactgtgctgttccatcatcaatttgtgtaagtgcactagcattactattctctgcatcccaatttactgcaaacgtagttttcactgtctattgtcagttttgtcacagtagatatggaatttatgctggaatactaatttagacgattgcggaaaacgatcaacaaatcatcctatagctattaaaaataaaagcattcatttaatttccaccatatttctctgtatttattagactgaacactacaattttagatgatatattgcgccttaatttacacaatactaggtgaaacattgctgtgggaatttagtatgataacaataaaaaaataacgtgtaagatagctagataacatcagattaagtaaattaatgtggtttatgataatttaaatttaaatagtatgtagaatggtgattcaaactaacaagtaaggtggtatgactttatggaagaagaaaaatagagagatagtttggaccgttgattaatcatctaaaggctaaaaacaattgatgtgatataacttaattagaggaaaaaaaggagaaatataatttggatcatagattaatcatttaagcactaactaagcgaggatgaactatataagtatataggatatcataaaacataataaagatatacattgaaacattatgtgaattatgttggatgataatttaacatgtttgtatttgaaaagctcttaaattataaaaactataaagatatagcatgtttgcacgatgtttaaatgtgatgattgttagtggataatgatgtggcatcttgttaattagtggatgatgatgtggcatcttgttagtagataatgatgttgcatctttgtatattaagcttaaagagttagtggaggataattttatagtaagataaaattccatctgtaacaactaacggtcttaacctgcctatgtaaataatacccgccatatttatccgtattttatttgacaaaatacttcagtacaattttagattatttcacccccaatattgggtgtacaactgtacatcgcaatagtgatggccctagatagtgttgcactatatgtgtgtctttcaaggcattgaccaaaacacacacgtgcccaagctgcaatttatctcaccatttcagattatgagaatcttcaattctcctagacagcaaagaaaaagcatatacaattttacatcaccattttcagattaggagaatcttcaatagacatcaaagaaaaagcatatgcaaattttacctcacaatttcagattaggagaatattcaaaagacagctaattagaaaaaaaaagagagttaaaaaaacccataataaaaaaagcaaaaggagactagtactagcaaggctagccagcccatggtgttcgactcgtctccatttcgcgtctcctcctcctcctcctccggccatctcaccctcccggcgagcagcgagcgggaggcctccgccaccgccgccgccgccgcc

SEQ ID NO: 17538 - DNA, 745 bp, Oryza sativa
  unsure (1)..(745): unsure at all n locations
cgccgtgnnaacgtanagtcgtgtnnnnnnnnnnnnnnnnnnnnnnnnnnnnnnnnnnnnnnnatcatattttggtcatacgaactcccaatcgacccgttcaagtctcctaatgtttgttataacctaaagaaccctgggctttctttttatgtattggtattgcttctttataggcttgtagctttgcttgtgtgcttcgcgtagcttctgtcgttccggaggttcccgaagcgtggttcggggtcgtcgccgtaggttcggaaggccgttctctctgagcaaggcaagtcacatcatccttgagcatattgaatcccagtttacaaaattatttttaatttaaattaatgcattatcgctttgtttaaattcccgcgttatcactgttttatttagccatgcctatttacctttgttatgaccttattattgctattgttattattattaccttgttcaccctagattaaacaaaacctcaactagtgggtactctattcatggttccactagtatgaatttaggtagatgcttcgcggtttgaattagacaacattaggtggttttacaactttagacttgggaaattctcatatcatttggacactatggaatggttggcttatgttggaattggacacacacctctcttcctctttcaaaacccctaaaacctgttttcggtggggtttgggtgcatgccagttgtgggaagtagcaccccggccactataaggattaa

SEQ ID NO: 17539 - DNA, 1501 bp, Oryza sativa
gtgaatagtgctaaaactatacttattttgggacggagggagtataagactttctagcattgtccatattcatataggtgttaataaatctacatacatatataccttagattcattaacatctatatgaatatgggcaatgctagaaagtcttataacctgaaacggaggtagtaataattactaggtggtgtttgaatctcctaaagataagatgaagataaagattaaatgtttcacgtaaaacgatgtggtaataatgtgtgattaattgagttttaattattacaaacttaaaaaatagattaatataatatttcagaacaactttcatatagaaatttttcgcacaaaacgcaccgtttagcagtttaaaaaacgtgctacaaaaatcttatcttcattcaacttttatcgaagaaaataacgggaccttaagacggttagatttaagttgttctgtacagatggatgacgactaaaaaaagttgaaacgaactagataacctattctcaccaaagttccatgttataaatcctttctattttgtactttagttttgaattattttgtcttactgttttgtttctaccggtcccgtactcttttcttcaacatcaagtttaacccgttaccatagtcttctctttatagtactcttattttcactggtggagaaactatctttcatcggtcggccgaattccacaatagtcccggatgcaataaaaatcagggctaaagatgatctttagtcccggttcaaaagagtaacgggcatatttgatctttagtcccggttggtaacacaccaaccgggactaaagatctttagtcccggttcgaatgctgtcagggtatgtcaggccccttcgggatctttagtcccggttggtgatctttagccccggttggtgctaccaactgggactaaagtcccacccatatatatatgtcttcttcctcctccagctgcccgagcaagcttcaaaatttcttcaaaaaagaggggaggtcatgccaaaatttttattgaatttattttggtgattacatacaaatcggaggtgcctaaaaggtttgcaacttcatcgtccaatgttttttttttgtcatactacatttgcacctatgttttgcacactttttttgtctccaaaatttagttgtaagttgatgagagagaaaatgtgtgtgggaaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtattaataaagatatcttataattattttatgactgtcattattgtaagaataattatttgtgtacgattttttttgactcatgtagatggatcgg

SEQ ID NO: 17540 - DNA, 1143 bp, Oryza sativa
gcatttatcctaatacatattttttgtatcggcagaaaagacgtgttgtcggagtcgtccctcaagccggagtggaagagctagccgtagaaggaattcgtgcaggcaagtgacgtaataatataaatgattgttatatttgtaatgcaattaagaatattagacttgtaattagacttagcatataattaagattgtgtagtgttctaatattatttgagttttaatataagattattttattgcaaattagacttagtatgtaattattgactacggaattggtgcgactcctagcaattgactattgtagtcttaattagacttagcatatacgcacgaaacacttagcatacatgactattttagtcttagcatgtaatattatttgagttttaatataagattattttatttgtaattagacttagtatataattattgactacggaattggtgcgactcctagcaattgacaattttagtcttaattagacttagcatatacgacagttacacttagcatacatgactctttcagtcttagcatgtaatattatttgagttttaatataagattattttatttgtaattagacttagtatataattattgactacgaaattggtgcgactcctagcaattgacaattttagtcttaattagacttagcatatacgacagttacacttagcatacatgactctttcagtcttagcatgtaatattatttgagttttaatataagattactttatttgtaattagaattagtatgtaattattgactacggaattggtgcgactcctagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 17541 - DNA, 1501 bp, Oryza sativa
tctagtctctgcgttcgcagcactcaaaacggagcgatcgattagataagcaccagctaaaataaattaaaaaatatattaatatgatttttaaaacaaatttttataaaatcatttttaaaaaaatacacagtttaatagtttgtaaagtgcacgtgcgaaaaacatagtaaaaagttagaaaagtagttgacaaacactgccttatgctcgtgggttacaatggatcttgttaaatcggtctttctctagaggtattttgtcatttgtttttttgccatttttttttacgtatcagttcttttaattgcaaggatatgagggattaaatatttttatatgggataagtgtatgaacgggtgaaactttggcagtagggatatcggataatagtgttaaaaacctagaattgaaaagtgtatatgggataagtgtatgaaggaaaaccgaacataatatcgataattttatttgactagtatgagtacttaagtttatagaaaaattgtaaggacagaaaattgatacatgcaacgaaaattcggccatctccaagaaatttgtcccatacaaattcatcccttcttttcaaaccttatttgattgttccacgtgaacatcttttatagtctccattgttttcgtacgaaggcttctttagaataaggttggaacatagacaagcacataaagatacgaaaatatagtaatataatgggaatctgtgcttaataaaatagataattgaaaaacgaaagtgttgtttgaaaggaattgatcatttagagctagcctgatttgacttgggcttttcaaaggattgaaaaaacaaagtatagttcttggtttttttttctaacacacatttgttagcttataaggtggaatagcgacaattccaattgaatttcaaattctaggtttttctccacaaatccttaaatcgggacaaaaaaaccctaaaaaaattattttttaaaaaaaaggaaggcccttttttaaggtttcacggaattttttttaaaacaaaaatattttagggtacggggtaaattgttttaagtaaaatttcagtttaaggttttttttgtaaataaagctttgtctcgttaatttatagagccggtgtttttaggccttgtttagttctaaactttttcttaaacttccaagttttccatcacatcaaaactttcctatacacataaactttcaacttttccatcacatcgttccaatttcaaacaaacttataattttagcgtgaactaaacacacccttactttgggacatttttagccttttctacacccttttagccaatgggtgtgtttagttccaaagtttttttttcaaacttccaactttccatcacatcaaacattttatacacacaacttttcagtcacattgtctccaatttcaaccaaattttaaactttgggccaatctaaacacagccagtttatggaggcggagaacatcaaagttgactaaga

SEQ ID NO: 17542 - DNA, 270 bp, Oryza sativa
attcatgcatttccattccgccactgaaaaggttgaaaagtccggcccggtcgttggtgctttgccttaaacgttggcacacatcacatagacccacaaactctgcaatttcccgcttcatgttgacccaccagtatttctccttcaagtctaaatacatctttgtactgcccgggtgaatgaaataagaactttcatgagcttcctaaagtatcacctgtttaagttctctgctatctggaacgcatacccgctttccgttccataagg

SEQ ID NO: 17543 - DNA, 547 bp, Oryza sativa
ctatacctaacaatacatgtatgtttgttcttataggttttttctcttaaattacttatccgaaatcttgtttgtttggaaattagaattccaacgaaataacttggcggaggtattcggaatggtcgtcaagatcttcttcttggtggcttgtggattaattgtcttggcttgatttgataatattgtgctaccataaatatttgctatgataaattaattagactaaataaattcgtctcgtggtctagtgacagatcaaaccaccctcgtatatgctccacggaagagagaattggtggtgacgcgtcaagttaatgggctataattgtggcccgcaaaaaagtacaagatgattcttttatttttcccacctaaagtctatatttattttggttacaagcaacttaaataagcaagccactaacaataagaaaggccgtgccgtaaacaaatctacagtgcgctcttggatctcagaggttgagaaaaaaagcccagaatccagcaaccgacgtcccagccgccatgacccagacaacgaagg

SEQ ID NO: 17544 - DNA, 1501 bp, Oryza sativa
tagctttacctatttctatagttaaatagacctcatatacacgttgagagatataattaagatggtagaaaaacgtcacatgtttagtggtacatagtaatgtgtccaccaattgtatttttaaaaaaaggtggttattttgtcagcagtaatttttaggattttcttttattcagcggttaacttaattgccgtatggagaaaaagaggcgacaacctatgggctcgtctcgtccgtgaggaagaaagtggatacatgctcgtccgtgaggagggaagtagatatgtgcattgtacatatgaaatctgacggtcttatcgatcaataatctttttaatatatagatctaatagtttaaaataaggtacataggtttgggtaatacgattttttttctcagaatctcttatatttactttagtttattagagcatcatgtggtggcttaggaatgtttagagtttataggacatttaatgaaattttagtatataataatagataattcatgtcatgttaattaatatatcaatcaataattaaataatttgtatgcgtagtgccaacataattttttattggttcgccactgaacaattaagttggtataaagtaatgagtctaccaattttattttaaaaaataaggtggttattttttcagcggtattttttaagattttctttttttttcagaagtttgatattcatcaatttttttcgaaggctataactcaccaaattataggctgaaggctaaaaatcacaaaattataagatataaggttaagagtaaatttcacaaaactacaggtaatttgatcaatttatcgcaaaagtacagatttaacatgatatatcacaaaactacagatttaacgctaaatttatcataaaactacagatttaagatgtaatatcacaaaactacagatttagtaacaaagttatcacaaaactacaggtttaatgacaatttaatcacattacttgatcaattataagtccaacataacattagtgctaaggatttcagcctcaaaatctgtagttttgtgataattttattattaaatctgtagttttgtgatacttagccttaaacctgtagttttgtgataaatttattgttaaatctgtagttctgtgatacatcaccttaaatctgtagttttgtgataatttgaccaaagtacctgtagttttgtgaaatttactctaaggttaatattcatgaattttatgtgcgtcgatcccagtgcaaatactcatgaaatattggagtgaaaaaaatatttatgcattttccccaaaagatcatgaaatattaggccaaaggctaaaaaaatattgaattttcttcgtcctaaggttagcattcacgaattttatgtagaaatgtttcaaggctaatactattgaaattttgggtcggagaaatgtttaaaaatcatgaattttttgtcctaatgtgtacattcgtgaattttatccgcaatga

SEQ ID NO: 17545 - DNA, 376 bp, Oryza sativa
cgtcctcgtggtttgttggtgatgcggctgacgacccgcgattaatgccaacggtgggcctcctgttttggtctgtcaccttgggccattattttttttgcaaaatagaacatatgaacttgtgtgttttttttcttgtgggttcgttttatttaaggggccaccggggccgatgggtagtgatcagattcagagtcttttatccctatgccattaagaaagttggaggttacgtgtgtgccacaaaaaatttttgagtcacttgtatgccatgagacaaactttcttttacctgtgcaccactttggatggaatcagcactaacggagactaacggaggtttgaaagatctattttgcccttgctctatttcagc

SEQ ID NO: 17546 - DNA, 529 bp, Oryza sativa
ctatacctaacaatacatgtatgtttgttcttataggttttttctcttaaattacttatccgaaatcttgtttgtttggaaattagaattccaacgaaataacttggcggaggtattcggaatggtcgtcaagatcttcttcttggtggcttgtggattaattgtcttggcttgatttgataatattgtgctaccataaatatttgctatgataaattaattagactaaataaattcgtctcgtggtctagtgacagatcaaaccaccctcgtatatgctccacggaagagagaattggtggtgacgcgtcaagttaatgggctataattgtggcccgcaaaaaagtacaagatgattcttttatttttcccacctaaagtctatatttattttggttacaagcaacttaaataagcaagccactaacaataagaaaggccgtgccgtaaacaaatctacagtgcgctcttggatctcagaggttgagaaaaaaagcccagaatccagcaaccgacgtcccagccgcca

SEQ ID NO: 17547 - DNA, 1336 bp, Oryza sativa
gggtgtgcacgaagccattgagtacatacaatcatgttttccctcatccacctccaggtacaatgctactaattatatgtttgcaatttctaacatccatcacgtgtaacatacaggtgtttaccgcggcaggcaagtactatctagtggactcgggctacgcaacccggattgggtacctggagctgtacaagggcacgaagtaccataacacagcctgatagcaacagcagaaggggagctgcacttgtccttacgaccgctgcctccataatagttgagccaaaggtggctttcgggaggaacccctcctctccggcacgcaaaacgaagcatgtattattgcatgattaattaagaattagctatttttttaaaaaaatggattaattcgattttgtaagcaactttcatatagaaacattttgcaaaaaaacacaccgtttagcagtttgaaaagcgtgcgcgcagaaaacgagggagaggggttgggaacttgaaggtaagaacacaaccgaaggataacatatgtatatccagggttcctcatgtctcccagtcctaaactgttggacgaacgaagggtctgcatgcatgcctaagcatatcgcatatgatttttaggttagagagagtacatatatataatactacctccgtttcagattataacactttctagcatagcccacattcatatagatgttaatgaatataggcacacatatatgtctagattcattaacatatatatgaatgtggacaatgctagaaagtcttataatatgaaacggaggaagtagtaagtatgagaaaactgcaatgtatgaatagatcatatatataggctgtataagtggaagaaaatataagcatatgtgggcttaattgattttaacttataaatgttgatatcaaacatgtaaactagcaaaaccatctcatgcgcataacctagagataaaatcgcacatgaataaatcaaatgtacggaatataattaatgtgtacagctagatattttctagatgatttgcacttggcgtaaagggtgctgctttgaccacgcatgctacgaaatgttgacgatgactcgtcgcaaccgagaaatgatgaagacatgtcaccgtgaatatacagcgggaagccacacgtagcacttcccaaacaccttattcgcttgcagtgatgactatacacaactacttcctttacaccggagaagagttcgacctaatgttttacgtctgtcttagtagattttatcgtttgttttagtggatccctatttaacattaaaagtatattaattttttcccaatatccttttcctagt

SEQ ID NO: 17548 - DNA, 1501 bp, Oryza sativa
ctttcctctcccctcgctctctcatgttatcaaatttgtcttgttagttagtaaagctacgagcatttgattaaaaattgtggtacatgtcctaagtgagacgtttcatgtcaaccccttattgttttgtagtgcggtggagagactgaaatgagctcgaggaaatcgaaaagaaaacacaggaacgaggaaatagacacgacgtcagattacagtctccagagaactcgctttgatggacgataggatagacatgctgatatggccaccatgatcaaataatgtatcaaaattatgggagacttgtatctatgagagcatctagactctagtttccttttccacatctttatctgtcaaattttgatttcgaaccatctgatcttagtctaatggttacattactactactccctccctctctagacccttttatccctctccaacctcaccatcttttccaaactattcaaattagtcatatctaaactgcactatactagaaccggagatacactggtgacgtctttttttccctcagaaccaacattcctctacctttgacaccctttccatcatcgcaagcatgatgaccctcctgttagaataattgggctaggctcgatttatcctattaaaatctcaaaggcccataataagtgtgataataataccaccttaggatttaagcgaggactatctcaacctaaatagggagttattggagactccctgttgaccggttgaggtgggagtcggaaagccacacgcgtgcgcgccgggccgaggccgtggccgtggctggcgtcacgtcacgtcgctattcttttgcaaccacgatcccacgttcccacgactgaacgatcacaacgattcgcttgcttctttcccgggtgttagttcttcctcctccgcgcttgtgctgttctcgcttctgatcgcttgcgcgcacgagcacaccttcgcctgagatctgcaccgggtaggcgggtgatcaggtttttggggagtgcttctcacacgactgctcgtccaccatgtctgcgcctggagccggagcttccgatggtgcgcctggagctggagccggagatggtgcgcctggagctgcgaacgtcaacaccaacggaggcaattttgcctcacaatccagcggagggccattctcggggtatatccttctcctgctgttaactcattcgttcatagcgctgttagtcctgttagtcgcaagtcaattgcgttcttgcttatgatacctttagcatgctactggttatgctacatgttgtcactagatcaccccacactgtttatgccatgattattgtcttaacattttggattaaaatatgccgatatatgaccatatttccaacactccaaaaacctgataggtcattttcggtagttggctttgctgctgcactgaaaccacatgcttttgatggttctaactataagagatggaaagcacgtgcactattgtggttgacagcga

SEQ ID NO: 17549 - DNA, 1472 bp, Oryza sativa
aggaaccatgtaagtattagatcatagatcgttaccactcaacgcgctgtgcagcggaagaagacgctgagaagtcgaaggaactctcgcgtagtagcgcgcgtcgatgtagaggaagtagtcgatagcaccggctcgaccttctcctccttgtgcgttctcctcgccgtactcccacgccgatcagcaccgcaaaccagcggcgcctctaccggtatccacacgtacagggacggaacgccacgcgcagatgtgctagcccccgcgcggctagggttttgctcggggagggaagtgatgcctagggtttctcacgtgatgcaatgcctccgccggtcacacccctcacgaatatataggattcatcactcgggcctccaaggcccgtaggactcctattcggatccctatccgaattaagctcatattggatctctatccaatccccttatttcggcccattaagcgtgcgacactgtaggttcatatatactcggctgtaacccgaaaactccttttcggtccacgtgtcaacagaggcccctagcagaacgtattgacctaccgggcatacataaagatcatatcggctgaacctctagtgtatacttgtatgaacccctttgcctcacgatatcgattaagctcaaggttagatatgtgccatcctctaatagctcaatcattcactcgaacctgttgatagattatataacttgcgattgactcctcaatcacctttggcatggccatgcacttccataatctacaacatcgaggggccccagagatatctctccataggaggggcaaatcccatcttgattattcatacccactacatgtttcacagcatacctgaaaactacttttataactacccaattacggagtagcgtttaacagtccctaagtaagctactacaaatgttgagaaccatgataatctcaggtctaaggattcaacaccaacactcaatgagatcactgatgacacaatacatatggctcttgcagtgtctcatgttgggtctatccaacaacatgttcaccaacatgtgtccacattattaatttggtatctctatatcatgatccatgagacatgatcatcaattaatacatgtgctgatcatataaacatatttgttccacatatgatatttgatcagggatcctttagaaatagcaacacataacataaagagtctcatgaaagaatcacatattcattaaccaataaggagttatctatttcaaggaacaatgttggataaatatgtaaacatagtatgtgatacaatcatctctatgattgcctttagggcatatcactgacaataaataatattgggtttaatttgcctcacttctatattgcaccattgtctgtaatcgatctactccatcccacactcatgtgcaatacacataatctacgagatcccactcaccggcaaacaccgatgatt

SEQ ID NO: 17550 - DNA, 562 bp, Oryza sativa
  unsure (1)..(562): unsure at all n locations
cgcggtgaaattgtaaacgccaacaacgcggcaataataggcaagcggtgtagacggagggcaccaatcggcggcgacggagccaagccggcgggtaaaacgtagacgcccacaagcacgggcataataggccagccgtgtaggcggaggcaccactcggcgccgacgaaggcaggccggcggtgaagtcgtanacgcccaacagcagcggcataataggccagccgtgtaggcggaggcaccagtcggcggcgacggaggcaggccggtggtgaagacgtagacgcccaacaacggtggtgtgaccaaccaaccatataggcggagacaccagtcggcggcgacggaggcaggccggcggtgaagtcgttgttgttatcagcagtggtggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatctgagattaaaaatcaatatgataaataa

SEQ ID NO: 17551 - DNA, 1501 bp, Oryza sativa
gttctttatgggaaaactgataaacaaatttcatcacttcagttaaacggaagaaactggatatataaatatggatgtctatgcctgattctggaagccatacagatatacagacaaaaacatctcgagcgagcacctgacaggcatgcacagaacctcccaaatggtatactattggtgcctagaccgatctctgcacgctcttgtaaccacagatcaatctgtagcccgaggtattgtgccgccgactcctgcaaccataggatcgatggtgcaccattcaatctactattcaatatttaatatactaactaagtcacttgggcatagttttagatcttggacccatggtaaatttaaaatttttacgttaaattatagcggtgcaaagttttaaattttatctaaatcgggaattaaatgatttatctaaatgttatcaacgtaatcgtagatctagattcattgatttgtaaagctagaaatacccatctctaataaatcttaatttgatccaaaaatgtaccaaaaagatctaagtacattgtcagatttatacaaacgtattggtattgagttgcacatttgcataatataatttagttggatttctcaccacacaacgcaacttactattgctttcatgatatgccacgttgataaggtaaggatcctgctgcattatagggactatagctagtctagagattccgtgaacgaggtggaaacaaacaagcacacagattcacaatattgacagaaaggtattggaaaaatacttgcggcaatctattcgtcaagcgaataaatttttcatagatattaataaataatgttggaaaaatgctcgtggcaatctattcgtcaacttgttttccacattggagtatgccgtgggaaaacttagattcaaaaccacctaaaaatgtccgcatgtgattaaatgtccggatttaaccgatgaggtgtgtgttgtcttttttttttcatagttgagggcggtataaatcatattaattttttcctatagtagatatggaaaatctagttattaaccctatacaaagctgtgttgtttcacattttatacaagtttaggctatatgtattgtaactatagtcggttaattaagaaacaagaaaaatcgcataatttgatttggttactttacaatgaggagatacccttctattgtttgaaaaattcctaagagggtaaaacaaatatctaataaataaactgtggatattatgggtaccccatacccacacggcatggttatccgactagttataggggataacttatatatatgaaatatgtaacatatcatgacttgggtattacgtttccctgtatattatggaacggcctaaagtcctggtttgataagattgtaaagtagatttaggaaaccgataccgtattggttatggtttctatcttgtaaccctgccccccaacctatataaggagggcagggaggccctctagggggca

SEQ ID NO: 17552 - DNA, 1196 bp, Oryza sativa
gtaggcaatacaaccagacatgagagtcaggtctctaattaagacaatactgtgcatggactccgtgtagtcacatccatagaccttataaccatacccacggaagaccgtgcactgtattgtcttaatcagagaacttactctcaggtctggttgcattgcctactatacctaacaatgcatgtatgtttttgttcttaggatttttctcttaaattacttatccaatctataatccgattacactattatgcacgttgcaattaaatatttacaacaagatcttacatgattatatttttgattaaaaaatatctatgttgtaaattactattgttaatatgtaagttacttttatcatatatataaattacttttagatttgattaaattacttcttacacattaatagtgctttgagttgtttgatttattattatttttaagtcaattccataatttgtactaattaaatttaatttttagatagactcatgtttttacccccacaacgaatttacttctaatgtcgtgataagttactttctttttgttttaagttacttctataatatatgtacattacttttaggatttattaaatttacttttatatgtcaaagaagtaatttaatggaatctaaaagtaatttagatatattataaaagtaatttgtattttttatcaaaaatatagtcatgtgagatcttgttataaagatttaattgttatgagcacaacggtgtaatcgaatcgtaaatccgatgagtaatttaagagaaaattttatttgaagtataggtgatagaaatatatttctctacttacatgttggactagtaggatcgctgtgcgtcgctggatagagcaaaatcgagagcgcgcacgatttactctcaaaatagggcttaaatttatataaaaatccccgtgtttctgtgtagacatacttctcgagataacactcaaccacacaacaggtatatttcttactattataaagatgtttatcgacgacaaacaccatcaaacaccaacttatggcgtattatgatttttatattaattgttcatgttgggttccatttaacaatatatttccttacatatatctatattattgatttgatgtcctcatagtaggtttataaaaaaggaataagtttactttgggttcctctatttgtcgcccagt

SEQ ID NO: 17553 - DNA, 1501 bp, Oryza sativa
tgaattatgtgggatgatttgacatgcttacattttaattctctaaaatttaataattattaaattgtagataatatagcatgtttgtattatgtttagattattagtgtattataatgtgacatctttgcatgtctatagattcttttgccacgagtttgacagtctggctcatctaatgcaaacagtattggcccatgaaagccaattgtaggaagcaaaggaagatcggttttggatttatcaagacaagaagtaagataattttgaagcatgagttctcatactccaaaactgggagacatgtgttaacaccaaaatttagtaagcccgaagtcatcattggcctagagttagtatcggcttcagagtcttggaatcggctgatgggagtcgtcaagtcactagcagttgtgttttttgtggaatcggatcaattaaaggaaatttatccaaaagagtctgagttcaaggaggatgcggcatggcaagtgtatctattaattaggaatagtttgttagttcattttatctttaggaaagtgtgtttagtgtccataaggactttatgttttccttttatctttaggaaattttctttcttgtcctagaaggactagtatctccctatgggtataaatatatacacccggggtcattgtaaaatatctcaacaatcaatacaactactctcgacgcatcgccaccctctttaccgaggtttttacttatcatccggcggaacttggcacctgacgcggggccacatcggttcagttcgatctccggtgaaggggtaagtcctacgttccgccggccctggcaattgtattggcttcatcggcgtcgttcaaggctgcatcagtacattcaaactcttggattgctctggttcggttgatatatttgcctacctatcatatgcctctgttaatttaatcttagcatatcgatttagctctatcggctgcttctcgctttagggtttctgtcagtatcggctaaatcgtgttgctatattagattagcttagacatccaccaccctgaaaatcagtcaacggcttgattgtctagatattatgtttctttttcatacttagtgttgcatcagttaagtttgatctattaagtcatgtttagaaccataatctctagcctgcttctttgactgctaaaaaatgttccatcagggtttcagccgatgaggtatctagacgttgcatcggcttacaaagattacgtataagtaggatttagccgatcgcaacaaggtttcactgtttatctaatcttgtggattttatgacattggacctcccaccgatgtatgctttaaccttcatatcagtgcttattctattatatcattgctagccgactggtttctactagatattattatttttatattgattatcatcagccgattgtctttatatcattatctacattgaatatatagacgattgctcaaaaccctatcgacatcggctggaatc

SEQ ID NO: 17554 - DNA, 1501 bp, Oryza sativa
ttttaattcttaaaacctgcttaacaattaaatatggaatggttggcctgggttggcttgggacgagctgggacccagggtcgggttgccagttcggtctgaatcatcataggccttgggttaaggcaggttcgtgtgggttcacggccttgattaataatattggatagttctaggatcgtgtttacaaaatggccttgagcaactaaatgtctttaaatgctgtttactgcaaccctaaccctttatattataattcccttgtactcccttgcatttattctgcatttgtgggtgtgtcttgttgagtacggtggttgtactcagtcttgctcaattttcccaagcccagatgaggagttcctggaagatgaaggctttggtgtctagctcgtgcctgccgtcaagtgcctgtggtcgtcgccctagtcttccgctgtttttcgttgtctttgagtgtgctgggccttcgttgcccgtgtaataatttttatttacgcttccgcttgttaaactctgaattgtatcaacttttggtgtaccttgcctctgggacaaggattaatgcacgcacgtcaggaaagcccgttgggttatttccggtcgtgacatgcagtgatcctcgctggctctcccgagcggacttcgctggcagtcaccgcgggtggagattctttccccgccgcttgcaaaacgccgcttttctcgccatcggcactcttcaccagcgctacccggacgagttgcagcactcgccctaccgctaccaccctcgtcgcggaggagcccgcgactacgccaccttccgggatgctagctcggaggatgacgctaccatcatgcacctggcgcgcatggtggaggcgtacgacgcggctcgtatcgacttccatcagatggtgcgccgtgggatggtcgagaacaacatgaagatcctggagctgcgtcaggagaacctgcagctcaagaaggacctagacgcggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctggcgtggacttgcttcgtcgagacccctcgtgccgagcccgcgcccgtggttcctcaggagggggaagcctccggcgttggtagcacggaggatgcgctgttgctcaccttccgtcctggcccgtcgcagcggtagacgagcagttagtaggcttgcgcgtgtgttctttctcgtttgtcttcttgttgggttgtgtggggcatggttatgccggtgtgtggtataactgtgtcggagcctgtctttattttatttgcctaagcaacttgaactttaatgaacccatttaatagcagtaataaattcaagaattatggtagtcgtggatggttagctttaattgtcagctctccctctgtttgctggttctgtgtggggttttc

SEQ ID NO: 17555 - DNA, 170 bp, Oryza sativa
ttctttggtcatatttgctcgtctactttactcatgtccatgatcaactgtttgtatgagataatcctatttaaagggcaacttgattaacttggacaagatccatagctacgttttgtttctaaataatgaactgacttattgctctccattttttttttctgtcaaca

SEQ ID NO: 17556 - DNA, 397 bp, Oryza sativa
agtggtgagcaggttttaagaattaaaacactaacttgggtacattgctcggcttgcccaaaaccagggcgcgggggggcccccctttaaaaattttttgcgggaaaaaataaagaatttatactcttgatcagaggtgtacatctttacccccaagacacatcttcttcacgtgtaccaacgtgccacataccaccccggtatacagacgaaagacgtgacatagtttccaacccatcctagccatagacaagagtaccgacccaatcccacttacggccggaacccccgggacaggcaggcaggactgagcccctagcagcaggacaccggccctgtgccatgacatctcgactaccgggccgcagctcgtgtagccttcatttgccctggagat

SEQ ID NO: 17557 - DNA, 415 bp, Oryza sativa
tacttgtccgaggtataactggacgaattcgagggcgaattcgattgaaggagggaggaatgttatatcccgtgttctagagtatgattgggcgaattcgagggcgaattcgatcgaaggggggaagaatgtaataccccgagttttaaattaatatatctcgcggaatattagagcaaacgcgcaaaagttcaacttttaaaccattgttcgtataggcgatcgggaaccgtggatgcgtagagctcgccgagtagtgcaaaatagactataaatttatagtaatcggagtccgaacgaagtcccgaggattgaataatgtgagccgttagatcttatttagtctctttatataaccaaccaaaaaaaacaaacgaaaaaaaagaaacaggagcgattctcctgtaaccctagc

SEQ ID NO: 17558 - DNA, 1007 bp, Oryza sativa
  unsure (1)..(1007): unsure at all n locations
ggcgcggctccnccgcgccggtggtcgccggcggcgaccatcggggcccgggcgcgccgcctcccgtcggctgtgccggggtgaccgccttcgggcgcgccccgcggctgccatgtggggcccggccgtcagccgcccgcgccctcgggtgcggctgacgcgcgggacccacggcgccggccggcgtaagccgcgtgcacccggtccaccgtggaccgagaggctgccgtgtgggccccactcccgtggacccggtccgcgcgctcctctctcccggctgacgcaataaatatgttttttaaattaaaatttaaatgaagaaattcgcaaatattcaattaaagagcatataaacttcaaatggccataacttggccatttgaactcggaattggaccgttcaagtctctaatttttccttaagaagtcaagaactcatttttgtgctttgtttctgcttgttatatggagtttagtagagtaaaagccgtttcttttccgttggtcgtgtagacgctgcagcttcggaagatccgctcttcgtggaagttgaagccggcgtttgggaaagcgagcaaggcaagtcacatcatccttgaacatattgaatcccagtttataaaattatgttgctttaaaattattgcattatcgctttatttaaattcccgcgttatcactgttttatctagccaggcctatttacctttgttatgaccttattattgttattgttattatttccttgttcaccctagaataaacaaaaccccaactagtggacactctactcatggtaccactagtatgattttaggtagatgcttcgctgattaattaggtaacattaggtgattttacaactctagactttgggttattcatatcacctggacactatggaatggtttggttattgtggaattggcttcacaccgctccttctattcaaaatccccaaaatggttttaggctgggctcggggtgcatggttttgatggtagcac

SEQ ID NO: 17559 - DNA, 1501 bp, Oryza sativa
cttgggatctacggctcgtcctagggtcaaggaaggctctgataccaacttgtcacgaccggaaataacccaacgggctttcctgacgtgcgtgcattaatccttgtcccaggaggcaaggtacaccaaaagttgatacaattcagagtttaacaagcggaagcgtaaataaaaattattacacgggcaacgaaggcccagcacactcaaagacaacgaaaaacagcggaagactagggcgacgaccacaggcacttgacggcaggcacgagctagacaccaaagccttcatcttccaggaactcctcatctgggcttgggaaaattgagcaagactgagtacaaccaccgtactcaacaagacacacccacaaatgcagaataaatgcaagggagtacaagggaattataatataaagggttagggttgcagtaaacagcatttaaagacatttagttgctcaaggccattttgtaaacacgatcctagaactatccaatattattaatcaaggccgtgaacccacacgaacctgccttaacccaaggcctatgatgattcagaccgaactggcaacccgaccctgggtcccagctcgtcctaagccaacccaggccaaccattccatattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacagacgaaagacgtgacatagtttacaacccatcctagccttagacaagagtaccgacccaatcccgcctacggccggaacccccgggacaggcagacggaactgagcccctcgcagcagggcaccaaccctgtgctttttgacatctcgactaccgggccgcagctcgtgtagccttcatttgccctggagcatgtccatcgacccccgacttcatccatctccaatccgtgtacttttgtttatgactagactgagccacaaactaagccttacccactagacatgtggaagtacggtagtgctttgcaacagaggcccgaagaccggtccttatacggccgaggtgctaccatcaaaaccacgcaccccgagcccagcctaaaaccattttaggggattttgaatagaggggcggtgtgaagccaattccacaataaaccaacaattccagagtatccaagtgatatgaatatttcccaaagtctaaagttgtaaaaccacctaaggttacctaattaaagcgaagcatctacctaaaatttatactagggataccatgagtaaagtgtccactagttgaggttttgcttgtctagggtgaacaaggtaatagtaataacaataacaataataatatggtcataacaaaggtaaataggcatggctaagtaaaacagtgataacgcggg

SEQ ID NO: 17560 - DNA, 806 bp, Oryza sativa
gtagaaatttatagttgtaaaatatctcttgaatgccaataccatcatgatcgccgtatataccttgcggaatatcaaagaaaaaaaataaagctatgtgagccacccctgcagaaacaaaaaggaaactacctaagaaattaaagctccatcgtttgtttttcaacttatgccacaaccaaaattcgaataacacttagagttgattttttctgcattatagttatattttagaaatgattttactaagaacacatatataaaaaaattatatcattttagacttatgattaactttagactaaattatattagccttgaccctgataattcatggaatatctagggccccactgaattgatcgtgagctgattgcaagttaaaacaatctatcaacgatttaaaaaataatttatgagtaaattttttatacacgtgttctaaaaaacttaaaacaaatataaaaagaaaaattgcattgaaaatatcataaaattacctttaaatttaaattttaaattttaatgatcggtgattttgtgcagggaaaacgacgaggcgccgagaggcgagagcccattgttgacacagccgtctcctctccatctctccgccccctgtatataaacccccccttcccctcctcgcccatcgcggcatcgctcgcctcctctgcttcgcttccttctccagcaagcacccgaccacaacacacacgcgagctcctcgacctcgagagagagaaaaaacccaaccccgaattcggcggcggcggcggaggcggcggcgatggacccctcgtcgg

SEQ ID NO: 17561 - DNA, 720 bp, Oryza sativa
tttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccagtttataaaattatgttgatttaaattattgcattatcgctttatttaaattcccgcgttatcactgttttacttagccatgcctatttacctttgttatgaccatattattattgttattgttattactattaccttgttcaccctagacaagcaaaacctcaactagtggacactttactcatggtatccctagtataaattttaggtagatgcttcgctttaattaggtaaccttaggtggttttacaactttagactttgggaaatattcatatcacttggatactctggaattgttggtttattgtggaattggcttcacaccgcccctctattcaaaatcccctaaaatggttttaggctgggctcggggtgcgtggttttgatggtagcacctcgg

SEQ ID NO: 17562 - DNA, 516 bp, Oryza sativa
actgtttaacttatatatatgtcatttcatgtggttatattttgaattagattaagtaatttcatatagtggtagagtgcattatgtttaacatgctgatcaaagggttttactaaaggagttatggtctaattttagtgaaggtgcaaagtagactaagtggtatgctagatattttcagacttagctaagtggtagttcgagtttaaattttttttgtggttggttgtatcgtgatcctgagtgtgaaaaaacatccgaaaaaataaaataaaaatgacaccgttgcaactccatacagagaaacaggaatggaggcggcggcgccagccatgctggcgccctcctccctggggcggcgctagcctcctcctgccacgtcggttcgcgtgcgccacggtggcaggaggacggcgccagagaggctggcgccgtcccactctggcgccccaaaaaggactatttctgggacatgttttttcaggggtctatttgcgaaataagtttttcaaaagg

SEQ ID NO: 17563 - DNA, 1501 bp, Oryza sativa
ttatccttttctttttctcccttatcctcgagcgagcggcgggcatttgcagagaggcgattactttgtgatgattttggggatgattttgtgatgtaaatttgtgggtgatttttagatgtttttttgaatttgtagatgattttgtgatgtaaatttgtggatgatttttagatgtctctatgaagttgcggatgaatctgtgatgtcaatttgtggatgattttgttgttgagtttggtgtgaaataaatatgcaagtagcaaaaaaaaaagcgccaaccacgtggcacttttatttttagtcccgtattagtccggttatttcaaccgggactaaagatgatgcccatctttagtcccggattcagggttctagtttgcaacccgggagtaaaggaagttgcaaaccgggactaaaaaccacttctccagtagtgaatggatatatttgatattttaaaacaacttgtatatagaaaattttcatacaaaacacaccgttagcagaaaagcatgctaacaaattttaatcagaaaagagcagggccttaatcgtatgtatcagctgaattcctgtattgcgttgaatttaattacttgaatatagtaaataagaaaaaaatatactcccagcaagttaaatactagtagtaatagccgtattcagcagttctcatgtggtgtgtaaagtgagataaaaaaaagtcgaaaactatttattagaggttaagtgctcctttacgatgcattaattaattaaccactaactaataattaatcaagccggtaggcgcagcgtggcccattttctccctgggccctagcctagtaagcgtaccctctccggccatgaaagcccaaaattaatcacttgatgcaaccctaatcaactaactttaaccttatccaatgcatctagagccttctcaaactaatcaattattattaattcaaaacatagtacacatgtacacgtagacaagtatgtaccagcacaaattaattaatgcaacacacacacacacacatatatatggctttacgaaacaattacaaaaaccactaacagtaataaattaatggcgcacgttgtttcaaagagagttaacaacttcgtactcgatcggacgaaacacaaggcgtgcagtcttcctctcttaattactcatcctgtacgagctaagctagcttcgatgatcccatccgtccatccgcgccgttgggtgatccgtggctcgtaccacagccgtacgatggatataggcataattatatatgcaactttgaatccaaccgacgctggtgtggggcccacctgcagcctcacatcggcaccagctgaccgtcgctataaagtaggctttcccgcgagttcgttctctcaaaattcgaagtcgatcgccatctccaattctccatcgatcatctatctctcacgatcatctcgccggagctgtgtagtggtggtgaggaggagaatgatgatgaggtgtggttgg

SEQ ID NO: 17564 - DNA, 955 bp, Oryza sativa
catgaccacacttccatatttccctataaagatgtgtatttttttagatgttgacttagtccatgctaacactaatacagttttaatccatacatatgcagagagctagagatgttgcgtttctacatttcttcaatcacttgtaaataggtatgtgtcatgatagataattgaagtacaagcgccaaaaggattggtagcactgtgtgtctatcattacctatgtacttaaaaagattgtccattaatcctgtattatcaatgatatgttgaaacaaatgcttaggcaataattggtgtacaactagaaagtggtcatattccccaatagttatatgaaatatttattgggtatgagttttgagcactggattgccttgttttgcgtctttgcctaattagtataatttataagtctcgttatcggataaacttagtttttctcctattcaaaaaaataaataaacttgcttttagccacccaatatttctagatgaaaattgagaacttccacttatatctacaatgacatcgatctatactccttaaaaagactccccacccactcttattgtagattttacatattaccccttaaacattttaatatcgcataacaactaaatctaagtggataaccacatttgaaattaaattaaggggtattctctataaaaaaaggcgggtaatatatacttttcatgaaaatatgttactctttatttaggcaatattatgaaatttgtcatttttatctatacgtagcaaagcacatacatttagctagtctttgaaaaaaaagagtaaattgcgcccgcggtacacaaacttgttaggtgggtgcaatttagtgtaaaaacttacaaaactcttgttttggtgcacaaacttgtataggtgcgtgcggactatgactaaatagaatagcaaatctaattttgctgagttggatga

SEQ ID NO: 17565 - DNA, 1486 bp, Oryza sativa
ggtatctaccaccctgaaaatcacacaaaaatgtttgattttctagatattatgtttcttttcatacttagtattgcattagttaagtctgatctattaagtcgtgcttagaaccataatctctagcccgcttcttgattgctaataaggatttcattgaggtttcagcaaatgagttatctggacgttgcttcggcttacaaggattgcatacaagttggatttagcccgttgcaacaaaggtttcattgtttatctaatcttgtggattttatgacatcggacattcagccgatgtatgttttaaccttcggatcagtgcttattctattatatcattgttagccgattggtttctactggatgttattattgttttattacattgctatcaatcaattgtatttatatcgttatctatattggacatatatccgattgctcaaaaccctattgacatcggctggtatcggcatcagctgaattactccatcggcttgacaaccaattggcttattgatatgctatttgtatatcttgtcagttgcatgatcaaactgactggcacgcccgtatcttatcaaccggtggatctgcacagaagctaagcagatctcccaggccgttgtgttcgtcgacctagtacgtgccaacacagacccgacattatcagccaaacgtggatttttttgtcaacacataacacatagagaatcatgaagaagactctgaccatgccaatacgaagcgtggcagggaagaaaaaaaaggaagatcatcattacaaataatcttataatatgtatgagtaattgaaacaaaatttataatgaacagacaaacaatccttcaactggctatcatatctgttactccctccgggttgataatacgtgtcgttttggacaaaaatgatatttaaaaatatttttgaccactatttttcttttacaatatatatagaaatatcaatacatatgattttatgaaaagactttttaatactaatctatacatatggtcttcatatgtttaaagtttttaaagtttaataatagacttgttcaaaatgacaagtattattactcgtaaggagtaacttcttattagagtttttaacagtttttattacaacctctgttgatcacagctgaatcatttcctcgttcaagtgttcttgttgtgccatcagaggtgttccttctctgatcagttgcctggctgcttatttctttctataggagtgacaggagtttcacgcggtccatccccagggtctgaaatgatgtaagtaataaactttaggcaaaatttgctacaggatactcaaagattgtggtctttgctgtgagacacccgaagatcgtgtatttgctcgtggacaccgtaaaaaagtggtaattagctactggacactcctcccattattttattattttcgatgaaaacggagagagaaacttaagttaaagacaagtttgtccat

SEQ ID NO: 17566 - DNA, 256 bp, Oryza sativa
ggccccgatggctggggcgccccgaccccctgtggtgttggcgccacgtgtgtgggttaggtgagcacagcggcgctcacctaaccgcatttattgcgggttggacgagcgcgccacgccgcatttaatgcagcgcagcgcgctcgcttatccggtccgtaaccggtcgcagtatgtgaccggtcacagaccggtcagatcgtgggttaggtggcagcaggcggcctgtcacacgcctcgccccgtcccatcggaa

SEQ ID NO: 17567 - DNA, 1501 bp, Oryza sativa
acatcggtaaccaaaagaaaatcagcctaaataattctttttacctgaatatatgagatagcacaaatgtttcaagtatcttccgaccaagctcagttaggcgtctttcctcgcgctccatggaaattttgttaacctcaccagaagcaccatcctatgacagtgagaatagtaagacagactgcaaatccagtagaaaaacctctactctgcaataaaccgatcaccaaacaactatgcacagatacaatacaagaaactcacaacaaaaaatattcccaatataatatatctaggagcataaagatttatactgagattattaaacagggaaaaaaatcatgcttcaatcatcaaagcaatccctaccttcatgcgactctgggaacatttgtcatcctttggagacacaggttgacaaggcagtggttctaaggctgctctctcaagcaaatctataacatcactggccaaaacaaacatgtccatgtcaacatggatcatgggtgcaggcagttcatccaaatcagctatcgttctccctttcttgcccttgctctggtattcaagcaccttcaggcccgtatacagagaatccatcactaatgttgaagtaacctctttctccacaaaaaaatgcttcactaatacttttaatatgacatcagtcttctctctagacatccgatgcctagtacttgggtcaattgctgaccagaaagcacaaaaactgaaaatccaataaagatctcatttcaataggcagtaattaaagaaaaaatactttgctttttattgcagcatattatattggaatagctgctagtcaaacctggaccatctcattttgtcctcaatcagcttgctaagtttatttcttcgttcctcaacaaaacggcggtatattgactcgatgtttgtcgtataaacacggagcaattctcttcgataagggcgatcgaggcaacgaaatggtttgtccaccttctcccttacatattaaatacagcagtatgatgttacatgatagtttgtagtcaattcatatcaacaagaaacagaagtaggcaaactatctaatgtatacaagtgatcttgctggtctgtatgagctacaaaacgctaggaaattagagcaaaaaaatgagaaactggaatagattaaataaattcccaccatgggaacatcacagtagaatcaaaaggaatgcaattgaataaagaaacaatgctttgagataaattggcagactacctgtagaaaattcaaaaatattgttcccgcgattaggacatgaagcaataaagacagacatgctcaaatgaaccagcctaatagattaagtagacacgaattggaagcaccatgatacaaagattagctaccaattgttcgcactgacagattagctacctgataacttgaacttgagctatgatttcaagaacatcatcaacaagaaagccatcctgaatcttcgacaactccataaattttttc

SEQ ID NO: 17568 - DNA, 185 bp, Oryza sativa
ttgattcaagccaagtaacaagttgtgggtgcactggctggcattcgacgggtttgcaaattcgcagtctgcccggcggcttggactcgttttaaaaacttatcttgaagactttaagccttgtttttcctggttacgaccttacagattgtaatcttttaattttttcctgttttatcaataga

SEQ ID NO: 17569 - DNA, 1501 bp, Oryza sativa
  unsure (1)..(1501): unsure at all n locations
tccatcttataagaggggctaataaaaagttggatattagttaacccggaaaggcccaagacgcaggtaaattttgaacagagttaaggtaatttgtataattacgtaccctctaaaaggctgatatagggcgcgcttataaaagcaggccctattaggacaacttaaagagggtgatattgaaaagggcactttggtacaccatcattcctaaggttggtaaaatgtacaaaatttcggccaaataacgcagaccccgatgtagaggccataaccgtttttccctgtccaagaggtactcaagcaagaagtccaaattgtgcactgggggatcatcaagcccacaaaagtgtgtcaaagtgggtacagcaggcaggattctgattcatccaccgaatcaatgtccggaaaatgcggaaccatgacccagctttagcgaaggaccacagaagcaaccccatgctgtttttctaaaggtgatctcaggtgaaatcagcgtggaaccggtgccacaaattaaggatatagctggagaacagtacccattcaatgattgaaatcacgccatacctggttaccgccgtcaaggcctaacacgacaaggcattccatgtcctcaaattttgggtatttaaganttnttttacnncccccccccccccccaacacccgcatccatccacaccacccgcacgcgcagccgcacccgcaggaaggacggggacgcggatcagaccgaccgtgccaaacgccaacgccatactccacctgacctcacactcgcaccgcaccgcaccacctcctcatcgagccttgttttttttttctctttcctctcctttccgtcgcgctgttcgctgcctacaaatcgcaattccccaatccatattcccttcccttcctttcctcctcctccatctccaccctcccgccgccgccgccgccgccgtcgccgcggcacactccccgggaccagcagaggccgccgccaacgccgcgggggcaggtaaaaaggcgcgcgagacgcccgcctctgcccgctgacctagatcggtagggtttactcgggcgcccgggtcgttcgtgtatgggggcgtgggcggtgggggattaggctttcggggtcggggggtcgggaaggtgtctgatcggatgatgggtggctctgttctccttctggggtgcggggttagagctagggctgtcgcggcgattttattttattttattttagttgaatttgaccggaatttccacgatttggatgggtttgtattggttggattgtggtaggagtgtttttataggggggttgggagtgagggggggtagggtttgttaatggtttttgagtgatataatctatttgattcctgttagggtcttctcctgggagatttcccggcgcggattttgttagcatttattaagtgtgcgcgtgttgttgttcatgcatgcagctgcggataaggttgcttgaagcagtggaagatttcctgga

SEQ ID NO: 17570 - DNA, 821 bp, Oryza sativa
ttaacaccgttcgatgcccttaacagaacagggtcatacgggagcttcgtttttgaaaaggaggtcaaataagcaaactttaaaaagtagggtcaaattggtagttagggctcaaaacggggtcaaataagcaattgtcccgtttaaagaaggtggcattccccttttgggtttatttatatacttgctccgtttcatattataagtcgtttgacttttttcctagtcaattttttttagtttgtccaaatttataaaaaaatatattagtattttcagcataaaacaaacatgttatcaaaatgtattcagtgtaagatttaataaaactagtatggtattttagattttgctatttttttctataaatttggtcaaacttagttaagtttgattaggaaaaaggttaaatgacttataatatgaaagtatggaacgtagggagtaacaatgaggttttctttatagaattctgttcttgctggcttgctgctatatgtgaattataatcttatccatatcggtgctagaaacatagtgaaattctcttgtgctgttgagttgtggaggaagactggtgtgctgatgaaaacatgtgctcatcatgtattgacattttcatctaaatgaaatttaaggccgcattggttgtacctttttttatctcacaggatttttttttgggttgtgcataatctcatccagattatttagaatctaccttgcatttatgcgaaacgagccctttgaaattcttgcagcacggacttgcatctttgtgtgatcttttgttgaactaacactttctgatttacacattc

SEQ ID NO: 17571 - DNA, 1501 bp, Oryza sativa
tatgatttagatattaataaatttttctataaccttaattacttaagcttgatcgaagttgaaaatttttgacttacttcgaacccaaaataccttgaaggaaacaaacagaacgccggcgcgatgaaattaagctgcgatggatagttttgcattaggatcatccatgcatatccttagcacaaaagaagccaattaatttaccgtgcttgttcacttccatccgttgccgatcgagcggcgtaacggcatcggacggaggtaaacaagcacgacagaccatctggcttcttttcggccacgctgacaaaatcaacccacgaaaacggaaaggctcgctcccggccgcttccctcatcatatgccgccgagttcttcgccgacggtgccgcaggcccgcagcgcagcatatcctgcggcggcgccgtccgcgttgagtgtctggttcgcctacgccgacctcctgtcgctggggccagcgcttctggccgagccatgggccatggctagctgcctcctcgagctcacgctcagatggagcgctgctgaatcttcactcttcttgctagtgaatggcatttgcgatgagctgagcccctgcaagttgaacggcatggtgatcgtaaggagggccttgctgccgggatgggtgcttgttcacctccgttcgatgccgatcaagcggtgtagctgcagcatcggacgtccctctgaggctctgacgtaggttgctcttaagtcagagatcctgttccccttagagcagctccagtgcgcacctaaaatcgatttcaacgtgaaaaaaccgaactatgcacactgtgggaagcgaaccgtatgtgtcagatgaaaaagcgacttcaaaatagaagtcgaacattgatgataaaaaattacttgttgctacaggttgtgagggggaagggaaattggggattaagatttttttcatgggtcccacccaaaatcgattttaacgctgtaggggtcgaatcaaatgtttattcgacttctgtgaaccggacttacctaaccaacactacaaatgcccttagcactatcgaaagtatcgatcgatcgagttgctcctctggtcctttggtacagctgctctacgtcttgtcgatttgaatagatcgccatatcggacaagacagacgagaccaaatcaaaactgtcaacataattaacaaccaaccatctcaagactacagccaaaatgtgtcgtcgccatgttccagctccaacaacgatcggccggccggcgatcgatctgaagttctgaacaatgaacaattggatggagccaccaccaaattccctgcaggccgatgcgagataccgatgctctagctgcttgtatataaaacctcttagcgatctcaacgatgaacaacaaccaatttctatagctggctagccagataaccactattaggaaaaccgtttttcattccatattaaagccgccgttaaattgcaggcggaaaataagtggtca

SEQ ID NO: 17572 - DNA, 1357 bp, Oryza sativa
actaaaacactgataacactccttaaacatatcatggcacatgtcaagctttacaatcaatgaaaattttacgttgtacgcttatgaaaactgccacttaaaacagttagagtcaagctaatcaacaaaaaaaacaattgcttgcttaggattgcatactcactttcttttttacaaggattttgccagagacactagtgctccaagaatggtttatttttagaattttagtaacaatcttgatgttaaaaaagctgacagttgacaatataattgaactgtgctcattacctgctcttctttcagaatattgtatagacgatagtaataaattgcatgggtaaaaaattgttttcatgtaaatgagctgcatgcacaaaatattcaatttgcaaatcaatggaaatcgcaaaattgatacatgtaacatacccaagagacagattttgacaagaaagacatagtcattatgtctatcttcatgcgccgctcaagcccaggatattgaacctatatgacacagttaagatggaaatcctctagattaatatacatgcacaccaagaaagacaatgtttgcaagacattatagggaaatgatgaaatggcatttcaaaattgaatataaaaggatatctccagtaaagagaggggaaatattcgcttctgtccatttccacaattctgctagcaaaattatgataaaaccatatcgctatatttttttttaaaaaaaaaggtgcaagagatcagtttatgctatgctctgagtcaaaagaattgagatgaaaaattcatgttcacatcaatggatattggatggcttagctgcttccatgtaaaattagtgtataaacatttcatatggctaagctaaagttagaaattgttgtagcctaagttaataatcaaaaaatttttcaggtaatccaactttctcattggctgtgaaatttagaagaatactccaacttgtaatttgtgtaaagagttggataaattactaaagtttgaaattggcagttgtccatccttaaattaaaagttctgttgacaagcatccataaatttgatagatgtgcaaagctataaggtagaactgggatggtggatataaatttgttaggtccctgtgcaagttataactctggatggtggatttcacataaatgcaatctctctgacttctgtcttgaaactgtgagcatgcagtgtgatgatatcaagctggacatattttcaatggtttacataaatgtattgcagagcacaggacattacaccctgcttcatttgaatggtgaagacataacagtataggatcaaacaatcactaaaatatctttgagaacaataa

SEQ ID NO: 17573 - DNA, 207 bp, Oryza sativa
gtacagtacttcatcatccgattttaaaaagcgatgttaaatacataaacttgaaaagtcaaattagtggttagactacaaggtgaaatgagcaattaccccttcttatattggaaggaacacactgaaagtctaaaactgtactctctctgttccaatttacttgttatccaggcaaataccgtgcaaaccatgaagatgtgaaag

SEQ ID NO: 17574 - DNA, 1501 bp, Oryza sativa
tccacgacaactaagtgcacatagtgaaccgtgattccttcactatctcaacatatgcctcccattcggtctctccattcaactctagcatttgcttatgtgaaataggctctccccccatatcatatctatcttgaatggataccaccttgtccgaccaacccagaatatccttcgtacgacacaaaagctcctcgaaggtaggcttagattgaaaaacaatcatcttcaccgacatcccatcgaactgactaccaccattactcgactctaggacacttccaccatagtgcacatgaacaactctctccatctacaaagtccgaccacctttcaaagtaagtaatactattagtacatctatttcaattaaacaacgacaagggtactaaaagactaacttacacaagtaaaccaaactagacaatgtggcacaaacttcataccatcacattcattcgattcactacatactacatcgccaatgagaataaaaattcttcccaaaccctacattggaacctaccaaatccatcctaccaactagggttcagtaccgatgaatgaaatcccctcaaaattaacctatagaactcacctaaccgataaatgaagtcgatcttccttgtctcacaaaaacgacaaacctagggttcatgctcttctccaaaacaaatcaccaaatgaagaaaatataggaggattttgagaaggttaccttactccacaacctccacatgaaatcccctccaaatccccttgatttcccatgggttagagggggattagggctcggagaggaacgccgccatcgccgtcgtagttttcatggagcggggaagggagagaaatgagagagctcgctctctcggccggggcaggtgggccttaatgtctcgaagctcagcgccagattgaatgacgctgagcttagacacctcagcgccgagtcaggtggcgctaaactttgacacgtcggcacaccgagtcggcctgccatccacggtgacacgacatttagcactggttgacctggcactgaggtggctaagctcaacgccggagcatttggcgttgaacctccggttcatttttgaaataagtaattttaggcgcggttcatttgcgaaataagttttcggaaatgggtcaaattgtcaatttttttttgtcagtgttgagccaatccaaacctctagtgatctctaggcatgacaaacacatcgacagttttataccattagcaatttagctgcagcaattgaacatagtgctagttcttttttttttcgtgttgttgcttaatttatttcataacattattagtgctggtttatatttaactttacagagagttgaaagcaattaacctgggaaccatccttgcaactgcaggtgtaccattcctttcatcatctagtatccaagcaaaagaagaggaatatgcatgtggcaaccttttctatatatagtggaacgcataactggcttgaaactttca

SEQ ID NO: 17575 - DNA, 758 bp, Oryza sativa
atctatctatctatctatctatctatctagctagctagctattttctatgtatgctaattggacactctgagaaagtttctactttaactgtaaaaatagtggataaatctagccatccctaattataatggcttaaattacaagaagatccccatataattttatcaatcaataatatcaatcaatattggatttattaaaccgagaaatgaaaagtcatataaaagagtattagagtgaatcctgcatataatttaattttaaggactaaatttaaagtttaaaaaatgcttatcaaataattttttttgaagtacttaaaaacattaattatattttccccttaattattcaatcaagaaagctaaaattaagattctatggcaagtatgactttgtatttatttactcttaatctttggagctattaaattaataaatgaagagtagcagaaaatagtgttttcatgaatcatatgtataatttttagtgctaaatctaaaatttaaaaatacttataatttttttattttgttctgaagtacttaaaaccaatgtttacacatatatatagtactatgtactactagcctacacaatggaagatttatataagcaatacttgtcaactttctttcgaaaaggacattatattttaagaacaatttaactaaccaagtgtacactttgtgtcaagttcttcaccctgcaagtattattcacatctatgagcatattcccttctgtaagcgtagg

SEQ ID NO: 17576 - DNA, 1501 bp, Oryza sativa
cggaagaacgccgtgcgccaccatctccttcaagttttcctctgtcacatcagagggcacccactgactttcaaagctttctctctcctctgccatggatgcaaattggatgatgcgatttggtttgaaatatggccgggaatggataggagatcgatgcggtggttgcgcggaagatttttgtggaactttggaggatggattggaggggatttgtgaaccctagcttcaccgaagtgatttcgcactatagcagtgagtagggaaagtggcaagagtttcggcggggaagacaaaacgacgctatgccttcggtgttatctcattagggtatcgggagtactaatgggcctgggcctaaacagtacttcagcccagttttgctatcagcgtggttaagttgtgatccttaggggcttaggcatttgtttttgctttggcaacacttgctcacgacaatatagcccaatgctgttaaaatcctttttgacgcagttagataattctgtggaattactacaatgcaaataaaaaggtgcctgacagaaaagtgttatactgattttgtaggcctttttaggctgcaaaaactatttgggttttgttgaggtgactggtttttgaatagtcattctctcggcatgttatatgcttattttgattatgacgtgagtcatggcctaggttatttagactcatcgatttatatcacatttgatggatctttttgagagtttttactcggattcttgtcatatgtgttggattatggaccttatagtattttttactcgggtttctttatatttccatttttggtatatcaaagctaaagcagtcggctggatattttatcaaacgtctcatatgcttagttgtatgatactttggatgattcggttgtaaaaccactcggttggatgttatttacaccttgactatatgtttagtttttttaactaatcacttagtcgggggctacacctaattaggtgcatctagtcgatgcacctgattttttctattttcagccattcacagtctttgattttgatactcgggagaccaaggcagaagaagttggagtgctcggattatcgtttgggattacgagagaaaactattttgttgactgtaaaggtctcaggggctactgtggagattatggataccccatacctacacggcatgtataatccgactaggtatggggtgccatgtatagatagaatatctttaaagggacttgggttaaattccaaacttgtatgttaaggaaatactcgggatcttagtcggttacgattgaatcttatctgtaactacctattccgttagggatatggactgtattttgtaatacggaccccttcccctatataaggaggggtccgggtgcctcttggggcacgatctgctcccagatcatacgatcaataatacactcggtggatcaatccccggacaggagtagggtattacttcttgttaagaaggcctg

SEQ ID NO: 17577 - DNA, 801 bp, Oryza sativa
gtacagtacttcatcatccgattttaaaaagcgatgttaaatacataaacttgaaaagtcaaattagtggttagactacaaggtgaaatgagcaattaccccttcttatattggaaggaacacactgaaagtctaaaactgtactctctctgttccaatttacttgttatccaggcaaataccgtgcaaaccatgaagatgtgaaagattacatggttgcccttgtcagatacatcttaattatcttttcaaagtagatgagccaattatgaccgcatcaatatgtattgctgcattactgtaggtagggagggaataatatcgatcacctttaaaatttctttggatcgagaaaacgacaaataatttaatataaaattaaatcctagaacgacgacgatgagtaatatgaaacagaaggaagaacatgaataagcagtgcacattctagttgttcctgcctctgcttaaatccttccatggcctttctccatttgagttatgcatgtcccggcgacataggaggattgtgtcccccgtttgggccgcctgaaatgtactcatattaagtatggacttgaagagttggagtgatatcaattccaattaaatcatatgtacaaaagaaaataatattcactctggttaaaaatatgtgtccttttggttttcaagaaaggtaatgcattttttaatgtaaaatttagtatccttaagtacatcagttacctgagggagaggggaccgacctgagaggtgacgagcagcaagagctccactggatttgtaccgtcatctagg

SEQ ID NO: 17578 - DNA, 1501 bp, Oryza sativa
agcttattggtgggctaaacatacttggaattattatagatttaaaaaatggatttattaaattttaaagaaaccccttatagtcttatataaagaagtttttgaaaaacaatatcatttagcaatttaggaaacatgcgcttatgaaaaacgagagagtaggtaagcttataaccagaatcaaactgtgcctaaggcaggcagcacaagttttatttctctcttatatatatatgaaagtagcatggtggcccgcgcatattgcacggctagcacggttatactttttcctcacataatagcacatatattttcatattttatgtaaaaaaatattaaaatggcaaccaaattttcatcagaacataatcatgcgatatcttgtagtgaagatttaattacaacgaacacaatggtattattggatcgtaaattaaataagtagtttagaaaaaaaatcattttgaaggtttttaaatccatgcatggatatagaggagagagagtaggtgcagatagttaaataaattttgtgaaacgttacactttgaaacatatcgctatcacatataaaacaataagttttaacggtataaaacatatatttttcttttatcaaaatataattatgagatatcttattgtaaggatttaattacaacgtattcaatggtacgatcggatcgtaagtcgaataagtaatttaggagaaaaaatatttaaagtgatgagaacaaaaaaaaataaactagctactccacttatcttgtatgcatgcagtagtagcaaggagcccgatttttttcttcaaatcgggctaccgagcaagaggattctcgcagtttttgctgctctatgcacttgcacctgcacccaccacgactgaaacccgaacttgccgctgctccatccgtgccggatgccgtgtctatttaccattttgcccgcccctctctgtccgatctctctctctctctctctctctctctctgagatagtgagcagagtaataacattgatgatcgatcaacgattcgacgccgatccagagtgagaggttttttcgagtgaacaaacaagctctacgcccattaggtagcttggatcagtggatgcaggagtcgttcatggcggtgagtgatcatcatcacaaaccaaacaaaccctgtcactactgcattgttgattattcggttcttggatataggaaggatcgtaggaaagaatgcacacagctccccttttgccattcttccttgttttgttcagattccattgcgatttgtctgtcttccttgtggatccaaacgctagatcagatgtcatgtcaaatggatctgtacaaatctagaattctgcctattgatttacaaaactcttccagttttgcaaaacaaaaacaaattaagccctgatcaattttgatcatacatttgcatgtctctcctgctgcaggtccggctggacccgggctatctgaggataggggtgactcctcccc

SEQ ID NO: 17579 - DNA, 294 bp, Oryza sativa
tttttgacttactttattacccaaagtattttaagcacaacttttcgttttttatatttgcataaattttttgaataagacgagcggtcaaacactacgagcaaaaactcaaaatcccttatattatgggacggagggagtagtaacaatattcaacttgcttcaaatcaaatactcctcttatacttatatgtaaattgaatatattcactgacaagatgcaaaagtatctagtatatgaaatttataacttctgcagccccataactgcaaatttatctccccgttcgaagt

SEQ ID NO: 17580 - DNA, 1501 bp, Oryza sativa
ctttcagcttggtattattataatccagattattaggagtaagctgaaagaaatagacaacttattgaagtagcttattataatctggagtccagtttattataatctgataagctcatttaggtgagctttttccagattattggatgaaaaattacctaccatgccaccccactccctctttagacttgcaaacctaataatctagactctaataatttaggaaagaaacaactaaccgcttattctactatagattataataatttagcttatagtaatctgactcaataatctagattataataatcataaactgaaagaaacatggccttagccgttgcactggtgctattgtgctaatgatggtttggttttcttccttgagaatttcaagctctaataattttcttgacccaacgcatcattgacgctaagaacggttgcctttttattttccttccgaaactttgagacaaaatcatttctgggcccacccgacagggggcaaggtcagggacggaccagaaaccagaaatgccgggggtgccatggcccatggtaggtccaactccacagccactggccgttggcacatgccgccaccggccaccgctcgcgcgccgtcgcgctcgctcgctagtcgctaccctacctagctacttactcggtttcacaatgtaaattattgtaacatttctcatatttatatatatatatttattaataacaatatgaatatgtgatatgctagaatgatttagggtgtgtttgagaagaaggggattgaggagattgggaagataaccaaaacgaggtgagccatttaactcatgattaattgagtattaactattttaaattttaaaaatggattaatatgattttttaaagtaactttcatatagaaaatttttaaaaaaacacactgtttagtaatttagaaagcgtacgcgcggaaaatagtgtgcattctcactccctatcagctaaatgaacgcagccttacatcgtgaaacggatgaagtatagcattagcagtagcactatttctttggacatccacgcctcgatctcttcctgggtctagtagtcttctcttcttccacgcgcaggcgcagccatcgtcgtcatcgccatcgccgccgcggcgcgcgcgcgcgcgcccgtgactgacttccgtagggggggactgaggcacgccaccccgcgcgcgcgcgcgcgcgcgtgcgcccgcacaaccacgaacgcgctccgaagtcttccttccgggagggcacgtgtggttggggtataaagggggagagaggcacgatgccgcacggcgtcgcgctcgtcgtcgtcgtcgtcgtcgctcctggccggtagcggatgggcgtcgtggtggggttgcagcttgctcgcctcgccctcgccctcgccgtcgccgtcgcccccgggttgctcagcttttccgccgccgccaccgcagcttgaagcgcgccgggcgtcgaaacgagga

SEQ ID NO: 17581 - DNA, 154 bp, Oryza sativa
aatgatcaaactcggtagaagaaagtaaatgattagcaacaaacatgtcaattgctgttgtttggaaaacatcatacttgaactcccagcattgccgaaaaaattgataaggctgaacaagcattcggcacacttgtcattgttttttttcaga

SEQ ID NO: 17582 - DNA, 1501 bp, Oryza sativa
ttggctctcatagaagaactagcttaacacaatccccaaaacaaatgtattaaatatataagtgagagagagatgagaaggaagttgtagtcaaccttataactaatctattatatatgttggctttaagaaaagctaatagtagaaagtgaactatactattatccttgctctaagtacagctcatctaggacactaatagagatccaatctacgcggcacgaatcacaaagctccccctcttccattcattgctcgccctaggggtgacaaaatccgagttggggaccagtccccgtcgggtcatattttcaacccaccggtctatcaggataaatctcacgttattatatttcgatggataaatcttcgcgctctatgttgaggaggaattgcgtagaaggcggggagcctagtgtacgctcggaaagatatactctctccatatactttggatagttatattttatcttagcacacagactaaggataagtaattctacttatcatctatttaaacatgctactagtcattcctcgtaaacaagcgattcattaatatttacatttttcgatgcccatgtaaccaatcttgtgtgaaagaatagagagtcacacattaaattcgagaaagtcattaagatgataggttgttggattgaaatataactattaaaaataaatttttcggatttgaaaatatacctatcaaaagtagatggagggagtatttacttgggggaggccgggagggggtatttactttcgccgtgtttagttccaaaataattcttcaaactttcaacttttccgtaacatcaaaactttcatacacacaaacttccaacttttccgtcacatcgttccaatttcaaccaaacttccaattttggtgtgatctaaacaaagcctttgttaggttcattaactatcatgtggtcacaggatcccatactctagctgccctcatatctgtttatgttagcatatgaatttttgtaaatgaataaaaaattttaagccgttataatttaacttcttataagcctacgaaagttttattacaactagctaaatgcatgtgttgtaacgggagttaaataaaagaacctcacattacattttaaagcctcaaaaattaaataaaattactcatgtcatattatttgttagggaaaattgcaaaaaccaccccaaatgtcactctgagtttgagatgcctcaccataagaagatttgttacaaatccccacctcctaattcaccttggtttgatttaggcaccttctctccacacgtgcgtgattcctgaagaatcttgtggcgaaatcagccgagtcccactcggcaggagcaagagattatgttgtttgttctgtataatacgatcatttcgttgtgttatcatggccatttcactgtgtttttcatggtaaactaactatatattccaaactgatatcatatgtactgaactacatatccgtttttttcggacgta

SEQ ID NO: 17583 - DNA, 236 bp, Oryza sativa
cggtatggccactggcgtggctagcagcagccgccgccgcggcggcggtagacgtcgacgacggcctcgcgctgacggcgttcatggagcgcatgtcgacgggcagtggctcgccgccgccgcagacgtgggggaaccggtccgtccccgtgtgccggtggcgcggcgtggcgtgcggcgcgagaggccggcgccgcgtccgcgtcgtggcgctgtgagcatgccggggcttggcc

SEQ ID NO: 17584 - DNA, 238 bp, Oryza sativa
acttgctgtatttgcagattggctctgtacaagttgaaatgctattaattgatgctgaggtagattaccagaagaaaatgcttttggaagcctgtaaagtggattatcttgcagccattttacctattgcaaaggcttgccttcgggttagtacagtacttctatcaccaactgaactcgtattcactttttccataactttttcttatgtatgatatttaatgttgacaggccaaaa

SEQ ID NO: 17585 - DNA, 1501 bp, Oryza sativa
atttgtctaaacaagatttccgcaatactaaaagggggtggctatcaagctggaaaagtggatggggttgagaaacaaagaattttatacaggttcaggccttcttaacaagaagtaataccctactcctgtccggggattgatccaccgagtgtattattgatcgtatgatctgggagcagatcgtgccccaagaggcacccggacccctccttatataggggaaggggtccgtattacaaaatacagtccatatccctaacggaataggtagttacagataagattcaatcgtaaccgactaagatcccgagtatttccttaacatacaagtttggaatttaacccaagtccctttaaagatattctatctatacatggcaccccatacctagtcggattatacatgccgtgtaggtatggggtatccataatctccacagtagcccctgagacctttacagtcaacaaaatagttttctctcgtaatcccaaacgataatccgagcactccaacttcttctgccttggtctcccgagtatcaaaatcaaagactgtgaatggctgaaaatagaaaaaatcaggtgcatcgactagatgcacctaattaggtgtagcccccgactaagtgattagttaaaaaaactaaacatatagtcaaggtgtaaataacatccaaccgagtggttttacaaccgaatcatccaaagtatcatacaactaagcatatgagacgtttgataaaatatccagccgactgctttagctttgatataccaaaaatggaaatataaagaaacccgagtaaaaaatactataaggtccataatccaacacatatgacaagaatccgagtaaaaactctcaaaaagatccatcaaatgtgatataaatcgatgagtctaaataacctaggccatgactcacgtcataatcaaaataagcatataacatgccgagagaatgactattcaaaaaccagtcacctcaacaaaacccaaatagtttttgcagcctaaaaaggcctacaaaatcagtataacacttttctgtcaggcacctttttatttgcattgtagtaattccacagaattatctaactgcgtcaaaaaggattttaacagcattgggctatattgtcgtgagcaagtgttgccaaagcaaaaacaaatgcctaagcccctaaggatcacaacttaaccacgctgatagcaaaactgggctgaagtactgtttaggcccaggcccattagtactcccgataccctaatgagataacaccgaaggcatagcgtcgttttgtcttccccgccgaaactcttgccactttccctactcactgctatagtgcgaaatcacttcggtgaagctagggttcacaaatcccctccaatccatcctccaaagttccacaaaaatcttccgcgcaaccaccgcatcgatctcctatccattcccggccatatttcaaaccaaatcgcatcatccaatttgcatcca

SEQ ID NO: 17586 - DNA, 204 bp, Oryza sativa
atactcttcttgtatccccttatatctcttcttcgcttcgctcgttcacgcactcacgcgcacagtctttcagcacctcttcctcctcgcccgactggtgcccctaaccttgccacctgaccagaagacgtcaatggtgcttgtaatccctatacctgaccggcctcctcccccttccacccctacctctcttccatcctaagc

SEQ ID NO: 17587 - DNA, 1501 bp, Oryza sativa
cttcatagccttcgtcgaagtcgtcgaggttgcggtagtcgtagcggtagccgaagtcgtcgtactctacgatctccgttggtcgtgagtcgacaccgggggagctgaggtagccgtccaactgtttcgtcgaaaccgtgccgagaggctggagtatgacaccgacttccctagagctagactggatcggggccagggcggatcccgcctagacctacggggagatgacgctcttgtggtgaaaacgacagccaaatcgttgaggagtttcatcaggattggcggataggctctattgtcttcatcgggtcgtgttggagtagattggatctcgtccgagtggtttggggccaactcggttgagatgatcttggggtagatctcggccaagtttggggtacgaacggggcggaaacctggtctcttcccgactggttcgaatccgagtcaagaagagaaatcttgccgaagtcgttggtgaagaagttgaggctgccgaaccggaacgcctgcccgggagggaagacgaagtcgtcgatgccggagacgaaacccatcgcactaatcggcgaagaacttgacgctacccctatctggcgcgccaattgtcgaaacaagattttggcaatactaaaagggggtggctatcaagctggaaaagtggatgggttgagaaacaaagaattttatactggttcaggccttcttaacaagaagtaataccctactcctgtccggggattgatttgccgagtgtattattgatcgtatgatctgggagcagatcgtgccctaagaggcacctggacccctccttatataggggaaggggtccgtattataaaatacagtccatatccctaacggaataggtagttacagataagattcaatcttaaccgactaagatcccgggtatttccttaacatacaagtttggaatttaacccaagtccctttaaagatattctatctatacatggcaccccatacccagtcggattataaatgccgtgttggtatggggtatccataatctccacaaaattggaataatgtgacggaaaagttgaaagtttgtgtgtaggaaagttttgatgtgatggaaaagttgaaagtttggaactaaactcggcctataatatataggacgattcattttgcttgaagattggtgatctaccggtatatttcctccgtactaaaataaacaatccagtatgaagtatgatatatcagaatcctattgttacgaaatccggacagtagatcgttataattgcccaaccaaaaaaaaaaagatcgttataattgccagtacacgaaggaattattactattgggccgattgggtcaataagcccatgagagcccactgggccggtgctgctgacgtcacgccgagctacttacctccgcgagcggccacaactccgctcccctcccccctcttcgcctgagtcgagtcgcctcccccaccgccggccaaccatgctgccgc

SEQ ID NO: 17588 - DNA, 1501 bp, Oryza sativa
ctcgctacctcgcagccgccgctgctaccacacacaaggggaatcgaaactagggttatttcagctggagaaaacttatctatgtgaaaagacaaaattacacttccaccactctcaacacagccggtaccatctcattggaaagtatgtaactggaggtaccgcatatttcccaccgtccgatcaggcaggttgaaggcccgagatttggtaacgggagacttgctgaatggaagcaaatctcttcacagcctagttgagaggtggaaaaatttccctgtctttgctttctttttgctgcccaaaaatggatgttgtaacttgagtggtttcaatttgattcagctgtgacatgatccattcttgtttctagtgtgctctccaagcatgtgaaagtaatcttgttgtggcctcgaaatgatctgtaaatcgatctgttctattgatacgatcatcggttcaatcgatggtgaaataatcgatgaacgctactactaaccaaactattatggccacttaattacataaatctgcccagcatcatttcttccgtggatgagaagtatcgcgtttgaaatttggtgtggctgataagctaataaaccaacaatgtttctcagaagacagaagtgacagactactaattttctattcaagcttcaggaccgaagcacatcccaaggttttacatggagcacatgcgaaagttttcagacatgcatctccgatcggcaaatccaaataatcaacgtagaaaggacttaaatttcggccataacagaagtgcatatgcacacaatgcggacgtactctgctgagttttcctaccaatgagctgctgagatggtcaatgtcactctcatcggctcacagcctgacacacataccagaagggactgcagcaacgatcacttcccttgtcgttgctagagaacggaagggagttgtacaggactggaatgcgatcagctaacatgaactggaccatactcagatcgacgcagttcaccttgaattccccatgaatcccattcttaacttaagggcatgctatcacttctcgtcgtcgaaccaccgccggtacgctgatttctcgtagaaatgaccagggttcgaattttgagtattgagcgatcagcgtgacttggaatattgagtgatcgagtgtgacttggaacttagtgctattcattcaattgtattacaatgtgttgaatagtttcatattagttgtggaagagtaagagagttaatatatagaacaattttacggttcttgaggaggtaccactttttctattgtaaatttggtacttcttggtacctaagtactatgaggtaccaaatcttacactaaatttttggtacctcatagtacctcattaaggactataaaatgtaaaatcaaaggtgtttttgattattattctgtgatgaacaattggcattggagattattggttttgatatttggaatttatttacgaagtggttttggaga

SEQ ID NO: 17589 - DNA, 249 bp, Oryza sativa
gaagttgcagcactgggcattttgatgttgaaaggatatgatctcccagactgcagtatacttcataacccacatagatgtgtttctgttgtggaatctgtatactgtacatgggagtattgtccatcattcacattttcgataattgcagcatgagtaattgtttttttcatgtatttcactatttatcatttgatgtagtaattttgctaaatttcttctttattggacagacgtacatatcaagca

SEQ ID NO: 17590 - DNA, 1501 bp, Oryza sativa
aattgaatacaaatgataaattagggtttcgaagacaaacagacgtgcggtctagccgacacgcgctgcaagcaagtagaaatggctaaactttaatctaaacaaaacccaagaaaccctaaaggggtaccaagctatttaaagaggtggttggacgaccaagagggtcctagggtcgtgctccaccagattggggcgcaccccacttgggctgagctccccagacaacgttaaaggtccataggcccattactggtgacacaacaccttgtttctttggttgtcgtcgactgagatggaatttggggacaaggttggattcattggaaagaggacttcaaaagctttctatcaagtactcatgaatctagaacggaggtcgtatgcacatttggcagtcgtttgaaatcattgttgcaagcgactgaattggattccagaacttagacaattttatctttgatgtgagcaacggttgtatcaatagcaaccatggtgtaacgccccgattttcgttcgggattaaaaatcatttaataattcattttctagaaattaaataaaagttaaagcaatttaatcaagtgaaattctggaggaaaataaaattttcctttaaaaatcatggccggaaatattttgtaatattctctgtgccctaatgaactctctgaaatttctagtgaatgtttagagctcaatatctaattttaatgatgcaaagttgtcacagcctgaatttccgtttcaggatttataaattatttaataaattattaatcgaatttatattaactgttcattaatttacaagtgaagttaaatgtgggaaataaaatttccttaatttaaagcatggatggatttaatttgtattaaattctccatgattaattatactctctgaaattttctcggaattttcggagctcaattcctaatgttaataatacaaagaacaatttagcaattatttaaataataaattaatcagcaaatgatctggatattattatattaaatactttgagtgtctaagtatgttcaagatttttcttggaattgtttgagcattgaaagtatttttaacaattgaaagatcatctcattggttaatttatttggaaaagtaataaaaatcctcctcctcagcttgggccgaatccagcccattgcctccccttctctctcccttcctctcagcccgcatagaagtctgttttttgtccctgtcgctacagtgctccttcttctacctccagacagagcccaagctctccagcccgtgcacagtgccgccgcctcctcccaccaatccggccacatcgttgctcctttctccaaattagttgtgggaatggaatcctctcaatctcctcttccttttccccaagaaatccccaaaagtttatatggaaatcctttccaatttcgcggttcaacctttcctttttccggcgaagatctaaactttcccgagtttttcccgtcgttgtgggct

SEQ ID NO: 17591 - DNA, 1501 bp, Oryza sativa
ttcaacatttcaacaattcaaatgactgcaatcagaactaaaatgttatcgaaaaacatatatagttatatacatgaagtgactgtaatagttcccaacctttggactctattaccaaccttaggacagcaagtctacacaaaattgcaaacttcacttatcaaacatctgcatctctgaagcaacatgatacggctctcataaagtaagccatgatttcaggctctagtgtggttaagttaatcatgcaaatttgacctcagcactctcctaaagtatgccatgattttaggctctagtgtggttaagttaatcatgcaaatttgacctcagcactctcctaaagtatgccatgattttaggctctagtgtggttaagttaatcatgcaaatttgacctcctgcaggaacaattggagcaacactgcactacagataagggtcgatcccaaattgtgataatttatttcttataatcgaagtaaacaccgacctgaaattctgaaataagctaagtattttgtaatagtcgtgtcctctaccgtctacagaatcagcgggcataaggaaaataaacatcattacacacctcaacgaaggactaatgagttacccacgatttctcattgctgctaccatcatctactttccaccaatccaactacgagcatatgaacaacttgttcgttttcctctcacaataactatgattcttctttttttttgtttttttaaaaacatggttagtttaaaggagaagtaactgtttatgctgcaattatcctctaacgggtgagagaacagtagatccgtatccccaccggaaggggaggagagaaaccctaatcctaaaaaaaaaccagacgcggaaaacccaactttgattacgcaaaattttctcctcaggtaccccaatcacaaaattggatatgagcataatctcaattaagtaaaccctaggccagctacgcacaccattgatcacaaaactcaaaaaacttagcaaaaaaagaaaaaaggacaggaaagaacaaagaggaggagagcgacggttgaattaccagcttcttggcgctgttggcctcctcgatctggatggtccactcgtcgaggctgtggatcgcgatcaccgttccctccgcctgcgccgccgctgaggccgccgccatctctagctctctctctctctcttctctctctcctcggcgagcagagcagagcgccgcttatctttcacgcgaggcaggacacacacttgctctgcggtgttctgactatgtgctccccttggccatggctcgccttcccaaagatattgtcgttgggagaggaatcgaaactttatcctagctggtgacgtgacgaatggtcgaatatgcccctctattctgtgcgaaattaccggcccccaattggccaaacggtatatttacaaatgaaaaataatatgtgaataaaacttttatatacgtgttcttagcaatctaaaagcaaagactga

SEQ ID NO: 17592 - DNA, 1501 bp, Oryza sativa
atcaccttcatcagcaaccgagggaagtacgggccattccgagaggagttcggggcatacttctcgtcggcgaagaccgaagggaaagttgtgggcttccatggccggagcgggcaacacctggacgccattggggtgcatatgcagcactggatgggagacaggaggcctgctcccaagtacgtgctatcaaagtacctcttctgattgagctatggatgaaaacttgaattcctttgaaacaaaaagtgaatacttgaattacatgtagtttagccaatagtcatatagataacagatgggctggtttcgatttgagctttggaggctgtaacattttgggatatggaacagtttaagcctgcggatgagtccgttccttgtactcaggcaggcaggcatatacttaatgcatgacgatttatgagtaaattcaaatgaaattcacattttctgattcttttgcttgccgtggagaattggagacctgttttcaagacttgtgtcatttgtgtggtccactttctccgaatttgttgtggtcaccagattagctgcactgcatgtctgcatctctgcagatctcatgttcatgatttgagacctcccggccacttcaggacgggcatccaatgttgaattcagcaggaaagtataatgcagtaatgcacatgaaatgctttgaaatcaagtgctgtgcaaaactgaaaatgaggcaacatcaaacaagtggaaatgaaaatgttttcttttttattgaagtggaaatgaagttgacacgctgcttaggagctaactagagagtcttcttaggaaagctttagcttcgttttaatccatcaaaaaagctaaaatgtttatggtacttttaattctagaataagctgtagctaatcgaatcaaaaactccccaaacatacccattatcacatatcgcagccgcccatgtttaggaaggttgtcccttcccttggtacaagcaccgaaaaaatgcccatccgatccgaccgttcgttctagatcggttccagatcggacggccaaggacagagatatgggacaccgctcattacaacaagggtctaaattgtacggccgcattttttcgtttatgcttatgtttattattcaaaatttaaattttcaggcttaaatttgaaattgattttagagttttttcatcaaaatttatttttcagtctttgcttttagattgctaagaacacgtatataaaagttttattcacatattatttttcatttgtaaatataccgtttggccaattgggggccggtaatttcgcacagaatagaggggcatattcgaccattcgtcacgtcaccagctaggataaagtttcgattcctctcccaacgacaatatctttgggaaggcgagccatggccaaggggagcacatagtcagaacaccgcagagcaagtgtgtgtcctgcctcgcgtgaaagataagcggcgctctgctctgctcgccgaggagaga

SEQ ID NO: 17593 - DNA, 1012 bp, Oryza sativa
tcaagtaagccaggggctcaagggcagaagaagcgatggaggacgctcgtcgatgtaggtatgcacggtagcgttgtagtgtagccaaccgctcaccctattcatgaggacaaccactaagcattttggtcattgtggactcaccggctcaagacgaaggaagtaggaagtgaagggctacgacgctgcttgatgaggaggatgtggaatgtgctatcagtgagcggaggacctcactaaagcttcactaaagtttgtgcagcaggatgcaacatactattcgcattttttttcttggtatataacaaatttgggctaactggcctctgcacagcccacgtagccaaatcttgccaggccaacatgacatgacccgatatctcactgggtcgtgcatgggttccaacctcagcacgtaggccgacacggcacggcctatgcccaaacatacctattatttatctatcatcttaaccttatacgaaaaagagaaataaaaatccaccatctcaaaggtccaacctagggggctttatttggaaaactagataaatacctcgtcgtattgctgcgggaaattaaatatgtacaaataatatgcaacatgattattaaaactaaaataatttgatacttatgaattttgagcctaaaataattgagattgcatgatattatgagagaagaaagaagagacaaattgaaccatagatctatcatccaaaggttagaaataattagagtgatgtggcttaatgagataagagataaatagcattaaagtaaggataaactatataactatataggatatgaataggacaggattagaatagcagtgctagatattataaggtaaaatttgctacaggacaccgaaagattgcagtctttgctatgagacacccgaagatcgtgtatttgctcgtggacattgtaaaaaagtggtaattagttgctggacactcctcccattattttattatttctggttgaaatgaagagagaaaga

SEQ ID NO: 17594 - DNA, 398 bp, Oryza sativa
cgccctatcaaagattatagtcatgcagactaataaatacagatgataaatccaactcgaaaccagaaaaaaactgacaaaatgaccataccaaaattattgcacaagtatttgttcatatggcatcaaatcaatcaagccagtgatgatcaagtattgccttgacgactaaaacagagccaaatgaccagtggcatgggacatgggggttcagttgaacccccccaaacctttttgggaaccatcaaactgttactagtattaaggtttaaggtaaatttctagaacagaagctagggttaacgcaaattcgagaaaaagtgcgtgggtagagagagagagagaggtaggtgaaagaggatgtgcgagacggatgcggcggaagcagcaggacgagc

SEQ ID NO: 17595 - DNA, 462 bp, Oryza sativa
ataacacttttctgtcaggcacctttttatttgcattgtagtaattccacagaattatctaactgcgtcaaaaaggattttaacagcattgggctatattgtcgtgagcaagtgttgccaaagcaaaaacaaatgcctaagcccctaaggatcacaacttaaccacgctgatagcaaaactgggctgaagtactgtttaggcccaggcccattagtactcccgataccctaatgagataacaccgaaggcatagcgtcgttttgtcttccccgccgaaactcttgccactttccctactcactgctatagtgcgaaatcacttcggtgaagctagggttcacaaatcccctccaatccatcctccaaagttccacaaaaatcttccgcgcaaccaccgcatcgatctcctatccattcccggccatatttcaaaccaaatcgcatcatccaatttgcatcca

SEQ ID NO: 17596 - DNA, 1101 bp, Oryza sativa
atgccgcaatggagcaaattgtgtgctattcctggaccatgtcgtgctggctcgctacatgcacttgtcatgttagcatgttgggtggtagcaacccaaacatggcgtggctagacgggccatgccagcacgatccacagccaaatagatcatgtttttcctgagctgtgagctgcacatgcgtactcggacagacacggaaggacccaacctatttgacaacctataggagaatttggtaaattcataggcattattatgtttgtacagatgggatcaattaagacacctcagttgcaactaattaatttgtttagtgtcaaattaaagctgtaatagtgattacactccagccaaccagaaaaataacacaccattttcccaaaataacatgtaagcatgatataatctagaaaacatatccattttattcttgtttttattagctcaatttcaagttgtgttgtctaagacaaaatttatttcaatatgcagaatgaggataaaccgatctcatggggatatacacattttcgttgcttatctcattggtgaaaaggaatatattttctcactaaatcaacacttgttaagagttgatacgtcataaaaaaattaagggccatccgatttctgctcttgaagttttaggccattggattctctgaatggtgaaatatctttttcgcccctaaggaaactgctatcaatttctaatgtaagaaatgaaatgagttcactataacaattataataaaatcggtatatgattcctgtaacttgctatagattctcctatatagtacattagattcctgtatacctcgttctttcataagaaacacatgcatgctagtagaaaaacagatataatccatccattccaaaaaaaaaaaaggcaatgtgacccattcagaggattcaccagtggcatttttaccctttttctgcatccaaccatatatacggctatcaaaatagggaacttagccccacaaacaatcaaatctaaattttgttcctatggagatttgaactcaagaccttgagatattacttaggtcattgtaacaactaggctacgttccctttcctggcagc

SEQ ID NO: 17597 - DNA, 717 bp, Oryza sativa
tcagcaatccgaataatatcggggatacccggaactgtcgcgccggtgtgaaaataaatgatagcggggctgcgctgggatattacgtcagcgacgatggttatcccggctggatggcgcagaactgacctaggccatgactcacgtcataatcaaaataagcatataacatgccgagagaatgactattcaaaaaccagtcacctcaacaaaacccaaatagtttttgcaggctaaaaaggcctacaaaatcagtataacacttttctgtcaggcacctttttatttgcattgtagtaattccacagaattatctaactgcgtcaaaaaggattttaacagcattgggctatattgtcgtgagcaagtgttgccaaagcaaaaacaaatgcctaagcccctaaggatcacaacttaaccacgctgatagcaaaactgggctgaagtactgtttaggcccaggcccattagtactcccgataccctaatgagataacaccgaaggcatagcgtcgttttgtctttcccgccgaaactcttgccactttccctactcactgctatagtgcgaaatcacttcggtgaagctagggttcacaaatcccctccaatccatcctccaaagttcacaaaaatctttcgcgcaaccaccgcatcgatctcctatccattcccggccatatttcaaaccaaatcgcatcatccaatttgcatcca

SEQ ID NO: 17598 - DNA, 1501 bp, Oryza sativa
gcgtcctcggcgtcggcctggctttcttccatgtcactatcagcttcttgtacctacagcaccaggaaattttatcacagtagtactagactactagtgtccagggcttacaaaatcatgcgattatcacgcgatttatcgcgtctaataatcttttcagtttttaaaaccacggtaaacacggtaaacacacggttaccgctaaaccatgaggtgacgataatcctgatcccaaacgatttagtaaaccctgctagtatcatggcagcggtttgaggaaatcctaccgtgcctactggctaatgacaattactgcaagcatttatgactgatttaatttaccgaattctccactgcctgattaagcttcactcaattattgcggttcagtttagtaaagttatctctcgatacccctcgacgtactgaaccacaattccgtcaccaaaatcagcgaatgatatattttgtttcttcttgcttgaaaaagaaaggaaattctcttttccaaaagaaagaaatgaactttgttttttcaaaaaaaaaagaagagttattttcctcttgaacacgtcgctttcaaaattttcacacgcccaatccctcgcgattacgacaaagctcatcggctctgatccatttccagctcgaaacaaggaggaagaaaacataagtaggaggaattgaattacgcaccaattagcctgcgctttcttggaggagactacatgccggctcagcccatccggaaccttaaaaattcaaaacaaaccaaattaaaccccccaagaaaaaaaaatcccatcaccttacgacgccgacgcatcgcaaaatcgaatttcatcagcttcagcctcacgccctcacctgcgaggtggcctcgaactgctggatgtcccggccgagcgccgcgacggcggggtgcgcgccgtgcggctggtactccggcgacggcgagcagaggccgcacaggaacctgtatatgctgttccccatgcccccgacctcgccgccgaaacaatcctctcaccggagaatcgactgtgggtttccgtgcgcgaatccgcttcgggatttgaaaacttttccggtggttttgtatggatctgcgcgaaagaggcagtgtgaaagcggttttagccgtttcggaatcggagctctcttcacgagggaggaaaagctgttaagctgtcgagtcgaagcgagatttgccacgtggagggcggtgattggatccgggcggtgccctggctggacggtccggattcactgtggagcgaatcctgtggctatctatgtgtgcttttgtgttgtgtcaatgtcttgatgctgatgtcgagttaggaattactgaattaggattatgttctaactaatctgtccaggcgtcgacaggaggtttgttcccggcgaattcaggattctttgccttcaattcagggaggaaaaacgaattcaaaatgctttgcttttcttttttttggtgagatttcagaaagtc

SEQ ID NO: 17599 - DNA, 1501 bp, Oryza sativa
ggacataaatttgcaccattcctgcatgcccattcatatcctgttaccagtgttgttttcgtcggtccatgccagcctgttgccttgatatggccagcatttttccacctgccttattctgttatatattatgaacgcaggaaattgtacacagactgatgactgatcagtgatcacagaagcagcaagtttcattgtcttggacagttggactaattcagagaacaactcaggttagtctcacgagtcatgatcagggttcactttctcgttttcggcctttgtatcgggcagtaccaatataacgaaatttctgaaatttccaaattttagaacaaaatttagtcaaatttgaacaaatattaccgaaattcataaaaaattaaaaaaatcaaaattttggcccaaataatatcgtatcggaggggtccgcaaaatgatcgaaatttcagtccgaaatatcaaaccctgataatgtggaattgtggagagagtgtctatactctaaacggatagacagtgatgcaagcgacaatgaaacttgctgccagcctcatactgcctcagttcagcagcttctatcctcgttggcctatctatcctcctgtctcattctcgttttctgtacttcttttttttctaatcagttttccagctcgataattcgaatagattgttgtgttgaaatactggatactgtcatgcgtgctgcacgggaccagactgtgtccagcgagggagtcaaactccggcgtggagtcgttcgccggtggctttgttccctgtggtctcggtcgatgccatttggacactttcggcacgtgcgtggaaatcctggccaatgtaaagggctgcggcttcactgttccgttgttgtgtttctatccgtgtttcgtaccacgtggagggcatccgtttgtcgattctttttgtgtggccccaccataaacggagattacaggattattctctccgtcaatcaccagattacgcagttagcgattaatcctaattagcgtggccctccagggaaacaaaggcgccaaataaaaattaagacgccaaaccattagacagtttttcagaaaatagattaagctttacatatggcacattattatcggatcacaatcatcttcttcgcaacaacaatggcctctctatctaatcttccaaggtcaatcaaggtcaccgattcactgcatgaacaagtgacaaccatgccgacggaaccagctgcctctgctggaacgtttgtactgcatcatccagggacaagctttcatggtaacctagaaggggaattagagacggtaagacttcataatgttttcactttcttttattagtaatcattgagacttgatcactacaagcacatcatatcagtaaatctcatagaagttttgcttcttttctattagcccttttttttctgtaagtttcatgaaagtttttctttttttctaatttgtctcagataaaaaacgggtatattaat

SEQ ID NO: 17600 - DNA, 1501 bp, Oryza sativa
tctgactcagacagagatcctttgtttgagcacaagaagatttacaatcttcgattggactttatgcttagggaaaatgcccttttgtaagctcgatttttaaaaacttcctacatatctggctatctgcctatggccagaaaggtagattattcaagtcaaggcaaatgtttttttgttgaaacgaagccattgacaacttggcatcgtaatcgtgcgagacgtcaatcgcacttagagattgaactggctgtgaacaagtgtacatgcgtcgttgtcgcggccgtgccctggtcagacgatgaacacagaagtaccacgaaacatacaaatccgatagcaccagctggccagctagctgccgtgcatactttgccagcgtcacgtcaccaacatgtagtttagtcgcaaaaccatttttcatttttaaaaaacacagcacaaacacaagcgctcacaacgcgcacatactcatcctatccctataaacacctccggaagactggatcggtatatcttaagattaataaaattattacatgcgccttgccgtcaacgtgtacatctaccattaaaagaaatacaattagcagtgtgaaatctaggatttaacacttcgatcacttctacgcctccgtgagaccgtgactgggcgggtgagcgcgatagaccgatggtgcggtctctgaacaggccgtgatgttgtcggcccatccatgtgtccatgtgctgtctaggcagtgggccgtttactaggtcaactacttcgacatgtacgggccgagatgtttggaggcccacggaaagcctgttatgttgcggcgaacaccagacggggccgcggccatgtcccgcctccggctgctttcccggcgacccggccggcgattgaagatgtgcagcggcgggtcagaggcggcagcgtctgcacaagggcggggatctctcccggccatcctcctggcgagctcggaacgatctccctctcctgcatggtgcacgccctgcctgaaggctgaagcgcatgccgccctggagggcctgcggcggcgccgccaccagctgcggcgagacttccacccctcgctgtccttctcccccacctcaggcggtcccgcacatcccaatccgtgataaccgccaccacttggacctcgccggaatggggcatgaggttgtaagggggtgaggatgaggggggcggagaggaaggtgagatggtatccaaggttccagatgttgcacttttcaagcagatattgcagtcggcaatcaatggatcgctactgggatgtcccgtcctgtccgtctgcttcgtcatcgccctcttcttccaccaccacaccacgagggccaccaggtgttcaagagaatgcgccaccggcccaccgcacaggttagcgcaaagagcacattgcttatagatggcgccactagacctgataatcacatatacaaaactatgcaaagcagaaggctgcattcttatcaacagaaaatg

SEQ ID NO: 17601 - DNA, 1501 bp, Oryza sativa
agacgcagccaggcgccgcgttgtgcgcgtgtggagctcgtgggcacggcgtcgtccccccaaatttccccttacacccttgtctctctcgctctccccttggtctcgtcgcgccgcgcccgacaccgctggcgccgcgcctaccaccgccgggaccgccaccgtcggccttagagagagagagaagagagaggcgacggtgatgacgatggatcggcgacgaccggatccggccaccgcgcgccgcggtagccatcgaccaccagctagcgacgggcggagatggcttgaggcgcctgtgctcgccgcctcgcgcgccttgcccggcctcctccgccggtgccttgcccgccaccgccggcgccacggggggcctagatccacccactacggcgccggatctggcgctcccgactgaccacgacgcgaggcggaggatgccggggaggacgccgacgggagagagaggaagagagaggggcggtggtggacgccggcaacaggagaggcggccctcctcgtcgtcctcgccgtcgctcccgctgctcctgtgacgcaccatgacgccgctcccggtccgacgaggccgccgcggccaaggaccgcgccatcgccgagcacgcctcgagtctccggcgagcggcggcaacgagagggagaaggagagagaggtgagcggcggaggggaggaggcgcgccggtaaatgagaagagagagggggggggggagaacagaggggtagtatagtaaaatacctacgtgggctttttgggctaggggcactcgttaggctactagggtatctttcattgtgagggggggtttcccagagagtactctcagttagtgagggtagtcttagagtgttctgattgtagatgcccttagaccgagttctcctttattcttgaggttgcccttagaccgagttccccttttttcttgaggttgctgcgttgaaattctggatcttttgttttctttagagcctgtttagattgtagccaaagtaaaccttaccaaaggcaagatggtaatattgccaaaattttgacatgatttcttatgtatttaccaaatatggtaacaattaaacgtagatatttttttgacaacttaattaaaaaaaattagtatggttgaaaatggtgaacaggcgcttagtccttttgtttcctttaagaatcttgtactccctccgtcttaaaaaaagacaaatcttagatttttgtgtccaacgtttgactgtccgtctcatatgaattttttttataactagtattttcattattgttagatgataaaacatgattaatactttatgcttgacttatctttttaatttttttcataattttttaaaatgaaacggacggtcaaacgttgcacacagaaacccaggatttttctttttttttttttttttacgaagggagtactagctttactatgatactatctcatctctgtcaatggaaattggggcctcaaaagcccttg

SEQ ID NO: 17602 - DNA, 1501 bp, Oryza sativa
acagggggagcaacgtgtcatgtccaagactggtaaatttgttatttgataggtccaagaagaacgattctttccaagtttcccatgcccatggaggtattgccccattcatttggttatttgaaaggtcaaggaagattatcttatcttgatgtcttaatgcattgggaaactttgatatgttgcaggaagctaggctcaagaattttactttgggagaggacactgctgaatcattgactaacccgtccaccacagataatttattatttgaaagatcaaggtgtgataagtatggtagtctccagaatgaggtaagttccactgtccccacgaagttgtttagtggaagatgcaagctatgcagttgtgtcaagttaaagatttgcaatggtatgtttccagtgaagttgctcttgaataaagacattcttctgagattcttgagattgcctatggaagatggtaaagatccagacaaaccacaatgagaaatttggagatctgtcaaagatgttagatttgttatccaagctggcattgatcctactaggccgagccccgaaacctcaaataagttcaaggatttaagcattcctagagaagacggcagttctgtagggaaattatttgcactcagactcagctccttcagatccgtgagattagaaatagagcttggtatgtaacctgagaacttggtgccactgacatgcaatttgatcaaactgctattaggtggaaaattgggcaaatcaccataaacttcatagttgtagctaatatcaatagctgtcagttttctgttctggaagatcctttgtggaaacaaaccctcaaacttatttcttgaaagctgaagaacactaagggatgacaaatcagcgaagaattcaggtatggcaccagacaggtcatttccttgcaagtcaacaacagaaagggatcgcaaactaaacagagattggcaaatgggaccagagatctggcataatggtaggctcagaacctgaatcttaggagtggaattagccagagcattgcaccacccttcgcctccgttggacatgtacaccaatccaagatagagctccctcagattaccaagatttgcaatcaacttctcgaagtttaccctcgagaagccccaggggggtaacaaatttgacatgatactgacatcgtcatctccttgattgacgatgtagatgctagatgacagatcaagagaaaccaagttggtgaggcttccaatacctgctggtatctggcctgcgaagctgggtggggagatgttgagatgggtgagctcagtgagcctctcgaatccggtggccgggagctgtgacgcgttgaagtcgttgccgccgaggttgagatacctcagcgacgtgaggctgaagacggcggcgtcaaggccgccgctctgcaggcgtcggccgcctagatcgaggaaagtgacgcggccgccgtcgcagcggacgcccgcccagcggcagca

SEQ ID NO: 17603 - DNA, 633 bp, Oryza sativa
  unsure (1)..(633): unsure at all n locations
acaaatacattctttctacaaaataaagaggaagctcagtttatagaatacaaatgctatgcgaggaaagggttaggaccagacataagaagaccancgaaaaaagtattgctttcagtaaaaataacatacccaaaaagaggaaatctccagctcattgtactagagcaatctgcataaaaagaaatagcaggttacatatgttccaacagttggtggtaatcaataagctgtacatgcatatagattctaacggaaaataactagtagatggtaatcgctaacgccaatgccagactaattgttggttgcatcagaaaaataaaaggaagaagaatggatcaaatctagaacaaattgaaatcaaacccctcaacgcagagttcctattgactattgtcaaaaaacgatatacttgtgataagtctcatgttcggtaggacgcgttttctactccaaaattactgcctgcgtaatcaaatcaaaatgccaagcatttggatggcaaaatgttctgtaggctacggcttgcttctactctcaaattgcctagataccgtagagcggttaatccatcactgaagattaccatgagctgctgataactaactaacttgggtgtgactttcaaga

SEQ ID NO: 17604 - DNA, 1501 bp, Oryza sativa
ggttgttttgccatacaagaaaccaaattttgcccgtattagaaaattcagctactggacattccaaaataatggtctttgccacaagacaccacaaaaatgtgggtttgctggaagacactctgaaattacagttatttgctggtggatgctgctcacataatttattgtttttactcaagtgaggagagagaacacttgcaaaatgtctatttgcccttggaacatgtattattaatccctttttgctttacatagtggtgcggtgcctgggcccattttgaaaagctaaataaatagagaggggagaaacagattcgaactagatggagaaaacaaaaggtagtgacatcatttttcaaagtttctctctcctaatcatacattattttgattggagaagtgtccaccagcaaattaccacaaacttaagtgtgtcttttagcaaagccacattttccggtgtcttttggcaaagaccacaatttaagaatgtagcaaattttgcctttttctatgtggtccacctcaagaatgttttcatcaacatagttgacctgtttcatctatccgtttaattatgcgctctgtttttactcttttaatcctccatcatcttaccttaattcccaacagcaaataatcaatgttaatgtagccaacatgacaaaataaactggagttcgctcactgctaacaaaacctccaaaaccgccttaaggtttgtttggataagtagggatatctacaatctttaggactggaagagaaattatactgaaataaccaatctgaaaggagttaagaggctttcatattgccaaacaagttcttagggtgtaaactgatccaggtttgtgggcttagggtggtaacaggttttaaaattcaaggcataaaatggactatttgcagaaattacagagttaaaaagtgggcctatttcagtgacaaaaacattgatttaagttgaaagtttattatctacaatcaatcagcaatgtaaagtttgaaattcaaatagcacttctattttggaaggcttactatcaccctacattgtgcaagcatggcaagagtagtgctatatgaacaaaattcatgtaaaatactggtaaacagaactacatgaaatggttaaaggaggtatcttacttaaagataggttttggccaattctgcctgctgcattgctcattaagcttctgtttgcactccctaagctctccaatctcatcccccaatccgttgccaaccccagttgttaacacttgcttctttgcacctgcaagcttccttgttgcatcccgtgcagcattaagcttagcaattaccttctgctccgaggaaccaataccaactagctccccagcaacaaatacattgaccactgtcatcccacctttttgccatgtcttgaattgtgccatcttcccgtgtttctggcatagttcatgcaacatagtcacaggttgctcgtctattgtttctgctgtaataa

SEQ ID NO: 17605 - DNA, 1501 bp, Oryza sativa
gtgcttgagctgcattgatgaagtcgaactgcggtccttgactccacggtgaagcccccagacctggctgattcgacggcaaccaactaggcgcaccttgacttgtattcccctccgggtgggccgaaggggctgtacctgaaatgctgtggggttggctgggttgctgaaggaaagcttggagctgcgcctgcagagccgaagccccttctgccattgtttgtggcacttggccaggcggttgaggatgtacttgggtagcgaccggttgagcttgcagttgcacgtgaggggccggatgcactgctgcggtcgaaggctgtccggcgaagtacattggcgcttgtgcaactggtggaggaaggggctaggtcggtgcttgtggatagacttggggtgggacatagcctgccgaatactgtaggattggggccgaagtgaccttggaccgccttgccgccttgtatgcttgctgctgttcttgcatttggcgaagcatgtcttggagtcgtgtcatgttatgtcgcatggcttccatgttggtttcggtttgtgtttcggggtcaggattgacttgatcttgcactgcggcgagcgcagttgaggccgctgccggctgcgacggagcggcttagggcaccagcagttagcttgtcgaaaggatctctgctctggtttggagtgcccttgccgccgcagccgccttcgccatgtcagccgcgttcagcacctgcgcagaggcggcaggggccgaaggcagtagtggtggcgtaggtgcggaagcagatggcgctcctccatcttcggcgacaggcgccgaaggctctgctccctattcggcggccatatctccctggcttcgctttcctttcgcctcgtaaccttctccttcacgaccttcttcggtagcattcgctctcaatggtttcgctcggagatccccacggtcggcgctagctgttgtcgaaacgacaaccgcattcgtcgaaagacgtggttactcaacagtggttggaaaagaagtaaactgtactaatttgagaatttttcttcggatccccctattacatgaccctacaagactatttatagccactattacagattcttactactagggttttggttatacagggagaatttatatggttgcccttagaaagagacatttacatgggtacacagtgtaattgtggttcatggtcccctgatgggccgtcgggcgatcgtcgacccaatagcccctgggcttgatgggccggaaaggcttcttcggtcctcgcgagggcgaacttgctatggcgaagtcgtctcccttcggcatatactcttcgccctgcatccttcgcctctccttgttccatagtcttcgctatggggggacttcgccctaactaattttgacgtcttgggcttgaatccccactcttcgcatgattttggcaggtttggtcgaatggcgtcatgccataccgccaacaatatatatagatatagatat

SEQ ID NO: 17606 - DNA, 1501 bp, Oryza sativa
agccagggagatatggccgccgaatagggagcagagccttcggcgcctgtcgccgaagatggaggagcgccatctgcttccgcacctacgccaccactactgccttcggcccctgccgcctctgcgcaggtgctgaacgcggctgacatggcgaaggcggctgcggcggcaagggcactccaaaccagagcagagatcctttcgacaagctaactgctggtgccctaagccgctccgtcgcagccggcagcggcctcaactgcgctcgccgcagtgcaagatcaagtcaatcctgaccccgaaacacaaaccgaaaccaacatggaagccatgcgacataacatgacacgactccaagacatgcttcgccaaatgcaagaacagcagcaagcatacaaggcggcaaggcggtccaaggtcacttcggccccaatcctacagtattcggcaggctatgtcccaccccaagtctatccacaagcaccgacctagccccttcctccaccagttgcacaagcgccaatgtacttcgccggacagccttcgaccgcagcagtgcatccggcccctcacgtgcaactgcaagctcaaccggtcgctacccaagtacatcctcaaccgcctggccaagtgccacaaacaatggcagaaggggcttcggctctgcaggcgcagctccaagctttccttcagcaacccagccaaccccacagcatttcaggtacagccccttcggcccacccggaggggaatacaagtcaaggtgcgcctagttggttgccgtcgaatcagccaggtctgggggcttcaccgtggagtcaaggaccgcagttcgacttcatcaatgcagctcaagcaccagccgttcggccgcaagcaccaacgccaggcttcggattaaaccaagcaccaaactaggtcgccatgacatggtcacaaccaacgttcgacccagccatggcagctcagctagcatcaccaatcggagccgggcagccgaatgccatggcccaacctcacgcgcaagccgtgatttcgcccttcgccacgccgtacccacagcaaggtgccgtgaacagggcagggggtgaaaaggggctaccctgagggcccctttgaatcgtaggaatgaaaaaacagaggaataggaaaaacacagaattctgataggaatacaattgtaaaacagagaattgcaaaacacaggaaaaacacaggaatggccgtttgattggaccacaggaaaaacgcaggaatcagatgagagagatagactcagaggaaatgttccaagaggttagacctcttgctaactttcctccaaaatgtgcataggattacccattccataggaattttaaaggattggataggattcaatcctttgtctcaaaggccttcataggatttttttccataggattgaaatcctccaaaattcctacatttttcctacaaatcaaaggggccctgagtgtgggaatcaagacccatccaatcc

SEQ ID NO: 17607 - DNA, 232 bp, Oryza sativa
tacaaattttcaaaaaaggaattgtcttgtaagtgttttagtccaaacagataaggtttctaaaaaagggtgttggaccttaagaagagccccagggttatttagaaaccgttatttccaaaaagtgtttgggtaccccctcctttccattttaaaccagttttttgaccaaaggggtttggcggaaaacctccttttaaagaatattattgggcgcaattctccccatagg

SEQ ID NO: 17608 - DNA, 587 bp, Oryza sativa
ttaggaaagctttagcttcgttttaatccatcaaaaaagctaaaatgtttatggtacttttaattctagaataagctgtagctaatcgaatcaaaaactccccaaacatacccattatcacatatcgcagccgcccatgtttaggaaggttgtcccttcccttggtacaagcaccgaaaaaatgcccatccgatccgaccgttcgttctagatcggttccagatcggacggccaaggacagagatatgggacaccgctcattacaacaagggtctaaattgtacggccgcattttttcgtttatgcttatgtttattattcaaaatttaaattttcaggcttaaatttgaaattgattttagagttttttcatcaaaatttatttttcagtctttgcttttagattgctaagaacacgtatataaaagttttattcacatattatttttcatttgtaaatataccgtttggccaattgggggccggtaatttcgcacagaatagaggggcatattcgaccattcgtcacgtcaccagctaggataaagtttcgattcctctcccaacgacaatatctttgggaaggc

SEQ ID NO: 17609 - DNA, 257 bp, Oryza sativa
cgtatgcatttactactaaggccctgttcttttttccaacaaaagttagataaacttttaagatactcgtggtacgcttttcaaactgttaaatggtgcgtttcgtgcgaaaactttctatataaaagttattctaaaatatcagattaatccatttttcaagtttgtaattattaaaatatcagattaatcacacgttattaccacctcattttgtgtgaaacacttaatctttatcttcatctttcatctttagg

SEQ ID NO: 17610 - DNA, 492 bp, Oryza sativa
acaagttatattttttcgtcaaggggcttaacaacttcatgttacccattagtagttcgatgttatataagtatgtgttacgatgctaaacaatttctaaaagttaaaatgttaatttttgaatagaaagaatctgtccatgcaaagatcaaaataaattacaattgttacaatcatatatttcaatggaaagggatgaaattcaagttgaggtgatacataccattggaattgttgcaaaatatgaattaatttcccttcttcatatatagatagcctacctttgatgtgtttgttatcctgttcttttcttgcatgtactgttcacttttcaatttcaattgcatgtaggaattgaacagtacgatgttttatgatctttttagtttcttggcattacttcattacaatctataactaaactatttcctcattggcgtttgctccatacatgcacattacttaaatatcccgcgtccagtccgttgcagg

SEQ ID NO: 17611 - DNA, 1501 bp, Oryza sativa
aatcttccaatcttgatatgcagataaggcagtttcaccttgggattcttactgttgagtgaaatttacagggtgttgatgaagaaaagggtcaaggggatgagcaaggcagtgctgttgccgttgcatcctctgaacagaaggaagactcaattaccacataaacagtaaaatcaatgataccgcaatcacaatgtaactactgattcttcaaagcgacgttcttcgtgcgccgccattttctattttatgtcttcctccttatcttttctctaaggatgtacatttgtaagtttctactggagggaatacaactcaatcaaaatactcatgtacagccgaattccctgcagaattgagtcgctacgaatacacctctctttcatttattgctgaaaattgtgactttccttttatacaagtcacccatttacatatgcattctatctctttttttccctcctttgtcttttattttttgagaaattgtctgtattattgttgagaatggcagtcgggcacgacgggcacgagtagtgactacccatacccatgcccacgaggtaatttatgctcgcgggcatacccgttactacatgatgagcaaggaacactactcatgcccgttacccgcgggtgctatgtgcccgcgggtatgcccgtttacccgtcacaaactcacagttcaacatttcaaccacaaatctccacaagcagagagacattatcgcaatttaaagaaagggtacagttgtatcaagttcaacaatacaagcattacaagttcatcaatactagatggtggcatttatactaatttgaccgagggaccacatatcagttggtttttgcgggtaaatgggcgaagcgggccagtgcccgtatgcccattgggtataggttttgacccaataaaaaacccactggtactaaatggagaacaaacccaactttattagggtttttacccacgggtaaacgggcaaacggtttaaattgccatccctacttgagagaacttgtgcagagtagaagtgaattggatggaatcggtaaaaaaaaaattaattgaacaggctgttgggcagtggccttcgggagaagaccagggtttcatttaccgccggggccgcggttaccgcgccccggcggtaagcacggttaccgcacggtaaccgcggtaaccgtgacaaaccgcgacaaaccgtacaaaatttatcaaaaattcaaattattttttaaatttatttgaatttgacgcggttaccgcggtttaccccttaccgtacccccgcggtaagcgcgataaccgcggtaaccgcgcggtttaccgcggtaaatgcaaccctggagaagactacgcggcccaccatcacggcccaatcgatgaaccccccggaatccctaaaccaacagcaagaggaagtctctcctgctcaagcggcgcgacgcgagtagcagacgcggcggcgcgacgccatgtcgtcttcctcctcctcgt

SEQ ID NO: 17612 - DNA, 1501 bp, Oryza sativa
gaagcaaaacttctatgagatttactgatatgatgtgcttgtagtgatcaagtctcaatgattactaataaaagaaagtgaaaacattatgaagtcttaccgtctctaattccccttctaggttaccatgaaagcttgtccctggatgatgcagtacaaacgttccagcagaggcagctggttccgtcggcatggttgtcacttgttcatgcagtgaatcggtgaccttgattgaccttggaagattagatagagaggccattgttgttgcgaagaagatgattgtgatccgataataatgtgccatatgtaaagcttaatctattttctgaaaaactgtctaatggtttggcgtcttaatttttatttggcgcctttgtttccctggagggccacgctaattaggattaatcgctaactgcgtaatctggtgattgacggagagaataatcctgtaatctccgtttatggtggggccacacaaaaagaatcgacaaacggatgccctccacgtggtacgaaacacggatagaaacacaacaacggaacagtgaagccgcagccctttacattggccaggatttccacgcacgtgccgaaagtgtccaaatggcatcgaccgagaccacagggaacaaagccaccggcgaacgactccacgccggagtttgactccctcgctggacacagtctggtcccgtgcagcacgcatgacagtatccagtatttcaacacaacaatctattcgaattatcgagctggaaaactgattagaaaaaaaagaagtacagaaaacgagaatgagacaggaggatagataggccaacgaggatagaagctgctgaactgaggcagtatgaggctggcagcaagtttcattgtcgcttgcatcactgtctatccgtttagagtatagacactctctccacaattccacattatcagggtttgatatttcggactgaaatttcgatcattttgcggacccctccgatacgatattatttgggccaaaattttgatttttttaattttttatgaatttcggtaatatttgttcaaatttgactaaattttgttctaaaatttggaaatttcagaaatttcgttatattggtactgcccgatacaaaggccgaaaacgagaaagtgaaccctgatcatgactcgtgagactaacctgagttgttctctgaattagtccaactgtccaagacaatgaaacttgctgcttctgtgatcactgatcagtcatcagtctgtgtacaatttcctgcgttcataatatataacagaataaggcaggtggaaaaatgctggccatatcaaggcaacaggctggcatggaccgacgaaaacaacactggtaacaggatatgaatgggcatgcaggaatggtgcaaatttatgtccgctcctggagcttttatatgtgtgccgagcaagcatatatacatctgcagtacaattggagcatcaacccaagacagcagcaaaatga

SEQ ID NO: 17613 - DNA, 1501 bp, Oryza sativa
ttgacccggagagcaagtttaatagtatagctaactactagctccaattcacctatagtcaatctaatagcttatttatacaatatttatatattacactattaataattggtcccacctgttatgcaaacaccgcgttttgaagtccgtgctacagctggctataaatctgtagcgtgctactcttctctcttcttatttatcttcttaaaatatgtttaaagctaactttgatcctgcaattgtacctgctcggataaattgataatgcggtttaaactttctatgccattgcactctctctgccctaaaatgatcgaccaatgaatttcaacagagacatatccagattcgttgatataggatgaatcatatctcatctaagttaagttattttagggcagagggagtacatctcaagtctaaataatctaagtatagaaaactcatggctacacttattttacgatgaagataactcatggctatacttattttacgatggaggtagtaggtccgtttcgttccagatattcaaacagtctgtacgcaaaaagccattcaacggccgcgacagtacatgggttgaacgttaagcttacgctaccacaccgcgacacgggctcatatttcattttctaaagactagccatgcagtcatcgacaacgacaggactaaaacagaggcgtcatttcacaacagaaaaattcacatgtaaggatcaacggttcaacaccatcttcagaagaaaagaatatgataaaaattaagtttttttatgtaaaataagatgatattaacgtataattaatttaagttttaattattataaacttaaaagatcaactttcatactgaaagttttcgcacaaaacacaccgtttagtagtttaaaaaacgtgccataaaaatcttaatcttcatctaacttttattggagaaaaatgaaggggttccaacactgcatgaacagtgtcattggtttttcttcttgactttaaatgaatgagcttaccttgacttcgcccgccattcccacggagacggagtgaactccacgtccattgatgggttgctttaccagatcgtaggaagcaagatgttatgtaatctcactagccaacatagggtgcgtttagttcacgttaaaattagaagtttgattaaaattgaaatgatgtgacgaaaaagttaaaagtttgtatgtgtaggaaagttttaatatgatagaaaagttaaaagtttgaagaaaaaattgggaactaaatcaggccataggccatagattgtacagaaacaggcctggatgacacgggatgtcaagttttcacacggagaggaatgaaattcgcgatatatatgcatggtcaggagccaggatgtcaagttttcacatgattcagtaagcaagcaccaagtgaactcgcaagatgaactacacgcatagatgcctccacagccacaaactccctcttctcatcctcctcattgccatcgtcg

SEQ ID NO: 17614 - DNA, 1501 bp, Oryza sativa
cagcctccaccacgccgcccggttcttggcgtcgcggcaggtgaccgacacctccgccccgcgcagcggcctcgcgccgtcgaggctccacgagttgcggtgctcgcagctctggcagtacaccttcccctccaccctcactagcaccttgtcgctgctttggtgcgccgctggcgccggtggcggtggcgatggcggcggcgtgtgctgcggtggtggcggtggcgatggtgtggtgtagccgttgttggcggtggcgccggcggccaggagggagacgaggatggcgaggtggaggaaggcagccattgatgcggagcttggtgtaagctcgactgagatggtttgtgtgaagcttttttttggctgtgtcgagatggagagaggcttggggttttatatactgccatggatcaaacgtgcggacatgtagatggccgaagcccgaagtggtggccatgtttgtcctggaaaatgtcttggttttgattaagattacgttttattatacattattgtaaaattgtgacaatattatacgtacaatgattgacctgtcgaaatgaaaagaaagacaatatgtaatgattggtcaccatgggcatttttaagagaagaaatcgcatgcttgtaatctgtttggcgattggtcagtctgacatagataacgaatgttcagaaggatgatatgcagatttgtcagagaacgtgctgcccgcgtgtgtcctcaagacttcaactgcaatatctggttctccgtgtaggcagagagatgttccccaacgcaatgccgcgcaaaataatcaattttgccggcagagcgacaacttgttttataatctgaaaacgaactgacatcttattttatctgtaaaatgtgcagttcatgtaggagcatgatgtgcgtccatgttttgtctgaaaccgactgaaagataaacagagagcactggagtaagagaattttctgattgtttctacataggagtaggagagtttaaggcgaaagttactggatggaaaggaagtctgactaatcgagcttacccaaaaattcacaaaacgtagcatctccatcccatcaagagcaatatgtgctctagttcttgtttttcatcttgagggagaaattatccgattaagtttacatgtctgaagagcctaatcatttttgtatatcacttatatgtgctgtcctaaagatttgatttatggaagagtagaagacaattctcacttcacattccaaacaggtcataaatcgacaatatcgcttgttattgtgcggtttccgcggtaaccggacttacctttggatacactaatagtaacttatcccgtcaaattcaaataaatttacataataatatgaacttctaatagcatcgtctagtttttcatggtttaccgtgtgattaccgtgcttacgattgggtgcggtaactcaacccctgatggtaaggttagccctgctctaactaggaaaaaacaataacaaaca

SEQ ID NO: 17615 - DNA, 1501 bp, Oryza sativa
ttctgttgtataattgagtatgaaggggaaaaaaacactaccagaagagtaatatattaatatgtttatctaaaaaatgactaacctttcttgggtgtggtattagatgagttccaatagttaacacagcttccaacctacaattacaggctcacattaccaaacactgacagatgaagcacactagaaataactaaagactgaaattatcagtgagactgaaatatatattagcagctgtgtttgtttgtagtctaaatcgctgagacgattttctgtagcctaagccattcctggcttagggtgttcttgttgtaaaactctctctccttcttaatacaaaacttggccggttcttttgccggcccggtgaaaaaataaactatcagtgagaacattgctccattacaacttaagatttgcaccttgacccaagtactactgataatcaaacgcatgtcttaggaacccgagaattcgataaaaccgaacatttcgtggactgaaacttatcgtaagggcaaagataagaggatcgaacaggtgtaagcagggaggcatacttggcggcgcgaagaggggagaagcgcgagcggcgaagcgggagatggggagaaggggtagtgggtgcgtggaggcgaggcggcgagaggcgggtagcagtggaggaggccgccatggctggcttgctgctgctctatctcctcctcgcctcgcctccgtcgcccgcggccaccgtgaatcgctcgctcgctcgctagtggtggaggcaggcaagacacgtcactagcacggcactttttcaaatacaccccttacgtattatctattctcgtaaggaccaaagtgaaaaagtttactacataaggactaatcgcagaataagtggatttccaagggggttcgagtaagaatccgggtcagaaacgggggaactgctttaagattcgcgcgagcacgatcgacgcgcacccagccacccacccgcgccccaaatcacgaggaggcgaagccgcccatctcatcgccggagctcgcgaattcgccgccgcgattccgaccaccgccgcgccggcgcccgcgcccgctacggtactccgccgccgtgctgagatcgccgggggagccatgtcgcggtccctgagcatgaggtcgtcgatgagcatgaggtcgcgccgcgacctgcctcctccccagcaggtgagggatccctcctctccccgtgccttgggtattgcgagtgtaacatttgcgcgaggtgcgcgggattcgctgttgcgtgcgcgatgcgctagtttgatctcggtgtttttcgaccttggggcgtagaggggcgagggggtcgattacccgactcttcgtggcgaatttgaggaaactagggttctagtaccgaatcatgtccaattgcgaatctcgccattttattgtgtggaactactagctggaaaaatcaatcgtaatatttctaagaaaaattaagattacttattgtggtttg

SEQ ID NO: 17616 - DNA, 1223 bp, Oryza sativa
ttgtggggctgtgtcttgtgggtacagttgtacacctctgatcagagtaaaactattcgaatagccgtgcccgcggttatgggcggtcaaccagattcaccgtgattagtctcaccttagtgtaatcttttgaatttggatagtttaggtggatggctgggcctgtcgcaacgtgggatagcgttggacagcggatgattaatattaattaattattacaactgtttaaatctttcaatttctgtttataaatgctcgctttatgcaaatgaaccactttagctcttctttgatgattccctgcaccatacccctattccggtatgacttgttgagtacagtgggtagtactcagtcttgctctacttttcccaaccccagagttcgagttcgggtcagatgaaggtttctccgaggagtaggctttgtccgtgccgtcgaggatgcctgtggagtggtgttcccgctgcagttttagtcaaggcttagctcctgttgtctttcttttcttccgctgcatttatgtaagacttttatgatgtttgtaagacgtggatctgaatgtcaacattgtcgtttgtgtaccccggccggtcctggacggggattttaatgcacattctgcttgaaattctattcgggaatttctgggcgtgacaagttagtatcagagccgaccttgaccgtaggacaagccaaatggaaaaacctaagagccttctgaatccttttcattgcatatgttctttgcaattggatttgttccgggaaaattgggatctgttcttgtggttcaagggaaaaatcttggtcgctcgtttaagtgagatttgtcaaaacgagtcagtctagggttttagtaaaactattgagatttattcgtcagtcagttgggatttgatgggtgaaatgcattaggtcctagctcaggaacatgggttgcaaggtatttatgctcttattgttattattagtatgtagctaatttccccattattttatcgttatgtgagtctgtcttatttattcgctctcatgcaaaacgatctatgcataaaaatttcgctcttattcgattcctttatttgagtcttttattgctttatttaagtttggatttgagcatgcattgatcctacccctttgtcttctctagatggccggtcacccacccaaccaccgtggagaaggcatgatcgactttgtggcagagttggcacgca

SEQ ID NO: 17617 - DNA, 1501 bp, Oryza sativa
tcttaactagatttttgctggcgggtactaaaagcaccgcccttgaaaaaatccacgcacattgaaaaatcattgcccattacaaaaatcaccacccaccactccttatccacaccgctccaaattacaaaaatctcctctggttcctccaccagcatccatagtacaaaaaaaccggaccggctcggcggttgaaccggaaaaaaccagaaccagagggctaggcggctcggtttgctgtaaagaccgcccctgcatttgaaccggaataaaccgcctgaaccgccagttttcatgtgaaccggtgaaccagagcgagccgagccggccggtttgtcatgccaagagaggatgggccttgatgggacagtctaggccttgtgcacgtgcatgtgtactactgaaaatagcaagaaaaagggatggaacgggggttcgaacgctggttggctgactgaaagccctatgcatccaccacccagctaactttcacaagtgataagaagagaatatgcatacaatataacacgtcgggttcaacattcgaaccgtgtgaaccggcggttgaaccgctggaccggtgacccaaggactcgagcgattcgatcgccggttcggttttttcaactatgccagcatcctctcctcctcccccttcagatccacccaccagcatcatctcctcctccctccccataggcagcggcagtggctctaacggcggttcttgggcgatggcggtggctccgacagcgatgcgcaacggtgacggtgataggaggcgggcgcttcttcttctcctcctccccctccctctcccacgatctcactgccaccacctcctcggcggcggctgggcttcctagatccggtggctccaccgccagatttgacggtgacagttgtggggcttggtgaggcgagaggagctcagcggcagtgaggtccgatgaggcgggaaaagctcagtgacggtggggcttcccacatacggtggcttcctcatctgatccaacggtgaaaagcatcaactgctgctcggtcggtgacggtgacgacgacccccttcctttctcccggccagattggtggtggaggcagattcggtggcgatgcttctagctgttgttgttgttcttttttttcatgttcttttgtttgttcaaaatgcttgtatgcgtgttcacttgcatgctaattgcatctaatgaactctctggatgaggatttgaatcgtagcctgaaaacttggatgcgaaaatctgagttattttctcttttctttgcgaaaatatattttggggatttattttttttcatggaaaatcattttcgctggcggtttgcttaatcttgccgactgtagaagtcgattttcgttggcagtccacttaaccatgccgccagcgaaaatctatttttgctggcagatgaagcccgcttgtgaagatagcctattttctctggcctttgatcgcatgcgattagcttagacgccagc

SEQ ID NO: 17618 - DNA, 676 bp, Oryza sativa
tctttttacctccagaagtccaataattaattggtataatatcacacattactaatcgtataatattatagcatatagaacacaaaattggccataactttataaattgatagaattgatcataagtccaaattctttaacatatataagtactaattgttcgacatatgtttttggcaacatataaaacatgtaaaggatagaaaatggtaaaatgattaaaaaaatcttaaaatttagaggagaacttttcgatgcttgatattttaaaaatgagtgatgatgtcctcatcctttaacttgtaaaaagaattctcttccaatgaatgtagattgttgctcatcttgcctcttgtttttatatagttcatcgaagaaaacaccctctctaaattctctaaattcctaacagcagctcatatatataaatttaacactctgaaaattaaatattatggttctaagtatctaaattcctaatatttacagctttatactatcaatctgtcaataaatatagacttctgaaaaataaagaagataggaactaaggaagttgaatccttcggtgctagtgaactattgaactggagtactaaagaacaaatcaataaatcaagccgtcgccgccagaaaacataactactattgaactacctaggacaaatcaatgcaa

SEQ ID NO: 17619 - DNA, 291 bp, Oryza sativa
  unsure (1)..(291): unsure at all n locations
gtgggtttccgtgtccaatgtttgtcatccgtcttatttgaaaaacttataaaaaatttaaaaaaaagtaacacataaagtactattcatgttttatcatctaataacaataaaaatactattcataaaaaaatttcaaataanacggacagtcaaacgntgnacatananacccacaactgcacttaaaatggggcggagggagtattactgtaatatgccttggcaaaaatattgaatatctaactggctgttctttgctcttgtgtacttgatttttttgtttcttca

SEQ ID NO: 17620 - DNA, 484 bp, Oryza sativa
gattatggataccccataccaacacggcatttataatccgactgggtatggggtgccatgtatagataagaatatctttaaagggacttgggttaaattccaaacttgtatgttaaaggaaatacccgggatcttagtcggttaagattgaatcttatctgtaactacctattccgttagggatatggactgtattttataatacggaccccttcccctatataaggaggggtccaggtgcctcttagggcacgatctgctcccagatcatacgatcaataatacactcggcaaatcaatccccggacaggagtagggtattacttcttgttaagaaggcctgaaccagtataaaattctttgtttctcaacccatccacttttccagcttgatagccacccccttttagtattgccaaaatcttgtttcgacaattggcgcgccagataggggtagcgtcaagttcttcgccgattagtgcga

SEQ ID NO: 17621 - DNA, 192 bp, Oryza sativa
tgcgaggtttttctctctcttcctctcggggaagaagaagggtttctaatgggccgggcctcacgcggcccataacaattgggcccatttaagttgggccggatgatattttggcccatttaattgggtccagtgggtgaagtgtaccaagccgaggtgggagaggcaaaaccctagcgcgggtggaggcga

SEQ ID NO: 17622 - DNA, 261 bp, Oryza sativa
taacaagtacacgacgacgacgacgacagtggtacaaacgtgaccagaacctgaaactctaaacgaactaacgcttaagaccagcaacatgactcgacaatgcaacgcaaaactcaacaaagcaaaaactgaatgaacaatgcaatggcacaaatatggctaggtataggatgcaatttttttgtatggctattttctggtagtagtgttaacgaccaaatttgagaacactgagcaaaaaaaagctctgataccacctga

SEQ ID NO: 17623 - DNA, 392 bp, Oryza sativa
  unsure (1)..(392): unsure at all n locations
cctcccccttcccgggaatccaccccctacctttttccatgataggtttgttttgtgtgaggataataataagtgggatttgtgggtttgcttgttgtgaagcgcttcaatttgcgggaaaccaacccccacatgccgtgggagttctcgaaggccaacatgaaaaaggggctgttgttagtctcgttcattcatttcccggtgatttatgatttggatggaaacagtggatgtttttgaagttagttgtggcagattttgttcagttttgtngngggatggncagnantggngggtagggnnccannnnannnngnnnnnnnnnnnnannnnggggggggggagcgaggaaaaaaccggaaatgagagtcggtcggtcggtagcgcggcta

SEQ ID NO: 17624 - DNA, 163 bp, Oryza sativa
  unsure (1)..(163): unsure at all n locations
tatttttgaaaagaaaaagggaattattgcatcaccggctagggtttccggtggcccgggcgcacgncgacggttcatgcgaacggacggccgagatcgatccatccaaaacggacggccgagatcgatcggtccacgaccggctcacgggagacggggacga

SEQ ID NO: 17625 - DNA, 1501 bp, Oryza sativa
atagctttgagcaactaagtgtcttttaatgctgtttactgcaaactctaaccctttatattataacccccttgtactcccttgcatttatcctgcacttgtgggtgtgtcttgttgagtacggtggttgtactcagtcttgctcaatttttcccaaacccagaagaggagcccctggaagatgaaggctttggtgtctagctcgtgcctgccgtcaagcgcctgtggtcgtcgccctagtcttccgctgtttctcgtttgtctttgtgtgtgctgggccttcgccgcccatgtaataaattaactatttacgcttccgcttgataaactctgaaatgtatcaacttttggtgtaccttgcctcctgggataaggaataatacacgcacgtaaggaacgcccgttgggttaattccggtcgtgacacttcctgatgtgtcgtctaagggtcaatgatggtcttggtgcccaataacagtatgattgtaagcaggtgcaaattgaatagatgttttatgataaaggacaactccaatatgcagtggagagattggctttcccgcagaggtgggagtaggagaggggatttcaaataggacaatttatgtcgtgaagtgtacaatgctatgcataacgggaagtacactcgatatactctgtagacaacctgtattttctcaagtcaatcaatttcccaaggcacgttaggtttagctccggcgcatatgtattatgtgtacggtacatgccattgtagtgctaacatctaagtatttcctaatctgccatagtattagtcaggcaagcatatgtaaccacataatcaatttaaagtcgtgaatgaggaatttgtgatggggcctatcacctgtcacataggccatactattgacgggctggaataaaccccgatatagaagcaaccatataggcactcatcataggcctcttggccagacccgtcaccagtgacactcatcggtgatgaggataggtggcggcccgataaagattatcattgacaagccgcaacctaaccccgcactggtgacggccccacaaagataatgttatggcccgtcactgaggattatagttattgatggtctccatttattggctgttactatgaatactcccaaccacttcgtggaaaggaatcctgatcaaatgtactatccccatttgtggtgggagagctagaggggtgaatattgtcttttattaaaataacagaaaatttaaggaaaggctatctaggtagtaataaattaaccattcctacaaattttgtaatatattgttggtatttcttaacgacattactagaaatataattctcagcaatggtgcagaaatactcctggtatattatggttacagagttcatccgcaagcgtacgaatataccattgtagcatttcaccggagagtattccaagggtatcgtatttattttatcctgtggaaagatcatgtagagagaactcaactaataatt

SEQ ID NO: 17626 - DNA, 1501 bp, Oryza sativa
tgtagaaaatatctcaaggaaacatgtaatatattttggaatatttacgaattgtaagaggtacttgtgaaatagaaaagaaatctatctagctaagctctcttactctggatatgttgtgtatgggtgttttctcattttgcgacttcgatcagtcacttgagtcatacactctccctagcccccaaccttgtcgtcgaagaatcgttctcagaggataaggctcttggacccctgacctgccttggttgaaaaagcactgaccctagcccccagccgtgaagttggaaaactaaatttccaattacacagcttggttaatacgcacggcaagaactcttacatgaacagatcttacatggtcgtttgtctctacatgatccgacaaggccttatccactctgggcgtccccagccgaagttcccttaagttcctcagaggccttgtcaagacggcggaaagggacatgaggataggtttcagcgctaggtgtcatcgtggtaagggatcgtcggaaagaaacactttgatcgtaatcttcacctgaaatcaactttattgaaatcgtaagatgtcttacaaatatggatactattgatttatacatagaagttatgtaattgatcaatgttctaggaatttgctaactcgcgaccatcgccgtctgcaatcttgaatgcacctggccgcaagacttgcgtgatcgtgtatggtccttcccacttgggtgagagtttgttacgccttgcttggctttgaacccgtcggaggatgtaatcgccgatcgaaagcgtgcgtgctctgatgcgcttctcgtggtatcggcgaagggcctgttggtagctggctgctctgacggtaactctttctcgatgttccttgagtagattcccatcgtcgcttcactgctcctcctgattctcgtcggagtacttctgtactcgtgtgctctgatgtcgtagctccgtggggagcatagcttctgagccatacgcgaggaagaagggtctctccttgttggacgttgtcggtgtggtacgcacggcccataggacagaggggagttcttcgacccacttcttgtcgtgtgacatgagtctgtcgtagacacgggtcttgatcccttgtattactatgccatttgtcctctcgacctatccattgctctgaaggtgagaaaccgaggctaagcagatcttgactcccaatttgatgaagtagtcctggaagtcggcactgatgaattgggaaccattatctattatgatgcggtgaggcaaaccatatctgcagaatatccctttgataaacttgatggcgttgtcggccttgatttcccccgtgggcattgcttcaatccacttggtgaacttgtcgatcgccacgaataggaacctatagccgccctgtcctcatgggaatggtccgagtatgtcgagcccccagcacgagaacggccaagtaagagggatagtctggagcgcttgcgctggtagcctt

SEQ ID NO: 17627 - DNA, 1300 bp, Oryza sativa
gagagaaaagaaagaaaaagaaaagaagagaaaagaaaaaaaaagggagaaagagaaaaaggaaaaataaatagaaaaattaggaagaaaattaggggggataatagtttagaaaatttaaaataattagaatttaagtatagaataatcatggtcctagaattgcaaaatttaattattctttgtaatttctataagaaatcaattcgcggtagtaatttagatgtaattaataactaaacaaatagatgaattcttatagattattatagattatttttgggtaatccctataagtaatcaattcacggtagaaattcggatttaattactagggattttagccatgtgttatatttaatcatttagtcatagactaaattaaatcgtataatatttctaggatttcgtccgacatttagctcgcgatagaaatttctaacctattatatggatataatgctcgggtagattaaattaaaaacttaggacaacaaaatatttatacccgcaaaatagtttaggatattaaaactcgaaattgggtttgccttagttcgcgaataatcgactttcgcattcgactttcatttgaatttatttggatttttatttgaattctaaccgaattcaaatcaatttttgcacgtaactatagcgcctgagggagttgcggatccaagcgaaggccaagacccgcaagactttgagcaaggcaagtcatcactattccttgaacatgttgatcccaattgcgaaattattttgtttacaaataaaattgcatgcaatgatgaacatcccacttgtgattatgccatgccttgattattgttaacccttaaatctttgtaaccatgtttacgtatgagtctctattcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacggaggatttgggtggtatctggaaaaggctagtaccgtccccggtcaattaaggaccaagccatgaagttaagcatgaaacgacccccgtacaaccgtacttctcgaatgggtgtagacctagcggattagatagctgagcggatgcagtatccctgcatagatggttcacccctgagtgaggcaggtgcgctacggtgggacagccattgaggtag

SEQ ID NO: 17628 - DNA, 1501 bp, Oryza sativa
gccgcttgatggtccgcaagcggcccgatgacgtccgtcagagggagggcctgtgcaacatgaagtcacaacacgatcctggcagaaaaggggtaatggagtcatcgagtacactcacgttgatcgcagcttcgcgttcagccggacccttctcgcaaagggggacggggatgttgctcgctgtcacaggagcgctgatcatcacctggccaatgcggcgtgccatggtgtccctgtccaaacctgtagatcgaggacagggactcgatcagtcaggagaaacagacacatccggaacaaattctggaatacaagaaaaataccacgaggagaaacccgggtcgcgtcctccggcccagagtagtcaaaggccaggcacgagcctggagcagttggatccgcctacctacgaagtcggcaacgacttcgtaccatgacaacccccgtactcagaggtcatcgataatgtcgatgaaagactggagggagggagtcagggcgggtttggcggtacactctggaatcttgtctggttgttcctcggggacaacaaggacaggatccgagttttctatctgaagatagaaccatctcgcccgccatttactgcgagaggaagggcactagaaggggatgtaacatgacatccggccatcccgaagtcggaatccaacgcatccagataccctgttggatttcatccagcgcaactcgtagtaaaagcggaagggatcaaggaatggctctaccccaatgtaggcctcacaaagataagagaagatactgaggaacgcgatggaattggggtttaggtgaagcaaggaaaggccatagaagttcaagacgagaagaagaaattcggagggcggaggaagaaaaacgcaagaaatgtaatcctcaacctcaaccatgcggcccaagatgggttcgggttcagtacctcctgtttccctctgcatggtcccatgaccagggagggcgccgtcgtcttgccacttctttagagacgcggtggtggaggtagacttatcgagatccatcgccgccggaggatcgccggagaacaaagcaagatgagcaaactagggtttttttttgcgggagcggagaagacgaagggcgtttgaagaccggagtgttctgtggcaaacggacttcaaaatggatccccaaaattcctttcaataagcacactaccgacggtgcgtattccaagcaaaggagagagattgccgccggaaaattctaggtccgttacgcgcaacggttttcggacttcaatttaaattcactcgtgaccgttgaacttcgtacgatgttgtcgataactatgtgtatctacggttatcacaccgagatcgactagatgagaacgacaacgattctgacatcagaagtcgcgatcggttgcatgagttcatttaagcagaagtcgggggctactgtcggggttacggataaggtataccctctatcgttggatatatattgtatactgata

SEQ ID NO: 17629 - DNA, 1501 bp, Oryza sativa
agctagatgggttatcccaattgttgtacttgtatgattcagatgaataaagaagcaacaccggcttcggccaacaggatgtagggctattacctgtcaaataaggggcccgaacctatataaaaatccatatctccatctcttttacctcaatctcgcatataccctagtaccaacgatccccatacatccaaataccctagtcgtgactatcaaacatcgacaggggtaaatcgattggccgtgatagttcaggggcaattcgtacttttctgttaacctaatggctgagaagaaagatgtatcaatcaaacggttggcataatctctacagtgggttccaactatgaagaagtttaatggtgtttgcataaaaataaaaagtaaagaaccaacacttcgtagtgaaaggtagtatgcaaaagatacttatacttgattgagatacttagataggaaggataaaaagataattttactggtcaataagtaagagtaggattgtctttgacagtagtgatagatacataggtaagggtagtattggtaattcttcagtatgggttaattcgtcctcatatccattacattatttgcgtgattttttcagatttatgtattgtgcctaaaaatatgatagattataatataagtgattgcatcagttaaaatatgactgaatcttgcttggctgggcctttgcctcactgctagttgccgccggctgccctgttagttgccaaagccctcaccgttgaacaagcacatgccagttgccatcgccagtccacgcctacttggtgtttgctatcgttggtcgtctcccgctgtcatacagataccgttcgagtctccgcacttgacacagaccgcaatggtagataagggaaacaggaattcgggagttatggtttttagccacaaacaagtaaagattttaacccacttcaacacaactatgttagaataggtgttgttagaataggtgtcgaatatactagtcctatttgattacagttggacttagagttgtaataggtgttagggggtggagttacagtcggactctgtaatccggcatctctcttaaatagagaggggcgcaccacaatataaccatggcgactacaatgtagcgtagacacacagggagacgatggcggcatggccatggactcgtagcggctagaagctatattggttggggaggagcgcgcataatcagagctccggggatgtaggcttcgactaaacctcgttaacaaatatttttgttttcctgtgtcgtcatctggcatgtcttgggtgaataatgattgaagcgatcgggaaggttagtcgtcgttccgctatatcaactaacttttataacaagtggtatcagagccaaaggtttgaaacccggaacaatttccatgggtcacatggtggagattgttgggcccgatgtgtgatggggggaaagttgggtttagtcccacatcggtaattgatgatgggg

SEQ ID NO: 17630 - DNA, 440 bp, Oryza sativa
agaagtgtatgtgagagtgcatgaagtgaggtcctttcataaggcagttatgacggttgtgagaaggggaaatgtccgaactgctccgcaaccgtcattgggagaacatctagagcgtccacgccaaaccctaggatcaaccgcgatcaggggggttcggccgaacctaggctgggccctcctggcctggccttcgttcagtggactccctagaccttcctctatccatttctcggagttttgggttgattcactgatgtttcgatgaagtacacaacccctccttgtatggatgcataattctcctcactttagtttgattttcctcccaacttcagcgtttatcatctgcatacaaatatacaccaatacttgtggaatatgagagattaagaacctatcactatgttggatgttttattatctaaactttatgcaga

SEQ ID NO: 17631 - DNA, 325 bp, Oryza sativa
aaggagtgaaaagaatggtcgaacatttaggccccatttgagcttatggctagcacgcaatcaaccacacaaaacaatagccacaagacaaatggatgatccaaagatcaaaagagagtgaattaccatgagacaagatgattcaccctcgaaggagggaatgtgcgaatctattgcaaattgtgctaggaccaaaattcattgaaaaatgagatccccatacacatagattcaagttctccacaaaagtgactagtgtccatccatgaattgaatgatcattttgtcacaaagtggtatgcaaacatattctaccaagcaaaca

SEQ ID NO: 17632 - DNA, 237 bp, Oryza sativa
catccatccaagtcgctcaatattcattaacctatagataccttggctacatgcatgcatgcgtgctagcagcttttaattcaggtgagaataattaacgtatatatctatatgatccggatatgtgcttggctgtttttttttttcaaacgtataaaatgattgcatgtcagtatatattagaagaaagcaaagtttcgattatgtaacacaaatggctagaaggctattgccgga

SEQ ID NO: 17633 - DNA, 194 bp, Oryza sativa
  unsure (1)..(194): unsure at all n locations
agggggccgtaatacttctcaatgccagtcgngtttaaagcggcttggcaatcccactcaacgcagttcgcttgtaaaggcaacaactccatccacgtcgtcgtcgtacgattctggtaaatggtggggattgtagcctcttcccgcacgccgttaattaatagtttcgcgaaagatcgatggaacgcctgcga

SEQ ID NO: 17634 - DNA, 314 bp, Oryza sativa
ccattttatgcacttacaacagtatatatatatatatatagagagagaggggtctagatcatttctaggcagaaatctataggaacatcagcgcttatcataccttcacatcctatattaattaatttgatcggaccgaaaagagagttcatatcagcttataagaaaaatcggacctaaaatcattccaccttcacaattaatttaagaaaaataaaaaaactacaatagaacctgttagagttctctgttagatcacctagatttagatctagtcgggttgtctctattgggttgatgaacgacattgtaga

SEQ ID NO: 17635 - DNA, 260 bp, Oryza sativa
gggtagtcacctgagacccgatcaatggtggtgtaccgtatatgatgaagtatccgccccccaagcccttgtcccgtcatgtaccccagcacatacgacacgtgcgcgccatgcttcgtcttcacggcgtgacatggaagcggtcctcatgggcccccccatgcatgccattgcaagaggagtagcatgctgtttcataaaatgtagacaagcagtagggtaggatggggcaggtccggtccagacaaacatttcggcga

SEQ ID NO: 17636 - DNA, 736 bp, Oryza sativa
caaggagcttaggtgagtcgacatgaatacacatactacgactacatgtattcatttcagaattcagattgcgtgtaccgatggagagtgcatttcttacatcaccacactgcatacatcatccagaggtatggagctagccagtgagatgaacaagaaacaaaaataacaggctgtgggatgcatgaacacgttctgaatttctcttcctgtcatgtcaacgggagagcaagattcagcacgcactttgttcagagactgtgtcgagttcagttcaaacgaattgatcggttagggctatgtttagttcacactgaagtatagaagtttagttgaaattagtacgatgtgatagaaaaattatgtgtgtatgaaaggtttgatgtgatggaaagttggaagtttggaaaaaaaaaaactttggaactaaacagggcctagatagctagctggaatatcgaattagtggataacatttgggaatattttggggctggcatctcgtggctatcttggttgtttaatccatggacagtagtacacactacacacagtatagttagctgcagtaagacagttttgtagtccaactgaacctagctgatgggtctagataatgtgttaatgatggtgttagatgcgtgtattgtactacttgtacatcgaagatgcgtgtattgtactacttgtacatcgtgcgtatgaaagtataattatttatgtatgtacgtataaa

SEQ ID NO: 17637 - DNA, 1501 bp, Oryza sativa
agtatgaaggtctgtagttggcttagtgaccggtctgaggggcatacaaaacgaggccttttgtcataccaccttaatctatacagactacaagaaatagagacatctttctaatactacagagatactttccgaatgcctttacaatatggtagagtcatttttaaaaattcctaataagtgccttacggtgaattgtctctacaacagaggcatttcataaaatgtctacaagagggtagacgcattttctagaggatttaaattgtaccacaaccatatcaaccaatgctactcaagatctcttgggcaaacttttttttatctttaatgcactaaccgacccaacatcatgtcattacttatatgtttgtgccttgtgttaattatatttagtcccttagtatacttatcattctaagaagtgtctctacagagtttaaaatgcttcaagaatatgcctttacatatcagacacattttaaagtgcacaaaaaatgcctatataagataaaatttaataaaatattctgaaaatgtctctaaaggtctctagagtaaaagttttctactcagtttttaaagtgcctctaaagtgtctacactataaaactcctaattttagaggcaatttgtaaaatgcctctacaaaagtgcctatacatgaggttttgttgtagtaacattagaggtctgaaagcaactccaaaacagtatacaaccggtagcggtaccgcttctaggctttccctaggtcttgcaagttcccggctaccagctattggatatgaacatatctcctgctcgatggtattatggttatgatggaaatgctaatagtaacatgtggtaattaccaagggaaaaaatactaccgaataataccaaatgttaccgggtgttctgggaacacacggtaaatcactgttccatttgattccgttaatacgtatgttaccgggagttcacgtacacccgggaacattaccgtgtgtttaggcacacacggtatggttttggccatactgtacgcaaaatcgtaaaacacccgggaaatgcgcacgataacagatgaattgaagccgccgtgtgtctgttaccgtgtactggaactcggtaacattgttaccgtgtgtttctgagacatgggagccttcccatctcaagtagtgcagtaaatgagaatctagggctaaggtgttatctatgtcaactgaccaagtcaaacctcatagataggcatccgtttggagccggttcaagtttcttgtttgattttaatttttaatgtattacggatgcccaaaattttcctactaaaattaattgtgtgttcctttggaaaaaaaaggtaggaatagtaccaatgcacaatgcaaaagtagccctctgcatcatgtgagttgtaatatacttatagctatagttgtattctactgctagtgcatgtgttaacataacaagaaatctctccctcccgtcaaaagatattagaacagaa

SEQ ID NO: 17638 - DNA, 258 bp, Oryza sativa
ggcgtttcttctgcgtttggtttccgatgtgatttcggagccggttttataacaagtggtatcagagcccaaggtttggaacccggaacaatctctatcagactagtcttttgggttatgtagacctaggacctaaagttgtggctccggttgggcttgaagccagagcagacccaatatgacctaggtggcccatagttgatgggccgagctacgcactctaacatgttcatgtctactctttcctactatttaaga

SEQ ID NO: 17639 - DNA, 300 bp, Oryza sativa
ccagtgctatagtatacttcctgtgtccctaaatatttgacgtagttgattttttagcacatgtttaactatttatcttattcaaaaacttttgtgaaatatataaaactatatgtatacataaaggtatatttaacaatgaatcggatgattagaaaagaattaataattatttaattttttttaataagacgaacggtcaaatatgttttaaaagtcaacggcgtcaaatgtttagcgacggagcgagtaagaattttggtaaaagaatcggagatcattcagttcactgatggaagc

SEQ ID NO: 17640 - DNA, 379 bp, Oryza sativa
tatccagcagatcatattattcagcgaactgctgagtaaacgaactttatcgagtagccctgtaaaaatcccgatggtttttctttttgtagaatgggtgaatagtcattttacattgtttgcagcgttgtatccatttttggttgctcggttcagacagttttctgtcttacaattctctgtagggtgaaccagtgtgagcaaccccatttttgtacatgtaaattttggcatttggctatgttttgagtatacggatgcaaccatcacatagaggttatgctgagactattcgccgttaattggtcaaagattttatgtaaaatccacttgcgtgtacgctgccttgatagcggactgatgggaacattgggaagtt

SEQ ID NO: 17641 - DNA, 960 bp, Oryza sativa
tggcgcggtgggcgaggatgaagtggtcggaggtgagggcggcgttccagtcgcgggagacggcgcggaggcggacggcggcggcgatggggaggcgcgtgaggatctcgtcgacgaggaggtggtcgggagaggtggaggtcggcggcgagcggcgtagcctcttggcgtctggaggagaagagtcgtcggacgccatgtgtgattagtttttgattaatgcatacacacgtgcaccatcatcaaccagataatgcataaagagagagagatagcgcgggattaatcgaatcggacaatgaaagcggcgaccttgtaggatttggaattgtcctcctgcagatcggccatggcgttgcggaggcggcggcggcgtgagatgcggaacgcttcggagccgacgggggccgtgcaaaagcccatgcggcccgcctctctctgcctcacgcggcccgagcacccaggggccagggcctaggaacaaatagaaggcctacggatatcagatagggttaattgcagtggtatagatctaattaacccttaattctacgttataaaggtgttgttttaaaaaatgccattactatttctgtctaattgtatccaaatacgtataaaattgaaaccatgctattgtcgtcaagttttgaatttggtttcctatggttatgattgagaacttttatagtatgacatattagtatagcatatattcacggtataaatgatctaacggtatgcatcggtttaattttccatttaaatagatcataagactattggtggtataaaatttaaaggggtaaaattgtcttactttgttattttacaggtcatttttgtcaaagaaaataaagcaatgaatcagataaaaaaatcgatacgatcatcggggttgtatgaattgttaacctagctagaaagattcagaatgtgtaagacctttcacatacatct

SEQ ID NO: 17642 - DNA, 464 bp, Oryza sativa
ggatcagctccgccatcacccactcaagtgtcgtagccgatgtttcgctgccggcactgaagatgtcctgcatatggtacatttttgcgcgtaggtgtgtgaaatgattagcacgagacaaaaaaaatccgaccaaaataatttatggtaaaactttttttatccacattatttagtggtaaaaggtcaacattgtaaaacaggtgaaataacttaaaaggaaaatgtatgaattacccgctgaactatcgtagttgaccgaattatccctctgaacccaaaaatcagacattgcttatcctaaactttcaaactggacgaattaccccgtcgatccaatccaaagtggttttgtcctacgtggcgtatgcgcggcaatccagtcagctctatatttatatagaaaaatgtgggacccacctgtcataccgcctctatctctttctctcgggcacaagggcaca

SEQ ID NO: 17643 - DNA, 808 bp, Oryza sativa
catcatttacagaaagcttaccctttgataccttaatcaaagctgccctaggctcatgtttaattttatgaccagctgagagaggaatatgaaaaaaacccagaccatcagtagcataaccacataactgagcagtaggtttaactgtagatctaaaagttgggcaacggatagcaatatgatccacactttcacaaatttcacagtaaaacttagaagaacaatcctgcatcgtatgcccctttgtaagacatctaaagcaataaggtttacctgatcctttactttctacctttgacttgcctttgtcaacatcaaccacacaagctgccatctcatgttgaaccggctcaccatgaacctaagaatccttaccacctccatataccgaagcggaaggagcaagagcaaaagcaccaaaagctcctccactaggtatagaacccccagcaggaccaccagcagtaggaccactagaaatattggagaccattgcccccgaacctctagtctgaatcccacctccatccacctttaacctatcctgttgggagtttccttttcttgaatcagcaattttcattaacgaaacagtctccgatgcaacagccgatgtagcagccaacacaccaccagttagcaaaagatcacctgccccagctgacccggcaccaggagtagcaccattcgtcgggaagccagcctgcaacccaccacctggcacaccaccggtcagcaaagcgccggactgcaaaccaccagcagccgtctgcaatctaccacccggcgcaccactagtcgacacagc

SEQ ID NO: 17644 - DNA, 230 bp, Oryza sativa
cataggtgaaagactagcactatgatgtacgtatacgtgaataaaataatttataactattatgatcgttattgcctgcacacacatttttatgatgcataactctgtcaatgtgttgaggctattggattttttaaaaataatattatttgatggaaaatggtaaacaataatttctgcctcattataatcgtgaaagtagaagccaatcgaactcgtgtcgtgatagg

SEQ ID NO: 17645 - DNA, 1501 bp, Oryza sativa
gagataagagtcatgtccgacacggacatattttgtaatctcgggtataaatagaccccaagccccatgtaatataacaacacacgttcaatacaatctttgcgcatcgccaccctttactttcattttgtttcgacgagttcttgctttcgggttgagctgcaacggtttcgatcttcaactacaagtaaaacttgttatggcggtttgcgttctcgggattagtgcttccatctttatgatactctaatcttgtttatgtaattcgtcgagttatcatatattctatataatctctaccaatattgtcatctaacctccaatcggctaacgtctgcaactagaaggtagccgatcaggttaaatactaatgttgacttagattatataggatatccaccactctatgaaacaaccagcggcttgattgtctatatattgttcttcttttcatacttatagctccatcagttgagtttgaccttataagtcgtgattagaatctcaatctctagcctgcttttggttgccgattagggtagcatcagggtttcagccaatcttacctgatttaactacttttatcctatatgcttgattgacatgttaaatctgccctttatattaagatcttattgcatttaagtatatttaggcttttgtttagtatattctacttgctttaatatcttaatatagagtagtatcggagtattagccgatacatgctagatctatctgatcagctatgctatgaacatatatagtcttgttgttaatatatatttcgatctaagtgatttatactgtctcggcatggtaactgatctatcccaatcacttgatttaagtatatatcgacataagaattatatattgttaacatctatagccgatcgaatagatttagttctttcttatttatccatgattgccgattaattcacatatgacatcgtctcaaaaataaatgatatgtcatcggcaactagccgatcggctatcgtttatggatttaaccgcggtttctttgtctttatttcttgttgattgcaggatcaaatcaactggcacactcacacacctaaaggcaagcttttgggcctgcattggagttaagcagatctcctaggcctcgtgtttttacatcaacaggctatagcgtcacaatgccgaagtgggaggagatggaggccagcttgattgagaggggtatcaaaccggccaccgctaaatggccggatcgatcgaagttctaatactatgctcacggtggaacgcttaaccccgttgatggctccctggtgttcagcgatcagatacgcgaggctgccagtcgactaacggacgcagtggaagcctcttctcagggcacgttccgacccgacagagagaaggacgagctgtcactcgccttgaagactcccgagcattcgggaagaacacgaggaaaaggcatggttccttggaagattggattcaaggaggacatccacacgta

SEQ ID NO: 17646 - DNA, 1501 bp, Oryza sativa
agatagactattgaggcaattaagatgtcaaatataaaatttcatgattgacataatctgataagatcagaccttgagattaaaaaatggtttttcttctgaaccattgcctgaaaaatatagacacatattcactagttaatagttgtgtacatgcgcagttagtcgatacaagaaaatgaacaccatatttgtcccaactcgtaaacatgaaaactacaatttttgtgcttgtatatatctagattctagacaacaagaatagcatttggttagtaacaaaaaaatattataattattgtgatactaatctatattcacagacagccgttacccgatatgagattaggaatttactaaaatatatttcccaaactgctaataattcaatcttaaggccctctaaatgtatgtggtaagtctaaggaaattatacattcataatgaaagaatcttactttcgtcaattgcaagtgtaagtgtaggtacaatcattccactatatgagtcacctccaatatagagtggattcagtgagaaccggggatggtcatgaagccactgtataaagcaacacttttagcacgcatccacggaatatctgttatacatgtaggggcaatgtagatcaatgggttatggtctcataacactatgtttttattatcgtggcaccatatttcaaatggaaactaatcctcatcacagtattgtttttcataattacattgtgcatgcaatcaatacatttttgaaacgtcttcattgttcaatgatcatagtgttagttttattaatgaccaattgaaaagtaaaggcagtgcatgcatttatttaactggataggagtaagaatggtaataatgaaaaaagagtgaaaaaaaatcttaagaatataatatcatttaattaacatgagagaagtaaaaaaggtaataatgtgataattcatacggccccttaagaagcccgcatgtgataatacgaccattatatccccaaacaagcttaagctgcaaccatttgaacttgaagtttctctctccaaaacaaagcaacaaatagggggaagtttccaacttgaaatctttgcttcaaattggtatagtaggttacatacttgcttacctccttcaattgcagccattttttaaaaaaattcattggtgaaatgcagcgaattttgcagttaataagggtacttttatgagcatttttttttgcaaattttagctacaataaagaatttttaggtgagcaaattgttattgtaagcacaggttcatagtgattcaatgtagtgttgcataattttgtggacatacatgaattttcatgttttgtggggaacaccttcaccctaattttattcgtactgccatgttttatagattgatttaggcctggatgtaagacatgcgacaacctcatctggcatttatgaagaaagcatataactttgttcaccatgctaaggcacatgctttaaggaaaaatagga

SEQ ID NO: 17647 - DNA, 795 bp, Oryza sativa
gatgaagttgcaaagcttgttcgcacctctgatttgtatgtaatccccaagataaattgatagctattgtggcatgacctcccctcttccctgaggaaattttgacgcgtgctcgggctgccggtgggggacgccgacagaggctaaagattgtgactttagtcccggttggtagcaccaaccgggactaaagatcccggtgatctttagccccggttagtgctaccaaccgggactaaagtcacacccctatacatatgtcttcttcctcctccagctgcccgagcaagcttcaaaatttcttcaaaaaagaggggaggtcatgccaaaatttctattgaatttattttggtgattacatacaaatcagaggtgcctaaaaggtttgcaacttcatcctccaatgtttttttttgtcatactacatttgcacctatgttttgcacacttttttttctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggttttttttaactcatgtaga

SEQ ID NO: 17648 - DNA, 1501 bp, Oryza sativa
ccacccccggcaaaaaaaacaatttcgagattgctaacctgtgaacaacaaaccctatacaagctatacattcacaactttaacactgaaaaatctgaagctgttttggcgtatgtcatggcagcgtccggtgagccgccgctgctgctggcgtcgtccgtgcactgcgcgatgagggaggcgatcagggcggcgcggagagagttcgccgctgtcggcggcggcaccggcggctcagatcaggtgacgtcgttccagatggacgtgccggcgacgatgccggccgtcaaggagctctgcggcctcgacgtcgtggagaggtatctcgagagcttttctgcaaccaccgcctagtgctgggagaaagccgaaatggcttcgcatcttggctggaagaaaattatgcaggacctcagtccttcgcccacccagaaagacttctcatcttgagtgacacgtgtccgcacgaatcttgatgtagtcatcttctacctgagctcaagtcaagtgcagagtgccaaactttccctttctctctcctctccactctccacctcccttcctcctcctcggccagggagggaaggttccacttgctagaggcggcgagctcgccaaactttttcatcgtggcgttgtctctcctctccactccactctcatctcaccacctccttcctctctttcttcctagccaatttttggccggatgaacagcaacagcggcgagttcgtccaatcgatggtcacagactagcaaccttaccagcctcccaagctaagagcacaagtactgggtgccgagttgccgactagacatgctacattgctgctcttgcatcatgttgcatcccgtgccggagattgggcctctggctgtgcagaaaggagccaggggaggtagggactgggaagtggaaagggagaggagagagggattggggaatttttcggcactttggtctgaggtagaagatgactgttctctgctctaagattcgtgcgaacaagtgtcactcaagatgagaagtctttccaaatgggcgaaggacccaggtcctgtataaacaccaacaataatggggctgctgacttgtatgttgatgagttttttttttatgtatgttgattactggaaatgatgtttaactatttattttattttaaaatatcatgcagttatatttattttgctgtaacttatatttttatatctttactaaatttttaataaaatgtatggtcaaatgttatatcaaaagttaaggcgttagatattttaagttgaagagagtatgtttagaagagaaaaggtttttacttttgcaaggtaaacctgtatatgtatggagatgagcaattctacagttcttaaggaagtaccatgagatactaaaaatttaatgtaaaatttggtacctcatggtaccttatagtatctaggtaccaagaggtaccaaatttataatagaaaaaatggtatctcatggtacctcctcaa

SEQ ID NO: 17649 - DNA, 1501 bp, Oryza sativa
ttcacctgtgggagccaccatcgtcgcagccggcaaagctgcctataggagctgccaccgtcgaggaggaggattccatgatgccgtagcggcggagaggggttacgttggtggtggtggagagagagagaggagatggagggggtgggagagaggagagagggcaatgaagataaggatgagtggagagagaatataaacgttgcacacgtgggacgagggagatgctcgagctcagaggtttatttcttccaccccgcttagctcagctctatcttctcgacatgtgtcggtttaataaaaaccggcaccatgtaggtgctggtcaaattgagaaaacatgcaccagaaatatatgtgctactatttttttaataaattgacacttataaagtgttatatatgtggttttttaatttcggagtctctaaagggttaggaggatggggaaaagctcatttgtgccggttttagattaatcaacacctataggtgttctctattacgttttctatagtagtgttaatatgtctttaataaatatgtaaaacaatcgtcttttgatgtagtagtgttaatatgtatttaataaatatgtaaagcaaccgtctttgcaggacgaagagaaaataaatagggcatataaacagcgaagacagaccaaggcaaaagaaagtggggcctatccagccgcctatacctacctttaagagagaggaacgggttgaggaagaaacatatgataacattgaagtcactactaattacttatatatacaaaaatatatagaataaatacagctagcacttgatttatatatttttttttaaaaaaaggagaatcacttgatatacagcgtatgaaacctgtctcgctgcacagttgtacactctcctggagaatgcatgcagcagcaagatagctagggtcgctttccctatcttcagagatggatttttggacatcctctttgtttattagtacccgtctgaaaaaaaaaaaatccaatcctacgtactaacctagaaatatttgtgtgtccagatttattgctaagattaaattttttttacagagtagtacgtcccacctaaataatcaacaaaatattattttaaaaaattaagaaaaatagattaatataaaaatatcacatcacgaatataaaaatttaaattcgacataaaaacaacgaatgtaaatgtgaattgagattttagtttaatttattctttttgctatggtttataggagttgtatttgcccctgcatgtttgtaaagtaatcactactggtgaaacccttatctctccctttatatatttatcttatattagtctatcttatctttttataaattttctaataactattaatgtgatatggaagaaattaatggtgtccaaaaatgcatctctgaagataggggatacagctaggacaggtgtacactctcctggagaaagcaagcagaaagggtcgatcgctttcacaccacgc

SEQ ID NO: 17650 - DNA, 1501 bp, Oryza sativa
gtttaatgcaggcttcaaggaaaggctgttgtttttgcaattgattttagttgaactcttttctaaaaacaactaagtgagtgcttctcaaacgacacggatgagacagtacgtctcgtccggtcggagtatgtgcaatgtatcagtctttaaaatttaaaacaaggttggcacccggtcaacagcttttcaaacggccacccgggcctacaactttcaaacggccacccgggcctagctgatcccatcagctgcagatttttcaaacattgaacccctttccacaacagcaatttcacaagcagtagtcaaacaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgatacaggtttaccatatgccgacaagaggggtcccagaccaggttaggtcccagaccatactgtgccaggaagcccaggggtcctccccgacaccaccccggcgaatccacatgtctctcgacatcaaggctcccctgataagctagttactcagccaggggtgtcccattccacccatgtggtcgtacttgtcttatgtttggatgaaattccaaggaatcggtccttaagtgcgagagcgggaaaaaccgtacacccggtacgttccccggtccgcggttttggaaattcatttagttcgcaagcgccgactcaggtgtcgggttttccaagtcttttgtaaaactccagttttacccaagttgttactcagattttaagtttgaaggtgaccgtcgatactcgcacagagtgcacgaatatcgaggcgcaactggatggttacaaggggacatggtatagcaattaacaatggaaggatcaaatgcaacaagttaggtaggtccgccaatctgccttgcagacgggacaacagattaagtgcgatcctatcaatgcataatattttgcaagcaacataattaaatttcaaatataggctcaagatgttcaaaggtggcttgccttgctcgagatctagagcttgatcctcgaaatcctcgcactgcgggtcttcgggctctgaaactacacgcgaaacggggcaactcaacaaacggcgaaaataaagccctattaatgacctctaagcgtgccattagatagatctcgagatttgaggaattttggaagttgaacggagtcaaacggatttatggttgggaagatattgaatttctaagattattggatttttggtctaaaggaaaaggatttaattaaatcctttttggaaaagaaaagaaaagaaaagaaaagaaaagagggatggaaattagacttttcctcgggcggctagggcgcggcccgagagagatggggcggtccggccgagctaaa

SEQ ID NO: 17651 - DNA, 1126 bp, Oryza sativa
aggtatcaacacatatacatgcatacatacatattgcgaggagtaatttttcagttgctgccaaaaagttctctctatttaactaaaaaaatatttgagcgtgttatttattttagatcgcaattaaaaaaactccctcatgctaaaatataacaaacttttggatttcaaattttgttccaaatatagctaaaaactaacatgttcactccagagactaggaattattataccacattaatcaaaaaaagaagaaaaaaaacaccattagtagcactcttcccgattttaatttatctacatcaaacataaaaattgaagatgttcccgtcgatattttggtacgtcatccgtatttgagtcagttttcaagttcgtttgcttttagaaatacataaggaatgatataagaaatctttttaaaaaactcgcacgttaacttacgagaagaatcagactcctaatttcttcagaactcttgccaagtcataagaaagcaacgtacaagatatgaccatcaccccaataaaagtttcaaactagatatcaaaactatcaaattgtataacgctgttgtcttttcccacaacgtttgaccattcatcttattcaaaaaaataatataaatatgtaaaagtatatgttaagattatattttatttgatgatataagaagtcataacaaaataaataatatttatacaaattttttaataagatgaatggtcaaatgttgtgaaaaagtcaatggcatcatatttgaaatggaggatgtactttttagaaaacaatttaacaataatatgattaaaatagcattcactcgtcgcaacgtacgggtatttttttctagtcaaaagtaatatctatcataagatatacccaaatatgaataagtatataggtaaagaatgacactaaaggatttgtagtccaatccgaagacgcgataaccttacttttttttacacgatatgataaccttacttgaccgtatccaaatgaggtcagaagctagggaggaccagaggagagaaagtaatcgagccataagtaggggtgaaaacgggtcaggttcggtcagatctcacccttcccatatcctaacccacattttataatcaga

SEQ ID NO: 17652 - DNA, 1501 bp, Oryza sativa
tgtttatggccattgctagctcgttttgtttggaatgtggtgaaatgtgcctttattaatctgaaagcaatttacagtgtttgaccatttgtttgggggcttggggagatttgataaagagacaaaggatggtgatggtgggaattgtgactgtcatctgggctatttggaaggccagaaataaagcctgttttcagaatgagttgccaaaatatccagctgaagtgatacattttgtttgttctttgcttatgtcttgggggtgtgttgcagaagtcggaagaaatacaaagaagaactctgttgggaacgcaactgctgaaacgggtggtcggtgaagtatacaactcgaagtatggacagcgacatgataggagcgggctggaggactgactgatggggttgaagctgacaaatgaagttcaagaggatcgaaaatgtgagaaaacgtggagaaaaggttcatgctgaagttcttttgagactcctgggagctgggaccatgtgttgagtcccctgagtaatgttgatcgatagtttgtagtggtagttgctgcagggggaggcttggagctgaccaagtgggttggcgctagatctcatctcacccttccctgctgtgttggcgttgttttctttctctgttgaacctgtagtgctaaacctgacgtttctcatcatggaaatgagagagggctttggcctatctttgattttttttaaaaaaaagaaaatataagaaatgcttttgacaagcgcccaattccaaaaaatgacatcgacaagtgcgagttctataaaatatcatcatacaagtgattttatcctagaaatgccattgctgttacggttccgtctatcccgcgctgttaaatacactgttcatcctatagcacttaacagagggttgctaatagaaccctaacggtgatggtatttttgggacaaagttgcttgtacgatgacatttcatagaactcacattattgggacaaagttgcttgtacgatgacattttatggaactcacacttaacaatgacatatcttggaactcacattccgactgcggccgaggcaagaggagcaagaagggaaaaatatagagggaggaggtgggggagacggggaccatgagctgctcctcaggtaaagggtgtggaggcgcgcgttcccctcgtgggggtcgcgcctccctccatgggcatgccttgcggacgggcgacggacggcgtgagccaggggcacacccagggacacccaggcaattttacccctctaaattttataatacaaacctaaaatctatttaaatgggaaaccaaatcgattcataccgttggatcatttatactagcagtatatgctatcattatatcgtaccataaaaattcttaatcataaccacacacaactaatttaaaaacttgatggaaatgtcatggttccaactttatacgtattcggatgacataaatacaaatagacaaaaataggaatgg

SEQ ID NO: 17653 - DNA, 745 bp, Oryza sativa
ttcttctctcttcgtcttcgtcggtcagttatcttttccccactccgccgccgccgccgccgccggtcgatcggtcggcggcgatggtcgagctcgatgcctcctgctgatggtgccaaagagcccccactccatcgtattaggactaggagagccagccgatttgatatttgggagcaggcagaggcaggcatttcttcaaccaggaatggatccctagcggcttagcaatttgcctgcagtgagttggagggagttcaagctggttgtgtgagtgtgaagcttctcttttcttttgcggagtagcaagcaacggcgggagttggagggagatctcccgtcgcggtcccatgtacgttacgtgtatggatcattgattcttatatgaaggaagctgcgccaacttgacctgaacctgaatctggagaagaacaggaaatgtgaatctcaagctggagaagaaaggcaaaaaaataaatgtaagtctttttgttctttcttttcttctttgggagatgcatacttcttgttttctgggaaacaggcatccgacttgaaatccacaaagggttttctttctttcttttaacaattcgctgaagtgtagagttccccacctgtatatgtattcatatcatcgcaacgagttcagggtagtacagggagttttacagttcagttagattgttgagggggaagaaaacatatttttacaaactgaaatcaccattctgtcctttctagg

SEQ ID NO: 17654 - DNA, 1172 bp, Oryza sativa
aattagtgtctcaattaaatcagtcgatatggtgaaatttgaattatattcaaataaaacagaaaatttcactatcataccgggcatagcaaaattttgtaattctcaccacatgatcatcatgaccttgccaaggcatcaaacacacatcctatttggagagcttaagattttgggaagtagttggttggtagtccaaattgttgttagatttgtgggctttgcatagacacgttgagggtataaaatagtagaggtgttgaggcctctagatatcaatttcttagagagttgaggtgagagaaaagttagggctttgaatatagtcgagatttttgtgaggggtgctattgatgcactttgtaaacactagttgatgcaataaagttgacatatttaaatctacatcttcgagttttcatctaccggtgttttctaggtcccgacagtcacaccgatagcaaggcggcggtctaaccacatgtggtgcagtggtctgactggctaggcaagggcggtctgaccagcggcaggagggaggttgttggtattttttaacgacattactagaaatataatttccagcaatggcgcataaatacttctggtatattatggttacagagttcatccgcaagcgcacggatataccattgtagtatttcacccgtgagtattccaagggtatcgtatttattttatcccgtgggaagatcatgtaaagagaacattgactaataatttatatattacttgtgataatcatattctaagcaggggttaagataatccaagggtagagtgatacacaagcattaactactcattctcataatatatcatctaagctaagtggaaagaaaagagaaagagaatctattcctatacttctaatatacatagtatacatacattctagttaactgatatactagctaataccctctatccgatgccctcctgctacttcgagaagccacccctgaccgccgagttccttacgacagcccgtcatgaccatacaaccggggctaagtacggaagaataccctccccagggaattaacttaggattatataccggcgcggaggaatacccgtattgagctgtcaccatcagcggcccacctctcatctgcaatatataaccccaaataatgatatcctgtaat

SEQ ID NO: 17655 - DNA, 1501 bp, Oryza sativa
taatatccctacagctcaagcagttagtttccatcgttcacagtcacactaatcagaaccggggattcatcgtacgatcggcagcacagcagcgctgcgtgtccacctcccacaccgaggaagagctcttcgccggcttgttctccccgccgctgccttcctgtctggccacacagtttctggtggcggcgaggcagctagagggggaggaaggtggcagtgcgggcagctagggtttttcccccgagctgcccacgtgagagcgatgcgagggcacctctctacttagatatgcgtttcaccaagtttatgttattacagtacaataaatcttactccctccatctacttttgataggcacatttccaaatctggaaattttacttttgatagacatatttcaatccaaccacttatcctcttaatgattttcttggatttaatgcgtgactctccattcttccacacaaaattggctatatgggcatcggaaaatgtaaatattaatgaatctcttgtttacgaggaataactagtattccctctgtcgacgggtgatatccgtagaccggatatagagggtattggggtacgttggtacaaggatctacatagtatgacatcgaacaatcaaaagacaagaattatactggttcaggccccttggtaggtaatagccctaatccagttgatatgggattatatggtggaaaacacagattacaaagggaacgatggaacttatcggatccgacgagatcgtagtcgagtggattcgactagctctcgatgacttggctcctcgcagacttcggcttcgtaggctgtgtgggttgtgttggctctgagattcgatgatctatgccctccccggggggtcccttttatatcacagatttggaggtctccagtaggactcggagatatcatacccaatacgatacgtcgacgacccagttctgtccaagaaggactcttcccatctgtagatttcgtgaaaggtttccttaggttatgtaggaaatatccgcgtgcgcgtgggtatgccatgtcgatatgtaacgtatatcgaagggtagagggtatgcctgacccgtaaccctgacagtagcccccgacttctgcttaaaatgaactcgtgcaaccatttacgacttcgggtgtcgagaacgttgtcattcctggtgcgaggaccgcggagatagaacgtagtcgagcatgccgtttgaagcccaacggtcacgagtgaattttgaactgaagtccagaaaactgccgcgcgtaacgggcccagagatttccggcggagatctctctctgttccttggaattcgcaccgtcggtagtgcgcttatttaaaggaattttgggagcccattttgaagtctgccaaccttgttgaacacacaccgcctgccagcgctccttgccttctccgccaccgcaagaaaacctagttcgccaactcaggctcgttttccggcgatcttggaacagcaa

SEQ ID NO: 17656 - DNA, 264 bp, Oryza sativa
ttaatctctatgtaatatttgtaatatttgatctaacagaaactactgtcttaagatagaaggatctcaatcagaagtagagtatcatatcatatggcctccctccccaactcaaccccaccaccggcaggcggcagccctctcgactccacattgactgacaacacgcagttgagttatctacccgcgtcgcgtgcaaaaaaatccagcgcaccaccgcccattctcatggggggacccaccaccccgactgcccccaccagt

SEQ ID NO: 17657 - DNA, 1501 bp, Oryza sativa
agagatgtcgccacctgatggtccgcgagcggcccgatgatgttagtcaaaggaagggcctacgcttaatcacgtcataaggtgatttcgaaaggagaatactggatgcttatcaaatacacttacgttgatggcttcatcgcgttccgccgcccccttttcacaaaggggcacggggatgtcgctagccgtagtcggaccgctgatcatcacttgatcgacgcgccgctctacagcttcgctgctcagacctgttaaacaggaaccaacttttgataagtcaagaggaacacgagtacaagtacgccaagatgaatacgagaaagataccccgaggagaaacccgggtcacgtcatccggcccgaaatagttataggctggatgggcccgagcctggagcggctggatccgcctaccgacgaagtctgcagcgacttcatatcccgacaagccccgttctcggagatcatcgatgatgtcgataaacgactgaagagagggggtcaaagggggcttggcggtccaggccggaatcttgtccggttgatcctcgggaacaacgaagacagggttcgagtccttgatctcaagatagaaccacctgttctgccacttactgcgggaagaaggacactggaaggggatataacgcgacttcatgccatcacgaagtcggaacctgacgcaaccagacaccctattggattccatccaacgtagttcatagtagaaacggaagagatcgagaaaaggctccaccccaatgtaggcctcacagagatgaacaaagatactaagaaaggcgatggaattatgattcaaatggagaagagaaagaccatagaaattcaacaccaggagaagaaactcgaaaggtggaggaagaaaaccgcagagaacgtaatcttcgatcgcaacaatccgacccaagaggggctgaggatcagtacctcctacttctctctccatgtctccatggccgggaagggcgccgtcctcctgaaggttcttcaatgtcgcgccggtggaagacgacttgccgagacccattgctgttccaagatcgccggaaaacgagcctgagttggcgaactaggttttcttgcggtggcggagaaggcaaggagcgctggcaggcggtgtgtgttcaacaaggttggcagacttcaaaatgggctcccaaaattcctttaaataagcgcactaccgacggtgcgaattccaaggaacagagagagatctccgccggaaatctctgggcccgttacgcgcggcagttttctggacttcagttcaaaattcactcgtgaccgttgggcttcaaacggcatgctcgactacgttctatctccgcggtcctcgcaccaggaatgacaacgttctcgacacccgaagtcgtaaatggttgcacgagttcattttaagcagaagtcgggggctactgtcagggttacgggtcaggcataccctctacccttcgatatacgttacatatcgaca

SEQ ID NO: 17658 - DNA, 183 bp, Oryza sativa
ttttgtatttccgttattcttggcttcttcttcttcctcctcctcctcctctcatttcttgatttcttgggctccttttctttcttggcatcttcttcccggttcttgatttctacttccagttcttgatttcttggcatctcctcttctttcagggatcgcccgtctcggacaggtggttca

SEQ ID NO: 17659 - DNA, 172 bp, Oryza sativa
tgaaacagagctactcaaaagtacaggcaaatcaaacgaatcaaagcatacgccatactcgctcgccgacattagcacgtactactcatagtaagcttacggcaacaacacgcagcacagtgggaaggtaaaactcaaatgaaaaatggtgtgcttacagaggtctcttcca

SEQ ID NO: 17660 - DNA, 1501 bp, Oryza sativa
aatgattcacctgagttctgtgtcaacgcatgtaggtcgtcttcgatcgcgtggcgcttgtacgttccttggaaattggcgacgaattgtctgcccacgaagagattgagtagggaggaagatgcatcagccatgaacgtgcagaacccttcaacgcggttggtaaatagttcactagcgcgttgtcgtctgctccggcagcatagagtactgtggagtagacttgaaggaattcttctgggtcggtgctcccatcatacttttcaattgctctgggtcggaatctctcaggccatcggacatcacgtagggaacgaccgaaagccctacacccagcgttgggggcggtgggttatcggcggtcgtgtgtccttcgtggatgtctgtctgacaatgaggaggacgcagatgatgatgatgacgatgggtcgcttggttccggcgtacgattacgaggatgacggcctggatctcgggaatcctgtcattgtctctcgctattctctcggcaccaatctccattatcgtcgtcgtttcggcggcggccatgaccagtattgtctggcccccgtcgttcacgatcgttgcgattgtggtggtcgtcgtgatcccggtcctcgtttgagtggtctcctcgatttccgttatcatggcgccgtgaagagacatgacgccgagagctatttacattgtctcgtgtgcgtcgtgcttctcggcggccgttgatttgatctcggagatcaccagcgccgcgaggtggaggagtggctcgttgaggtgattccctccattccggatcttcaccattggcgtcgccagttggcggctgatcttgatgcgttgcggtagcggcttcttcaaacgcgttgctgaggttggtcaccgattcccgtagtcgttctgtccaacgctcgaggtcatcgttcagaacgggatcgtaaggagtttccctcagtatagcttgaacggccctgatgtgttgggttggagtagtcgattgattcgccacttctgcgttggcttgcgctgacgtgccaacgtcatcgatagccaatacctcccgcggcacgctcgttgtcgatgacccatagtcttcgagaagatgtaagaccgatggttcgtgatgatcgatatcgattaccccaatgaatcgatctaaggctggagtcgctccttgttccttgccgttatccctgacggagacgtatgacttaggagacggagctttcatggcgccgaggaagactttgcagctcgagaggtcatgattctttgtcttgtgaataggacaatagacatcccgagttggagaagtacgctgaattccacgttctttgcaggcgcgaatttcaacacggacgttgagttcccaacaatcttgcagggtgtgtttcttggttttgtggataggacaccaagaccttgtggcttcggaagtcatctttgccggctcgtggttcatgtcggaaggacaaggtttggccgtatcagaatccttccc

SEQ ID NO: 17661 - DNA, 195 bp, Oryza sativa
tgaggggacgtccccttgagagtcaatatactttcccctacttgtagagttgaagtagtgatccacctaccccatattgcatatttctcagtagagatttgctccggtccaacaaaaagtaccttgaggtaccggtacctcacggtaccaaatcatttctaatcattgaatataacaatatccatcctacctagc

SEQ ID NO: 17662 - DNA, 227 bp, Oryza sativa
gagggccgcgggagaggggaagatgggccgagagaaattcggcccatcgaccccgggggaggcaaaatagacttttgcggaggaatttgatttggaaagatttggattcggatttgaacttgacgatagatcggggattgagatcttgagatggcacggaccctagacgacaagcgaagaaacaaatttcgcaattagggtttttaagagataatttttccgctagg

SEQ ID NO: 17663 - DNA, 1501 bp, Oryza sativa
tttaatgtaggcttcaaggaaaggctgttgtttttacaattgattttatttgaacacctttctgaaaacaactaagtgagtgcttctcaaacgacacggttgagacagtgcgtctcgtccggtcggagtttgtgcaatgtatcagtctttagaattgatcaagattggcacccggccaacaactttcaaacggccacccgggccaacaactttcaaacggccacccgggcctagctgatcccgtcagctgctgatttttcaaacatcgaacccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgacttatgtttggatgaaattccaaggaatcggtccttaagtgcgagagcggggaaaccgtacacccggtacgttccccggtccgcggttttggaaattcatttagttcgcaagcaccgacccaggtgtcgggttttccaagtcttttgtaaaacccaagttttacccaagttgtttttcagattttaagtttgaaggcgtccgtcgatactcgcacagggtgcacgaatatcgagacgcatctggatggttacaaggggacatgatataacaattaacaaagggaggatcaatgcaacaaattaggtaggtccaccaaactgccttgcagacgggacaacagattaagtgcgatcctatcagtgcataatatttttcaagcaacataattaaatttcaaatataggctcaagatgttcaaaggtggcttgccttgctcgagatctggagcttgatcctcgaaatcctcgcacaacgggtcttcgggctccggaactacacgcgaaacgggacaactcaacaaacggcgaaaaaaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttggaaaagaaaagaaaagaaaagaaaagagggagggaaaatagacttttctcgggcggctagggcgcggcccaagagaattggggcggtctggccgagctaaa

SEQ ID NO: 17664 - DNA, 865 bp, Oryza sativa
atatatatatatatatatatatatatatatatatatatatatatatatatatatatatgttacttcgcatttatcctaatacatctttctgtatcttgcagaaaagacgtgttgtcagagtcgtccgtcaaacctgagtggaagagctagccctagaaggaattggagcaggcaagtgacgtaataatataaatgatcgttatatttgtaatgcaattaattaagattattagacctgtaattagacttatcatataagattgtgtagtgttctaatgttatttgagttttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttaagttttaatataatattactttatttgtaattagacttagtatgtaattattgactacggaattggtgcgacaagtagcaattgactattgtagtcttaattagacttagcatatacgcacgaaacacttagcatacacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 17665 - DNA, 1501 bp, Oryza sativa
gacttgatgcctcgggagagtatttgcggtgatggaccaggagtcggcttggggataagacgacgtccatggtggtcagagatcatgcgggatacttaggctagagttgatgtacgtggttggtgaagattccatatggcatacgatggaggtattgtgtgcgtatgggatgcggagtcgaatttgcaaggagtctaaatttggtacgattggttatgtaaagtttgtttttttgtactaaagggtttcctaaggtgtttaggacttctagtatgagtttggttcgtggctttaggctgactacctcggatataaatagagagggagcgtgaggcttcccggtatcgcttttgagagcaattgagtagagttttgagttagggttttgagtttagtcgaaatttttgtaaggagtgctgttggtgcactttgtaaacacagagaaaatcaataaagtcgtcatccactttaagagttcttcgatttatgtttcatcgggtttcggcggtctaactggcgatataccggtggtggcgaggcggtcagaccggtggccgcgacagcgagcggcagctgatctcggcggttagaccggagatctaatctcggtcagaccgatggcaaccaggtggtcagaccggcaggacaactgcgatccgtcgatttcgagggtaacttttatttccgctaaaagttttcggtttttgggtataccaaccattcaccccctctggttggcttagttattgtgattcgatcctacatttccgtcacataaaaaaattttctacacacataattccatcacatcgtttcaattttaatgaaacttttaattttgacgtgaactaaacacacccttacacaaggaaggggatgagtgtcaagcgaaaagtaacaaaaataaacggtcaagtgctcaggacgaaggggtgcataatagtgaaattggaagattaaacaacgattggttgtctcatgtctagcctagatctgtacttatgaattttatggctatttatgggttggtgagcgatgcctaacctcggttcatattatttgcccctttgaatttttttctaatgtttgattttttcttattaacaaaaaaattgaattattatttattttgtctataacttgttttattatcaaatatactttaagtataacttatcctcttttacatttacactaactttttaaataaaacgaatgataaaacaagaaaaaaatcaaaacgacaagtaacatggaacggagatagtaactcaaatactctaaaacgaaaagacacagaaatgtgcagattggccgggtctcttgcgtttgcatgcaactacctctactcacctggacaaagcctctccactcactgagagttgtgatcagatcactcatcattaagctgtaaaacccacgatctgaatatttctgatcagttcatcagtactgtcattaccagccatggccaccgtgataatctcctacctgctcgtgc

SEQ ID NO: 17666 - DNA, 1501 bp, Oryza sativa
acgattacatactcaagacatatagtacttccagtaaagagagtaacgctcttgactttataccctcttcatttcaaatttcaaaatatatatgccaccattgacttttccgcataatgttttacttcctccgttttatattataagactttctagtattgtccacattcatatatatgttaatgaatctagacatacatacatgtttatattcattaacatctatataaatgtggacaatactagaaattcttataatatgaaagtcttataatattaaaaaaattatacgaatatcatttattttattgtgacttgtttatcatcaaataaaatataatcctaactcatacttttacgtatttatactaaatttttgaataaggcgaatgattaaatgttgtgcaaaaagtgtacgttgtgcgaaaattctatggcgaaaagcagagaaaattgttcattgcttctcctccaggaattcggtgaagtcagtgatgaatgtacttggattttccacacagttaacagacttggtaattttgccccatatttcgcatacaatactcttttaacattttttctaacttaatccattttcttttcttctcctatttttccatcaactgatgtcatcattttaccactagctctgctttttctccgcattaatcttctcctcacgcttagtcaccatttctatactcctttaaaacaaacaatgtattataattgtaaattttacaaattagtcctcacctgttcttgttgtgaatttagcagattagtcccatgaacttcttcatattaaagataattaaatcaaaatggatagccacatacaagcggatattccctatacagtaaaaaagacaggttacaacatcgcatggggaaacatattttatttatatgatattataatacgttttcttttacccataataaagcaaatgcattcacctagtactcataaaaccgttattcaaaattaccaaacccattaattaacatcttcagtcaaaattgccaacgctacaatatataggctgtgtttagttccacactaaaattggaagttttgactaaaattgaaagtttgtgtaaaaaagttgaaagtttgtgtgtgtaggaaagtttttgatgtgatggaaaagttgaaagtttgaagaaaaagttgaaaactaaacaaggccatacttcatcaataggaaaaacaaaaacttatctcttattattgatacatacaaccaatttccccctttttttgagggttcaaaggaaaattcacataggaccatatcctgcagtccctgttgatccatcctgccaccgatcttgtctcttctccggccgccgggccgccctccgctttggaccttccggccaccggcctccgtcccgtgacctcctcctcatcctcatcctcctcgtggaaaccaccacccccatcttctgatgcttcctcctagtttctaacgcatcgatcacttccgacacgaca

SEQ ID NO: 17667 - DNA, 551 bp, Oryza sativa
atagtgtcttttcctatttaatccccatgttagcctatttcttgtgtaaatttgattctataaatcctaaattttgcataaatgaagtttactcaatatttgtgttattccaaccaatggatccaccctagattaatattacccatattttatttatataatttatttgaatttttaattaggctaatttttattcagtcgcactagaattcaattgttattaatatggttgcgataatattttatttatttccaacctcaccaaatctttattttaaattatattttaatcatttattttaccaatttaattttagggtttattcctaattaattattccttattcgcgattgatgaactccaaaatcaaaatccaataaaatcatcgaacaaaatcggcatgatgcaatttattcaaaaagtttttgcaggcccatatttttggagttttgattttttttggtcaaatttgcagggtgttacagctccgcagctcgtggtcacgcgtcacggcttggcccaacagagcgcccgcgtcacatgttgtctc

SEQ ID NO: 17668 - DNA, 351 bp, Oryza sativa
caaaaggaagtggaagggtaatgttaagtgttgtttttgtgatactaacgaatcaattcaacaccttttctttgattgtattttggcaagattcatgtggaatgcagtctatatatcttttggaattcacccgcctaggaatgttgctagtatgttcggcaattggctaaagggggttcaacccaagctaagagctcaaatcgttgtggggatttcagctttgtgttgggcggtttggttatgccggaatgatgtagtctttaatggctccaatactaattttctgttgcaggtgattttcagggggactttttaggcaagacaatggtctttgctacttaaggaggaaga

SEQ ID NO: 17669 - DNA, 1501 bp, Oryza sativa
gttgatttcggggggagggggagcggatcgccgcatggatagtggggacggaggagttggcggcagcgagtggcggggtaggagcggattttacggcggcggggaaggagaggagattgcggcgccggtggaaacagcgaaagaggaattggggatcgatctggccggaactcgcgcgaaggaactgaggagcgccgattttttttatcctgtggaccccacctttactaccctctcgccgagataagcattgtggatagtgtcttctcctattaccgcctgtgactgggtcccacactaatactcatcttgataatatacattggtgttgcccttagggaaaagtgatagatgaacaatagttggatatcgatgtaaggagctgtcatagcctcaagctctcaagtgctgagtcgaacaacattagaaaaaagtttcattccactgagtgtggcaatatagcagcataactagcaacacactgatgctgtcattttaatattctgtttccctgttatacattgcctgcagagatatggcattttgcggcatgacagcatgagtagtttgattgttcaatcaatattgcaataattttgtagttggaatttgtttggatgatcgtgttcatgattaatgtttggttatctggttagctgttaggcttttaagtttcatctggcgttcgagtccaacagctaaacctgctgatattgccccaagtctatattaacgaataattaattattctatagctttgcgtgctcatgttttactgctgcaatgggaactttggatagttcataattatcagaggattttatcgactgcattggtgttctattagttattcagagtaaaaactaattatcttttacaccagcaagcactatatagagagattatttaccatgttgaaccttatgaaggtggtaaaatgtaggcctgaacagcagtacacttgaaattttagagctaaacaggaaagtacactcgaaatgccgtaggaaactgtcgacataataaacagatacgcccatcctcgatggttacgcgcgacatcctcgcctccttcatacccacgcagagctgcgcctggaagacaggcgaccgcatcgcgagcacgatcttatgcgccgcaaagctcccccttccaacaatgaaggtaacatatgctccctgctttgtctccagcagcttgccaacttgccaagatgctccgcgatgtctgacggcggcacttgaatgatctcagaggtccccttggtttcgctcagccgcgattctttgatgaccttcaccgtgctttcaaccgtgatggtatcatccttgatgtaacccggacaatgaaagatccaccgaatctggcaagatgagtactgcaaaccggctgataccttcatggctgaacaccggctgataccttcatggctgaacactcacggtgtccggcgccggccggaatcctggttcagcttcagcaatctcagttcataggatg

SEQ ID NO: 17670 - DNA, 1497 bp, Oryza sativa
ttttttaataagacgaacggtcaaacatgtgataaaaagtcaacggtgtcaaatatttcgaaacggagggagtaatatgctagtttcgtcgccgtttcttgcagaggggtcagcgtgttaattgtaattaattaattaagaagtgaaacagcggtgagctagcttagctagcgtaatcaactggttcttcttaaattgatactatcacactgcacccgaagagaagaatacagtatccagcctcccattgaaccgcccatagctaacccctaaagctggcaactttgaggtataattaattcagtagtagtagtagtaattaagtttgtacaagttgattttatagctaaataatctcagtcctaaccctaatgcacgctggcagttaatcataatgcacgatcgtcatgaattcatcatgattcatgcatgcatacccttgttctgatcgcatgcgagcacaccgttccacagtcatctactagtactactgtgagaatccagcaagaatctttacgaatatccatttgtgaatcgagtagtaattaattaattaatcagatatttgattggatcggatcagcttgctagctagtagctagcccattatcccgtgcttaattgcttaattaatggaggaagaggttattggaagctggagctgaaggtggccggcagcggcgacgacgacgcatgagcatgagggagctttggatcatggcgaaattggcgagatctccgatcacagctagctggtcgcgttggcacagggcacctagctatcggccgcgcagccggcagggcacgaggtgaacgtcgcagccgcatcgtggccggcgaactgcgcgtccaaggcggcggtgcactcgctgctgggcaggggcacgccggcgtcgcacctcgcggccgggagttcgccgtcgcagacggggaaggcgacggcgagagatcgatggtgtgcgtgctagaaacggcccatgcaaatgcaatgcacgtttattgggccgaaacgggattcgacttaacgttttgtgccgggacgcccgtattaatcacttgggccgaaaacggggtgtcaatttcgtgcggcccaagaacggtgcagttaagtagtagtacgttcacttaccttcccttatcttttcgtcggctttaattgatatccctataccataatatctgaaatcttcatcccctatcttaacaaaatcatcgaagttagatcctgtagcactatagatagctgatttcattgacgcagtatcctaatcaagaaaaagaaaaaaaaatatatggatttgttcgacacaccgtggccccactccaccacaaggatgccacgtcagcgaaatcagctatcaacttatgttggatccgacttgaatgatttttttaagatgggggataaagattttcggtattatggtttagggatgtcaattgaactcgacgcatagatgagggatggtaagttgacttatgccgtggatttcaatt

SEQ ID NO: 17671 - DNA, 1501 bp, Oryza sativa
cggcgcggggcccccaggcagcggcgcgtggctcccaagcagcggcgcgtcggccctaggcggcggcatgtcggcaacagcctctcaggcgacgagcggcgagaagatagcaaaatttctgaaataattttgatgccaaaatttgtgaatgtaattttggaataatttgattgatagcaaaataattatgtctgaatttaaatatgcatcaatgcaaaataatgttgcatgagcaaacaatacagaatgatgtgtgagcaaatgtttgcctagtggtaagattgtctttccatacaacctaacggagaggagttaacagcagttcggctgtgatggtatttctgggacaaataggcttgtacgatggtattttcgagaagttgcgcttgtcgatggtatttctgggattagggtgcttgtcaatggcattttatggattttctcaaaagatataagagtacttagactcacacctcaacaagaaggagaacgcacaaccgaaaaagaaaagaaaaccaaacgacctcaacacatccctgcttctctgcttcccgtcatattctcctgaaacggccaaatttgacgagtgaaagtcatctagtcgcctctagtgcgccgtgcaaacctccgttggtgccatctttatccgtttcaggtgagttgacgccacgcgccgccaattagcccactttcaactatcatcattcatcgtttagttagaactagccaactagacacgagctgatgggatcggtttttacttcgtcgcatttctaaacatccactattcatagtgcttagacctccgccgtcccgggccgtcgacgccgacgttgaccgggtgttttttttataccaagaacaaaagttattgatgccatatgcatttactgtcccacataagtttcagtccaaactcgagatcatgaaattctatcatgaaggtcggcagtacgagcactaaatttgtttttttttttttgggtgagattgtctggcctgaatctggtcaaacgctataaggtccaaagtgatccagcatatagtatcataggccaaatgtttaggcttccaatatgggctgcaaaggccgataagacgggctacgtgagcccattattgtggcccacatattggtgccgggccggcggcaggttcaggtccagccaaccctgcgtacttgggcctcacgatagcgaaatcccaatacggtccaacaaaaaatgggccgcgcgaaactccaaataccccgttctttgggggaataagttcacttagtgacccttaaagtgatcgaaatcacaaaaccggatatctcgacctccaaactcttaaaatcggtataatttgactcccttaacggttttggaggacggttttgctgacgtggcgcctatgtggtggtaattatcgggtctcctttacacgtgatgttgaggtggcatttagaatttaaaaatatatgtgggatccatttgtcagcgacacataaaaaaaattg

SEQ ID NO: 17672 - DNA, 885 bp, Oryza sativa
tgcgttctactccatgactacatttgacatagtttttagaaatttgaactctacttcatgaccatacttggcacaattttaagggcatgttcactttaatgccaagaaaaatcttaccaaattttgctaaaattttggcaggatttcttatatagttaccaaattttggcaacaaactgaatgtagccatttttttggcaactttaccaaaatttggtaaggttgaaaatagcatcaaagtgaacatgccctaagatattgttgccccctaacaattaggagtatccattatcatccaacagtcattaatttggcaccgttaaatcagctgctattcgtaggatagtttagaacaaggcaagtgtattatgttctcggtttcttagtgatgatttttttgaagcttcatccaaatgaacatggatggatcaaataggcaatacgtttccggtaaattcgagaaacgcctaaggatcttccggctagcttcacaagatggtgggctagccgacttagttttgaagccccactcattctaattatttaatattaggtctttccctaatatttctttttttttgttccggttaaattccgccaggttactcgcactcaaaccacatccccatgctctacttatagatagagcttgagaaatattggttttgattagttactagattatctctttttgaatgaatttcaaatgtttatagccattaggatgtaagggattttattccaatattcaaatctgatgggggcctaactgcaaaatgtgcacctgtcatcccatataaaaagttgccccaaatgattccatcacacaaactcctaaacccacaatatacaacccaagatacccgggcacatttacagaaatgc

SEQ ID NO: 17673 - DNA, 701 bp, Oryza sativa
ccccaaagtgtaataatataggagttagcaaagaagccccaaagtgtaataatatacatctcatcggtcattttgaatttccggttacttgaatcgatattgtacattggtaggaaaattggagtaaaacatacctataagtttattcatgtctaaagatattcaagatatatggtggagataatcccttgtataccgctaaaattttaactgatcctttctatgcttctgaattttgtttacttccttgtatacctccaatatttgattttgatcctttccatgcccctccattcaattgaccattagttgaccgtttaatttctataaaaataaccattttacactttgaatgaacatagaagtttatgaattacattattgaaaatataaaagtttgtcacgtgagattattaatagttatgattgctatgcgatacattatttatgataaaatttacttttagataatgaaataaaaatatatatatttattttattttttgaaaatcataaaaatgaggagcattcatacaaatataggactactaatgctcacgatatttttttaagaatgctcccgatcaaaaaaaatctattgtcctattaaatttcaaataaaaaaataatttattacatttgttttattttcaaaattttatgaactaattatttagtctcattagttacttaaaatgcac

SEQ ID NO: 17674 - DNA, 213 bp, Oryza sativa
tttcctgagtttggctttgacctgatacttatgctccacttgctggtccaagatttcatttatgggggcgggtaagttacgaccacctgttgctgcttggtgatctagatgagagatgagaacaagttttggtcatttgttacaggtcactgtcctccaatgtcaccatccttggccatacatatctacagctgctgtttttttctctctatc

SEQ ID NO: 17675 - DNA, 1501 bp, Oryza sativa
ggcacatgaaaaaggaactcgagcacgtgcatctcggataaaaaaaaggcacacacatgtcgcacgcaattgtcgtatgaaaaagggacttgcatgtgtgaaacagactgcaactaacatacgactgacgtgatgatgatgccagacgtacaattacgaatgacaaggatttgatggattagaaaactaactcacatacggataacatgaaaattagaaaaccaactaaaatatgaatgacgtaccaaaattccaacggaaacatcttcatttcattttttgtaatagtggccaagtcctattgggctaaaatatggctttgggctgaaacatattagtaaatatggctttgggctaaaacatattagtttgggctacaggaaatctcaaactgattgtatggcccaataggcattctgtaggtatggcccaacagcaattttgtttttttttccctggaaaccgacgggattttgttttcatgtaacggatttagttttcacgtaattttttttctgaaatcggacatgacttttttgtccgaaccaaatacttattaacggacgatggaagtacctcttattttttaagtattagagaagagatatatatatatatatatatatatatatatatatatatatcatatcataaaattttttaagtattagagaagagatagagatagatatatatatatcataaaattttatatatagcttagagggatcattgagtttgtctagggccctcaaaatcatagtaccagccctgagcagcatcatctaaatttgtgcatcccgttctaagatgcatggtgcgcaatgactcgttcaagatttaatcctgaagcaaattaaaagaaatatacgagcacgtgtgagccttgaacgcgtacactggtggaatatatgatctaataatcattggacgtacgtcaagttaattaatcaagttgccgcgtatagtatgtggagaagaagttaattagtcaagcccactctcttgtccatctgttttcctgcacgatagatacatatactcctattaattttgtgttgtagtgcacaaattgcagcgtcgtctcatcttcctggaactgcaagtgtctgcataattaaccatgcgagaggagttagtttttttttcgaacgatgaggccatttccgatgttttatataaagaagaaggtgtctcattttaagtagaaaacgagactaaaccttgcgcaacttacaatgcgcagttaattatggaaaactggatgaaaaccacaacactctaacctaagctaccaacaccgcgaaaaaagaaaaaatggcggagcccaaaacaaccatcgataaagagcttattgaaagcgacacaaaggcttcgacttcgcgaggcaagtgttatcgttgccgagcttgtcacctagcgacacagtagcttcgactccacagctatcacatcatcgttgacaaaggcatcgcagaaaacgagcaagacaccgactgtc

SEQ ID NO: 17676 - DNA, 1501 bp, Oryza sativa
taaagtagttaatgttaatacctaagtaattgaaaaagtttcatactcatttgaattgggtatatactcaatttcaacaatggtgcccgggcatataaaccatgtagcaacagggccatgccaaaaaaaaaaggtcagctcgatctttagtcccggttggcaagccgggtaacaccaaccgggactaaagatcgatctttactcccggttatttcacccgggactaaagatagcgatctttagtcccggattggtactcccggtttggaaaccgggactaaagggggttacgaaccgggactacaaagggtttctccaccagtgtcagtatcaggtttatgacagcttggttaactatgcaaaattgcacataattaaacatcaccatatcagtctcaaaggtatgcatgacagctattttaactcttatcactgaactatacgccagaatgcacgtgtacaaaagccaataggcttgtttggtcgtggactcgtggtcagcttaaaaattaacagtgggataattttgtaagcctagctatgcccaaaacgaagggttcgaaaagacagtaattagttataatctctccgtctctagcctaaaaatttatcctaaaagagtgtaattaaatttgtctgtaaaatagtttagttatagagtggttcattaggcctctttaatattagattattttttttcgtttttagctattgtaagtcattgaacagatgtagggagtactttgacaccagaagtttttttttaggtatttttgtttaatttggtgagtgtgcgtgtatgcatcctccgacctcaaccacacttcagtcatatttcacgcagaattatgagcccagattggcttattatggcctcgatcgaagaaaagaaaagctcaaataaaattttaattacaattgcgtgctcctacgtgaacctcgtgatactgtagtaatataatccaatatagtatttgctgtgtttcattttatttcttcagaccgatggtcccgttatgccggccagccaatgcttatactgtattcttcatttcctcctttaagagttgtccacatgaccgaatggactgtcctgtgatcgaacaagacgacatcaacctcaggttcatccgcattggatttgaagtttgtatgttatgtattaaaggtttaaaattttatattttatttaaaatagaaacaaaatttttaatctaaatgtttcaaagatttagattatggatttgtagagatggaaatatttagtttaaaagaaatttcgaaaacggagttgtgccaatcagagtacttaaaacaataagttcactttaggtctctcaatttgtcgttgaatccgaacttcgtccctaaaccgaaatatcccatcccggcatcttccaacgaacaataccatgtaaattttggtctctcagcagtttaattgccgattttggttgacgtggcgagtgggacccatgtgggtcctacatgttagtggcca

SEQ ID NO: 17677 - DNA, 1501 bp, Oryza sativa
agctcgaccttgacctcaccaatgcatggaggatgaagagccaccattttctcatattgccaccaacgatgtggagatggaagagctgcttggtggaggtggaggtggatgctgtgctcgcaaggtggtggcgatgaaggagctgtacgaggagaaggattggatctagagctcaacaaccaggcggcgatgatggaggagctcgatgagatggtaggatggaggagctcaacaagacagaaacgcttgggacatgaatctcggcggaggagctttttgaaatgctagaggtcgaccttggctttgttgagcatgtgttgacggtccttaaatcataatatctgaccgtcaatacctgcatataatgaaataaaacatggtatcaaacttagtggtagggattattactaatcatttccactagtgttggtgaaatatgtgtatgcaggtaatttgaggagaaaacacatccgtcatgtggcaaaatgcacctccgcgcattcaggacgcgtttacacggattagaggcccaataagtcaataaaaaccatttagaattgggccaaaacttagcctaggttgttggagacccattaaacaacctctcggccgaaggagaggccgggaggagtgtttttgggttcggccgaacccaccagttcggctgaacccttcctgccgcttcctgccatctgcttccacgtggatggcttggattccttcccagaggcggttgcatggtgttttggtcattccccatacccctaaccgtcatttggagcctataaaaggaggagctcactctcattccaacacacacaactttgagctgaattacaagaggctctattgtatcttttgtacattataataaggtagggagtgagagaaagctatgtaggagtgtctggaagtttggcactcatccgacttctacctcaacgagtgtagcttcctaggaggaattctggaggagtaccggagctgtcagtacactctgcttcgggttcagagaaacttcttatataaagtaagcattcatgctcctttcttatgttatttaattactttgtctgagtaagatatatttctatctttgcgggttcattgtttagtattcatactaagtgctctagtactaggactccagatagagaagaaagttcctacgcaagtattagagtagtaattaataacttaggcgtggtgtctagagtagagattacctttgtttgttgtgtatcccacggatttgtcagaggtaggcggcaggtggtgacaaccctgaattccgtcctaataatcctccatgttcgggtacatcatagagctatagccggaaccacgctagcagaccagcaggggtcggtgcctgaagcaacaaatagggaattacctttgcttagcttagataattaaaacccatagaaagacctctctagcctagcctgcctatcgtcagttgttgtccttgaatagtcttagccttagatagattaca

SEQ ID NO: 17678 - DNA, 1501 bp, Oryza sativa
agttcttcatatcgtacaccatacgaacatttggggctctcacatttgctacgataatgacgactagacaggtgaatgctgtttttatcatccttaaatgtgtatagatgtgttatttaacctttccataacagttattttccatgtattgttgtagctggtgagtatattattgtcctgtgtgtggtttgtacatcctcttagctggatgcagtgggttggcgccgtaagtcatctgtcttagccttcgtaaatcattccatgatattacacattgttcgtttcagttatgattaacatgttttcggtaacaggccattgtattcggagccctgtacacaaaaagcttcttgagaagtaaaccgcagaagccagccgctgcaaacccgtcgaattctgctaacaacagctgaccaaacgacataagaagagatccaccccatttgttgccttgctgcaccggaccaaacaccaaagtcttggtgtgagatatgaatgaagacatcctgatgagttaactggacgacaggttgtagggttgtgttaacatggagctcagaaggctcaagggttattaggctattagcttaggaggatccagtggcaaatagttgaggaagcccagcctgctggtagtgaaatgacttggctgccgtttttgaggctttatccaggccgttctctgcactgcaggtgcttgatatataaaatgtaaaattatctttgcagtcattagattacaagtactaatatagtgctggacgccgtcttgtttgttggccgtggcttctgccgctcgggtcacgcgcagccatatttctttccggcccaactgtaaacaggcgtcacgcgagagaatttggcccatttacaggcaggaacggtactgtggaccacttgcgggggggccttttatattgggccggaacgtgaagcccatgaaagtgattttctacagtaaaatggacgtcagcacttcaaccaaatttccctttatcgtgcaatgatttttgactaataaacatgggagatcatcgagtactaaatcacaatcagagaaggtacacccaacaaccaagtgttagcttaaaagttaagaccaatggagggacttataagacaagaggattacacatctgatctgtttctttttcgagatgtacaagaaatttttagggtgaaaacgacaccgttgcctcccagtttctgagcttacattacaggggagcggagaatatacacccaaattgtgccaaaacctgatccatgtgtgttttaactcacagatacaacgttctggcagcctcctgcccattttctgaccataagcaaatcatatgaggtaggcacaattgccaatccatcatcagttctactaaatggaatctgtggtctatatgttcaaggggaatagttgtaacggcttatacctcgctgaaaatcaccaccgcatggagcgattctggaggagatgccttcattcaatcatacttcacggctg

SEQ ID NO: 17679 - DNA, 1501 bp, Oryza sativa
agctacaggcattttgttctttctaccagctgcttgctgaattttgatcttgctttcttcagcagcgttgttcattgttgtgagagtattatcattggtcactgcatgattattcagtttaggagcataccgtagtctgatcgacattactgatttcagtagcagttttcactgatataaaatgggaccaatctaggaaggactagattgattttgaattaaaaagggggtgaggctcgaacccggaccggctagctcgcagcttgcgttactagccgggaagacccgggcctttctccagttttcactgttgtgggagtactacttattcagtagcattggttactgaattttcattttagtagagtagttcacttgttttaagacttgattgttcacttgttcttattacaaaattgctcactaagagcaagtttaatagtatagccaactactagctctaattcatctatagccaatctaatagctcatctatacaatagttacatactacactattaatatctggtcccacctgtcatatacacactgcgtcttgaagtccgtgctacagctggctacaaatctgtagcccgctgcttttctctctccttatttatcttcttaaaatatatttgtagctggcttatagcctgatattgtacctgctctaattgttgttctgctcgatatcgacgaatttcagcggaaagtgcgttgcggtaccccgatgtggaagcgtagagtagcagtagacttcagcaaggatggacagcttggacgtcctacaaaagtgacatcattaagatttgtttcattcttttagaaatagtaccacttggatcattgctgaggatcagttcagtaaagtatgaaaaaatgcacctctggtgtattcccgaaaagatggtgctagttttggttgaagaaaatcaacagagtagtttgctagttttactgacaatattcatagaacagggaacagtacagggcattgacatagaactttctctgaatataatgatagaataggtatagtgtatttttgtgtcgcctccttcaggtttagcttcaatcaattgatatgtaacaatgatctgatgcaatgcagttatttagctctaaatgtgttgctttacattttgatatggtttcctccttgaagcagtagcatagcatctgctcaaatgtgccattttggcagataaagccatgtgaatgtagtggatctctgtttctgaagcatcattcagaatgactactactcctactaaacttactaaacttgaagttggagagattgggaggatgatttaacgctgaattaactgctgatcctgaattcctccttcccgaagcagagtgttgagaagataaaaaggctctggctcttccaattcccaccacggaattactgagaagaagcctactaggagatttcagttaacaatgccattaattaagcactccactaatcgaatggtcaggtaaaaagtgagag

SEQ ID NO: 17680 - DNA, 316 bp, Oryza sativa
gttgtgaggaatttgaatgtgattcgggtggagtggggaaaacagatagctcataaagcgtaatagctgttatcctgggcagtaggatgtttataagtaagaatacgtataggtcagaatggattcaggagttaggtgagggtatacgtgccctatagagggcgttctaataggtttgagagcggagggaatgcttggaagggctctttatcgatgaggatgggggagtgtgattgtagaacagatgaggggggggggtacctccctcccttcccccgtgaaaattttaaacacatccagtgggctccgctacagg

SEQ ID NO: 17681 - DNA, 1448 bp, Oryza sativa
ctatataatcttatcgttgattttcatttaaattagtggacccgttattttataccattagattagatctattattaaaaaaatatttttcttatgttgacatacaagcgctacacgatgtaaacgctacttcttgtctttccgtacgtacaaatgcacgtgactgaaagcaaaacgataaagctttcctattcttcgctggaaaaaacatacatccatataaaaatcaatggtctttaaaatatgatttctataatataaaaataaaatatataacttcacaaatataaatatatttacttaaatctatctattattatatactaaaagttcgttaaacttcctacaaacgcttctaaaccgccttcggtgctataaaacaaaaaaacgtgaactttcgatttgccttttaatagacgggaaacatctagccctcaattttcatttaaactggtggatccattattttgcaccattagattagattaaaacctcccttcctctcctctccttgcacgttttgtggtccaaattacagaaaaccatacacattttgacacttggtactcaagtacatatattttggtagtgtagtttaacaaaactaaactatcaatgaatggattcacctgtgagacgacgtcatcgttccacctaggatgaggacgtggtatcctgttaacttggaccataaaacgtgtagttttgtgaaatttactcttttttctattcccattcacccacttttattttttttacctagggtacccctaaatatttttatattacttttttcgctattgacttttgagcatatgtttgattattcatcttactaataaaaatacataattaccatttattttattatgattttacattgatgtcttatgttcgctatattttagcacaaaatacattgcggcaaatggcatcgacatgtattaattaactccataacaattttttcaaaaaaaaatcgcatcaaactatatactttatggtatcaaatattacttaacaaatatacaatggtaatttgaactatgtaaaaatgcaaaccatgtaatttagttgtttttttaagtagatccaatttaaattttaatttatgtgagattaacattatcaaatcattttggaatttttcgaaactgtttggttggtatttcaatagtaataaatcctacattatacatatatgtaaagaaaattcaacaaaaaaattttcaacaggtaaagtatatatcattggttttttttcatattttctaataattatttaaatgatatgaaaatagtcagaatataacccaaaaataacatatttatttaagaagttcaaatatagttaataatggtccaaagacataagtcgataaaaaatagctatttattttaaaagattataataaattagggttcctgactaatataggatgaaaaca

SEQ ID NO: 17682 - DNA, 1501 bp, Oryza sativa
cacttactgaaacttaggccatgttcatcagcaatgggtagtgactgccacagaaggtgccaaatttcagttggaaaggatttcataaactaattaacaggtgttcaaaagagaagagacaaatctgttatcctttgccattgttcttcctggaaacatgaggcttgttcccatgcatctctttcatttatggagcagaacatgggtgaccaactgctttgagcacccaaatccattgcatatgtcccaacatcatctttttcaacacaaaggagctcactccaagaaaactctccttgactaggccacttctttttccagtgtaagataatccataactgctcctttgtaattaattaattaatcctggtagattagcctgttaggtctcacatgagcagataagaggggatttctacttcctactcctaatcacatgcaagtaaaacagttcagagtacaataaggattttatccccaaaaaataacttgcagactagagatagatattcctaaatgcactggatacaaactgataaactgcatgggtattttcatattaaagcatacaaaaattacatgtgttccattacatacagagtaaaccttctaccattttcattagaggaaaacttaatttagtcagtgcatgatctacaaactaaccacatcaccattcaaaggtagctttcgccgaaaaattatacagtttaatcaaatgattgagatatccaatgtaatgtatactactacatagtactagtggcctagcaacatcagcaggcaactgctgtccctgggagtacagaattgagtcaggatgatagaagctgctgctaatccattgatgctgatgcctaatactttcatcaattcctaggtcctttgcattaactagttcacatgcatgattgatacagcctaaacagagactttacctgaattgcaaacaagatagcacagttaaatgtaattcaggaggcaagtaacaattgatgggagatggtccccataaggcactcccagaaaattaccaatcccaaactgtccagtagcatcaatcaatcaaggcgggctagcacatgataagagatgatgaattttcagccgacacaagcttggatcaaacctgggtagaaacacactgctttcggcctttcatgtcatcatttacttgtttcagtgagcaggaacatcctgtaattcaatcatgccaactccattacgtgctgtccctgtgagtacaaacggagcataatgcagcatgttatttcttgcatattgacatcgatgtaaggtagtttgtaacataattttctagaccacatactttcatactttgagatattttttggcccattatgctaactagtcccataggcatgcctggtactacatcctaaacagcttaacataaactccaatagcattgcacaaatggaagcatatatccgtgatgtgctagtagtgagaaggtgaaacaaaactgctgaataatttg

SEQ ID NO: 17683 - DNA, 550 bp, Oryza sativa
tttgtccattcatcttattcaaattcttttatgcaaatataaaaaaaaataagtcatgcttaaagaatatttgaagataaatcaagtcacaataaaataaataataattatatgtattttttgaataatacaaatggtcaaatgtatcccaaaaagtcaacggtgtcatatattaaaaaacggaggtggagtacgtagattttccgtgaaaaatacttcacaaatctttactattataaaaattaaaaatgtttttgccggtattttggtacgtcatccgtgtatgagtcggtttttaagttcatttgcttttgaaaatacatatccgtatttgagtcggtttttaagatcgttcactttttaatctgtttaaaaaaaactcgcattctaacttgagacgatcggactcctaactacagctcatgattttttaaaaatatatatatccaagtgaactctcatagttaattttatcttaactaaatcatataataataatgagattaaaatagacttcacccgttacaacgcacgggtatttttttctagt

SEQ ID NO: 17684 - DNA, 288 bp, Oryza sativa
ggtgtgttcacaagttgatctgtgcagtggattgattgtcttgtctcgtcttgcaaataagctcaattaagttgagacgcactgagtccccttcttcgactgcttccttgtttgttttaatgttttgtagatattgatcaactcactggtactgagattggtaattgttcttttgggtcaacttactagcaaaattctgctcgattatactaaattgttcatgaattaaacacaaatcaccattttccgtcctgaatctatggttggaaagttatcaatgtttggatg

SEQ ID NO: 17685 - DNA, 1501 bp, Oryza sativa
ttcaaatcaattcttcgcacgtaattttagagtccaagggagttgcggatccgagcgagggtcaagacctgcaggactatgagcaaggcaagtcatcactattctttgaacatgttgatcccaattgcgaaattgttttgtttaaaaataaaattgcatgcaatgatgaacatcctacttgtgattatgccatgccttgattattgtttacccttaaatctttgtaaccatgattacgtatgagtccctagtcaactatgaccattgtttagaaatgctatgctagaatcatgcatactcatatttatcaaatgctttatgcttgggcaattacctttgggaaggtaattgagatgcggcatgtggagacatgagcgccacattgccatgatattgatgacatgatttgtgaaaggaaaataaagtgaaacaactgttttcgactggggcggacggaggatttgggtggtatccggaaaaggctagtaccgtccctggtcaattaaggaccgagccatgaagttaagcatgaaacgaccctcgtacaaccgcacttctcgtatgggtatagacctagcggagtagatagctgagcggaggcagtatccatgcataatggtttcttgatgtgtgaggctggggctctacggtggggcagccattggtaggaccgcgaggcgggtgtctacaatggtgtcgccatcggtaggactgccatgtgagaatctaaacataattataacttaatgcatgtgtgagtcttcccttcccgggtgcgccagaactcctctcactgctagaaaccgtgtacgcctagagtgcatgaggatgtaaagttcatggagtgggtactgccaatgcgaggttatcgaaaagctttgccgtgacgcgtctcatgtgttgggacgaggctcatgtgttgggcagtcgcggagtgtgggtaaagtgtacatccactgcagtgtgagtaaaccaaatctattcgaatagccgtgctcgcggttactgagcaccgggacgtgtattacacttggttagactctaaattcttaacttgtgtgggatgggatattgcatgatgatttttatgctgttggagccatttcctgggaggcgggaaggtggacgtcctcagaaaaccatgacgactcaatggcgggaagctatccttgggattacaatggatggtggacagaaccatcgttatttaaatgtgaacactggtactaaaatttgatcagtcaatgctaggtcttaggcttatgaaaagaattacaaaactgactttgcgcaaagaaccatagccatcctttgaatacccctatcatgtgcattgttgctatgatggcttgctgagtacggttggtactcactcttgcaatatataaacttaatcagaggccggagacgaagcttcagaggatccctatgcatactatgaggagggtgatgaagacgatggcgctcagtaggtcttagttacggtcgttgcctgtggcaa

SEQ ID NO: 17686 - DNA, 1501 bp, Oryza sativa
gtccctacatgacaaaggtagttaatagtgtgaattacaatcctaggttggcagcactttgcacggtaaggagagagaaataataatctagagatgagcagattcttaaattctcaacacccctttacacatacaaacctcttggctgtaacacctcatcgtcgactaatagatcactattcagatagtaaaataatgacttaggttggaattataataggtttgaccattcgcaagcttacaacagcaagagacattaacatctttccaaatgaaagataaataacttttctttgagaaagaaagataaataacttatccagacatgaccataaaggacatcttcagaaaatgacctaaattaataccatataacagaaatcagagatgttgataaaaaaaagtctctatttctttctggaggaattttaaaataatgtacctcagagtgtaaatatgaccaacataagcaaacatgtaaattgttctctgcgatgtttttagacacacagttgctagtgtttaacaattcccagtaaacttcaattatataggtaagagagaaaaggaaaggaatggagaaagggatttttggatcattagaggatgataggtattttttgataccaatgtaaaatatagatgttgtcagagagaattaggctcttagtgttccaatataatactgtactgtacttacttggaatttggaagtctctgatgtcttgggaattgttccacatagttcactatggacaacccaaggaaacaactacaaaaaaataattatccaaatatctaaggagtcagattattctctcaaaggtctaattataagaaatgaggcatatgtgagaactctattagattagatgctaagctatataagcaatgatgcataagtacagttcagttaacttagtgtaataagagagattgctaatcccaaaattactgctgaagttgtacagctcatcgagatcctcgtcatggagtaaagaccaaagagaccctgcatgagttcaacaacaggtgagggttttaaaattctgctataagaactgtacctgagtgcaggcaaaggtgcgaacgacaagccaaataaaaaccctacaaagggagcaaccaagcgaggagggttagctgaagtctgaaacttaaggtcgagcttcttctttctaacagcacgtgatagctgtctcatagttttcttgcaagtttcagttcagattaagaatatagctcgctcttttgttgataagaaagcacgtactgctaagagctagctttgttcaggtctggaggaagctacagttatatgtaatcttatgtataattgttccttttctatcttcagtaaccagcagaaaccaaaatcttttaggtatagccattagggtttgttagctcgtaaggtcttgataaccagaagtaggtgagagtgagcaccgtttgagctagctagttaccatccaccagtagtttctgtactgtgttgata

SEQ ID NO: 17687 - DNA, 1501 bp, Oryza sativa
caataaaaagtaatttacaggtaaaatttttatatccgtattcttagcggtttataagtcaatattgaaaataaattccaagtaagaaacttaagttcaacactacaattatgttttaaaatttaaattttggtcacggctgataaattagaagacatactatgagtccgtctttttctgtctgattccagaacaatcaatatctacatatgaatccatacattatctgctctgatttcgaaacataataatataggagaaaagaattaaaaatatgtgtaatcattattcgtcaaaatccgatatgtttcatagttccatacgtaattgcttggtttgacagtggtgaatcgatctagaaccttcgacaacaatcgagaacatatatggtcctcagatcttttgttaaggccgtgaaaacggaggtgattcgatgggaagacagacatgattgattgccatataggaataactgattcaagttctgaggtcaggcgcgcgccattgcagatgcatcagggaacctacctacagtattagctagacttgtgcaaagtaaaaccatggttattctgaatctaaacgatgcttcttcagagaatggttcagggcaccatatcaacttagcagatatcggatggtacacctgacctcaacatggggtgcttttgctactgcttgatcacagggtagggcctagcattatgccaggaaatgtagttagattcatacacacaaaagtgattaacaagaactacactagtggcctgaggagcgcagacaaaagaagatcaataatcagcgaaggtaattatgccagcttctggatggatggtgcatctgtgattgattcactgatctgatcgctcactcgtcagctatcttggttccatgcctctcatgaaaagctaaggggttgcagagaagcgtggattttccctcttgtggcctggcctcatgccaatgcgctagtctcatctcaggcagcacaagctgtcttttcatcctgtagatcgtgcaaaataaggtgctggttctaaacgtgccccagaaagcgctctctgtttgcacatgtgtgtatttagtggtatttttcagtaccaatatccatttattttcatttaatttgctttgctcgtaaagtagttcttgattctacatgtatacatctacaaagtattgatgagtgctcattacagaaggcatctcaaatcaataaattatctgcatttttgcgaaagaaacctgattgaaacacctcgtgaacgaaatacctagcaaactctgtaaggcctgagattttcaccaagtcgagtggctgatctgcaacgagctgtaccgatcaaaatatgggttctttcattctttgtgatgtgtgctgattttccaatcgaaaatcattgtggcaagattttgtcagggcatcgccgtccacactctgctcccccaccggggatgcctaccaagggaagaagaggcgtcataactgccatacacttgt

SEQ ID NO: 17688 - DNA, 1501 bp, Oryza sativa
ctgagtgggttgtggcatgaaggaactgttgaaggcaagtagctacttccggtgaactggatggtggaggagatggcatcggtcattactgatgatgtgttatctgaggtatgctgacttctctgtgtggtctgcgagacaggggcagtgtaggcttcatttgtgctggacaagggaggagatacccatgagtgtgagagcgctctttgtgccgtggaattggttttcttgaaaatcctgcagattgcccaggaatcctgctcatgataagaaaaaagaagaataagattagggcagtgttttcaggtaaaaagtgcattcaacttatcttcacaaggaaatggtatatgaaattgttggtgtcatactgaattagctcggaaagcactacatatgctaggccttttgcagtttatattgcaagttttcccattgtaattatgggcagacatgtattgctcagatcatctaccttagtgccagttttggtagctatgcctaagctacttttgtagcatatgtgttaaggtttgaagttttttgttttcaaatgttgcagcatgccagttgcttacatttggtggaatgatcttctcgagtggcttcttctgtggcaatgaagggtcagtgagcgatggcagccggaactcgtgcatcatccagtcagtttgacgcctttagctgctctgcccttgtagaagacaagggacttcttcaagcctatgcactttgatccatcggaggagtagattggcctatcggttccagtggccttccagaaacctgctccagtcaccctgtttggccttgtgctgttccggtacttcctatcccttgggcagtagaaataccattccttctctccagtacttgctaactcttcacggtgaaaaaaggatttgttaagtaaatatgactagaaataagttaaatggtgtctattgtgtaacactgacttaaaacaaaacgtgagctagtcagctaggctaactggtctgactgataaaaggcatatgcatcacatgaaaaataatctatttactatccgcatgcctttttagtcttgagagcccaactgtgatacttgtaaatcaattataccacattaacactactgaaagccaaatctcagaatacatcatgacattaatagcttggtagacttgcaaatcttgctctaaatgttttatgaggcttaaccctaaaactgcatgggcttcgtgatgaatggacattatagtagtagcgcttaagaggcaggttgaaaactcttaggtagttacttttcttatttccttatcaaaacctcagagacaactaaataaagatgcatgcaaaaagtttagagttcgacttcaacatggtggcaaaaagaagaaaaaactattactactaagatacgaagtctcagcatgatggaacatgcaccatgaaagtcataaagtaaaaataggaaacatgatggaacatgcaccatgaaagtcataaagtaaaaatagga

SEQ ID NO: 17689 - DNA, 394 bp, Oryza sativa
ccacttgtcatgatccttcttttccggcattgttcatcaagagcattggatatccctgtgtgagccaacagatcctttagcatcatgtgcgagagatgaaaattcctagtgccatggaaacttcaccacctcaaatttggaaaccgccgtcgctgccatcaacgataatcaacttgatcagctgtcgccctgattaaattgatctaccctgatttaattgaccccctgactaaacttgcacagtcaccagccggacaataaccaaccccttttttctccaaaaaaaccggttcggttttatttttggttgaaaaaaccagtcaagccgagcggtcaaaggaatcagatcgatttctctccttcattgggccctctctagctgcccttctacaga

SEQ ID NO: 17690 - DNA, 1478 bp, Oryza sativa
atggctcaaaccttaatgtgttccgagtggcttttccaagcacagagggggacgtgcagaacatctcagaaggaacacacctatatgagttcgactgctagtcacaatctatgaggtttgggcgatctctaaatacttattaaaggcctggagtttgacttatatgctccaaacagaggggatgcgaacggcagcccaataccagataagggtttgagtgaaacctgatcacacaagactgacaattcaaggcatagtccattgttcagttgtggtctgatgtagctcattttctaggtggaagttcaacttaacagtctccaccaaaacactgctatatcaaacaggcacaaccttgagaacatttcttctgagccttgaaatttggtggggattgttagaataattgggctagacccgatttattctattaaaatctcaaaggcccataataagtgttaaggataataataccacctcagaatttaagcgaggagtatctcaacctaaatagggagttattggaggctccctattgaccggttgaggtgggagtcggaaagctacgcgcgcgcgcgccggcccggccgagaacaaggcaaggcgtggctggcgggcgtgcgtcacgtcacgtctctattcttttgcaatcacgatcccacgttcccacgactgcctccgtaacggtgcgtgcacgatcccacgattccacgacgcgtgtgttgcaactggcgggatctctcctgctatctaaggaggccgctagtccgatcagaacgattcgcttgcttttctccctggtgttcttcctcctccgcgcgcgcctgtgctgtctcgcttcctcgcttctgatcacttgcgcgcacgagagatcggaaggtgcaggcctctagaaccacaccttcgcctgagatatgcaccgggtaggcgggtgatcaggtttttggggagtgcttcccgcacgactgctcagttcatccaccatgtctgcgcctggagccggagctgccgccggcgccgctgctgcctctggagatgacgcgccaggagccggagccgttgcgaacgtcaacaccaacagaggcaattctgcctcacaattcagcggagggccattctcggggtatgtccttctcctgttgttaattcatttgttcataccgctgttagtcatgctagtcgcaagtcaattgcgtccttggtatgggtatgtgcatgatgctcatgataccttaagcatgttactggttatgctataagttgtcactagatcaccccacattgttcatgccatgattatgattattgtcttaatattttggattaaaatatgctgatatatgaccatatttccaacaatccaaaaacctgataggtcattttcggtagtggctttgctgctgcactgaaaccacatgcttttgatggttctaactataagaggtggaaagcacgtgcactattgtggttgacagcga

SEQ ID NO: 17691 - DNA, 1255 bp, Oryza sativa
attatataacatatggattcgttaagcctttcatgcattgtggatgaaacttttaccgttatgtggttgatggcgctgtcgaccgatgttggattttccgccaactcagttgatgcgcaactgctgcgcttttggttgggacttcctaactcttcttgcgcagcagcagcggcggcctgcgggttatgttgctcttctcggatctcttgcctaatcttggccctcatcgactcgagcttctcgtcgaattcagaggtcagctccactctgatcgacgcccggatcttggcttcaaggcgtgcatctttctccgccttgttggaagtccgcttgtctagaaatccatacttccagagaacggtggacctaatgccccatgtccgtccacggtgttccttggtgcccaacgcttttgtgaggaggtcatcctcgtgtttttgagagctgacctcttgcaaggcttgttgctcggcaaccaactccttctgcattacaatttagtagggttaaatcgaaagctcaatgggaaacaatgtgtcacgtcctgataaattcatcccgaaataaaaatcattccataaaaggaataatagaattaattaaaattcgaaaagaaattggcaaacactaaaatacgtacaagaaaaattcgaatgtcgtccggagaatttttgttaaattctccttggtctaaaaggagccctcaaattttacttgaattttcagagcactggaaataattattaagcaacaaaaataattaacaaagtttactaaaaagaaaaactaaaaataatccccctcctccctttgggccaagtttggcccaaagtcctccctctctctctcggcccgcggccaaagtcctctcttcctccctctctttctctccctctccttctctccctccttctcttgggcctccccttcccctcccggcccactccctcttcttctcctccttggccgcctcggcttcgcccggcccaagccgagccgtgcctcccacccgtgccgcgcacgtgcgcgcgcgtgcgcgccgttgccgcgcgttgaccgcgcgcctcccgcgtgggtcccgcctgtcaggcgcatccccgacctctagccgccggcctccttcctctctctcccgtgaaccctagcgttgttcctcctccaaatccaccccattcaagccggctctttccaaattaaatagggggaattaatccccattgattcctctttgatttcccccgttttcccccttgaa

SEQ ID NO: 17692 - DNA, 448 bp, Oryza sativa
gttatggcttctggatggatactatacgtatgtaatactgttgtttgctaacaatgagtcaagttggtgatagcttggtctcggaatatggtttctttgtttgtttcatgtgtaggtgactcgatgccacgggagagtatttgcggtgatggaccgggagtcggcttggtggtaagacgatgtccgtggtggacagatatcatgcgggatacttaggctagagttgatgcacgtggttggtgattggttatgtaaagtttgtttcttgtactagagggttttctatggtgattaggacttttaggatgagtttggttcgtggctttaggctgcctacctcatgtataaatagagggggagcgtgaggcttcccgatatcgcttttgagagcaattgagttgctagtttagttagggtttcgagtttagtcgagatttttgtaaggagt

SEQ ID NO: 17693 - DNA, 481 bp, Oryza sativa
tgataaaaacaatagttatggacagggcactatgaccaaccctagagggagatttgtcttttaagatggtttttcttattagtttctttgtaagaattggctttaacttctctgaaataaaatccagaatgaattccatcatcttaaaatagaaaaaaaatagttatgggcactatgaccaaccatagagggagatttgtctttaagatggtttttcttattagtttctttgtaagaattggctttaacttctctgaaataaaatccataatgaattccatcgtcttaaataaaaaaataccgtcttaatttgagagataccaagaggtgccaaattttacagtagaaaatgcagtacctccttgtacctccccaaggaccgtaaaatccctctcttaaaaatatctagttgttacaaaaattggaattaatagatatggagttgtttcatcgctttattaatttaatatgaatttgaaat

SEQ ID NO: 17694 - DNA, 253 bp, Oryza sativa
cgggggtggccgcatcggagctcgtcgccggcgaccgcgacctccgtcatccacacccatgcaacaccggagctcgtcgttgacttagttgcagcagcacacgtgagagagatgttgtagaaagaatagctaggtagaagaagagtggattggttggtgtctatcctatcccgtcgagacggtataccagtgtttagcatttcccttaaaatattgctaagaacacatcaactaagccctcctctgtcctagg

SEQ ID NO: 17695 - DNA, 1501 bp, Oryza sativa
cattgttgacgccttgccgccgctcccacctcttgtcttcgtctcttcgcccgtcgcacgcgtcggaggccggtgcatgcgtgaatgcgagacgaggactccgggcgccctcgatctccttccttttccccggcctgaggccgacgccccgtgccgtcggccatcttccggcgcctcttcccgacacggtagtccctccgttcccatcccttgacctctcctagctcgctagatagctcggcattgtcgccccgatcgcgtaggagctaattcctagcggcgccaccgatcggcatggccgccgtcgccgcccgctcccggaggtcgccgctggtcgccagcctccctcgtagtcccctcgctccatccgagcccgggaacgagtccctcgaaccctggagatgctttcgtcgccttggattgaatcctcgtctcccctccgctgtatcccctttgctcaccgccgacgatcaccgtggaaatcctccgccgtcaaactccttccggcgaattagagccttcggattgattcctctcgtatccctcttcacaccagtgtgctccctttggccgaagacgtctcgtcgaggtcgagctccggtgaactccgccgcctcccgccgtccgttccccggccagcctccttcgttctcctctcgccagtccacgtagctgccacataggtgccacgtcggcgccacattggtcgcaaccgggtcagcaagattggtcagcgccccctccgtcccttttctttggtgcacgcggtccacaagagccgtgcggctgcaagtgggcccaccgccatttggccttctcggtgcacctcgcgcaaaccgcacccaccaaaaccctagcgcagcgccgcataaaacctctcctcggtgaacctggccaccgacaggtgggccccatcctgggaccccgcgtcgtggaccgaggtccactggcttcctgccgcgcgtcttgtccgtttgggccgcgcctcgctcggccgtgggccgtcactcccgcgcgccgacccactcgcctcgaccgcgcacgcaaattccttgggctgcgcctcacgcttggcctaaaagtctgattccggtccctcctccattatctttttcaagggaattaataattccttttcctttagacagaaaatcaaataatccttagaaaattcatgtctcccgattcgtaacaccgattgactccgttccacttccaataattccgtaaaattgagatctatccaatggaactattaattagtctaaataggatctttcttttgctcttttgtttaggatttcgattgtttgcgtatagttgcggttaccggattttcgtcaatcgtggatttctcgaagattcgtgaagcttcgtgaagaccttgagcaaggcaagtcaccctttgaccaattgcccctataattagaaaatcattattattttgtttgcaacttgctttattagaatcacacgttaacttgcttggcctcggtttgcg

SEQ ID NO: 17696 - DNA, 1501 bp, Oryza sativa
gcaaggcgaagactatctgccgaaggaagacgacttcgccatagcaagttcgcccccacgagggccgaggaagcctttccggcccatcaagcctaaggcctacagggccggcgatcaccagatggcccatcaggggcccatgagcccctataacattatgtacccctgtaaatgtcccttttgtgagggtaatcatgtaaattcccctgtacaacctaaagcctagtagtaagaacctgtaatggggctataaatagtcccctagggccatgtaatggggggatccaagaagaagaattcaaaaattcaatacactttgtttccttccaaccactgttgagtaaccacgtccttcgacatatgcagttatcatttcgacaacactttccaaaaccaacctgatgcgattgatggccaaagtggttcccagagagatcaagcttctcaagttttgtctggtttatgtgtgtgaaagtctggtttgcacttgaaagtgaggaacccgaaagaataagaacctcaagggatggaattgtgttcaccacaagaggtgatcaatatatcatttactgcgcttaggtttacgctgctcatgtcaaggtacttaagttgatgtagattggttaaccatgagatatctactgagtacatatcagtatccatgaaaccgaggttaaggtgttgtagatttgaaaggttaccaagctgaggaggcactctaccaaacaatatggatgtttcagacacatcaagatatcttatgttcttcattgaaccaaagtactctgggacatggctggcttcaactggatagccaaacttgttaatagagacatcaagctccacaagttttgcgaggtttcgttgtgtcaatgactgagttttgcctggaagcgaggagcaagaaatatggagggccaccaaagatacccaagtatcacaatggtggagcgacaaggaatcagggtagtacaacctacacgaattagtgcgactactgggtaggtccgtcggtttggcacgcaaaccgaggccaagcaagttaacgtgtgattctaataaagcaagttgcaaacaaaataataatgattttctaattataggggcaattggtcaaagggtgacttgccttgctcaaggtcttcacgaagcttcacgaatcttcgagaaatccacgattgacgaaaatccggtaaccgcaactatacgcaaacaatcgaaatcctaaacaaaagagcaaaagaaagatcctatttagactaattaatagttccattggatagatctcaattttacggaattattggaagtggaacggagtcaatcggtgttacgaatcgggagacatgaattttctaaggattatttgattttctgtctaaaggaaaaggaattattaattcccttgaaaaagataatggaggagggaccggaatcagacttttaggccaagcgtgaggcgcagcccaaggaatttgcgtgcgcggtcgaggcgagtggg

SEQ ID NO: 17697 - DNA, 298 bp, Oryza sativa
tttgaaggacaagaggcacctctttttgcagcaaaccagcaaggcaacttgtaaatcattttttttttaattcatgccaaccgtaattttcccacccacttttatgttgtacctacaaaccttttccattttcaatatttgtattagaactggtgctggtttgtaacttacctatccttccccattttgtatgcttctgtcattcactttggttacacactttattagagcactttatagctggttatgttctagctcagtgttaatgcattagattttttattcttcgaattgcagt

SEQ ID NO: 17698 - DNA, 750 bp, Oryza sativa
tctctctcagggtcattggggagggggtgagggtgcaagctgacaccaagaagcttgtagatttagggttcaagtataagtatggggtggaggagacgctggattgcagtgtggaatgcgcgaagaggttgggagaactctgatgtgatgatgtgtagcaaaaattcgtgaattgcttgaccttatacacatgggtataccgtgtgtgtgttcggtaagaaacgaatgaacgacaaattcgttcttgctcgaatattcgtaaacgcagatcgatccgagatgtgaggaaatgttgggttatagtcatcatcaacggatcacaacttttggactgttttgagatatagtcatctctgacaggtccgcacttgtaacagttgatatttttcttattactagtgatcaccgacgaggcatacattatgtaggttatcatccatcacgaataaaggattttattgtagtgatctttaatgcatatatctcgtgggagctatatatttttcagctcaagccggtcagtcctgcgagatatggacctgaaactcgtttcgttcagagccacatatgacacccacttgcgtgcaggaaaggaaatcaaacaacgaaagtcttgggtgcactcagttagccacacaggtcagcagggcaggaatggatggatatgaacagtgcgatgacaactactgctgagatcacaaattcacaattcgtcccactcactgaatcgatcggtttcagaagagagag

SEQ ID NO: 17699 - DNA, 1501 bp, Oryza sativa
tcataaaaaaatttcaaataagatgaatggtcaaacgttgaacgtgaatagtgcaaaactatacttattttgggacggagggagtactgaagtactggaacaaatatctgatgatgttccaatctttctttagttattgcaccggtaaaagattgcaataagaaactggagttagtacgcactttaggctaccctgaagaattttttgcatggtggttagtttattgaaggtgtggtgtcatccttgcgtgtagagattatcacattgtctaatcaagaagagccaggagctaagctaatctagctcggccgcgaacacgacagcaagttatcttgaaggaatcagtcagttgactaagcaggctctcgctctctccagtccagaaaagcttcggcatttagaatcccctgtttgcaacaggcgacaaggcaactttcatatggcaccaaacatgtcggtaacagctgatgaaaccgtctaatttatctgctaatctcgctgttttttcccttgtcaggatggctcacaagtggaccaagttgtagaatgttgcaaaacccgttgtttatcatggccacattcggctagcgatgcagagcgattgacagagaaatcccatgcgacttaagaaaagcgaaaccggggccctcgtttgccagccagggtggctaacgactggagtgtgtgcaactagccgctgacagacaacgcgacgcttgttatcattcgcaatgccgacctgatggatgtgagctcgacgtgactcagctacaggaggaggagtttggagtcatttgcgtttttagtccaactcggtgaagggtcatcccggatcatctgcactgtagtgtgcagggttcatgacttcctgtgttgcagccctgaacctaaggatcgttctgtagtcgtaggtccatggtatcatgattaatcatggttgaatgattcttttgctcctccgcgttgtggaggtcgatttctactgtatcgtagtccagattcttgtgcaatgttgaccatgttcattggcctggcttgagctccaaagagccctattatttctcttatacatatgcttatccttacagcttattaacaaatagaaaataatttacaaataaaactttcatataagtctcactaacgactcaaaaataaatgttgtaaaataaactgcgataaaaaaaataagttcaatatttagttttaaaatttaacttttgacttataattataagtataaaaaaatgaggccgtaattgaaagtcttttctgaagaaaatgggaataaagatgaggatttgatacagtaaaaggctgtttggggcgaattgggctatcggctcagtaggattgcttagttgatctaacctccatatgggctgacgctgatcatgggctttacatgggcgagttgccatggcccatgggctgtcttgcgcggaagaggcgtgcgtggcagttgatggcggtgtcgccgtgagagaacggagaagcgga

SEQ ID NO: 17700 - DNA, 319 bp, Oryza sativa
  unsure (1)..(319): unsure at all n locations
aatcatttagaagttgtgcaacatcccctccacagcctctccaaccaccgtaatattgcgtgcagatgttccctcgcctccaagtgccatctgggcagaccanaaggtgtnaccccccccccccccccgcgccacccctcatctccttagtcggctggcctcctcccttcccatgccccctctttcctaagctggcggcggtaagtgcctgtaacatcccggcctagggtttaataggattaatagaatattcatatcaacaagttgcaacttcttttccggaagccaatctccaaataactccagggttaagcgtgct

SEQ ID NO: 17701 - DNA, 667 bp, Oryza sativa
tcattagtaaggttgtagattcataggttagccacatcaaaaaggaaatcaggagaatataaagagtacatactactccctccatctcataatataagacgcgcacatattttaagattcaacctttaaaacacttgactaacacttagtataatattaaataaattttatttgttaaaaaatatattattagattgagatttaaattactttcatatggttataattttgttgctacaaaccttatagtatataagaaattataagttaaacattagttttggagaccgtgccaactttgaccatgccttatattccctccgtttcgaaatgtttgacaccattaactttttagcacatgtttaactgttcgtcttattcaaaaacttttgtgagatatgtaaaattatatgtctacataaaaatatatttaataataaatcaaatgataggaaaataattaataattacttaaattttttgaataagacgaatgatcaaacatgtgataaaaagtcaacggcgtcaaacatttcaaaacggagggagtactatcttgtactaccactatcagtaactgtcttcagagttcagatactacagttcaggaaaacaaaactccaattcaggcagctgaattttcatcaccttgtattaaaaagagcaa

SEQ ID NO: 17702 - DNA, 218 bp, Oryza sativa
agtgtcaattgttggcactatccaatttcccttcactcccaaatgaatgccaattagacaataatgtaaattgagtaccgcttctaaaaactgccatagactatgcaattcacagatagtttcaatttacatgtagtaagtatgcataatcctcaagacattactagacgaagcaagttttgctctgtactctataagaagacaatgaatggaatagt

SEQ ID NO: 17703 - DNA, 415 bp, Oryza sativa
  unsure (1)..(415): unsure at all n locations
cgtgggtccaagctcatcncaaggcacccgaggccaaccattccacattttagttgttaagcaaattttaagaattataacactgacttgggtacattgctaggcttgcccatatccgagggctcgactattcgaatagattatactctgatcagaggtgtacatctttacccacaagacacatcttcctcacgtgtagccacgtgccacataccacctcggtatacagacgaaagacgtgacatagtttccaacccatcctagccatagacaagagtaccgacccaatcccacctacggccgggacccccgggacaggtaggcagggctgagcccctagcagcaggacaccggccctgtgccatgacatctcgactaccgggccgcagctcgtgtagccttcatttgccctaga

SEQ ID NO: 17704 - DNA, 215 bp, Oryza sativa
agcaccatcgctgtcgccggtctttctctgttaagttctccatagtatatgcttcaaccaagctcgcacagcaccggagcttcatcttcgccatcaacccaagccggctatctttcctactccatcacggtaacctcctcgcagaccaaagaccttaggaacgccaccctgttgtcgtcatcttcctccgtctgtcattcctacctcgtcgaagc

SEQ ID NO: 17705 - DNA, 355 bp, Oryza sativa
  unsure (1)..(355): unsure at all n locations
cccgagttttgagtnaccgaccctcgatagggcgcctgtcgagctcggtacccccagaagaacggatctggatatattatgctaagatcgacaaccaattatcaagttggtgtgctagaagactaactgatgcagcagggtaggaaaatatggtttcgatcaacgcaggttcaatagcgtttgagaataattttctagcatgcatgttgctaaagcaacaagcatagcctggttagaaatgttgatctgcaggcatttacagactgaaaaccacatttgttttcctttgtttctagttgatcaaattaccttaaactgtgcctatatggggaggacgagtagaggacggctaggg

SEQ ID NO: 17706 - DNA, 760 bp, Oryza sativa
gtgtgcaaaacataggtgcaaatgtagtatgccaaaaaccactttggaggatgaagttgcaaaccttttaggcccctccgatttgtatgtaatcaccaaaataaattcaatagaaattttggcatgacctcccctcttttttgaaaaaattttgaagcttgctcgggcagctggaggaggaagaagacatatatataggggtgggactttagtcccggttggtagcaccaaccggggctaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatagttttgactcatgtaga

SEQ ID NO: 17707 - DNA, 818 bp, Oryza sativa
ttagcatatacgcacgaaacacttagcatagatgactattttagtcttagcaagtaatattatttgagttttaatataagattactttatttgtaattagacttagtatgtaattattgactacggaattggtgcgacaagtagcaattgactattgtagacttaattagacttagcatatacgcacgaaacacttagcatagatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatagatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattgtagtcttagcatgtaatattatttgagttttaatataagattattttatttgtaattagacttagtatataattatttactagctagggttgtataatatacgtcacctagacttagcttatatgacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 17708 - DNA, 1501 bp, Oryza sativa
aaatgttcattaatttacaagtgaagttaaatgtgggaaataaaatttcctaaatataaagcttggatggatttaatttttattaaattctccatgattaactatactctctgaaattttctcggatttttcggagctcaattcctaaatgatacaaagaacagttcagtaattatttgatcattaatgatctaattataattgttaagagcttttcttgtttaaaaatccttaaattataaattgttgtttaaaaggaattattagaaatgatcttaaaagcctaaaagagaagatctaattttaatttgctaaatctcaatataaaatttggctagataaaattttgttaaatacttctcttgaatctttagttcctagatttttctgggatttatttgagccaagaaagtatttttaataaatggaattccatttcatgaataatttaaatagaaaaatgtttttaaacccctcttttggctttgggccgaaagtcggcccaaaaccttcctctctctctccccggcccagtcggcccagtcagccagcagccgtctgcgcgcgcgctcccttccgctgacaggtggagcccacctgtcggacccgtcgtcaacctcgcgccgtcgcccggccgaaccctagccgagccgcgccaccgtctccttccaaatccggccgccccattccttctccagccaaatcatttgaggggaaataatctcctcgatctcctcttccttctcttttagaaacttcggctaatttcgtttggaaaccgacggatttgagctcgattcggatcgacttttctccctccaacccttgctttccatctcgccgccgatcgccgtgggcctccgtcaccgctcgctagcccctttataagcatccccgggacctcctctttccgccgccaccttcgccctagcttgtcgccttctctagcgccgcctccgcgttgctctctgcgtcgccgccgccggcgggtgtctagtcggtcgccgtcgtcgcttcggtcatcgccgtcgatcgctgtctccttcatcagcatcgtgaggtcgtcgctgtttccgtccaccgcttcgccgccgccgaagaccgtcggagcgccgctgactccgtcgccccgaagctctccaccgccgccgtcggtccagccgtgccgtgccgctgttgcagccgttgtcttcggtcaccgtcgccaccatcgggatcgcgaggaggagcagcatcttgtccacctctctgttgccgacgtttcccaccgaagcaccgccgtcaccgccgacccgaaggccgtcgccgcctcagcctcgccgccgtcgtcatccgtcgtcgtccgccaccgtccaagccactggtgagttcgccgagtcgagctctacccgttggtaccctccgtttgcgccgtctcgccgccgttcgccgtcgagcacgtgctcccgagtcgccgccggtgatgacgtcaccgctgacgtcatcgtcgccatgtcccgtg

SEQ ID NO: 17709 - DNA, 180 bp, Oryza sativa
catgcatccttcggtccaaaggagtactaaaaattccttcaaatttttctcttaccaaacgagatggttggaaaaattccattaaaaaaaaagagagatggatggaaaaatgacgcgttcctactcccaaactggccagtgggctctcctcttccacatgaacaggtgatgggccatgca

SEQ ID NO: 17710 - DNA, 1501 bp, Oryza sativa
gatcacttccattttgtcttcaaagaaagaaacacacattgtcttcattttatccagatagaacaacatctacacgctacgcacgaataattcttcttaaataacaacaaagtttaactacacatgcatatacataagcaaacagtagtactgcacgggtcatgggcgcctgcgccttaagctgctgctgcttcaatgcgagaggccgcttctgcttgttgagacgccgctcatctcgctctcgctcgcgtctctgcagccgcttctgcttcttcatccaagcaggcgtgtggcggctgaaaagcctccgcacgccggcctccgcggcctccaactcctcccgccgcggcgtgcactggtaccacgcgaacacgccgtgctgctggcacacccgcctcagcctcgagagcccccagccgatcttgacgaacttgaagtagcgggtcctcctgatgtacgccatgtacccctggtctcgatgcgaccacacgccgaatcggttctggacgatcatgttgctcgcgtgggcgtacgtgtacaagtgccgcttcatcgcgaacgcgcgtctcccttcgggcactcctgagcggcagtagttgccctcgacctcggcttctaattgtgcctgggtcggcggctccatgtctcgattgccgctctcgaaacgatcctgatgcaaacgagattataactagctaggagtaattaattaaccaacgagacaaagttgtattcagatacgtagacaaaggtaacactattacgttgttaactttgattcggtcacgtacaagttgagaaccgcagaacgctcgtatttaaacggggacaaccggacatatatggtggcggatgagtctcattccgcgctctctgcataatttataattaattaatacatattcacaacaatggcacataattagtactaaatggagtctggattgagtgactaacatagagcagttcaagttggcacacaacattttctgcgagacttgctgcaaagtgcaaactccagggggtgagagtgagaccatctgttattgtagcgagccagctgcatgacaggggcaagagaaaacatattcgtataaaaatatactactaccttcgtttcataatataagtcgttctagcattttccacatttctattgatgttaatgaatctagaacatcaatatgaatgtgggaaataatagaatgacttacattgtgaaattatcaatactagattttgggatcgacggcaaagataattgtctgccaatgtgacgattactgtctcatgcaagatcaggaagcagccggccgggaatcatcttcatgttggctgtgaatttgacgatccatctccattatattaagatagcagcaactcgtaacatgacatcagtattagctggaaaactctgaacaccagcttgcctacgggaaacgagaagtagctatgattcagtggacaaagtggaacgaataaaactgaactcaaacgtcat

SEQ ID NO: 17711 - DNA, 391 bp, Oryza sativa
  unsure (1)..(391): unsure at all n locations
cgcgctatgaatatccttcccgtgaatccntnccanangcccaatnnnagctcggnacccagatggcggcaaatctgatcacatgctgttcaattataccataatttcaattctaccattttttaatccactgttctgttttcttaatggggtaacttaaagaggtttggtggtgtgccatggactcatgggaaccttttttgattagtggaggtttggtggcctcttggccaagcataagaccaactcacacctgctcatttattccagatttctgaccagccttgacacggtaaatttttcggagggggggtagatctgatctgctgggtttgtgggaaggggcatataaggagctgaggcctccctctgagtgcatatcgtaggcagc

SEQ ID NO: 17712 - DNA, 607 bp, Oryza sativa
tttcacacttatttttaaattgattttaaatttacgaagaacccacgactaattgcgtaacgcagcgttgcttttttttacacgaggaaaccgcgtgcgggcgtgatttctgatcgctggcctccggcgccagcgatcggtcgcgcagcagccacccctgtagcggagcccactggatgtgtttaaaattttcaggggggaagggagggagggaccaccccctttcccctgaaaacccatcatcatcttcccttgatgggaactctagaaggcttccttccttgcttaatgctacaataccccgcttgaagtgccccatagaggttattcactctttccaaatcaccaaaggcattctattcggtagcgtagttgcacgcattggaaatctacttgtctgatgattactgcaactttgtctacagttcggaattttggtatttactttctcaaggttcgtcttattgtctttattactccccttaattttgttactttttcttgtattaaaaataaaaaattatgggttaacattgccttaatgaatattgtttgggggttttccaaaccttgcatgattaaccgtgtgtttacctttttttttaga

SEQ ID NO: 17713 - DNA, 1137 bp, Oryza sativa
tatttttattccttataggcattgtttgaagttctaattatgttagttgaagagtaagcgacgaagtttgtttattgagttaactcattccctacttcataatgctagaaaggactatcttaatcgagttcatttcctaccaaactaatctctcaattgagtttattttctcaaaatttgatcaaatttctccttgggttaaatagaaactaactagttaattgccttagttgtaagttccaaaccttaattttaccaacaattagtttggtaatttttctccaaccttcaggagcataaactatatgtagtattataaccatttgggccttttgatttataataaacatcttagtatgtccatacagtcctagaaagaaactcttttaatatgtttgtaatgatattctttgcaagaaattccatgtaaggagtacgtatggatgatacatatgagaatcggggaaccaagttaagttgcacacgaacttcgggttatcctgattcaatatagtggtgttttttgtgttttactagagcgcatccatgaatatattattattttctaaagtggttgctaaatattatgtaccttttgctttacaatctacattagagttctctatgtaattctaccatgaagttcttcatttcttatatcaatctacatcaatataataatatggcctaccagagtggtaggtcattctccctttttcaactatttgtgggaattactatattttaggtaatatagagtctttctttaacaatcatactaatatatttttcatcgatgatagacactactccctccgtcccaaaatataagcatttttagtatagtgataagttaaacattttcaacttactattaatagcaaaaaaataaaaaaaagatcaaacatgtaaaaatgatgttactagatttattattaaacaaactatcataatatgcaacttttttttatttaaaacatcttacttttatagatattgttggtcaaagtagcatctcggagactgtgtcagagtcaaaaaaaatcttatattttgggacggagggagtagataaaatcggataatgtttaagggtgacactattgtagtccaactaacttgtgtacgtgatatagg

SEQ ID NO: 17714 - DNA, 1077 bp, Oryza sativa
tgattgtaagatcaaatcagctggcacccccttgacacactcgaggctagccttggacctgcactggagttaagcaaatcttccaggccgtcatgtttcaacacgcttttagcacgcctagtgggacactcgaggctagccttagacctacactggagttaagaagatctctcaggccgccgtgtttttacatcaacaagatgatagctcgcttgttatttatttctacactttcgcactctctcttactttgtcctgtggtttgcggtgtgtttgttgtgttgcgttcacctttgcagagttggctgatggacgatgctccacttcatgcatccctaggaaatagtaggaggagcagacggatgttagggagaccacggcttcggcaatgacttttgtggaggtcgttcactatagtcgaggagtcctcgacggatgctacgcctctaggtcatgtgattcttgagttgggggggtgctctgtcgctggtgcagctgacacaatggaattaattggtcgggaggcaacgactggatctagaggtcgtgttgtggcatgctaggcctccaccgctgcacccatttttctctttcattttacaacaacaaaaaaaaattgcccaatcattttatgtaacctgacaacttgtaaaagttgatgatttatataggccttttgttagatgtaggcacttgaactgtaagtggaaatcaaggaatttatacaactagtgatttatttagaggtttgttaacagtattatgtaatttactctctatgaagacatgtgagggtgcctattagacgcagttacgctagggagacgaaacatgatattttataataaaaataaaataataggggttgaaagttttagatttggagatgtaagtttcaaaagtttaggtagagattttaaatgctgagttgaaagtgttagatttgaggtggaagttttaaattttgatttaaagttttgaaatttggttaatattttttaagaaaaattgagctcgttgttttattcagactcttattttttttcaaatttaattttcgttaaaaaaaatcacgta

SEQ ID NO: 17715 - DNA, 1501 bp, Oryza sativa
agcgattctgcatgtttcgcatcagattaccacaaagctaaaaaatgaaacaattcatccaaccaataactcgggtgcccgcatgctggaagagataaccggcggcgaggaggattaccgcgaagagggtgagcgagacggcgacctggaaggcctgctggacgaggacgcccctgacgacggtgcccctggagacgacgttcttggcggcctcctcctccctggggtgcagccggtacacgtccagccgctccacgccgtccagcgcgaggtacagccccgagtagagccagtacacggcgatcggcacgaacgtgcccagcagctcgtccgacgccccaatccccatccccccgccaacccaccaatcctcgggcgcaaaacacgccccccacaacgaacgtcgagccgggaaggccgggagagagatgggcttaccacggcgcagcgcggatccccccggcggcggcggaggaggaggaggagatgttggaattggattcgtggaggtggctggtggccacggcggaggggaggtatggataatttaggcggccgtcgccgtcggtccgaacgaggagaggagacgagggaggagaaggtggggaggggagggggacgggcgttggttgcaaaggggagcgtgtggtccgggttcgtgcgacgaaccgggcacatgtgcctgtttctacttctcgtgcaaaaaatctaaggaaatttcgtacgagttgaaaagaacagctaaacataacttggctaatttttcttctctgatttggactgtgtgatctatggtttgattgcattttttaaaatagtttataataaatttactggtgccagtaagcgcatgaattactgtacattttttaaaatagtttataataaatttactggtgccagtaagcgcatgaattactgtacattttttaaaatagtttataataaatttactggtgccactaagcgcatgaattactgatgctaatcttgaagggacgtatacagagctcaatccacaccatctcgtattttccaagacctggcttggaacaccagtaaacacatgtcgattctaaagtttctctttgcctacgcaagacatgaaaagctagacaacgcttcaggaggcaaaatcaatcgaaacagaatgtttctaagcgaagtgagcgaatcctggattccttcgcataaccactttagcagaccaggttagagccaaacaactgaagaacgatctcaggatcatttagctaagacaagacgtaccacatataaaaaatgaaagggcaggacgataatgaattccctttcacgacacaaactaaatactaggcagacagctaaataccgcacattttattttgttcattaaatctgatgaaataaaacccatgatccagtataaaggaatctatgttacaattgggataaaaaggaatcgatactctgcagcaacaagtacgattaacttgtagcctgactttcaagagagcaggag

SEQ ID NO: 17716 - DNA, 1501 bp, Oryza sativa
ttattactgatgcaacctttatcaaaactaggaaggtggcccgcgcatacgcgcgggcacttatattattgaaaggtaagatttttattgtttgttaaaaaaaatatctcataattaagggcaaactaaagttcggatattgttattttataataatttaagggttcgattttttgttaagatatcttaaaaatccatttacaaactttgagtgggagatggattaagtacttacaacttttgaaatatatttttttcttgagtaaatagattaaatcgtctcatgaaggtgcatgatatagtaagaaagggagggaagcatattcatggagaaaagaagaaatgaaaaaataaaaaaagggaggggagtaggtgcgtaccaaaggtggagaggtgggacctcgtagtatttagtttattctaatatcaatttaatctaatagtttataaactattggacccatcgattcaagtgaaaatcaagtaatagatactttgcttttttttttcttagaatttctaatattttctctaatttattagagcaccacgtgtcatcttgagggcattttaagaaattttaatggacttaccacatgtaattagaatattaacatgtaatatatatgtatgggatgtatgttaatattcgttctagcttcgtccatgtttatatatatgtagagaaaaattaaatatgtcgctagcaagccattagatgtttaattaatagcaattaattttgacacctatttacaattggtcatagtagttcttacagattcatcatacgattttgattatgcgttgatcaccaatttacttatcaccatgactcgcatgaaaaaaaatatgtactttagaggttaggataactgaaattgatgaattatcttatttatgtgatagctatttgagattataaacgaatgaattgacttctaaaaagttaaaaagttgtttaataaaagcaccatttagtaacttggaaagcatggagcgtgcaaatgaaaattcaaaagatggaatcagggaaaaaatagggccttaaactcccttataacactcttatcctagtaagagttctattgatattcgttaatattgtgttcacaattataacataatgatttctttcaactgtacgaacaaataatacaaaatccaaatacaacataacacaatatattataattattatttaataaactctcgatttcatcttaaacagagttaagtgttccacggtacttaattcttctctcgctgcatcacacctttaatatttttttcatgctattaacaaaagtggtagcgctgcagcggtcgtgatcacccaagatgcctcaaatacgacactttgtcacatgtgcgaaaggtagaggtgcagacgtgcattgtgcagtgggccaaaaagagaactttagacattattaacaatagatccgatgatttaaataatgggtccaccggttttagtgcaaatgtaaattagtttata

SEQ ID NO: 17717 - DNA, 1501 bp, Oryza sativa
cctggctgagtaactagcttatcaagggagccttgatgccgagagacatgtggattcgccggggtggtgtcggggaggacccctgggcttcctggcatagtatggtctgggacctaacctgttgttggtctgggacccctctcgtcggcatatggtaaacctgtgtcggcttacgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattccttgcgtagtgttgtttgactactgccttgtgaaattgctgttgtggaaaggggttcgatgtttgaaaaatctgcagctgatgggatcagctaggcccgggtggccgtttgaaagttgttggcccgggtggccgtttgaaaagctgttggccgggtgccaaccttgattcaattctaaagactgatacattgcacatacttcaaccggacgagacgcactgtctcatccatgtcgtttgagaagcactcacttagttgctttcagaaaagagttcaaataaaatcaattacaaaaacaacagcctttccttgaagcctgcattaaacacttatttcccatggcttgctgagtactcccgtactcacccttgctctacataaataatcccccccagttgctgaagaagatgaagcggatcccgctgacgaggagttcttccaggagcaagccggctacgatgagttttagggtttcggcctagttcccaagtcgcgcctgtgttgtttggtccaagtcctggcttccgcttcccttttgtaatgcggttgtgagctcgggatctgtccgcagcccgacttgattgtactcctactctataataaagagacctctgttgctgtgatattctgtcttcctgtgataccagcactgttttctgggactggtatcgattaacaggttaatttggagcgtcacgggctagttccggtcggtaatagttcggggcgtgacaccaatcccgtgttcgaagaaatcactcttcattgaagcactgcaacagcccccgtgaaatctggctgcctctgcatcgtttctttgccatacccgcatgagggaggaagaggatctcattctggaagctaagaatgatatgcgatatctagcattgccgtaaaatattggttaaaaaaatacccaacacaatcatttgccacccaattctttttattgccaaaactcatcgttaccaaatatgttttctgattacacgaaatacgcatacatgcacaccatgctcacatacacgcaattccgcaaatagacaccccagcacacgataaaaaaaaacagagaccaacgacaagtctgtgggcatcaagattttaatcatgatggatacaataatacaacgatcactgtggcacccgccacacttgat

SEQ ID NO: 17718 - DNA, 618 bp, Oryza sativa
acaacttatacgacaaagcgtatgtttttgcacttgttacttgggccaggttaattagacaggcaactgcaaattaagcacttcaaatcatatgcttgttctgcttcctacaactgacaggtttactggtatgaatgaataaatgaaagtggagaggcactcaaaagaaaatgtcattctgtatacttttgtttcctgtgttagtggtgtgacagtcaatgttgtctgatagttgattaattttctgcccaccactaaccatatgtaatgtagtccaccatgttataatttgtatcatcagttgtggatgagcttggttagttctttgtcagattcattgtgtttgtgttaatcgttcttactttcagagattccctaaactgtaaggggattctcagccatagtagtatatacccgggatcaatattttcagagaaagcacccccactcaccaaaatttatctgaatcatgatttgggtccggttcattcacccattcttcaatttagctgtctagtatcatctcattgctttactgcacgcatatgcatataatagattaatcttaccggaaactaattttgttttcttgaactgaccaatctcaccacaaaagca

SEQ ID NO: 17719 - DNA, 1363 bp, Oryza sativa
cgccaccttgttgactgcactcgacccacaccagcattaatccagtcgtggcctaaccgcaactacatggaagtaccatggttacattatggcaactctctctcagttttaagggttgccgcgttatggaggtcaactctaaccctacccgtgtcatcgataataattctaaatcgaactgtaacctgttagaactaatatattcgacacctgttctaatagacctgacaactccggcagctgcctaggctggtaggcaaacacataataaaatttcgatgttagtgcagcaatttgaagacattcttttaaagtaaatattcaaggtaggtagttttattcggctctaaaaatttcctgtatccaccgttggtcccagcttagtggaaaacaccattataattgagatgggaggtcatgagagagttgatcacatgctatacataactatgaaggtcctcttataactatgtccaggtcaattggcatgccagcatcagtcacagattcatgtagtataacggacaaaggaatgcggtacgatctgagaggtccatcttcttactagcactgatcaagatatgtgaggttattttccataacgatggtgaatcagctgatcacatttcttatgcataaaactatgtgtgtgcacaataagaaaatgaccatttatatgtgcacctaaaaatggcatttccatagatcgagagaaggaattttagagagggccgactaacacgccacatttctgcttattgaatgacctaagaccagtaagacgtggatttcgggcataattaaggatgtcctgtggccgttacaggggtaactagtggacaacttgcctgtttgttgagaagccttgatcattaactagcacgcagtattaattccagttgacacaaaactgtacatccacaccgacgacttgacttgtatgtatgattgcatgcccaggatttttcactttcgattttcgcttaatatttgggtaatttcgatagcacaaaaactcctgaaatttaggcaatttttggactgaaattattgaaaattttagcacaacttgactgaatttcaataaattttgggaaaatacacaaaagtttgagaaaatggaaaatttcggccaaaaaaatgccttgcggtgggggcagagggttccgaatttttgaaccaaaaatacattcactgtgcatgtcctggaactgatggttacaacccgtcacagatgaggaaagagttcgtggtagtgatgccctggaactggttactataaaacacaatggaatgaactgcacttaataacacacaccaagcaccaaatcatagcaatcaagcagccccaatcacttgacca

SEQ ID NO: 17720 - DNA, 1501 bp, Oryza sativa
ggagccatctcatctcgcaacacatcttaaccaactattccagctccactatggtgccacaagacaccccacctgtttgaaaccactcaggttctccgtctgccacacagaccggctctggaacgattccggcccatcccacaaaccaatttcaaaaagctttcaaaatcagtgctacgctaagaaaatcacctcacattcgcccttgaccgtaagcacagctgttcgaacagtttacactccacataggttgtacgctttacccacatggcacgaaactaccaacggtcacccgtcgacaccagaagtttgtggcaaggcctttctaaatctagttcatgaaaaccccatgccacatagttagttgaatcgcacgacaagcatcaggctggctagccatcgtctactcggggtacaacaaggagtcaaggatgctcctacacctatttgtaccgtaagcagcacaatagagacgattgccatgaatggtcaaaatctcacaacacaaaactccgtctcctcatccccgttgtccccaaccactgacacacaaggtaggcacaaacaaactaagtactacaagatgcttggatggaattcccaaatgaatcggtccttaacaacaatacatagccaatcacacaggttcagcctacatatcatccaggttcataatccagtttcatttatcaaacacaccaaaataaaatctcgggttttgaatatttggttggaaacccatgtttccccatacgacaatgcaatcgcagcatagctaagcaaaactacctcagtgatcatacttgtatggtaagttaccgacgcattatctgtggagctgtccaggacatgttacttcaatatcctactagattcaagtgcgactaataggtgagtccgtcggttgcattcgcaaaccgagaccaaacagtttaacgtgtaatctaagcatgcatatttccaaacaacataattttgtacatataggaagcaatatggccaaaggtggtttgccttggtcctgcgtggttcttcctcatcaagaatggcttacggatcgtcctcaggcttggcaactacacgcaaaaaggagtaaatcaacacaaaagccactaaagtacctaaaatagtaggcgataatattgccaatagatagatctcatttttatagagattttgagagttgaacggagtcaaacggagttaccgtttgcaagatatctatttatgaagttcaagttaatttcagaacgaaaggaaaaagagtttctttttaatggaaaggaatattctggaagaatattcctcgtagggcccactgtcagtggcactgggggttcggtgcacgatctaccgagtccaccgagcacatggcgcggtgaggtggtggatcggctcacgatccacgggtcggtgctcgtgggacccggaggtcagtgtcccgatgcacatggaccgggcgcgcagaacggataaacaaaggtgggtcccacatgtaagc

SEQ ID NO: 17721 - DNA, 1501 bp, Oryza sativa
cgactggcgagaaagagagaggaagagtgagagagaggaaaagagagagaaagagtgagagaggagtatggcaggtggatcccacatttctttataaataaaatgctgatcggactgccacgcgtacgctacgtaggataaaaccgctctggattgagtccaggggggtaatttgtccgatattgaaagttcggagtgaacgatgtctggttttcgagtttaggggggtaattcgatcgaccgcgatagttcgggggtgggtaatttatactttttccttaaaagttaccctcgaatcgatgaagatcgatctgaccagaattgatgtgccgatttgacatcccaaagacctttggtctaaccggtgttagtaatccggtttgaccgcccggaatcgccatcgttgcttgttcccaccgccagtgtgaccaatgaggtcccgccagttgaaccaccgaacctgagaaaaacacaaattgcaaatctcccaaagtagaatgaaactttcttacttctatttgtgtttacaaaatacaacatcatcactcatctcagaaatcttgactaaactcgaagtcctaactttctctaaactcaacttactaaaaatcaatactgggaggcctcactttatatttatactcgaggtaggcagcataagcctataatctaacttatacaagaagccctaatatcctaggaaaccttcctgtataaaaaaacaaacttttacaaactctaatggtaccaaatttggactcactccaaatttaactcctcatcccacacgaacacaatatctccatcacatgccatatggaatctccatctaccacgtgcattgatcttcagcctaagcaccccgcaagatatcctgatcgttcagacgtaatcttcccccaagttgactactgatccatctccgacaatgctctccaaaggcatcaagactcacctacacatgaatcaaataagaaaccatatttgagcacaagttcactctaactttactcaacatgagcacacaacaacattacatatgcataggaatcatctaaaagtcataaacacgaattaatcacgagtatccaattaaacgacccgaaaccaaaaccgacgcagagccggtctgtcataccgtcaggttggtcggtctaactatgcaacacacgccagtctgaccgacagcacctgcccggtctgatcgatcccgttagacaaaaatatctgttcacaatatgaaaaccacatatcttcaaaaccacttcgccaaatatctctaaatatcaaaaccaactatcgcacatgccaaatgttcatcacgaagtaataatccaaacacactttgatttcacaggaagaaatgccatagaagatccaaaactgataacccacgttggccccataatttcttaatccaatccgcacagtaattatcttcttaatcctccctaaattctcacggacatgtgggccccaccgtttttaatttctatttaaa

SEQ ID NO: 17722 - DNA, 260 bp, Oryza sativa
tggaatatgatttgaattcactggtaccccggttcattattatggcctaccagaatctggatctccaccaatttgtaccagccacggatgtcgcgcattcgcggaattttttttatttttaattttttttattaaaagttttacaaaaataatttttcatttttgaaaattgacagaagtggtcgcctaccgccctctgggagggtgatttttaaaaatcgccatcccagaaggcggcgaaagtgacgtggcagatggcc

SEQ ID NO: 17723 - DNA, 203 bp, Oryza sativa
agtctagcccagtagacacattgctacacaagagagacagaaggagtatgttgtcaatatagtaaactggaggtgcagtagaaaaaaaacatatgaaatgagaagctccaatgtgttcttaatttttgtaggtttcaatcttagtttgttgtccgacgagctattaaattttatgttccttcaggccaagagcttatcaaatg

SEQ ID NO: 17724 - DNA, 559 bp, Oryza sativa
tatgacttccaccgatttttgaaaaaaagggtaaatatatgtttccaccaaataaaaaaggcttgccctccaaccgtttccataaaaagtgggaccaattattcaggggataaaaaatgatgaccaccaaccggtttttgaagcaatagatttcccttgttggaagccccgttaaatcccaaccaaaaattataccttcccaggcaagttaccagatactgcccgtaatgcatttcaaggtagcatattctgcaatgaccccaatgtagttagtaaccagatgcgccccgaaatcttagtgtcaaacaagatttgaaatgttgatgaagatttagggaaatttccatttagcagtggatctgataaatttgacaaaatagaaaaatggataccttcacgtgcattaggatctgctagtaagaccctataaagttgaattaaccgtgaaagcatgacactaggcagagtagtggcaccaagaagtatgcctgatgaagcacccggcctggagcatatacatatatcatcatcaagcacttaacaatcttttacagaaaca

SEQ ID NO: 17725 - DNA, 381 bp, Oryza sativa
agacggaaaagtgaaatatagattgagggtataagaggagagagagttagagtggaggtgaagtaaagtggagggaacccccccccccccccgaaattttttatttttgttttatttgtttgatatttttttttcacgcttagggacacacaagaaccaaccatagaaaaattgaactcaaatggacgtaatatgtgacatgtagaatttttcctctcctctcctctctccgaactagtacagaggagagagatgtgcaacttttttatttttattttatttttttgatatgttcttcacacttaggaactcacaggaaccaaccatgtaaaaaataaactcaaacggacgaaatatgtggcatgtggaattttccaaagc

SEQ ID NO: 17726 - DNA, 343 bp, Oryza sativa
actcaatcctgactttgaatccggttacagtgtatgttcaaattaaacctaggattgggtatactcagggttggaaatttcggtcattttggatcccttcgatatgatattttttgggccaaaatttttcaatttttcatgaattttgataatatttgttcaaattcaactaaattttgttcaaattttggaaatttccgaaatttcggtgacgccagatcaaatcggctaaaccgaaagtataaccctgggtatactcacattcaaatctaggattgagtttgttttgggacatagaaaatatttatcaagaaagccaaatacggtactctgcttttatagt

SEQ ID NO: 17727 - DNA, 338 bp, Oryza sativa
aatttttgggttctttcttataaaaaattgaatttttgtaggcacgtggagcaatcgcctgagcataggtgtatgtgaaaatctgagattttcctagatggacaaaacaactgcatgtgaaaaaggattttcataggcaggcatgttatgctgcccgactgcaaaagttttttggtgaaacaaataaaaattctaaaaagaatattccaacaactctaactctaatatacagtgaataattgtctccatggttgtccccgcaaatggacgccgctgaccatactggcattatctccgattccctcgacactggatctgtcgtctccgacctccccagt

SEQ ID NO: 17728 - DNA, 296 bp, Oryza sativa
gagagcgaacgtggaggctcctttttctattcctttaattatataatagatttccagatattcttttacccccaaattccaagtagtaacagagaaagaggggcaaagctagtacaaattacaaaagcaatagcacttgagagaaaaagaaggggagaaaaagtaaacacacatccacccagctagtgcttaaccccattgtgtgtatggattcagtgcagcagctgcaggccaagcaggcagcacagcactacacatacaaggcacacacatcccatgctactagtgctgttgcc

SEQ ID NO: 17729 - DNA, 646 bp, Oryza sativa
acagcagttcatcacgtacgcgcacgcgccctacaccgtgctgacgctgcacccgcagcacggcgttccggttagggtgcggcgactctgacgtcgggttagggaaagaaaaaaagatgaaatgaaatgaaatcgtctgtatagatccgtgcatccggcattctgaatctctgatatcaaagcagaacacatttgctgataaacactggaagctccatgttccgggcatccggcactctgaaatctcaatctctgatatgaaagcagaacactatttgctgacaaccgctgctgcagttccttgcatagttgaagtgtatgagtatccgtactccatatcacgggtattcagctggtcttcttaaatcctaaactgttaaggtgtgttctttccccgagaataaaatagaataagaatatacatgttctctattggtgtgattttttttaaaagttacatataagttatttaaaatattacatttaaaccattcttttacttaatacatttgtttgtacctcgaattattaggctatttagtattccattcaggcaagacaacactcccaaacctaccagaaaatgatttgccactacaagatagaagatggatcaaggacatcaccagtgccttaggggtctagg

SEQ ID NO: 17730 - DNA, 290 bp, Oryza sativa
acgtggcgctaaggtagcattaaaaataaaacttatatgggctgtatttgtcattcacacaaaaagtaattataggacccacatgtcatccctatgaccctatcaacccttctttctcctccctctctcccttgagatttaaaacttccagctcgagatttgaaattttccatgtctaaatttgaaaaatttaaagttaaaatttaaaaattactagtaaaccaaccactagtaaaaataggaagctaatctaaactaattatatttttttcttttatccgtacggcagg

SEQ ID NO: 17731 - DNA, 1331 bp, Oryza sativa
ttttttggagggaagggtcagatggacgacgactgtgagtgcaatgagtgaggtggaggacagtgtaatggtggtgggacggtgccacgtaggcgacatgcccatctctgtatgtattttttttaaaaaaaagtaaaatgacacaaatgttcttttcttaaaagaaaaaaacacaatgttcgagcgtcagcttgagaaatcagaacgtctgaagcagaaggtttagcccagaaatcaaaacttcagctaaaccttacgcatccatgggcctcgttggttatagcctgtgtgcatcaacatggggtgtttgatgggccggaagatgttttccgttccaggcccactgatgactgaacattttggggggtctgtctttggatcagcttctccttcctccggccctatcgcgcggtgcggtatctccgggatttgcaaccatacatcctctcctccattcaaagcgccagtcgtgtaccaccgcccgaggcacgtagaaccacgccaagatgcgtgaacccccgcttgcgtcgcgtcgacatgcgcagcggcgcccatgctccccatgtcgttgtcccgctcctgcaagagatacacctatgttagccacgtcttttctgtttgagatccttccaaatcctccccccatcttaatttcttcccatctctccggcggcgccggcgccattcgccttttctcccaaacgctcaccggctggcagcccccagcctccccgcctgctcgttcggccggtctcggcctcccccttcgttgatctccaacctgagcaccgtcgaccacgccgacgccggcgacgcctcgcccgcgtacaaggtaccaggtactgcatctgcatgcatactgcacacacgtgtcttgctgaattcctccaccgtggcaatgcggcggaggtcgcgctgtgacctcacctcacctccggctacgtggcgccgtcacgtggagtgattcactaccgtaatcagtgacgtcagtagtatcagataggatttcggagttattctgtgggacaggatggtcactaatttccggttttggttttaggatatcattttctttttagtgttggagaacaggagaaggcaatcattgattgttactttgttagtaattggttagtatatctgcactgcactctgcacacacgtactgatctctccgtcccgtttgcttcaacaacacatttgctttgctcggtacatgcagagagaaaaagaagcaatgggcatcggcatcggcatcggcatcggcatcggcatcggcaccggcaccggcgcggcgctaccattcggcgaggcctcgccgtggagcctgc

SEQ ID NO: 17732 - DNA, 1165 bp, Oryza sativa
ttaaaattatgttgtcattttaatatatttgaataatataatgagaaaacatatatgctattatatgagagaaaatataatgatgctagccgcgcaatctgcgcgggccactatgcttgttacataataaggtaccaaatggttgacctgtgacgactaatcgggccattaggagatcatcactagcgttttgactgtattttgcaggtggtgaggagtgtattagattaatactaggagcaatcaaagtatcaaacacttggaacagttatctagccaagttacgagcatgagccttaccacacatttttcaactccttttttgatacttatataaaaatattatctagccagttgctccatccgttcatgaaagaataaacattccatggtatttaaaataaaactttcaccacatattattattacaaactatttaaaatctacatataatttatagcaccataaaagtactattcaagataaatctacgcatataatttttgcacatccaatctaagccttacttatcggacacaactaaatatttaatataaaacacaattctacaataggatttttgaattattttcaccatattatagtttttagccttgacttttaaactgataatacacatataaaatgttttacatataaattgttttttctttatttatgtatctccgtcttatctattagaattaaatgggataggcccaaattaattcttgtaatttcaagggctcacaattaatgttaagagattaataccacattaaaaaccaatgaaaaatgatcttaacttaaatagactactagagaatacctactgagcggttgagatggtggtgggaatgtcacacgcgtgcgctcgagccaagccaagccagccagggcgtcaaagcggcgggttcggacgggctgctcgttttcagccgttttgtttttatgagtaaaagcataaccggcatgattcattactccggtaacagacgaggcctatagtgcaatcaatcgagattaacgtagtaatgtttctcttgcgttatcttccacctctaggtagatagagagctctctctcggttctatctacctcagtttttggttcttcttgtgtagacacctcctctgcttatgtgctcctatggttgtttcctagt

SEQ ID NO: 17733 - DNA, 456 bp, Oryza sativa
ttagtacctaatccggtggcttgatcaaacaggaggccgacttttgtgcaggcatccttccccaaagggtgacaagaaccctgtaaactatgtcttgggtttgcatggtgcatgagctaacgacaatgattttttctgttaaaaaatgggttaacgacaatgatccagacattagaggtagtttttttatttgacgaagataacccactcctgaatcctgatagacatgagcacagcaaacactgggggttgttctaaaagcaagatggcaagatgcatatatatgacctgtcataggtcaaatgcttcattcagagttcagacacactcaacctgcatagctcatcctactctcttaactctcaatctctcccagcttcttcaaaatttcctgcgagacaagatgaggatgtccaagttgtcaatgctactgctggatcttgctcctggtagtga

SEQ ID NO: 17734 - DNA, 213 bp, Oryza sativa
ttcctgcgcccctgacacgcatcagacacgattaattaatcaaagtcgttctcatcatgctgcttaactaatcaagcacacatggagttgtactgtggatttgcattaaaaaaaaataataattacaacagaatttacactgactcggatcactgtctggttgcctccggcccaggcaatttaactacacttttttgggcgatctttcccagt

SEQ ID NO: 17735 - DNA, 250 bp, Oryza sativa
gggaaggcgtgagaggtgtaaattaatcactagtggacgttgacggaccatcgtttcgtttattcgcgaaccgtaaatgaaaagtaagagtgaataaaaacttttatatgtgtttctagtgatctagaagcaaagactaaaaaataaattttaataaaaaaaatcaaaatcagctctaaatttaaggttgaaaattttaaatttttacggataagtattagcataagcggaaagatgaggccttctcctg

SEQ ID NO: 17736 - DNA, 933 bp, Oryza sativa
tcctctcaaactcagaactttttagttcccaactttttttaaaaaaaactttcaactttaaactttcctacacacaaacttcaacgtttcggtcaatttctttaaacttttaattttaacgtggaactaaacacaccctcaaacgttaattcagagatgagataatctcatctcatgaatcattaagagccatcgttttgttattcatgcggcttatctgaataaaacttttatatatgtgttcttaacgatctaaaagtaaagattgaaaaataaaatttgatgaaaaaactcaaaatcaactttaaatttaagattgaaaattcaaattttggctgataagtataagcatgagcgaaaagatgatgcattttgtcttctttgatttattcatgatttcttttcattttctaatgaggatgaaaaacttgtctggttcatttctttattgcggagaagtggcccgagtagtaattgcaaagtaactcaaaacattttcaagctgaaactaacccaatttcattctctaaaactgagtaatggggattccttataataaaaaaaaagtagcagcagcagcgaaaaggcaggggaaacttagccgcgtaggtgaagtcaagagacgataatcaattaaagatgggggcaaaatcatctcgaaacttcacggaaaagaacagtaaattactcacagccacagacgctgacacgcacacataaagagcatttgctttcaggccaagcttcacggccgacctgtgaacatgcgcctctccacggagctaaacccatcatttttttcccacttttttaaacaaagattttcttttttgaaaagaagaggaagagatcattaaccaaccaactgaaaaaaaaaatcaagcatgcatgcttgatctgcatcagtaaaattcgcataactgaacaaaggat

SEQ ID NO: 17737 - DNA, 404 bp, Oryza sativa
atcccagcaccattcattgactagacagatgataacaacactgcgaaaacaaaaatacgtgatcaaaaatcttacacgacgaacaatccaattctgagttgtcgcagaaaccaggatagagggggaggaaaatcttgggttcataccacggaccgaatttaagatggagaaaggacacctcattttttaccggtcacccttagtgggtgggcaaatgtgactggaatccaaagagagatttggtgaataagaatatgatgtgaagccctgttgctgttgctcttctttcaccatttacagtgtgatcctgatcttgtcattgcaatccttctgtcattaaaatccttctcaaacaagagtaggtatttaacccttttttcttttttcctttttttttttgcagt

SEQ ID NO: 17738 - DNA, 1501 bp, Oryza sativa
tcttttggtgattttgggacttgtgggtaacattagcgtgtatttgtgctatagtgaacgcttttgctggtttctgtctcctggatgcattgaaatgaagtggtattcaagatttaggctcagattttcgattgttttgcttatctaggagtaggatttgagaagatttgcagtattggcctattggttaaatttgggaatgcactggtgcctttactagtggcgctgcattttctacgtgcatcaaattctgaaattttctgttcagataactggttcttttgcaattacggatgttgtgctaagagtcaatgagcattgtcttgtgtttttttatgataaaactacagtgaattttgcagcaatatactgacctctgctatgttatgttggtttagatcctttgcagggggatttccctgagacgattgaggagttcttgcagtatgggagtatgaaatgcatagcattcaaccgcagaggaactctccttgctggtaattatcccattttatattcctgtaacagtacacttaaattgtgctcatatgtaattatcttcttatttcacacagactgtttattttacactgtgcgcttgtgaagcatgcctgcacgattaatgttagttttaatctgtttgaagtttctttagctgttaacacttaacagtaaccaaagccatttcttgtagcctgaagtagttccttttcttcttttgtgttgtctccgcatctctatttatcttggcattgccacatataagtataacatgatgatatgataagggatctgtttactttaatgcatccttttgttcttttctaagactaacctgtgcacacctgtaaggccttgtgatatatctatacacagatgtaaaaacatcattcatgtggagtgccataaattttggtggactgctgctttgtacttgaaccctgaaagcaaatttatccaacaatttatgtcagttgattttttttttcagctggatgtgcaaatggtacctgtgttatctgggactttgaaacaagggggattgcaagagaactgcatgataaagattgtactgcacctataacaagtgtggcctggtctaaatatggtcaccatttgctcgcctctgctactgacaagtcattgacactttggcatgtggtaaatgagaaaaaaattgcccgcattactcttcagcagactccgttaagtgtccgtcttcatcctggtggtccatctaccccatctatttgtttggcatgccctctctcgtctgcacctattcttgttgatttaaacactggaagtactacagttctcccagcttttctgtctgataatggtaacctccctgctcctaatactcgcaataaattttctgatggttctccaccttttacaccaactgctgcaacatttgacaagtatggggatctgatatatgtgggcaattccaagggagagatattaattatagattcaaaaagcatcaaggtacatg

SEQ ID NO: 17739 - DNA, 1501 bp, Oryza sativa
ttgttagcgtgacgtccacgtgtcatcctagttattgaaaaagaataaaaatatcctctctctctctatgtgttccacacactctttactctttctcaccctgtcaacagagctgaccggtggcggcaggggattgaaggttgaggagtgcacagcagcggcaaaagggatctgggcgtcctgcagataagggtgcaagcagctacccataaaaattcgcttataggctaaaactaacttgggaactcgtttatttcaatctataagtgagttcgcgtgtgacccacttgcatccctgcagatgcatcgcgcggctgcgggtgcgtgcgtctcgtcaacgggtccagggcttcggccgccggtgcgtcgtgcagatgcatcgcggattcgcggctgcgtgcgcagcatgggcgtcgcgcatggagctgaactcattttgtggacgctagcagcagccaagggggaaagctcccacacgaacagtcttccgttgctgccggaaaaattaacgagaagacgagaaggatagcgtccggattccgatgtctgtgtgtcttgtctgtcgagtgattccaaactgagcagccaattccgttggtgtgtgtggttactgacattagtgagcatgtagtagaagggaataggatcgtactagtgcagataaacagatgatgttctctagagaaaaagcttcgatacaacaacttgttccaatttggttgcagtgtccacattagcagctgcaggcatccatcatgcggtatggactttcaggccgactcccctattgcggttgaaacggaagccactagcccacttactgtgtttgtgatactctcaaggccctattgaatcacatgaacgaaaaaacatggtaacagaaaaaacaaagaaataggatatgaatatatatgcaatacaaaaaattgaaaaacacaagaattatgtaggaatgagtatttgattaggaaaaaaaaggaatggatttcaattattagaataaattgggttggttatttacttatacacatctaacatacactaattgaatagaaaaatggccatgagctaatagatttacatcgaacctacgcgagatagaaaaacatgagcttagagtggatgttaaatttttcacgtttttcctctagattcctaggaacatgaaagttcaatttcatgtgtttttcctttcctcgttcctactaaacaagagcatgaatagtgtaggatttcaattcttttgtttttcttctattttttctccaattgaaagtggcccttaaagtctagtgcttagataggcatgtatcacccagttcaattagacatcatatcacccgctcaattagacattgaaaggcacatactactccgtcattaaaaaaacgaatttttagatatgtgttcagattcataggcgggattggtttttttggacgggggtacagatatactagctcaattcccaaatataagtatttataattgtgatggtcta

SEQ ID NO: 17740 - DNA, 1501 bp, Oryza sativa
cactactccctttatccaaaaaaaaaaagctaacttaggaggaaatatgattctatcctaatacaacgaatctagatatgatgggttacattctttgttaggttgtttttacaacgaatctagaaatgatgggtcacattttttgttaggttgttttttttaacggatagagtacttttagtagatggcgctgttaaaccgtccaaacgaatgctgctttgttgttgcacgggctcgtgattcgtgaatgccaaatcacttgaagacggctggtcatgtgtagaccgatcgtacacccatgtgaggtagtagtgagtatgaccacacggtccacgggaatacgggatcgtgatgcggctgatctggagttgctggaccatgtaatacagatatctggaatttcagcgtgcgctactgtacatgtgttcgctgtctggctctgggcacgcaggtttaggacgattggcggattgggatataccaatcatgtataggctagtaccatcgctgtgtaatcagttgtgattactcgttgttaaggactggagttcatgctgatatatatgagagttacccatattctcgggatgggaataatttatttgtgggatacgactagcagaaatagctaagcaaaagatactctccatgcgggcacggcagttccagctgacagagttcaattgggaagtgttaatgtggtcaccctgggtcaccatcaattgtaattataactaatcgcctatgcagattaacactgacgtacaattgcttatctattgtattagcaaaaaaaaaacagtgtcatgattaacatttgattaaactagctatactcctccgttctaaaatataagcattcttaattagcaataaaactgaacaagtgtttattttaaccattgctagttatgcaactagaccatcacaattataaatacttatatttgggaattgagctagtatatctgtacccccgtccaaaaaaaccaatcccgcctatgaatctgaacacatatctaaaaattcgtttttttaatgacggagtagtatgtgcctttcaatgtctaattgagcgggtgatatgatgtctaattgaactgggtgatacatgcctatctaagcactagactttaagggccactttcaattggagaaaaaatagaagaaaaacaaaagaattgaaatcctacactattcatgctcttgtttagtaggaacgaggaaaggaaaaacacatgaaattgaactttcatgttcctaggaatctagaggaaaaacgtgaaaaatttaacatccactctaagctcatgtttttctatctcgcgtaggttcgatgtaaatctattagctcatggccatttttctattcaattagtgtatgttagatgtgtataagtaaataaccaacccaatttattctaataattgaaatccattccttttttttcctaatcaaatactcattcctacataattcttgtgtttttcaattttttgt

SEQ ID NO: 17741 - DNA, 348 bp, Oryza sativa
atgatgatccaaggtaatcaatgcttaatgcttataacagaatgcgttcattgttgcatcattatctgatttaagcttgttcaaaactcttgggcacatgtggtcagaaaaactcgacggagaaggtctgccagattgaaccctggatcttttgaggtcgcagagatctgtgataaattgcatgaggatgctactgttccttcggctcctagttctaatgttccaaagctgcaggaaccaaatgctggaaaagatatggtagggttttactatttctttctgtttttctgtttcaaaaaaaatttcacaatgtggttatgattttgtgctagatttgtggtggcaaga

SEQ ID NO: 17742 - DNA, 228 bp, Oryza sativa
gtttgcggtttgtctacttatccattagctccctacctcaccattcttgtgtcaatgtttgtttatacttgtgcaatgctggttcaccaggcctgtaggttgagcacatagtttgagttatagctatgcataatggcaaatgagaagtgtttgtcttacttcattgctgattgttttgtggtagttacagactgtttgatatgtctatgttttcttcttccttgcagg

SEQ ID NO: 17743 - DNA, 219 bp, Oryza sativa
atcagcaccaactttccgtttatgattagcagccaaaatttaaattttaggttaaaagttgattttaagtttatggttaaagttgattttaaggttttttttatctaaatttattttctatttttagatcgctaaaactaagacgacgtatataaatttttaattacaaattatttagaagttttaattacaaattatttatcgtttgcaaatacgcaa

SEQ ID NO: 17744 - DNA, 502 bp, Oryza sativa
cgacgataatatagggtaaacacgtagcaagagaatggttacgagaccataggcttgtagcggtaagacgctacgtggactgtggagaagtgtttataatcggagacatataagcttggatttaacttcgttaacaaatatactaatatcgtatacgtttccgtatcgtcatctagtatatatgagttgattaatcatccatgcctaccacgattaagaagaaaattagtcgtcgttccatagtaactttcgtaattccgcgtgtctaattttcgtaacaccacggcgtacgacgtactcatttcgtttcataacgtaagtcattctaacatttttcacatttatattaatattaatgaatctaaatatataaatgtgagaaatactataacaacttacattgttaaacggaggaagtacactattacagagagtttgatcgagacataatactgtagcataggcaggcgacatgtgcatggtagagagagaccaggagatg

SEQ ID NO: 17745 - DNA, 321 bp, Oryza sativa
agacagcttattaaacggatcgccagttcgccgctgctaactgtcactggtcactactacccgcatcctttaattttgattgattccatcaacttaattatatatcgtcgtttcctctcgcatctcctggtctctctctaccatgcacatgtcgcctgcctatgctacagtattatgtctcgatcaaactctctgtaatagtgtacttcctccgtttaacaatgtaagttgttatagtatttctcacatttatatatttagattcattaatattaatataaatgtgaaaaatgttagaatgacttacgttatgaaacgaaa

SEQ ID NO: 17746 - DNA, 777 bp, Oryza sativa
aaggatcaagaacgacgcctctttctttttcttggattgtccttctctgaacccctcaatcttgaggtccttgatttctctaaggtatctatgatccggtctctaattttagttgtgttttcagtcccttcccctgttctgattgagattttttttattgagataataagggcgagaatagtttgaggtttttcttaattgggttcggaatagtttgcaattcttatgtttcttagccaactagactactagagataaagttggcgctgtctgtcctaggtactgtttattgtgaaggtagtgaattgtagaaaataataatgagtcactgcacgtctgcaccttgttatacgcgtgattttcattcatgttactagtaaagtgcttccaaatatgttagttcagtttcagcagatgaatgctagtatttctggacttgcactgctcatttgcttgttagaaacttccctttttattatctgcttcagtaattcagttgatcaggttgttagactaattgcatattctttatttgcttagtcatttataaatgcatagggaggttccctcatttaaagttatttgctaatctaaatctacctcttagttgaattggaaacactcctgccatcttatcgaaagtattacctctaaattaatatcattaattccatctgactatcacatctcatatgtttcattcttattacttttaggccagtccgtagtgccagctgaacattgatattgcttaagtaaggcaaccgtattgcccaa

SEQ ID NO: 17747 - DNA, 366 bp, Oryza sativa
tgccaactccgctgccgccagtctggccgccctcgctgctgctgcagcggtctgagccgttgctcgcctgcgctcttctgctgcggcgagctcggcgtcctgctgacgccgagtgctcgaggcgaccgaacgccgagaccgagcgtcggacatggcgcacctccggggggctgctgtgtggagagggggaagggaaaggggaaggaggagcaaccggtgctgctgctgctgctgctggctgagagctcaaccgagcttgggaaggggtggaacaagagatgtttagcctacaggaaagtgtggctctgataccagatgttagaatttcaatggttactctcattgagaagaggatggcactcgaga

SEQ ID NO: 17748 - DNA, 428 bp, Oryza sativa
tgtttttcccaaaataaatttatttttgaacaatcatttcatccgagtttgtgaaaatagaagataaatgtattaggagtatataaagtagaaaataattgcattgagatttcacaaagtgagtgtattctggtccttttatatatatctatgtgggatgggtgaaaagtaaaattattttagaagaaagacagtagcattgacaaaatatacactttattaattgcattggttggagctaagaaaaattgaggagctaagcttcttgcgttgaggtcaagaggttcctcgtgttattggatactccctccgtcctaaaatattgtaacttaggataggattagagccatcttaataaagtgaattcggacagatattctgtttagttttattatgctacaattccgacctctctggagtaaatcagt

SEQ ID NO: 17749 - DNA, 541 bp, Oryza sativa
accactatattattaccccttgtacccccttgcattaatcatgcatctgccggtgtggcttgctgagtactgtggttgtactcattcttgctcaatctttcccccccttcagtaagagaagctttggagaagaagtcttaggtggagtcctggcttataccccagttgagagcctgtgaagatggagccgtaggcccgctagtccgctactgtttatttttgattgtcaggccttaagtgcctttgtaataatgtaaatattatcgatataataaagatgtgccttttgtatcatgtttgtgtggtgtaccccggcttttcctgggacggggattaatacactagcgttcgggattaatatttttctcggtcgcgacaagctggtatcagagccaggttgactgtaggataagccaagtggataaaacctaagggcatattttataaataaaactatgcgaaagttccttttttttctccttcccctaatgctatttgcaaaaggtttactcccttcttccttcttcggatttcaactagt

SEQ ID NO: 17750 - DNA, 173 bp, Oryza sativa
tgctattctaacccccatcgagttagtctgttcttgctccattgtgcagaatgaggaggcgattgtctcatctgttcaaggggtccggctcttcatcaagtcatcatgacgagtctagtactcgttcatcagctgatatctcgatggagacgccgaagctccgcgatgactca

SEQ ID NO: 17751 - DNA, 154 bp, Oryza sativa
ttttctgggatttatttgagctaaggaagtatttttaataaatggaattgcatttaagaaataatttaaattgaaaaagttttaaaaaaagtcttcttttggctttgggccgaaagtcggcccaaaaccgccttctctctcttctcggcccagc

SEQ ID NO: 17752 - DNA, 1501 bp, Oryza sativa
tactatatttgtctataaacttagttaaatttgaaacattttgacttcaaccaaagtaaaaaataccttataacctaaaacagagggagagggagagggagtaacatagaaacactcatcgggtaggcatcaagacttgcggcggaagattctcaccgggattgatcacaaccgtagttcctcgtttcatgtcgtatacattcaacactttgccattgataccccagtaatagatgcaattccctttcaagccggtttcttttgcatcaagtgacgctccaactcccaagctgtctatcccaacgaagaatactctgccatccagtgaatccaccttcacccacgccgatctctgcttctgcgtcgccacgctaagtttgtaaacgctcacgcgcgcaacgatccggctgcaaccgatggggtgagagaagaaaacgtggtgcaggtccccgtttgattctaccaagttaccggtgagccgcgtgtaccctgctgggcatccgtggtcgccgtcgacggcggtcacggtgaacacgggctccggcgagaactcgaggacggcgacgtggtcggtgaagtcggtgtagaacttgccatcgatcgccgtaagatttcctatcgcccagccgacgcagtcacggtgctcgtggtgaggcgtcccgggctgcaggtagtgatgcaccaccccatggaggtctccggggcggcaataccagagcaccgtgtcgtcgaagtcgacgacgacgacgacgcagccggggtccgtgggccggcggcgtgacaggaggcacatccggtcgcagctgtgggtgagaagggtgccgtgcgtcgtggtcgggaggcagggcgatccggcggccggtgaaagggtcccataggaaagtcgtcgcgcacggtgagggcgaaccgcggcgcggcgccatgagcaaccagccctgtgccgtggtccaccgccggtgggctctcgtcgtggcgtccatgttgtcgtcgtcgtcgacctcctcggcagcagggctctcgtccgcacgctgtacatgaaggtggcgtcgtcgtcgtcgtcgccgccgaacagcagcagaggagcaagcttgggatccaacgacgacggacattcattattgtctttctcctccatgaattcgacggatcgatcgatcttttcttgtgtgagagacggccggtatttgtgccgtgtcttacttatacacgatatatataagggtagtttaatttgcggttgcctgatcgtgttgtctcatgatttctattgcaaagactgcaattgtaaagatgacagaaaaagaatccacccgatcgaattacacttggaaaatataaagtatatgcacgcctacacgacatcagatcaattagtaccaaccataatctgcaccggtaattaaattaggaaaaggaagcagcagcgtttttttaatttggcaaccaataagaacccgatcgacgggttacaagctgaaaccgacccatacatcgagcgttt

SEQ ID NO: 17753 - DNA, 1501 bp, Oryza sativa
aataattatcctgtaattatggtcagctagctagtactaaaatcaacccatatactatagtctaccctctccaatccccaaaactctcttgcttcttcttcttgccgcccaatttcatatgaccaaatattcatactagagatgatcttctttatgctagatggtgagtatgactttggtacaaatgctgcttcaccatcacgaacaataaggtcaaatggatggtcttaggccactcatacaacttgggaaggaaaaccttgttttgcatcgacttgaacttagtcttcctcatcattgttgtgtatgttcccgtgaacagcgcccgtccttcccaggtctctaacttgtcccactccatcgtcgtctcattgagcttagtgacatggataggtgcaccattgtagccgacgaggacagccatgagctcaccttggtccgactcaaagaggtggctgtcaacttgttggtggtcaataccaaagttgtcaggttaaccaagaagtctaaaattatcggtgtggctacatggatcatacaccgccagcttcccatctccaccaagaacgtacagcaagccatcgtggagcaccgggttgctgatcgcgccgccggaattagctgtgtccctgcttccacgttgaactccgttcggtcgagcgggtgagctgtagcgccagggtcgtgttgacgcagtacaccctccgcgagccatcgtcgtatacgatgaagtcgtaggagtaatggggcgtacacggcaactcgtatgcgacgctcgtcaagagatcgatttgggagatggagaaaggtgagaacaacgtgaggcgttgttcgttggagcagaagatcctggtggcatcattggacgacgccgccttctgcataataacctcgaagtaggggctgtagtacctgatgttggttcgaccgacgacatccgcgcagctgagtaggagcggggtgatccacgctggatagaagggcgacacggcggagcgccagtgccggcacgtcagcgcgaagccgggggtggctcgaccacccgagccgctcaaggacgagcgccagcatatccgacgggagagacgaccagtcccgttccgccgccatctcgcttccttttttttctttttcttttttcccgtacgtgggataaagttcacgagtacacgtgcgtgtcagcaatggacatggtacgtatatacgcagcgttttattatgcacaaacgctcgatgtatgggtcggtttcagcttgtaacccgtcgatcgggttcttattggttgccaaattaaaaaaacgctgctgcttccttttcctaatttaattaccggtgcagattatggttggtactaattgatctgatgtcgtgtaggcgtgcatatactttatattttccaagtgtaattcgatcgggtggattctttttctgtcatctttacaattgcagtctttgcaatagaaatcatgagacaacacgatcaggcaaccgcaaattaaac

SEQ ID NO: 17754 - DNA, 1501 bp, Oryza sativa
cttgtcagccttcgccatctccgcccatggccttcgccatagggcttcgcccaattggctctgatatctttggctcgaatcctcgctggttcttaggtttcggcaggcccggccaaagggcctgatgacataccgccaacaagcccctcacgggcaagggtgagtaaggagcttcggccgagaccatgcaaaccatgtggtatggtatgaggcgccccgtttcggccgacgtacctgccgaaacctcttcttagagtcctgcagaaaaaacgtgaacacttggtgttttcatggtttggttagaaaactttagcattcgccctttcggaaagggcgagactgcattgccttgattttggcccgaaatgcgacagtaaggggcccttcgtgggccggtatgctcctcttggatttcggcctgtactgtgcggcccagcccgataggaatttaccgtttcgtctgcccctggacacgtgtcgtgccctgattgggcggaagccgaaccgtcgtgggacgggattatataatcccgccccgggttaccgcttttctcccctcgctttttactttcactgctactacacgctcgcgcccttaggatttgataccttcgcctttgcgcgctctcgtgcctttcgaccagtcccttcctttcgccacagactcgatggctcctcgcaagcctacgaaggctgggttgactggcgaagaccctggcagccttggcgaagggtggtcgtgcttccttggcaaatcacttgtcaaggaggccgccttagccgagcttgtcctttctggcgttctcgtgtagggcaggcgacctgtaggggcaaagccgtcgtcccttcgtccggtgacggccagactgtcgtcttcgccgccttcttcgcctcccttgcgaccactttctgctatccgttctggagatgtacgaggtcaggctttcccagctcagcccatcggcgttcccgaagttagctgtttttgcgtgggtgtgtcgaatgtgtgggttcgatcccactgctgagctgttcgccattctgtttatggcgtgcacgacgacgaaggacgtgagcacaccggccggtccgaagaggacggtgtttgggtgcgtaaatttcatactccgccctgagcgctcagacgcctggcgggtgcctgcctcgatggcgaaatgggagcgaaactggatgcaaaaatggttttatatcaataatccatattctgctgaagatagcaaggcgaactagcttaggttcgaacgcgttgctgtttcgatcgctgctaagccgagtgtggaggtcgacagcgttcttgagtctcggcttattctcctttgcaaggttgcgcggcggctatgtacccgcgacctctgcgaggagttctgcctgcttcggatctctccccttgctcgcgaatggggggtgtccgttagtgaggacgaagaggtgctcgggcttccccgcctcgcttttcctcctggagtcaagcgtaagttcc

SEQ ID NO: 17755 - DNA, 1501 bp, Oryza sativa
agggacgctccggcatttgctcgaacgtccttattgatgttgccggagtatacacgttcgaggaatgtcggcacgacgcgagccgcatgattcgtttaccttttctacggagggagtcgaccgtggccataacttcctggttggtacccgcgataccatctctaagcttctcccacaaagttttcgcatcccttactaactcccctgcaatgtcggtctgcatggaacggagcaacagtgttagaaattggaaccccatgtataaggagacaccgatgcaataaaatatttaaatgcgagtagtaccgtcaagtgagcggggggtgctagctacagatcatatatttgctcaatagtgggtggacctcgctcgtcgggatcctcgggtgcaagcagccggatgcgagtctgcgatgagtaccaggccatgtattgttcgtaagtgttgtgatcgtatgccctggtctcgtggacgacatcattcaaggcctgcgaccacgcctctatccatggggtcatccttaagtgcatagatcgacgatacctgttgtcagcttgcctcttttgcatgaaacaaaaatacaacaattagctgttaattatatctcacaatgttggagagcacagaaattaaagcgatgtaaaataacaacatacgtgtgcacatctggtggaaggtgaagtccaacaggaactggaacttgctggtacagtcccatctgacgcattaccctttgaacattatacccctcgacgaatatgtcgtacaccagcatttttcatgtcatccagtacgcttcatcgcggtagcataagatgctaactccatttggtccacgcaaaatggcctcttcgttcgtgtacggtgtccaccgaacttcgttttccctaaggctttcgaacgtctcggtgaagtacttgtacacattgtgcacctggattctcgcccactgtggctgcacgatcggagattgcagatttagttatgcagtatcattgaattgacagaaatattcctttaatgcaagcatacgtaccggtccgtagcaccagcgagtaccgaaggtaggacgatcatcaactgtgtcagcgtaatcgtccttgtgggccacggccacgctcatgtatggatgtccgaacgagaagtgctcgtacgaccacaacttgaccaaaagtggacaccctgtgaaaatcgcctccctttgtccggtcttaacacaagcgtcgcagaatccacggtatgtggctgcaaggacggctgatccccagctaaactgtgcagatggcactatattaccttcagcaatttggtgagcaagggggataagcctggcgtccacagtgttcccgtgcgagccggtgaacatgactcaaccaaacagccaaagtagataagcctcaaggtacaacgtcagttggtactcctggacattgtcaggcatatatcgcacctaaaaaaacaatgtgttgtgagatatgtgaatgtgaatggaatatgcct

SEQ ID NO: 17756 - DNA, 1221 bp, Oryza sativa
  unsure (1)..(1221): unsure at all n locations
ggagaaaagaaaaattggtcatcggggaaaaaaacctccaaaggagacagcggcgcaaaaaaattaacatattgccgagtattgaaccaaacggataattttaaccatgttgggggtagtacacacatagtttttgaaacacttttgggggagtagtggagttttttataagaaggggtcacatcgngcacatatgcgcgtagcctagcagcgagcctctcgggggtctcaatacagaggacggnngggttcaactccactccaaattcaactcctagagttatatttaggagttggagttataccaaacaggcccttatatttagacttctgagaggttagcagcttggcaaagagtttagatgggccatctcaacaccatgttacctttgctttcatttgtgttattggggatagctcaagtcaagagaagctttgtgttacacggtgtcacctgcttgatagtaactctccgtgtcattgtttttatatcgacatgtttgaagtcttctcttttgacaccgggtggcaagatagcactgcctggattgagtaaataacagtaaatccattagtccaatgccaaatataataaaatgttttactcactccattttattttatatgttttcactaatcgcattttttaaattgaccaaatttacagataaatttattagcaacgtctataatactaaattagtctaatcatattagcattgaatatatttgaataatatatatgtttgtattatgttgaaaattttagtgttttctatatataaacttgattaaatttaaacaaatataacttaaaaaattgaaatatcttataatataaaacgaagagggtagacattaacatatttttgtcccaagaaatgcagtgactcatccttctttccaaccactacatgtactaatttgccaacagcatataagtacaattcaacgttcggtagtttgaataatccaatacacgtagcaagagcttgtggcgccacatactgtataaacaccttccccacctcaatattgaaaattttatagaaaatttcgtcactacccactgaaattgactagctttcattctgttataaatagagggccaactgtaagagcagaggcaaaggctgaaaggcatagctctagacacacttatatttaaacttctgagagggtagcagcttggcagagtttagatgggccacctcaacacca

SEQ ID NO: 17757 - DNA, 1176 bp, Oryza sativa
  unsure (1)..(1176): unsure at all n locations
cccgcctcgcacgcgcacttctcaactctggcntttgctctctctcgcgccccntaccgttgtcgcgcgttgcgcgctcgtactgggttgttaattgtttgttcgcgccccccccacccccccagaacgttgatgacagtggttagnaccnactncatnaccaatggcatatcatagaacaattgctaaagttatcggtatattatagaaagagataatgtcgatggcaaatagttgaactcgaacaaactcgatggtatagatagattctctcaatcttaattaacacccttcacggataatgttaccctgaagggtgacaattacaaacctccacgcatgaggaaaaattcaaatttttgaaattttcaaacaacctcagattatgaaagttgtagatgtcaatgatatttataacttcaaaactgataacatttgaatttgagatagtttacatgcccgaatatctatacctatactaatttggcactttttaggagccctcacgttaataagaaagatccgaccgttgattagattgatcctattatcatgaccgtaaatcatacttaaaattatctcaaataaaatatgtagttttgcaatattatatgctcttttagttatacatacagtatgagctgtttttgtggtccaactatataaaatcaatatgtgtttgactgttattctatgataagcaattggcacctgagattattggttttgatatttggtgattattggcaaagtggttttggagataattggatttgtaggtgatgaatatggactgcttattgtcgtgtcgggttagaccaggcaggtgttgccggtcagaccggaggtatgcgtgcggtcagaccagcttgcccgcggtctaaccagccgactctgtgtcggtttcggtttcgggttgtttcattggatatccgtggatagttcatttttatggcttctagatggatactatgtgtatataatactgttgtttgctaagaatgagtcaaattggagatagctgggtctcggaatatagttttttttgtttgattcatgtgtaggtgtcttgatgcctcgaaagagtattgccgatgatggattaggagtcaacttggagataaggtgatgtctggacggtcacatatcatgcaagatacttgggctaaagatgaa

SEQ ID NO: 17758 - DNA, 1501 bp, Oryza sativa
ttggttgctgttaattctagacagaatgaatgacgacgagcggctccagtttctcctgctcatttggcgtgcatcatggcacctgaggaatgatagtctgttcggctcaggtaagagtccaatccaagcttcggtggtctttctgcagggtctgtgggagtctgttgttcagatcagaagcaatggagctgtggatagtaaaggtaaacggcctgccctgatacacaacagtacattccaagggaaatagatctgtgcaagcagtctgaaaccaaatggcaggctcctccgtcgggttgggccaaaataaacgtcgatggagccttcgtttcacagaccagcaaaggtagtgtggggattgttattcgagaccatgaatgcaatgtccttctctctgcttggagcgtcatgagatattgcacgtcggcagaggaagtggaagctacagcttgccgtgacgtgatggtgttaattaagctggcgaatgaatggatcaagatgccgctgatcctcgaaacggactgtgcaaatgttagcagtgtcctgaaggcgacagaagaagatagatcccagctctggaatatttttcaggaagcaagattagctttagctttgtctcacaagtatcagattgtctccgtaccaattcgtccacggtatggcgtgcccaggccccagggagtgtgtctgagctgctggctctggattgtaatcatgttaacttgaattaataaagctccctgttttccttgaaaaaaaaaagtattacacctatgtgaaatcttatcttcaaatccattatattttagccataacaagaaaaagacaaaaattgtaatagatatttaccttaaaactgtcatattttttgactttttttacgactaaaatataacgaatttgaatatgaaactttgtaaatatgtgtaatcctattaggagtaaatgtccattttttaaagaatttttcgtgacatttgctagttaatgtgcacggagtgtgcacgagatgtttgtgtacataggatatgtactctatgggcctgttcattttgatgtcattttcaaccttaccaaattttggtaaagttgccaaaaaagtggctacatttagtttactaccaaattttggtaactatataagaaatcctgtcaaaattttggccaaaattttggcaactataccaaaatttggcaatgccaaaatttggtaaggttttttttggcatcaaactgaacaggccctatattgattgactggtagtcgtgtacttcacgcgtatgatttccaactgttaaatggtaatgttttttttgtttttttaagaaagttttttaaaaaataatattaaattattttttaaacttttaaagctaatacttaattaatcatacattaattagtagctttgttttgtgtgcctacggaaaacttcccatcaccacctacccaacacaccctttgtgtatactttaaaatagagagagaagatccaacaat

SEQ ID NO: 17759 - DNA, 1231 bp, Oryza sativa
acatgttgtttccctccgacatactagctcactggatacgatttttgagtactttatactaagcattccatcttaccattaaagagggaaagcataaagtgtttaccttatcaacttaccctgaacttaccatataaaggacagggaaatgaaacccctaatctttggatccctagatcttctttttggcggcgcacatgtgctccccctgtggatgatcacttttggctcgtgccattgccaggggtttaggctagctactttgggctagagattcctaggtcacaagtcacaacccacaccgtccacatggcaaaaactataatcatcacggcacaattctgcatagactagaggatgatcattcctggtacgttgcagtgttgctgaaagattttgtgtcgtgtgcaatggatctgtgctctaccacactcttggagaaatgcaggattacctaactggcagaggaggagttaccatgtaccgataggaagaccgataactgcggtaatcgcgcggttaccacagtgaagtgataaaacgaagcggaattgataaaaaaattgaattgttatttaaatttctttaattaaattggtagcgttgtggggcacttgtttttaccagtaacggacggtaaggcagaccctatagataaatgatgttggacaactaatataaaaaaaagtctctattgatattttcatagattagagtcattactttcagtcatgtaaaattccatttaaattttgttgcatggcttggtcagacataggcacttttttattagattttcagcggcatgtgaaacgagttaagccattagcacatgattaaatcgatttctaccttagaatgtatttatttatttattgattagaatggatttatttattgattgattaaacttattgtcagtatcatgagtatgggatgcctaatatattaagcttagcgggacgcaccatataccaagctttatacaaaatttaacctcatatacaaaatggtttcggataagaaaagataaatagagttctagttggacaccacaatgtctactcgaattgtattcatacttgactctctaattctccttaaacaagaggacactcgagggtaaaaatacaagactctctaagaggagatgggccacaacaacataggttaaggcaaactaacacaaatcagcacaagccaagccaagcttatagcgccacagaagcca

SEQ ID NO: 17760 - DNA, 1501 bp, Oryza sativa
accatagcaattgctataacttgaatctgagaaaaaaaaaaagaagacttgggcatgccctaacaaaatccaagaaatggtcaatttgtttagcatccaacccacagaagctttctaataaccacgccgtatcaaatctagatgtggagaattaacctgaaaaagattattgtgaattaacctgataattaaaacgctttgccattcacaccaagaaataaagaacttcagttttacggcctatttattacatcagttaatgtaagactaaccaaatgctataatccgtgagaaatgttatgatttatccagaatacatggggtcatctgtgacaaaatatttaaaaagatgtccaaactctcaacgtgttttctgaccattctggtcgacagttaccaatacagggttacatcaaagtgccaatctaccaaagcgaaatacaaaggtattgtcggaactagtggaagttagcattcttggaaatgagtgaaatgataacaaagaatgaaatccaagagaattttttttatgcaaattactaccagggctttgcccagtagttatatatattaaaaaagaagagttatatacagaaaaacaaaaaaacaaaacaaaacctgacaaatatctgatttagtaaaaatatctgatgatacaatacacctaaaaccttgtgtcgtacaatcgtagtgtaaattatgcctgtgaaaacaatgacaatatttggcaggcagaggattagagaaaaaagagatatctgatgaaaagactgagttcaggacgggacaacaaggaaacacaacaaaagaaaatgacattgcaaaatgatgtaggcagtactgttctaatcaagaacaaatcccacatgaacatcagcagcacatgtctgacaccattgacgccacgaaactggagttctaacagtagcaagcaagagattcgatgagtctcaaatcaaatcagggttgagatcaagcctgtcagctccttcgcccggtcatcggtgcgcgcctccggcgtgccaccggcgagctgctggttctgcagcctcagctccagcgaccacgccgtcatgtcgctgacgccctcgagtgccttcctcgccatctcgtccaccttcgccgccagcctcgggtactgcacgcgcatctcctcgtaccgcaccttcttagccggcggcgccgccgcttggcgggggcggcccgcctgccgggccggatagcttgtccccggcgcgttcttggcgggcgccgtggtgggtgtggccgcggcggcgggtttgggcggcgcgacggccgtcggagcggcgccccacacctcgagggagagggtgtagagccggagctggtgccccggagcagggccgccgctcccgctgcagagcaccgcgtcgttctcctcgaaacgccgccggagcacggtgacgagcccctcgagctccgcgaggctgtagtccgtacgagtgaggaggccgtagacggccatgaggaggtcgacgcc

SEQ ID NO: 17761 - DNA, 673 bp, Oryza sativa
aaagaagtgacataagcttcatgtatccaagtctgagattccatttccaggtacttgtgtaaagagtttttgaatggtaatataattctcatgtacaattcagtttttcgttttgaggccacttaaattcaatttgtcatcacgttcatccatttcattcaagatttttgctatttctcagaagggtccaaaattgcggaacaccaccccacccacacacacacccacaccccaataggaaactattctccagatcttcctactttttgttaacttagcaaaatccctcgtagggatcggctcatagatgtcggtttaaaaccagcaccaatagacaatttcccacctccctgtgatggaaaaatatagaaccgacacctttaaacactataggtgtcggttctagcgaaaaaaccggcacatatatattataggtgccggttttttaaccggcacctatagcttaagccgagccgacgagccgagccatcagcgactcagcagcaccacacggtccacacccaccgaacgtccttatctagtcgtccacaccacacggtccttatctacacatcgatcacatcccttctcgtgtttctctctccgactctccctcccctctctctctctcgcatcgctctccctccctctctctcgcgtcgctcccctccca

SEQ ID NO: 17762 - DNA, 154 bp, Oryza sativa
gttactaatatacagagtagtggtggtaactgcaaaggtcccataaaatcattgcagcaaatgatcaaatcacatctgctttccacacaaagcacctacctagattaagatcaagtttaataaataatgataaaggataacaacatggagaaaa

SEQ ID NO: 17763 - DNA, 1050 bp, Oryza sativa
aataagacgaatggtcaaacgttaatcaaaaagtcaacggcgtcatacattaaaatacggagggagtaagtacttattttgtaaagatcagatgatctaattaactggaaatctggaaagtgttgacccttaagatcaagttagttaggaggtcagtattcttttactgaactgaagcattaaacaagtggctgtaagactgaacaagcatcagcttcttcagacgacatggtgcgatgtattcggaaaaagaacagcaatttccatcttgattcttgaatgtaataactgtagttcatccaaattgcatgccggatcctgtacatcactagagtacaccatccatcagccccaaataagggaaaaattttgggtttggttgtcgaatcggatatacggacatatatttgaagtattaaacgtagtctaataacaaaacaaattacagattccgccagaaaactgcgagacgaatttattaagcctaattaatccatcattagcaaatatttactgtagcaccacattgtcaaattatggcacaattaggcttaaacgattcgaagctttttgtggtaggtcaccgaagtacccactatatacttgcgcatatgttctagcgcttcgactcttaccacttctaggagttcgagtgacacttcacatccatcttcgccacccctcgggccgccctccgttgaaggcaaaggaaatcacatatgaagatgcacggagactgcggcggctgctgctgtaccatattatacactttgattttttttcctatgttaagcttatttaattttaattaaatttataacgaaatatagcaacacctacaacaccaaaatgcttttattaaatctagcattgaatataattggttttattaaattggtttattttgtattgaaaatgttactatattttttcatagatttgatcaaatatacagaagtttaacttagaaaaaagttaaaacattagagggagtataatgctagtgccaccaataatggtcatcggactccaaccgttcaacgcccatca

SEQ ID NO: 17764 - DNA, 307 bp, Oryza sativa
attcctggacgaggattttatgcacaaataagttcggttaattactagtgaatttccgggcgtgacattatgtcgtgggcttagcctaaggggatgtgtgccctagggcaaccctaggatgtccctaatcatatttattcagtagctgtcatagtttagagtcgagttttgtttagattgatctgtcaagaacagttttgccgctaaatcagtttgtgaaaccccaaattcgagtgcttaatcattcatatgctattgtgttgcaatctatcttgtttttacttgtgttcttcaatttgtatacagg

SEQ ID NO: 17765 - DNA, 162 bp, Oryza sativa
cgcccgtgccgcgcctaagccccgctgccctgccgtgcccgtggccgcgctgccgctcggccccgcaagccagcgcgcgtgcccgagccgcgccgcccgcgtccgtccaaaatcgggaggcagcgcctctcgctcccatctctctccctccccaaatcgaca

SEQ ID NO: 17766 - DNA, 160 bp, Oryza sativa
gactttggcaggggaatttgatttgggaaggatttgaattcggaatttgaatttggcgatagatcggggattttagatccggaatggcacggagacttgacaacacacaaagagacgaatttcgcaatagggtttttagaatttaatttttcccgctagg

SEQ ID NO: 17767 - DNA, 713 bp, Oryza sativa
agcaccaaccggggctaaagatcccggtgatctttagccccggttggtgctaccaaccgagactaaagatcttaactttagtcccggttggtaataccaaccgggactaatgatcccggtgatctttagccccggttggtgctaccaaccgggactaaagtcccacccctatatatatgtcttcttcctcctccagctgcccaagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactgaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtaga

SEQ ID NO: 17768 - DNA, 1501 bp, Oryza sativa
tttccctaacttgcttccagatgtagagataaaaaccctctttactttgcacaattccctctttacagtttcacttcatattgtcattggcatgttggatattgttctgtagatgtaagattttttaatcactattttttataaaagtgaagcagcaaagttagtagtccacatatttctgttatccaagtatgtatatagttcgcataaaaaaatattgtgtataattgctgtccactgataaataacaagatgactagagaacatacctgttttactttggtaaaagctacatcactatgctcatgttctacatattttagagaagcacaactagacagagtttattacgctaggttgagtaagcttctcatctgtgaaattttaactagcatctctgcacaaactgtgcatagctgatcatctgaatgcattacggccctattgcaggtattatccagaaggcaaggataattacggagtgtttgcaccggttctgtagggactgcatagaaaaatccatgcggcttgggtatggtccctaacattattcatctaaaattctgtcaatgtcatttcgaaagaatagacctgactggggttttgaaatagaatgtggtacttactttttatgataatctgagtggcacattgtttttacagaaatgatgaatgcccagcatgccgcacccctgcaagtagtcattccttgaaggttgatcctaattttgatgctttaattttgacgctgtatccagatcttcacaaggacgaggaagaggtgatgcataagttttctggttgttgcacttagctatttcatttagttttcactacaatttgcttgaccacacaggaacttgctttcactgaagagaagacttgtcacaaaaaggtgggtttaactgactgtgtcatagtatatttaatgcagggaaattattttccctgcccatttggaatttgtcttctgtttattgttactgaaattagcttttttttatcaatggaagatccaagcatccaccgatgaggcacctcatagacgaaaagaagcacttgggaagaagagctccgctgcaaaagctataggttcttcaaggtctcaagggaatatgctggcaaggaagagaggacacattgattttcctgatattgtcccaactaaagttcgtggtaaggatagagaagaaaatgacaacgatggctgcgatgagtggtctttatttgatgagtattaacaagatataaagaagaaaagagctcggaggtgtcctgtgccacgatcatcccctgctggacatagagtacccagcaaagtggaccaccatgaggaaggaaatgcaacacatacagccattcggcagaagcagaatcactctaaggcacataattgctgcccgctgtctacagaagatcagatggatctttcttctaaacagacacatccatgaaaaaaactggttataatgccaatggttttaacaatttcactgtgcca

SEQ ID NO: 17769 - DNA, 1501 bp, Oryza sativa
  unsure (1)..(1501): unsure at all n locations
ttctttgagagatattctactatcgcaatggcttcaggaaaggtaagttatgttattttctgaattataaatatgcacatcttatttcaagaaaaaaatcctaaccttcttcttataactcagataatacatcattgccaaacaatacatcagaatgcgggaaccaaatgcaacttgtgcaatgcgagatttctaaaagacagtgatctagagttccacaggagatattatcatcagcagcagtaggatgctattgtgatcttgacttccacaggaatgatggtgaataggtctagatgactgatctactttacagcttgctctcatttcttgtctttagtgtcaaatatgatggtgaatatgtctagatgactgatcttttactgaattgagtacaattcatacaatgcttacttaaccgcttcttcttctctagtctttgcagtatttttctcctctgttggcaaatgaacttgatcgatcaatggtgtctccatagtagtacagggcggatccaggaactttttttttgggggggggggggggggggggcacattttcttcaacctcgacccgttaggaacttttagtttnnnnnnnnnnnnnnnnnnnnnnaaggggatgcttcggagggtatccataggtcttatggtgtaggggggactcaagtccccctgcacccacgttggatccgccccaggtagtactgtagtagtgtgcatagggcattatgtgttaggtatccccatgttctcctagtgatgtttagttggttagtaatgaggtggtagttaactatttattggtgttgtttgatgcataaataaaagaaactgtactaaacagcgcatcatgtcctccaaaccctaccgggagaatagctactttagtccctaaagtttctctgtatatgcttaggctatacgcctatacatgtagcaattgtcaattgatttgattgtattcataatcatacaattatcttagctaattaatcaaaccacaaaactgtcgaactgaagccgtgcacttactgtcaatcctcattgtgtatgcaagttttgtgatccactctgatcagccgttggcgcgcgatccgacggctgcagagtagtcaaacatcagtgcaggactcccgccaaatttgaaaaatttcccctttagtttcagttcaaggctcagattgtttacccacgtagtactgaactaactgcgtgttcttcttccactaattaacctcaaaaccaccagaaacctcgcgaattgattgctccagcttatgattgccaccttccaattgaatgccggagcggtgatctacttttctttcggagcaaaaaaaaaaaaaaagttgcggttgttgcgttccaattcattcgcttgatccgtactcggcgttactccgccgtgtcggtcgatcggttgatcgaattgcttcctttttaagcgtactgaagtttcttggatcggatcgatacgtcggcgatggcggcggcgacgg

SEQ ID NO: 17770 - DNA, 1501 bp, Oryza sativa
tttcctgaataattttacaagcaacatggaactgcaaaataaaaccaggataagaataactgtaagcactataatggacatcaggatgaaatgttgaactcaaaccatattgtgtaaaagtaccagacctcattacttgatctatccgaaggtaaattccgcaacttcttcttgactgccttgatgatgtcatttccttcttttcgtttctccctttgcagttcagcagcatcagctacttcctttgcagtaaatggactgaggagaaaggatccaaatgcaccttccacattcatgaaacaaaataagtcatgctgacttgagtccttgcacacatctatgacgtctaaggaacaacaatgctcccccatcacatcctcacacaggtttggatctgaaacttcaagtagtttctcccctagtgaaccaaaatgggaattacacaagtgagtccataacatgacagtgctgtcgaatgtaatgttagagcatcctcaatgggggcatttcctcagaatccatgatttgctactactcacgaaatgatgagcatctgttagagacttggatagtgaacggttgattttgctgtagtattcgcaaagaacatcaagcctcacagataggatcattcgttgcttttcacttgttataaggctccaatcacgtcttgcgaatagtacaagagtttgtagaagcccatggatctgtttctttacaaagcaaatccgatcatcatattcatcccctttggtagaccctacagggatgtcgtgactgcttggatcgtcagccttctcaatgggctcgacaacactcatcctcagctgcagcataatcatggaggacagccatcagtcctgcacgaaacagtgcgatcacaagagagtgatctgatatttttgcagcactgtccatgattttcagggcacattgtaggacctcctccttatcagcatctggttcaatactcttggcaaggtccagtgccacataggttggcagaaattgcgcacgagctgacttagggaatgtggttgcaacagctgcggccctatgcaccgcatacgcgactcctgagctctttgcaatgctgagaacacgctccacatcgacttcacaacaagcattgttgtttatatcgattgctcgttggagcctttctcttgctgcagtgattctttggctcttagaggctttttcaggtagggatactccatatgaaatgttatggatggcaggatctaatggtcgtgcaattgatagtgctctgttgaactgggattccgccaaactgtactccttagatgcagaaagagactcaccgtgggcggtagttgtctcaatgcaatctggaactgcttttgcagcagaaccatacatatcagtagcaattcatagagacatttctgggctgcccttggccgctcgggagtgaaatgccttcatattcaggtcccctacgaggttgtagatcatgggacatggagaggcgttgaag

SEQ ID NO: 17771 - DNA, 744 bp, Oryza sativa
agtatatatatataaagccatttattaatattgatcgactatttacaagtcctatagaattcatataaaattttggtgggatgaggctcaaccgtcgtagtataacgaaggctcaacatcatcatgaaaattcctaaattctaataaaaattccgataaacggaatttacctcttacaatctctttttttcctgcactacatccaaccgatcaatgctgcattttttaaggaactgtctaggtgtttttgacaattaaaaaaaccctcaaatcttacaaattctggaccattggatcattttgagatttgtgcaacatacctaagccctacatttcctcctccacatcacagtctgcccactgccacctccactttcacgcgtgtgaacgagcgcgagcgctcctctgcctcttgtgaagtcgctgtgccaccaccctgcctcgctggctagtcgaaaggggtcaacggtgcagacgaggctccctcggccagcctcctctccctcccccttctcttccacaaggtggcgacgtcgagtgtccccaccccgttgtcttccccgtctccggcggctccccaccgccagatccgccaccaccagcctccacctcctaaccagtttcgttgttttcccccgccaccaacgcatgtcctccgcccactgccaaccccgtggctccagcgccgcgtcgacacctcttcgcccgcccgtgtccaccacccacagccatcactctaagcca

SEQ ID NO: 17772 - DNA, 1501 bp, Oryza sativa
ggggtttctgccaacaagcgattcggattcaattctgaatcctagaacagctgaaggaacaacaacaggacaagttaattgtagctgtgcaagtagtctgcttgataaatctctccatccatccagcactgatggagcttccacaggatgttttgatgagcatatttgccaccttggaggtccctgacctcgtccgggctggttccgtctgctcctcttggcgatccgcgtacacaagcatatgcagccttggacattgcaagccacagtagacaccatgcatgctgtacacatttgattctgacggcaccaaggcgacgggcctctacagcctcgtggagaagaaggcgtacgttttgccgctccaggatctacctaataggcatatcatagtgtcctgctatggctggattgtaaacgccgatgagagatcagagttgcaccttgtcaatcccatcactggcgagcagatcgccctgccatcggtcaccaccattgagcaggtgaagcccatctatgacgacgatgctgctgctgccaacgggtacaaatacttgtggcacacgggagaggtgacggtttccgactcgtcctcgatcctctattacaaggcatttgtgtcttgtgatccatccatgggaggaggatatactgtggtgctcatccacaatccgtattgccagctctcgttcgcaagggctggtgatgataagtggacatggctgcccccgtattccgactatgaggactgtttttttaaagatgggttgctgtatgctgcgactttgttaggagaaatacacatgtttgatcttaccgacccaaaggtcgcgccaaagatagttatgggtaaggtgaaggactttctgtatgagaatatttatatcgttgaagcttcatgcggtaacctactgcaaatttggcggtccgatgatctaccgaagtgggatgtaccggagggggatgaagatgatgatcactcgtttgattcagaatctgagttcgactctgagtcatatgtgtgtgatactaacacgatcaaggtacataaagtgagtttgacagaaggaaagattgtggaaataagtagcttggacgagaacttgctgtttcttgggcacggccaaacgctttgactccacgctgaagagtacctgcagctgaaggcaaatcatgtttacttcactgataataacgaactgtatctttttggatacaagaacaaccatcgtgatattggagtgttggacttggaaaatttccgccgtgaagaaattgtgtccccgcagatttggtccaactggccaccccctatttggctgattccgaatcccaggaggatgaaattggcatcgcattagtagatacacaagacgtttccccctcggtattttatacttcttttttccattgcaccaaatccatttagggcccttttgaatcgcagggttgaaaaaatggagggataggaaaaacacagaattctgacagaaattgcagt

SEQ ID NO: 17773 - DNA, 712 bp, Oryza sativa
tgttgagttgtcccgcttcgcgtgtagtttcggagcccgaagacccgcagtgcgaggatttcgaggatcaagctcaagatctcgagcaaggcaagtcacctttgatcatgttgcacctataatttaaatctaagtatttcttttccagaaatattgcatgaataggtttaacacaagtaattcggtcgcagcttgtgagatagcctgctggccccaatcctaattgctacaattaccctccttgaattattggacacttaaacctcctttgtcaactgttgtgcttcgatgcacgggccttcgggcacgggcatcggaacacctcccctcaaatttaaaatatccgacgatgggtaaaacttggggttttacaaaagacttggaaaacccaacacctgggtcggtgcttgtgaactaaatgaatttccaaaaccgcagaccgggggacgaaccgggagtacggtttcccgctcttgcacttaaggaccgtttcccttggaattttatccgtacataagacaagtgcgaccacatgggtgaaatgggacacccctggctgagtaattagctaatgtggattcaacggggtggtgctggggagaacccccgggcttcctggcacagcatggtctgggacctaacctgatgtcggtctgggacccctctcgttggcatatagtgaacctgtgtcggctttcgaaatgccttgtca

SEQ ID NO: 17774 - DNA, 1501 bp, Oryza sativa
taaatctatgaatgaatctatttaagacctaaaatatcttataatatgaaatagaggaagtacatctttagaatctacttattaagtatttattaagacaaacactcatgagtatgaaagtatggtctatatatgagtgttgaaggttgtgtatgtgcacacattagttttttatatattatgagaagttctaaatagcacgagtagagaccgaacacatttaatcaatatcaagtttttgccttttctactccaatatgccaaccactgagcctcaacggtcaccataaatcccatttttagcactagccacaaattcacctcagcataacaaattcacaaataaatgtggtgatagagataagcaaccggcaaccacattagcagtaaaccacagccttgtccgcgcgataagatagtgtacttaattaaccccatacagttaatttaccttgttagcagtaaaccaatcattttaaaccccagacagtgcaaagtttcatattgatatggtagaaaaaaaaatacaagattacaaactgggatatcgtaaccaggaaaaaaacaaaaacaaccagcaccttcgcatgttggccacacctcacacaacctaggagaaaacacaagcgtcaagccgaccgccgctagagctaaggggagtcaaacgccccccacacaccaacttcatatggaagatcgtcaacaagttctctgacagagcaggggactagggttcgccccccgtgccacctgcacagagagacgacatggggtctgtccggactaggaatagctttgccgatctagctaggtgtaaactagtagactcctttattttttgcaagtattaagggctttctacattttcaaattttcgacctagttcaaaatttcaaaatgttttagtacaggccaaagtgaaagaatgaactctaaagaatatagtcgaacagttccagaactacaagtcagatctatacaagaaatacatcctgaagggcctgacacctgacttcaacaaattcaccaagctaaggaatcattgggatgtgtttgtcgcatacaagacagaagagcacgggcaagtgcaaatagaaaaagaataaagccaatgccgctaggaagcagtaccatcaccagctagggtcaagcggctataacaaggcagttgccaagtgggagagaatggaaactggattgctagaaagaggtattgttccagccacagctaactggcctgaacgatcaaagcattggtactatgctcacagtggaacgctcaatcccagtgatgggtccttgctattaagtgatgagattcgcgaagcagcaagctgacttatggatgcagtagaggcctctgctcagggaacattctagcccgacaaagagaaggacgagcatacgctcgcactacaaaatcccgagcatctagaataaacgcgaggaaaagacgtggttgtttggaaatatggatttcaagaggacatccacacgtaca

SEQ ID NO: 17775 - DNA, 318 bp, Oryza sativa
ctgcaccccgttttgaagttcagcaaataaatcttatatgattatagggaatacaatatggaataaatatataaaagtattgcaatcgtcataaatattgaacaacgcgttcctgtccaagcaatacttctaggtgcaccagaggcagttgcgggccttgcggcgtacttggcgcaggagactagggatccatcaccgccacgaccggatccaacacctccacgtcaggctaggccgtggtcgagcggatgtgggagcgagcgactggggaggttggggttgccgtgggtgatggtagcaagcggccggcgcgaccga

SEQ ID NO: 17776 - DNA, 1501 bp, Oryza sativa
atatgttaatgaatctagacatatatgtgtgcttagattcattaacatctctatgaatgtgggcaatgctagaaagtcttataacctgaaacggatggagtatattgcaaagttcaattatcgagtttcccatcttccactccaagagtatgccacacagcagttgaatggcaggtacgtacatatatgttaccagataaccttcctaaccaaactgtcctcaactgcagccgttgtgctggcgagtggcgacccatgtaatttagtaatttctatatcacatactaatgttaactttataaactcaagaaacatgactgaaaaacattgacatgaattcatgtgttagatggtgaatcatcactttcagattcatagtttacactccaatgaattgtttatagtattggagagatatattgacaaacatcaatgacacaatgatcacatgctttgatgagtaacaccaaggcataaaaaattatgtgtattaaatttcctatagctggaagcaaaaactaataaacaataatgatcagagacatatttatttgttacattaagatacatctacatggatacattcattttcatctataaacaaacaacagacataacatgaataaccataagaaaatcttgatcttgatgggtgtcaatgttgataaaaattatatccaaatcagaggatgaatatgtaacaaatctaatgcctttaaaataacatttatatgacaacaataaaatggcattaccaataaagcaagcatatgagtgttctaattttggaaggctttgaataagagaaaaacaatatacttcaaagtagtagtactccatctcatcgtaaaagaaacagttaacaacataataaatttctcttataccttatgcacatgtatcaagcatagaataaaactggagtatatctaaaagccttggtgaatccatgactaaatgctctgtgtgctcaatatcttagaaattttaataactttgtgggctcaaaaagtatagggatatgaaggaggcaaggcacataacagttgacatctgagataatttgctatatcagaaaagagtaaaatgacaatgtgcagccatctgaataatcaactctatagatatcataccacagtgtaaataagagactgggtaagcaaattgcaatcaaaagaaaaaatgagtcactattatttacttgcgtcaatcaaagggtccaaggcaatgtgttacttattaacttaagccattcttgcagtaaaatcaaatactcagtcaacagcgctgttgcatatacagtgtaatccattgtgaaaccacctatgaaccataagaacgcagttgcataaaacaaaaaagaaggcaattctgaggctgctgctctcatatagactgatatttcaagttttgaacaacattacccacaaagacacacttatccaatccacagtatctcctcctaactatgcatttgagagttattccgcacagaagtttt

SEQ ID NO: 17777 - DNA, 1501 bp, Oryza sativa
agtactactactttgaagtatattgtttttctcttattcaaagccttccaaaattagaacactcatatgcttgctttattggtaatgccattttattgttgtcatataaatgttattttaaaggcattagatttgttacatattcatcctctgatttggatataatttttatcaacattgacacccatcaagatcaagattttcttatggttattcatgttatgtctgttgtttgtttatagatgaaaatgaatgtatccatgtagatgtatcttaatgtaacaaataaatatgtctctgatcattattgtttattagtttttgcttccagctataggaaatttaatacacataattttttatgccttggtgttactcatcaaagcatgtgatcattgtgtcattgatgtttgtcaatatatctctccaatactataaacaattcattggagtgtaaactatgaatctgaaagtgatgattcaccatctaacacatgaattcatgtcaatgtttttcagtcatgtttcttgagtttataaagttaacattagtatgtgatatagaaattactaaattacatgggtcgccactcgccagcacaacggctgcagttgaggacagtttggttaggaaggttatctggtaacatatatgtacgtacctgccattcaactgctgtgtggcatactcttggagtggaagatgggaaactcgataattgaactttgcaatatactccatccgtttcaggttataagactttctagcattgcccacattcatagagatgttaatgaatctaagcacacatatatgtctagattcattaacatatatatgaatgtgggtaatgttagaaagtcttataatatgaaacggaggaagtataactgaaggaggcaacaaaagtgaagaaattttttgtacttggtgtatgctttttataggaaatggttttgtaaatcatgctatcatagtatattgtaaatcttatgccttaagaatcctgaaccttctacttgagatagacctgtctatcaaatgtgttagatgtgtctgcttttggcatattcgagcttttaggtctaagttaatagtgttctttatttctacaaatatgtagatttttcaacagatatatcccgaagctggatttcatttagtgtcaatctcctgctattgccaacactcaatgttgcatattttagttttgcttccaccctttcatgctactcatctgattgaactttttttaacctggatttgaagtacgaggtaatcaagtatgttgcttgttttgcaggacagatgatctaactaatcaactagccctttgcaacgaaaccttactaaccttgtattactagaccaatgtggggttttactaggctgaagtcttatggcagaatggcatattttatgttgtagtatgttgttatcaactgtacagttcaccaaaatgtgatcaaatcctgagattccactgataccaagcaactc

SEQ ID NO: 17778 - DNA, 1501 bp, Oryza sativa
aaaacaaaatttagaaactccttgatccagtgatacagatacggtggtacgaatagtagttgcgattggggttaatctctagcacctcctgatattctcccatgcaaaagtactggtactaatagaaggccaggcagaaagtcatttgccttgtcttccttccttgacgatcgaactggacgaatcaatcacacctactagcgcgtacttccctacctgatatagccaccaagctatcaacagtgtaggcaggcaatgcatgtttgtatccatgatgggagtggattctaaactattagggcttcttcggttaatttatatgagggagagattggagaggagactaattccatacctattgtagtgtggaattattccccttcaatcgtcccctccatcttttcaatcccctctaaaccgaacaagacttaagaggatatcttttagttgtttacatgccatccaaatgattatgaaaatatttgaaaaaaattaacaagataaattaatatgtaataaatcattctatggagatgcaagttaaaatctaacttctacaagttgcaacgaaaaaaaattaaactacggttagtcagttaacatatatacgcaatcaaatttattttttgttgcaacttgtatgagttaaatttgactttacatgtttgtggagtgattcataacatattaatctgtcttgttgaattttttaaaaaaattataaccatctgtatgacacgtaaacaatgaggggatgtccttacgagagtttaaaatagttccccatccattattccacatatccacaaccatttttacgctgcaataatgtatcatttcaattactacaggactgtttgacggagagctctggagtctaagaagcagccgaagagaattcagcttgtgagaatggagaaaacgaaaaccatcttatggcttctcatgtattttttgagttctacaactacaatttctcataatctcgacgaaaagctgaacggttaggaacaacacatgattctcggagaagctctagctaccacaagcttcccaatagctttcactcttcatgtacttagtctatgcaacaagattcaacacctcccccatctcatcagccatcactgatctagctccccaaggtgcacatcaagtagtccaagggagcaaaacaaaaggaaggaggaagagtgatggcattaattaactgtgctgtgtaaccctgcacacatgtactggggtaggtgaggccattataagcttagcttcagcagagacaggaatactacacaggaagaaagccatagccagatccatagggttcttttcttccccctcactgttcttctacagacttcagagttcagagctgtagacgacgacacacaccggccggccggccccctactccctctctcatcatctcgccatcatccatccatctgatttgatcgttcgttcgttgcaaagcatatctcgatcgccagcagcagcagca

SEQ ID NO: 17779 - DNA, 443 bp, Oryza sativa
catggccaagatcatactcaagtgatcttagtgccatcctaaagatgtgagaactaattggtgcatatattgagttgatttgaagacgaggggtacataccttggacaagtgtcctctacgtacatgctggtcctgagcatctcaagtgcggtcttgagcctcggcttgtcctggtatatcagcttgttcttcctgatctgttaaatttggcatggcatggcaaagaacacaccaaactgagtttatatgctcaacgacaacaaatctgttggaccactgtatcaaatgttcagaaatcatgttgaactaactcatcatgtgggtttctctagcaaacttaacagttaacatagggctactaccaatgttaactgaagcaaatgttactgaaactgacttgataacacaaaacagaaataaaaaaactgcaaatgtttttgca

SEQ ID NO: 17780 - DNA, 1501 bp, Oryza sativa
aggtcgatctcgatcgaacgatcgatcgatcgatcgatttcgatcggttcaattcaaggcagcaggcaggcaggcagtgatgcatgcacctcccaaaattaaattaactgctccccatcaatcattcatatgcttctgaccttgaaaactacctcctgtctcctcctcttttggctgtcaccagtggtaaccctgttgccacatctgcgagctcattgacctccatagttaatcgactgtagagtggtctagcgattagcacgaccattagtcgatttgcacgtgttgtacaatgtagaacttgagcaagggtgatgcatcattgttcctacgaaaagcatctctcaccttacattctatatagtcactatgtgtctgtcatctttgtagcatgtttttctgttttaggactactttgaaatagaaaaatttcgtgagaagaaattatcgggtttacactagttttcctccgaaaattctgtaaaattcttacatttcaaagcaaccctaagatttagttaggcttttccaagtcatttggtagttgctgatcgatgagctagacacattggtagccaccaactaatgctgctattattgaagtacttgatacgtccttgagccggaggctagccaggttttaagcataagcctgcataatctgttctgacggtccctttcaagcatcttctgcaggccatagttgtcaacaatgcaacgagtcccttccatccatgcatgatgcatccattaatttctgatttccatccatttatatgagatcgcgagaaggaaattagagaaaaaaaataagaagggaggttgcagtacaggtgagcggcctgacctgccggccctgaccattaagttaagcaccaaccacaccgccaactcttttccttaatctaaccaccatatttaacactaatcacacacgatttaagcagacgacacttaatgagttgctttagcatcattgttattgttgcgtttaatttagctgagagatggcgaggcataatttgccacttgtcgaatcgcctcaatctctattaaaccatctccttcgttgtttgtatgccacgttagtaattataaattaattaaaattttgagttttttaaatgtttgaaaagaaataaaaattgggttgggtgggtgtgggtgtgggtggttgcaacgctgcgtcagcttggctgatccgggctatttggcaaccgatcgaaggagtgttgatgagcattgggcacacgacgagaaggatggcctacgtacgtgcctgcaatgcaatggctgggtgtggttgagctgccattaaaattccttaatggagtagaggttgcagatcgatctagctaggccaccaagtactactactgtagccgtaatgcttgggttcattcaatactgcgacttgacgaattcatttcctgacaatcttggctgtgtacagtatgagtagtactgtgtggtagcaaattaagtattgtgtatttgtgtt

SEQ ID NO: 17781 - DNA, 540 bp, Oryza sativa
ttcttctctaatgctctattgctgtcactattttggaaaaaactatgctgacttggtgtagtttttatcctactcttcccttgtagcgaggtatccaacaagtgggggggggggcccttttggggaaaaccccccttctctcggagctacttctaccaagcaaaagtgtaatcttctaaacgaaagattcaaagcatgggtgccctaaaaattaggacagcccagccacaatccccagcatttggaattccagccagtagccctcctttaaaaaaaaaaaaaacaaacatctatattctcaacggttcatattagcagtggctccatagtactatagccttttcaaatcacagggtaatccaataatagcttatttttctgtcagtattttgattcttagaaaaaatttctagaacaaataaacataattttgttggtttctgtcctacagtaaaattataagaaattaatacggagtattgacagcataggtgttcccatactcttatctgttatccaacaaacaactcagtccaaaca

SEQ ID NO: 17782 - DNA, 197 bp, Oryza sativa
acaaatacatatataggtggtgcaaaatgcaagtaaaaaaattactactacggctaggggtggattggagattggtcgtcggtgagttaaattttaactacgtattatggacctggtagggagcgtgggttggtggggctgaaggctatatcaggtgttgtttaataagtagcgccttagggtgctgtatagtagtt

SEQ ID NO: 17783 - DNA, 591 bp, Oryza sativa
aagcgtacatctgctccagtagaatatttatgaacctattcgaatagctgtactcccggaattgagtcccgggactcatatggtaccctggttagaaccttaaagtctacatatttacaaacttttggtttaatacttccagattgtttattattgctttttgcaaagaactttactctataccaatgcataacatgtttccatggtaacttgttgggtattgtgaatactcccccttctcttataacccctttttcagatttgggtcaagaggaggacccctatgattattactatgatgaccctgataacttagaaaatcccgagaggttatacctccctagttagaatgtataaaaacttccgctgtgtaatagtcttacttatgtttaattatgtgagtacctattattgtaaaacccttagtattgtaaactttaacgtatgcaatgaagaaccagctatattgtatgtatcaatatttactgatccagggattgatacattaatctcagtcggatccaagtcattagttttgggacccgatattcggtcttcgaggtagcctgggattcgagtgatgaggaccga

SEQ ID NO: 17784 - DNA, 1501 bp, Oryza sativa
ttgcatccacttgttaaaatcattgcatctgaatcgatctgtgggtcttatctttgaacacgctctaatataaatttataataatccttacctgacaagtcaaccgagctgaaaatatcactcaatccgaacaccgttttcaattcttcaggctagcatgcaagtcgctttctgataaaactgaaacagcttagtttatctgaccgcttgatcttgaagctaaatactagctaactaggcaccgtttagtataatctggagtttggggctggaacatggaagcagtgtggttgaagcctgactttctggaggaaatcgcgtgtttcccatcgttgcattgctcgtacgttggagcaggagatgtcacaagtgataagatgcttctgggtgcaggaactgaccgtgatatgctgcgatctctgatggtggccattgctcgtccacaaagggcagatagcttgggcaggttggaacagaatgttttgtgatcttttgcctctgggtcaactcatgcagtaatgcatgtatgacgcgatggttagcttgctaattggaatcgagaaataaaatgagcatccattttcacaacaactttgcactaccaagtacaatcgtttccgcaatcttcccgaactgcaaatcagggtcttgaaatcagcccaaacccccaaaaccactcttcatcgtgcgtggtgagttttgacttgaaaggccacacatttgacagttcagattgatgaattatctgatttttcctcatagctatttgagagtataaacgagtgaattaactattatgaaatagaaaagttgctttagaaaaatatattccaatatttattttacacgaaaatgcgttgattaatagcttgggaaacatctataagaaaatctaaaatatagaataataaaagagaacagggcataagccagtcataataaaagagagcagtctaagtcaatggttgtgtttagttcacatcaaaattggtagtttggttgaaattagaacgatgtgacggaaaagttggaagtttatgtgtgtaaaaaatttttgagtgatggaaaagttgaaagtttgaagaattactttggaactgtccaatatctcttccatttttcagacgaaacgtgtagctttattttttgatttttttaggctaatctgaactctgaaggcagtcatatggttgaaccggcccatcaacacaaatacaccatgggctcgaaccataacaagtcaagccagaacaaggcccacactatcatgggccggatcacggcccatctaaacaagcctttccacaagtcagcgacgcagtctgctctttcctgtcttctcctccacctttttatacaacgcaaatcgcctcgtcactactccgtacaaattttcttctggatcccacctctgctctgcccattcgacggcaacgcgctgccgcgccatcgcgccacgtcgcctcgtcttgcctcgcctcgtccaaggtcaacgagagca

SEQ ID NO: 17785 - DNA, 1501 bp, Oryza sativa
tcaccctgatccgaccacctgtactacatatatgtacaaacaatcagttcattctagttaagctcatgacctttctattattatctttgaacacattaatttctaataatttataattagattggacataactacgaatctagataagcttttgttcagattcatagtaataagatgtgtccaatctaatattaggtttttatccagattcataatatcgagatatatctaatccaattctagattgatatagctattactttcttctataccattctctttttttgggcttgaaataaacaaacatggaatgcacagttgcacaccatatgctgttgtaagtacagatcatcatcatatcttgctgctttgcctcgtggtcgttggctagttgcttccatgcattctggttgtctgtggcgagagcatgctgcgatgctgctcctggactggaacccagctggacgaacacgaggtctcaacttgcagctgtaatgctgacaagaaacatgcactcagcgtggcaaaaatccaacaaactttagcttcactactaccaagctgccgatgggtggcagaagggtcgccagatccgaagtgagcaacaggaatactatgttcaatttgaatccggatgcttttctcagtttcatgtgtagtgtaatcactaatcagttggtaaaaccgaaaatcgccttgctgaaacatagaacggttatcataagttgtcagctgtctggttgccaatgaaagaccaaagcaatgatcacatctgagatctgcatccagagtaaattttagatgccactagaaaaccagcagaatgaaactgaatactccatctgtttataaatatttaacgttattgattttttaaaatatgtttgaccgttcgtcttattaaaaaaattaaataattattgattttttttctaccatttgattcattgttaaatatacttatatgtatacatataattttacatattttataaaagtttttgaataagacgaaatgtcaaatatgttctaaacaaatttttaaataagataaggttcacttgttaccatcagataacagtagaaatatatgctcatgcaactatgcgagtggattcgccgctgtctccgtcaccgcctcaccggcgaggccaccatctcgccgccgatctcatctagcgcaggtttccctgaatcccgtcgcgagatgggggccgcccgatgaagcctaaacggcggatgcgaatcggagtaaagattttgcttaggcatttctccatcaaatggtaggacccacctagcagtgacactgacggctaacctttttggtacgtactcccgttccgagttacgggccgttgcttagcctttttatgggcccagatcacggcccgtcacgcgaggaggacgggtgggcccacgcgagtgataaatgggcctcaagggaccacccgacaaaacggccaactgcttccctccacggtccagtaatccacgccgt

SEQ ID NO: 17786 - DNA, 1501 bp, Oryza sativa
gctagttagtagtacatcgtggtattaccaatcgcgtgaaagattagctcaagacacatcagagacaaatcgtactaaggaacaacactacgaattaattgtggaacggtgtgtgtaagcaggcaactaactacatactccctccgtcccataaaaaaccaatctagtaccggatatgacacatcctagtactatgaatctagacatacatatgtcttcgtagtactataatatgtcatattcggttctagattcgtttttttatgaacagagaccaacctagtaccggatatgacacatcctagtattatgaatctgaacatacatatgtccagattcgtagtactataatatatcacatctgatcttagattcattttttatgggacggatggagtataggcaaagatatatggttgctattccttaaactattgttgcttggataagcagcttgcaggcttgaaggttgcaatggatcttaagcttttgcgtggtgcatgagagtgagggtactcgtgtttaattctgcaagtatcttatcgagtgaacccgagttaatgaaaaccgtgtactctagtgcccaacttccatagctacaaacaagaccacgttcctgaatcctgaagagcgtaacgtctgtaccaaactgtttcatttccagctgctagctgaagtgcaaatgcaccactactgctggaagccacatttgccaaacccattagctttctgctggtaaccgtaagcagcccaaagtccacagattacgccacatgtttcatgcctctgtgaaatggactatcgacgtctatatgcgtttcaatcataaaagagccccgataaaagaaacaggacagggttgcacaacaggcagcagccttgagcccttgactatgttctaacatatactccatccgtttcacaatgtaagactttttagcattatccatatttatatagatattaatgaatctaaacacatatatgtgtaaaatcaaaggtgtttttgattattattctgtgatgaacaattgacatatgtgattattggttttcatatttgaagattattgacgaagtggttttggagatgattggatttacaggtgttaaacatgtattgctggatttggtccgatcagaccgggcatgggttgccggtcagaccggcggttatcgagcggtcagaccggccagctcgcggtttgatcggccgaccctgtgttggttttggtttcgggttgtttgtttggatatccgtgattgttttatgtttatgttttctagaaggatactatgtgtatgtaatactgttgtttgctactaatgagtcaagttggagatagattggtcttggaatatggtttctttatttgcttcatgtgtaggtgactcgatgtctcgggagagtattgccggtgatggatcgggagttgacttggggataaggcgatgtccgtgacggtcagatatcatgcgggatgcttaggctagagttcaa

SEQ ID NO: 17787 - DNA, 1501 bp, Oryza sativa
acgggattcagggaaacctgcgctagatgagatcggcggcgagatggtggcctcgccggtgaggcggtgacggagacagcggcgaatccactcgcatagttgcatgagcatatatttctactgttatctgatggtaacaagtgaaccttatcttatttaaaaatttgtttagaacatatttgacatttcgtcttattcaaaaacttttataaaatatgtaaaattatatgtatacatataagtatatttaacaatgaatcaaatggtagaaaaaaaatcaataattatttaatttttttaataagacgaacggtcaaacatattttaaaaaatcaataacgttaaatatttataaacagatggagtattcagtttcattctgctggttttctagtggcatctaaaatttactctggatgcagatctcagatgtgatcattgctttggtctttcattggcaaccagacagctgacaacttatgataaccgttctatgtttcagcaaggcgattttcggttttaccaactgattagtgattacactacacatgaaactgagaaaagcatccggattcaaattgaacatagtattcctgttgctcacttcggatctggcgacccttctgccacccatcggcagcttggtagtagtgaagctaaagtttgttggatttttgccacgctgagtgcatgtttcttgtcagcattacagctgcaagttgagacctcgtgttcgtccagctgggttccagtccaggagcagcatcgcagcatgctctcgccacagacaaccagaatgcatggaagcaactagccaacgaccacgaggcaaagcagcaagatatgatgatgatctgtacttacaacagcatatggtgtgcaactgtgcattccatgtttgtttatttcaagcccaaaaaaagagaatggtatagaagaaagtaatagctatatcaatctagaattggattagatatatctcgatattatgaatctggataaaaacctaatattagattggacacatcttattactatgaatctgaacaaaagcttatctagattcgtagttatgtccaatctaattataaattattagaaattaatgtgttcaaagataataatagaaaggtcatgagcttaactagaatgaactgattgtttgtacatatatgtagtacaggtggtcggatcagggtgaatgacaaaatggtccacatgcaacagttacagaaaaagaagaagcctatgttctatttctgtttcagttcagacaaaatcagagtagcctccttatgtgtcactgacagtgggccccacaggagaccaacgaacacggtcaggaactctccccccatttcaacggaaaaaagtttcctcttttctactccctctctctcatccatttctccggttgagcggcgccgcggcggagccgaggcgagcgagcgagcgggcgcgatgaacggcggcgggagcaggcggggaggtgcgtcgtgcg

SEQ ID NO: 17788 - DNA, 1501 bp, Oryza sativa
ttctctccgtgaaaataccgtgcaaacgcataggtacaactatgatcaccttaaaaaaagtagatcgatatattttggaattgataaagttatcactgtcttattatcgacaagtatatcgtctatcactaaaaatataattggccgcaaatacgagtatcttttttcttaacacatgaagacgcgcacacgcaaaacacaggtgtcactttcgatattggtggtcgttttcttcagcatcgatctatagcaaagcatgcagactggtcatgaatcatgatatttgtcacgaaacctttgacgccgttggtcgtttatgcacgtttctttgactcgacgcatgcgccgttgattagtgctgtgtgtttgtttgttaatctttcgatgaacatattggactagctagtatgctatcaacatatcaattaggcaattaccatcaaaggatggcagcacttggggccacattggcattatctcaatatctcggaatgatgtgaccgaatacaaggaacatgatgcggatcatgattcgctggatcttgttttctatagtaaagaacagtgcaacacatgcgcgcaaaagattagtgcaaaattgagatgattattgcacatggatgcatgatgcaggagggttcactgtctaatactatgactgcaatttttctctccgacgagacctgtgtgatttgatgattgatcaatctctctgtacacttaaggtccataaatatatctggcaaaaaaaaaaagggttcatgaataatatgcatagtgacagaacacctatcactttttttttctatagaaagcaattaagattcatctttttgtaccacacaaggtacaatggtagttcaagtaacatagatatcccaatcatcatttactcattcagtacgtcaacatcttaaagatgaactacatggcacaaaaaatcttgtcaggctgaagcagatgttgatttggagagcatgactcttttgaacagaagaccatgaactatagctgggggaggaaaaaaacaactgcttgattcttgaacttcctgtcactgaaatgaggaaattctttgttattgcacaacgtcgaacctacttgcgaagtttttcagcacatcatccaacgacatgtaaataactaacaagttgccttttcttgttattgaacttcagttggtataccagtgcactcttgcttacgataggttgaaagcacatggaaggaaagcattgaccagcttgattatcacataaaagaaaaattagataatccacccttagctgggatgtgtgaggtagacactgatgtcaaatataaggattgaaacaagacatgtgtgaatttaaaagaaacaacttccaggagcatcgatatcttgttgtatagtatctgatgaagtatacattgatgtcagctacaaggattggacggcatttgcgagaacttcaggatcacatccagctaaaaaccattaatacatcagggccagtggtaa

SEQ ID NO: 17789 - DNA, 1501 bp, Oryza sativa
ccttggcgaccttctctttcagagacgccgccacctgatggtccatgagtggctcgatgatgtcagtcagagaaagagcatacgcttaatcaagtcataaggtgatctcgaagaaaaaatccgcgatgcttatcggatgcacttatgttgatagcatcatcacgctcagccgcccccttttcacagaggggcgtggggatgttgctcgccgttgtcggaccgctgatcatcacctggccgacacggcactccacggcctcgatgtttagacctgtgaatcgagaaccaaatttcgatgagtcgataggaacgcgaacataagcatgtcaggataaatgtgagaaagataccccgaggagaaaccctggtcgcgtcctccggtccggaatagttataagctggataggcccgagcctggagcgactggatccgcttattaacgaagtctgcaacgacttcataccccgacaagccccgtactcggagatcatcgatgatgtcgataaacgactgaagagagggggtcaaggggggctttgcggtccaagaagaaatcttgtccggttgttctttgggaacaacaaagacggggttcgaatctttgatctcaaggtagaaccacctattccgccatttgctgcgagaagaagggcactggaaggggatataacgcgacttcaggccttcccgaagtcggaacccgacgcaaccagataccctgttggattccatccaacgcagttcatagtaagagcgaaagagatcaagaaaaggctctaccccaatgtaggcctcgcaaagatgggcaaagatgctaagaaaggcaatggaattggggttcaaatggagaagagaaagaccatagaaattcaaaaccaggagaagaaactcggaaggtggagtgagaagactgcagagaacataatcttcgatcgcaaccatgcgacccaagatgggctggggattagtacctcctgtttccctctccatggttccatggccaggaagggcgccgtattcctgaagcttcttcagcgacgcactggtggaagatgacttgccgaggttgattgctgattcaagatcgccggagaaagggcctaggttgatgaacgcttacaggtggaatgttttcaggtggaatgttttcaacacggttggcagacttcaaaatggatctccaaaattcctttaaataggcgcactaccgacggtgcgaattccaaggacagagagagatgcccgccggaaatttctgggtccgttatgcgcggcggttttttggacttcaatttaaaattcgctcatgaccgttgggctttgaatggcatgctcggctacggcctgtctccgcggtcctcgctccaggaatgacaacagtctcgacacccgaagtcgtgaatggttacacgagcccatttttaagcagaagtcgggggctactgtcagggttacgggttaggcataccctttacccttcgatatatgtaacatatcggta

SEQ ID NO: 17790 - DNA, 426 bp, Oryza sativa
gtctgaccgcccactcaacgctggtttgaccggccgggccgatggggccctctgacagcactacaacggctagttttctaggcgttgcagagtagcacggtctgactggccacatatctccggtcaaaccgacagagcacaaagttgggggatttcgcccccaacggctagttttggttggtgggagtataaatactccccctccagcagcaagggggctctcttggcacccaattcaattgcatacaccccttgcacctctctcacacccacttgagctttgtgtccatccatctaatgtgttagagggttaattagccaagagtcaagtgcattgcttccatttgaagagctagtgtggcacttgattgatcatctgcacgccgggtcattgcttgttactcttggaggttgccgcctcctaga

SEQ ID NO: 17791 - DNA, 1501 bp, Oryza sativa
gaatttaaacttgcatgtttgtggagtgatatatttcataataatctatgttgtcaatttttttcatattttttatgactatttaggtgatatgcacgaaacgaggggatatctcctcgatggatgattttactttcccatatttttattgaagctgcgtagctgaccatcacgaaagaacgaacagattggacttcatggctttcaatggcgatcaaattcgtaccgtaggctcactctaataaacccgagatacaagatacaaaaaaatcagacaattagaggcatagatgagggagaagcgctgaaaagaagcagaggaatgagatcagatagtaggaatttccggaagagggggactgggggaggtctctattagtttctacaggtgatgtttttatatatatactaccttcgttcttcgttttcttcaaatagatgatgtgattaaattttaaaataacatttagaataacagttagatacaagccctacttaaatttatataataataaaataagttagaacaaaataaataatattaatatttttcttttgaaaataagacaaatggacatatgtcatatcaaaagttaacatcatctattaaaaaacggtgcagtgttatctaaaaagttaattacaaatttgataagatagaacaatatattgtatatcagcccacaaatatgtaagttcaaatttaacgtatgtggtatatcacttaataaacatgtaagtttaaatttgacacctatataaatatatttttttagcatgtttgtggggtgatgtaccatagatctatcttttattttttttaagaaaaaagtttgtgactttatatacgatatgcacaaaccgagaggatgtccactccattctaccttgaagacgcagcaatgaacacgaagagagccaactggcccacctctaaggttttgtagtgttcttatgatgttcatcatgtcttcactctgtacactcccatcgtttaaccttcagcttataagctatagccgaaatttgatatgagttacatttcactctttgtggtttttttaattaaagtttaactttcaatatttgattttaatttactaacaaactcatgtataaaagttttatcataattatcttttgttggtctaagcagtaacagcttatacacactactatagaacttcttctaatagggctcggctcatagtagccgattcaattggaaccggtacttattaccatttcccacctccatgggccaaaaaagtatacaaccgatacctttgaacaactataagtactggttttagagaaaaactagcagcaatactattgatattgattttttaaaagaaccagcacctataatgtattatagttgctggctaattaaaacacaggtatccgtaaaaaccaagctaagttgagcctctcattcttatccattcacgctgagtcctctaacccactgttctctcattttcccctcgccaccagc

SEQ ID NO: 17792 - DNA, 389 bp, Oryza sativa
gggcgaattcgagctcggtacccttaattacaaaagatttgtaaaaatgatgattttagcttaaaaattcaaattgaatagaaacattgatgagattacagtctctcctatgcaacttgtaaaatcatttgcagttgatgatctaaatgaacctgccgtttcgcaaaccaagtatgcagcaggagttagtggctactgaatactgagagggcaaaacaatactgccaagttggaagtggtataatttcctgattggattgcattttgggacccacagcctgatactgctgctggataccatcaagctgttgaaacctcagaccatggtaaacaagctttaaaacccccggctgtctctccccacctttggcccttctttcaactgatac

SEQ ID NO: 17793 - DNA, 1501 bp, Oryza sativa
ccggatgtatgtatttaggaaaaggatctaaccttctaaaataaaataacggattcaccgatttaaatgaaaatcgatggtcggagccacttgatgacctaggagcatttgtaaggtatcgcttggtggattaggagtacttacaggatgtttaatggagttttagtatataatattatttttctgaaatttttaagatttttttgatttaataatgtcatatagtagcttagaggtgtttataaaatgtttaacggattttaacactacacgggggtggggagggatggagagaggtctaggattttttattaaaaaatctaacgacctaaatccatcaatttaagtagaaatcgatgatcggttgcttggaattttttaaaattttctagtactttttctaattcaatagcaccacgtagtgatttaaaagcttctgtaagatctttaatgtgacggagggagagctgctagacttagtagttggtctattttgtgatttttgactgtaaaagtaattttgattttagtttctcattaaatagaaaataaaaggaaggaactgaaagggaaactcacgcacgtaagttcggcaatatgatgccaaaaatattaggtacgttggttccagatgttttttttttgcaaaatagatctaaccatccaaaataatgggtccaccaatttaagtgaaactagattgtcggatttctcttatttattagagtgccaattggcgacttgagagcgtttatagggtgccacttggcagtttgggagcgtttgtaggaagttttatggacttttagtatataatagataatgcaaaaaagatgtaataaaaatagtatcgttaacacaaagaaactggtgtgaaaaatatacggggagtaatatcgagcccctaatttgtggggagtaaagttttaataaaatttaaactaacttgtggggagtaaaattttaactaagtttaaatagaggggagtaaaattttaactacgtagatataaaggtctgattttgctatggaattttttactggaattaatactaccggatgtaagtgggaaaaagattaacaaaataattttattagtgagaatggaccaactgcagtaaatattttacttaacacaggctggcgtcgggagtgctgcatgcggaacgaataagtcgggaggaggtgggaggaaaaaaaaaagaaaagaatagcggtactaagggagttaaaaccgggaaaagcggaggcaggagggggaggggggcgagtgttactcgagatgtcgactagagggggtgaatatgcgatttaaaactaaatgacacctaatcaaaactaacttaagttgctagggttggtgagggtgaactctaactaagcaactaagttatattttgcaaacctagggtgatagtggctcaattatatctctaggaaagtaaatcacactcctatgtcaatgtttagcaatcctagggtgatatgatctcaagtatg

SEQ ID NO: 17794 - DNA, 234 bp, Oryza sativa
cccccccccccccccgagggggtcaggccacgtgggtgaccgcggctacccaagcctctagtcacgatacccccggccccatgtcaccgacacccctatagaccataaaaggtcacctcctatcacttaagtgagttttgttgcaaatcatcataatctccaaatatttgggtggttagcaatactgaaactcacacatttcaaaaattgctccaaaaatctttttttattaga

SEQ ID NO: 17795 - DNA, 524 bp, Oryza sativa
taatctggattattaggagtaaattgaaataaacatatagcttattatgatagattattacaatctataagccaaattactataatctagtaatccactctaattgtgctttttttagattattgggttgctaacacctaacaaccagctaatgatccagagaaacaaaaagctaacaacttattctatgtcggcttattataattcagcttatagtaatttgtctcaataatatagattacagtaatcttaagctgaaacaaacaaggcctaaagatcctcgaccccctgatatgcctctgacaggctatgaaccatctttacttcccggttggtgtaccaaccgggactaaagatcaaaatttttataaccaggactaaaagcaaccttttgttctgtttctttttggaaccgggactattgttgattttgccagaccgaccaaagatggtttagaacctagaggttgagaggtatccgtcgatgagcttggccactgttctaactgcatgagctcgcttga

SEQ ID NO: 17796 - DNA, 218 bp, Oryza sativa
tgtatctaaatgatgtttatcacagctgcaccaagtttgggtagtgtacggcgtacctatatcgatattaatcaacaattttgtagttctataaaagcttgaataattatgttcggctatttgaacttttcacgtccctttctcgctttagattaatcatgcttcttaagtactctttacaatgtgaaataatgaatccccttttcatccaatacagg

SEQ ID NO: 17797 - DNA, 343 bp, Oryza sativa
cccaatttttggttaaggtgtggtcttattgcttgattatactaaaaaccaaatgggttttagtttgttcaggttggttatttccattgttgagtctaagaaaacaaattaaagatgcctaaggatgaaatttgctaggtatctgtggtggcgttggcattagatgtagctgttccccattagctatgcagtggctgtatgaactgtgaagggtacagaatcttaaggagcccttgatagagtcattgaatcctttttgctcttcatactacaggcttttgagatctgtcttgtagaagaaccgatagctgataagttgtccttgttctaactatgctttgtt

SEQ ID NO: 17798 - DNA, 1501 bp, Oryza sativa
atggcactatcattgtcacataggagtggggttttggtgaaggatatgccatagtccaacaatgtttgtttcagccaaagcaattgggcacaacaactacccgccgaaatatattccgcctcggtggtagagagggctacagagttttgtttcttggatgaccatgacacaagggatctaccaagcatttggcaactactggatgtgctctttctatccactttgcaaccggcataatccgaatcggaatagccaacaagcttaaacttagcaccttttgggtaccacaagccaatagtagaggaatgctttaaatatcttagaatccttttcacggccactaagtgacactccttaggagcggcttaaaatcgtgcacacatgcaaacactaaacatgatatccggcctagatgcggtaaggtaaagcaagataccaatcatagaacgataaagctttaaatctaccggtttacctccctcatcaaggtcgagatgcccgttggttgccataggtgtcttgatgggctttgcatcctccaagccaaacctcttgagtagatccttgatgtacttggtttggcttacgaacgtcccatccttgagttgcttgatttgaagtccaagtaagaagctcaattctccgatcatggacatctcaaattccctagacatcatatcaccaaattccttgcaaaatacctcattagtagaaccgaatatgatgtcatcaacataaatttgacacacaaagaaatcatcaccaatgatttttgtgaaaagggtggtgtcaacttttccaattttgaaatcctttgacaaaataaaatctctcaatctttcataccaaaccctaggagcttgttttaaacatggttaggatttttaggatcttcaaaaccggaaggttgttcaacaaagataagttcggcaatttcaccatttaaaaaagcacttttcacatccatttgaaatagttttatatcaaagcatgatgcaaatgcaagaaggatgcgaatagcctcaagtcttgccacgggggcaaaagtttcaacaaaatccaaaccttcaacttgtgtgaaaccttgtgccaccaaccttgccttgtttcttaccaccaacccgttctcatcttgtttgttcctaaagacccactttgtccctatgacattgtggtctctaggtctttcaaccaaagtccacaccttgtttcttgcaaaattgttgagctcttcatgcatagcattcatccaatccggatcacaatgagattcatctacatgttttggctcaagacaagaaacaaacgagtaatgttcacaaatcgaagcgacacgagatcgagtttgaacacccttactaatgtcacccaacacttggtcaattgggtgatccttggaaagagcggtgtgtatccttggtggcataggtggatcttgtgccttctcctcttccacttcaacttgagcttgacttggcatagcggaagtagatggctcatc

SEQ ID NO: 17799 - DNA, 1441 bp, Oryza sativa
atatacggtatatctttttataaatatgcgagttaaaatttgatttatataattaaaaaaacaaatttggcagtgaattacatgttcttttcatagttaaatttgttatttttatttctacctgtataagttgaatttaaatttatatgtttgcgaagcattatagatcgaggaccccgagtcccccaagctatttcgagcgataaagccattcctaattcacttcacattttcctcctgataagttctctcccctagcccaaaggaattttctcctgagcttgtctagcgcctctaacaccgctttggaaacctgatggaggtgagatggtagatgggttgcgagattagcaccacctttaggcctggtttagtttccaaaattttttctcaacaacgtcacatcgaatttttgacacacacatggagcattaaatatagataaaaacaaaaatagtgcatagtttgcatggaaatcgtgaaacgaatctttttagcctaattagtctatgattagccataagtgctacagtaatccacatgtgctaatgacggcttaattaggttcgaaagatttgtctcgcggtttccagccgagttatgaaattagttttttttattcgtatccaaaaacctcttttgacatccggtcaaacatttgatgtggcatccaaaaattctcatttcatgaactaaacagggccttacaagggcggatctaccggcttgattcagaagctttccttgccaatgtgtcagccttgtcgataccttgttcactagggggaaactgaaacttactcccttcgtctcaaaaaaactcaacctaagagggaatgagattcgttgtctttagagtggtctggtcatatcctcttttagattaagttattttgagacgggggagtagctttgaaggagctaatggtagcctgagataagtcagcgggaaggttgttattaattgttgccatgaggtgcacgagcatgctgttgaggtcgagggaccgacatcgaattgtgtattcgttcattcttaacggaagacgataaaccttaccctatttaattttccctactgaattttatccttattaatttaatttaacaaagtcaacttgatttcctcaatgggcatttttatgtcgcatatatgcttgcgtgcgcgcttcatgcatgtcaataacttagtataccatactaatctatgtaatgaacccaatcgtcttggaacagctctcgccatggacgccttcgtgcatacaagataatcttggttttgttcttgataatcttggtttatccaagattagatagtactactagtaatgaggtagtatataaatgtcgtctcgatatgtacacccacactgccacataaatcctttgcgaaaggaaagggaaatggaagacgcgtctcatggctacgtctacgtcggct

SEQ ID NO: 17800 - DNA, 1501 bp, Oryza sativa
ttcattctgaatgatcatggatggacatgatagtttctcttagtttctcattcaagggtacactataatgtttaagtgaaaaagaaagggagggtcatattaggcatatgtcatccttattgactgatatgactatgaggaataacaattctaaagttgtaagagctgtgatttctatgtttaactttctttgacagacctcttaaaacttgttcttctgttgctactaaatttttaaaagtatggtagtatgatgtaaagaatgtacagatttcatgctttgatgataaacctttttaatgtggataggatgttgatgggaggcttctgactgtaaacaaggcagctcctagaggcgctcgggtggaaagacctccccgtcagtttgggccttctttcaggatttatgtgggcaatctcccttggcaagtggatgactctaggttggtacagctgttcagcgagcatggcaaagtagtcgacgccagagttgtgtatgacagagaaactgggcgttcacgaggatttggttttgtaacaatggcgacacaggaagaattggacgacgctattgcagccctcgatggacaggtaagtgtatattcgattcactgacatctttacaactgggattaagcaaccactggtaatcattgttacatggaggctgtgaactgatgctaattgactcataccatcaataacttttgtgtcttttaactttgcttacccaagtaacacacttttccaatctgaattcaacagagtttggatggccgtgcgctgagagtgaatgttgcagaggagcgaccaccgcgccgaggcttttaatgggatagcaggctttgtgggggtttaacagcatcggaggcatcatagcacgtctgatactggtttagtccctcaaatagtagctttcttgcgattcttggttctgtatcctcccaagtcctttctcatgcctgctgtttactgctcctttcttgttaactgttggttgtggccacgagttgatgcacgtaggctactgttatgatgcccctctaccccaatttgtcgatgcatccaaaagttttgtctaacatttatctatttaagcaaaagaagagcatggtgtgtgtggcatttgtgctgtttctcttgcggaaactgcttattggatcaggcttgttcacccgccttaattattccttttgggttttgtttgcacctttgcattgttttttctaatcgtgtcgtattaggtttcatcaggctatgctgtattatctgaggaaacgatcatatcatacgttggtttccgttgcatgtagggtagtacgtcctcgttaattacgtttttgcatacatacatcatacagggcagtccaatggatgaacagttgattggatcgctcgctagccgctgatctgatctgatctaatctggtcgacgtccatggatgccgtctcgtccagctgcggctggcccaacctcccgccggacttgctccgggaaatc

SEQ ID NO: 17801 - DNA, 1501 bp, Oryza sativa
ctttcaacagggagatgactagacgtggtgctcgggttgatggtggcggaagcgattggcgatccaatcggcgggtcggacacttcgggcaggtggcccggactttccggtgagctactctcgacagggagacgtgcggccgcatgctcgggttgattgaagttggaggcgatcggcgttctcgatcggtggattcgaacactttgggcggggtggcccgggcctttcgatgagttgcgttcgacagggagatggctagacatagcactcgggtcgttcggcggctgagaagacggcatgcgacttgtcggcttcggctcgcgactagatcgatggcgatcaatcggaagtcggagcgggtggatcccataggctgtttggaggtgttgacgaggtatttgcacgatggaattgtttcaaaggcggcgtattttgtggcatatggctgaacaaagcctagggcgaatagaccggcatccagtagcggttcaaccctggagaggctttggttcaacctgtttttccctctagcagacaagaagaaaaccacacgggctgtagatcaatgacaacagttgttggtggagtcgtcagtggtgcttggcgttggtgctagatgttgtcagagatacgaagaagcccaggaggtcagggtcgtgacggtgtgcgcgtcctgcgtcgaagccgagccggtgacggagatcagggcgatgccgagaaggagctggctagggtttagctatgtcgtgcagggttcggtcttgagggtttgtggtgtggaagacacggacatggagtcgtctccggttcggtcatggcacggacacaatcgaagacaaacagtggataccaagtttcaacacgaaagggaatcggacgaggacttcgattcgttcaggaatcggactcaatttttcccagataaaagcaacagaggaccacgggattgcaacaacgcaatcgaaacaaatcacctagcagagggcgagattcgtacctgattttcacagaggcggaggtggtttgggtggcgaggtcacgggcggctggaggcgcatccttgtaggcggtgtgcggcggcgtggagctcggcacggcattcgtcggggttcgcaggagcttgcggcggcggatgcgatagttcccggcgaggaaccgacgcctgacttcggcggcggcggctcccagtgcgtaaggcggcgtttccctgctgggccggcggcgcaaggcagcggcggtgcaggcgcgatacggcggcgagaggcggcgacgcatctggaggacgcgggtgcagagaggagggaaggaagccgaaggaaaaaggggatcggctcgatctgagccggtctttgaccgctgttgactggctttttgactagaaaagaaaaccgatcgggttggttttgtccggctagtgactgtagtcggtgggtcaattaatcagggcagatcaatttaacagggcaaccgctgttgagttgattatcgtcgatggcggcga

SEQ ID NO: 17802 - DNA, 1501 bp, Oryza sativa
cgctgcaccccatcccgccgaggttgaagctcttgatgttccccctcagcttgtacttgttcacgatcatggcggagagggacggcgtcgggttgaacaggctgcagttgacgacgagcacgccgacgtccttgggcttgacgccggtgaacttgaacagcttgtcgagcgccccgaacatgacagactccgcctcggcgcgggcattcgccatggttggttccggcgggatgaggtgcatggcctcggggacgtaggtctcctcgctgaggccagaccgctcgaggatcttgcgctggaactcgaggcagtcgtcggagaatccgcacagcttggagtggtggaggaactcgtcgaagcggaccttgagcttgtcgggcggcttgtagcaggcgaagtcgacgaggtagacggggcgtgggcgggtgaggacgtagacggtggcgccgaagacgaggacggcggagaggacgaggacggagacgaggttgtactggaggtggagccagagctggcggagatcgtcggggtcggtgcggccggcctcgaggacgatgacggccatgagcggcagcagcaagagcgtgaggaggtgggtgatgaggtagtggtaccccagcttcacgtacttgaggttcacgctctggaggaagtccggcagccgccggtggctcggcgtcgccgccgccgccgccgcgtcgccgccgttcatggctctcgcctagatctgatggcggaatcaatcacccgagtcaaagatgtgggtgctcgtccgagattgcgcgtggactggactgcctgcctggtggatgaacggattgttcgggggcggcgatgattggggggcagctggagaagagtgggagcggaggaggaaacggatgcgaggcgattccgccgccggcggatgcggatgcggcggcggcggaggaggaggaggaggcggaggcggacgcggacgcggttgtttggggctttgtgagaagggagaggtgagggatgggtggataaatagaagtagttaaccacaggcgaggcgaggtgtggtatagttaatttgaaggaattttttcagggaacccctcgaagtgttggagtattaaagaccgcaggttttttttccttttctggaacccctcgtagtgttggagtattattgcgatattaaaggccgccgggtctgcctgttcaagcgatcccattccctcccttgttaatgtgattgtatttaataataatgttgtttgcttagcaataatattgggcctacattgtttattagattttcacttatgtgctcgaatcctctaaaccagtagttttggatgttccactgcactattatacaattttttgtgaagtttaacagctgacatcagttttttttttaattctgttcatttttcgaagttgataatttgaaagtagcacagagctgatagtttcatatacagtcctaagtagactataacaacgaggaaagacaattaatatccaacta

SEQ ID NO: 17803 - DNA, 1501 bp, Oryza sativa
catgggctatctacttgattataaagataaattaaatattttaaaaaataagttaacaaaacaggttagaaaaaaagtttaaccaatcagtagattttttaagtaaattacacccacagtgcaacaacttgagagcaataaatgtctaagtgcaacaacttgataaatgagtgtattatatagtgcaagaaatattctggggcaacaacttatgtaagtacgtgctattttggttaacaagtactaggcgagttattttcatgatattaatataacatcatatagcaattctatagatattgcctaatcttagcaattctatggatattacctaatcttaaatttaatatttaaaatttacatggcacatccaattcgcatcaccggtttgatttttttattcaccttctgaaatctcaattgaagtataatattttctacatagtaaagattaattgactttcaattattacaataaaaaaactaaatatgtttatgcaaatccgtacaagtatagtaacaaaataagtactaaaaaattaaatatgtatatcaaatgctcaaaataattaaattgtcatatcacttcttaacttattggactaaaatgaaaccgtcctcacaagttgttacactcgtacggtaattagaaagtttttgcgctaaattacaccctcctgccttgttgcaccgcaaatataatttactctttttttaagaaaacatttttgagaagaatggatcaaataaactataacaataatgtgaagaagcagccgagaagaacgggatctaagctagctcggtgtcgctgttgtaacgcgggttgtttgacattgagattagattcagtacaagagccatccggtggaatttcttgcctattttcccccctttcttttctcagggaatagtacctcaatattcatccattcaatttcaagtttgcactcactcaatatcgatgaagtaccgggcaatttttctagtttcgatgcagacggacaggggatatgaacagaataaagaaaacggctgttttttttttctcgaaccgattgccacaagaaattcgtgacagttacgtgctctagaaaatgaaatggacagggtgactacgagatgaagtcgagagtgacagagcacgtgtacacttggacatggacgtgtagaagaagcaggcaagcagcatatagccctgatctgatgacctcgaaagtgaggaggcccaggcccaaatatctgtcaagaaaatcacggcccaatactacaaggcccatatctctcgcacgctgaaccgaaccgccattctcccccgcggagtaagcccgcccacccacgtgggctccacgtgtcgcttctcccgaggcccacgaagccactccatatcttcgccatatttagcggagcacacgcgttcgtggcgagaagcagagagaggagagaaatccagagacgcctcgacccctccatcccgatcaaggcgagaattcgtcggcga

SEQ ID NO: 17804 - DNA, 1501 bp, Oryza sativa
gagcaagggtgagtacaggagtactcagcaagccatgggaatttaagtgtttaatgcaggcttcaaggaaagactgttgtttttgcaattaattttatttaaactcctttttgaaaccactaagtgagtgcttctcaaacgacacggatgagacagtgcatcacgcccggtcggagtatgtgcaatatatcagtctttgaattgattcaaggttggcacccagccaacaactttcaaacggccacacgggcctgactgatcccatcagccgccgattttccaaatatcgaacccattccacagcagcaatttcacaaagcagtagtcaaacaaaactacgctaggaatcacctcacatccgcccatgaccgtgggcacggctgttcgaacagtttaataacctctgcagagggggtacactttacccacacggcattactaacccggatcatccagcccgtgcagaacggccacgtctagagaccttaaggctttcatgacagggcattttgaaagccgacacaggttcaccatatgccaacgagaggggtcccagaccaacaccagattaggtcccagaccatactgtgccaggaaacccgggggttctccccggcaccaccccgttgaatccatatgtctcttggcatcatggttccctcgattagctagttactcagccaggggtgtcccattctacccatgtggtcgcacttgtcttatgctcggatgaaattccaaggaaacggtccttaagtgcaagagcgggaaaccgtactcccggtacattctccggtccgcgattttggaaattcatttagttcgcaagcaccgacccaggtgtcgggttttccaagtcttttgtaaaaccccaagttttacccatcgttggatgttttaaatttgaggggaggtgttccaatgcgcgtgcccgaaggcccgtgcatcgaagcacaacagtcaacaaaggaggtctaagtgttcaataattcaaggagggtaattgcagcaattaggatgggggccgacaggctatctcgcaagccgcggccgaattactcgtgttaatcctattcatgcaatatttgcggaaaagaaatacttagatttaaattataggtgcaagatgatcaaaggtgacttgccttgctcgagaccttgagcttgatcctcgaaatcctcgcactgcgggtcttcgggctccgaaactacacgcgaaacgggacaactcaacaaacggcaaaaataaagccctattattgacctctaagcgtgctattagatagatctcgagatttgaggaattttggaagttgaacggagtcaaacggacttacggttgggaagatattgaatttctaagattattggattttttatctaaaggaaaaaggatttaattaaacccttttgaaaaagaaaagaaagagggaggaggaacggacttcgcgggcggcttgagcgcggcccgagaggggttggcacggctcggccttgccat

SEQ ID NO: 17805 - DNA, 1501 bp, Oryza sativa
cccatactgcatatatcattataacatagatgattttctacaaatgagttagtccctcggagggactaataatattttatgttgtgaatactaagattaatgctcccgacaccaaatattgctgactagagggagtataactttgctaagtcttgattgaagcattttattaataatttactacatcaagtgaactagatggtgcacttgactaaaggaagtagtcattctcacatgttgttccgcaacttgactaaaggaaccaaagataatcatagatgggcaaaaacatggcagatacatcaataaataaaaatgtgttatccaagaacatttcttacttcggcagtgatcttaccaacgggattgaaaaaagcaaataaactttttctgattctttttgaatgacttgatttgtgtacatgaaatagcctccatcaaatcaataaaagttcaaaggaatgcaaataagaacataaatcaagagcaattattaaataataaatgtagaatcaataaatgcaacatatatcaatatcatattaacatatgactaaagaagtacaacattttcatgaagagaaaaaaaagagaggaagaaatagcagaactggtaccttaagcaaagtaaaagttccatcatccataaaatcagcaccttccccactcttattatcctgcccggctatctgagtccttaggtacacatctgaaaaataacagccacagattatagatgcattaaagtggagtttctctaataacatagtacacacagggcattcagaaactgttagttaagtttctcaccatactgcagatctccacaaggcaaagaaaatccggttgtttgctcatattgattgaactctccagttttagccagctccaacttattgttttgtgaatgtacattctctatggtattatctaaattaaaggagtcataaaactcactcccaatatcatcatcattacaattgttcttcatcatcaatgttagcatattaatgaatgctgcggcaatatgaactataatacatacgctgcaaatatttgacaaaagaatattttcattacaaagcaaaccgagtctagaataatattctaaaaacaaaatgaatacaaaatagaacacaaatgaacgtgccatcatcatttctttgtggataaaatacacttaaaagcaacaaaccagtacaagttttcatgtaatgaaaaaataaatgtgtaaacacaaatggataggagaaacctaaaaacatctttcggagacaaaccatgccaagatttaatcattacttggttcatcataatcatacaataagggcaaacaatcatgtattcctattcctggaaaaaaaaaacaaagtatcctcgcccacacaatccataacagcatagaaatctatttcaaatggtaataacagtctttttacactttgctggtgctgatttcaattagtatgtttagtttctacacaaaatatactaactcaga

SEQ ID NO: 17806 - DNA, 201 bp, Oryza sativa
gttagttttagagtagtgtagcagcatattaatagcaggtggcttgttcaggaacatatttttgccaagccaaaatacactgcttaatgttgcaggtactcctgtaaaatctgctgtagttgttttttgttatccctaccttcatttttacctccattcctatgctaagttggtgatactaaattgattcttttctgcagt

SEQ ID NO: 17807 - DNA, 1501 bp, Oryza sativa
cgacgatttttctccaacgcaacgtggtgcgtctcctgatctcctcgagcatccttggaagcgattcctcctgttatttctcggttattgtagttagggtttaatttttggaagtgattttctgttccctcgagctagcttgatttgattggcgattttttgttttagttccttggttttttgggtttagatccatggagttttgggtttctccgtcacaaaatcatgccgttaaactgaaagggaaaacaccatggattacacatgcaccacactgtagacgccgtcgccgccgcggttgacgctgccgccgccgacaccttcaccgccgcccgtcgctgctagggttagggtctaaccctagcaaaatcatggatctaaacccaaaacgccattgcttgaatcttgtaagctctagtattgcaatgaactactgtaagcaggagtattgcaaatgggaatatttgtggctgcatattgctggatattttccatgtgtatcctggagtgaatggacaatttgggtagattgctgcatattgctgaatcaatgcattgatatagctagaatatttgggcagattgctgtaaatgaatgctatttttgactacatattgctgcacaattgatgactgcattttttgcaatgtgattttcaatccagtgcaatatccagctgcaatcttggagcatatttggctcctgaaatactacatatctcaagttattttgccagcttgagtatattttgccatctttcagcaaattttgctagcatgattcaagttattcacggagaaatttttctatctccatgccctgcttgacctggtattatcatgaggctttcacatgatgcatggatagctgcaatctgattttgtaggtgtcatcatatagttgttgctttctaataacattcatacttgagtcagattttcagagaaaaaactacaaaggatttaataggagcaaaaacatctttgtgcattaacttggtgtactgagttttttttgtcagaaatgtactattttgcgttcctccctatgcagttagtttttttcccctgaaacgattgtgcacagatttgctttgttctagacaaatttttgggagaacacaaataggggctggttttgaattttgttttagactcgattttttcagttgattctaggtgtcctcatcaactgattttgttcttgtatttgtaggattagatattcagtaaagtttcagtgtttcgctctgttttttatagtgcaatgggtgcactttttgtctaaactgtgtgctggtaaatataaacgaaccatccagaactgagaaaacctagcagccgcttgtgttgtgtttaattatatactgcagatttatacacctctgcatttctaagtttgtattcctgcagtcatcaactcataatcctcttatactgagttaagttcagtctggttgtagttagtcacgaagttttgatgattttttgttaaaatttt

SEQ ID NO: 17808 - DNA, 253 bp, Oryza sativa
gggcaacagccattgcaattcttcacccatttatgaaggaatgacagggagatcccctgtgtcaggcgagtgatgacgctgggcctcactcaaggacaagctgtgatttagcttccaggcgaaggcgcgagccaagttttggtcaagatagggtgggtccccacccaaaagaaaagtaggtagaagtggtgcatgtggtatccccttgagatataaaaggaggaccttgcccaccgaaggaggggaactctca

SEQ ID NO: 17809 - DNA, 208 bp, Oryza sativa
gcttctacccctaaagggggatcgggtgtcaggtttcgggctcggacgaactccgcacccccctcgggcgtgcagggttggccggtagctaccacatatgcatattcttatttctctgatatctgtatttcaataaaagtattttcgatttcctaaaggctgtatctgtgctgttgtttccttttgaaggatcttgacttgaaatagg

SEQ ID NO: 17810 - DNA, 918 bp, Oryza sativa
agtccaacatccacgcttctccagacttctcgtcagacactgtgagaatctcatgactgctgctatctgaatcatcaccacgagctgctaaacttgcaatgccacctttcctcttcttcagtaacgggcaattcctccttatatgtccaaactcatgacacttatagcaccgtgcccccttctccttgctcttcgacacccctgtttcatgatcatgcttcgctttgaccagcaaactctcaccctgagaagcctctgttgcctcgtttttctttgatcttctcaagtctcgtgcaagcaacgacgaaattatctcctcagttttgacagtatccttgccgtgcgtcagggtagtcaccacatgttcataagacggtggaagcgagcacagaagaattatggccttgtcttcatcatccaatttcacatctaacttacttagatccacaacaaactgattgaagacatccacatgcttcctaagatctgactcctcttgcatctgcaaaccatacagttgttgtttgagatacaacttactcgtcagcgacttggacatatacaggcttgccaacttgtcccaaatttccttcggtgatttttcatccatgacctggtacatgacggaatctgagagactcaagcgtattgttgcagctacctgcgccttcatctcatcccacttatcagcatccatcatttccggcatcgtctcatcaagaaccttggatatcccctgctgagccaacagatccttcagcctcatctgccagagaacgaaattcccggtgccatcgaacttcaccacctcaaatttggaaaccaccgtcgccgccatcgacgataatcaactcaacagcggttgccctgttaaattgatctgccctgattaattgacccaccgactacagtcactag
